United States Patent 8,664,475 (PLANTS WITH INCREASED YIELD) - sequence listing, part 2

SEQ ID NO: 1847 - protein, 1228 aa, Agrobacterium tumefaciens str. C58
MADGASNAGVTIQQVGNSIFQNFAPPVREQSLLRKAVTAAYRRAEEECMAPLIEAATVTADQAKAIRDTARKLIEALRAKTKGTGVEGLVQEYSLSSHEGVALMCLAEALLRIPDTATRDALIRDKIARGDWKSHIGGGRSLFVNAATWGLVITGKLTSTVNDSGLSAALTKLIARAGEPVIRRGVDMAMRMMGEQFVTGETIGEAIKRSKPLEEQGFQYSYDMLGEAATTAKDAERYYKDYENAIHAIGKASAGRGIYGGPGISIKLSALHPRYARAQAERVMAELLPRVKSLMLLSKTYDIGLNIDAEEADRLELSLDLLEELALDKDLAGWNGLGFVVQAYGRRCPFVLDYIIDLARRSGRRIMVRLVKGAYWDAEIKRAQVEGLEDFPVFTRKVHTDVSYIACARKLLDARDLVFPQFATHNAQSMATIYHLAGPDFKLGDYEFQCLHGMGEPLYSEVVGKKKLDRPCRFYAPVGTHETLLAYLVRRLLENGANSSFVNRIADPAVPVDSLLEDPVAVVKAYAVPGAQHDRIAAPADLFGPERKNSAGVDLSNETTLSALDKTLKAGAATEWKAAAPQAGGQTRPVLNPGDHSDIVGHVTEPTEADVEAAMQRAAASSWPSMPVEDRAACLERAADAMQAEMPTLLGLIMREAGKSMPNAIAEVREAIDFLRYYAAEARRNFKSDEKSLGPVVCISPWNFPLAIFIGQVAAALVAGNPVLAKPAEETPLIAAQGVRLLHEAGVPQDAVQLLPGDGKTGAALVGSPLTAGVMFTGSTEVARLIQGQLAGRVLANGQPVPLIAETGGQNAMIVDSSALAEQVVADVIASAFDSAGQRCSALRILCLQEDVADRTLTMLKGALHELRIGRTDQLSVDVGPVITAEAKGIIEKHIDGMRSLGHRIEQIALAGETGKGTFVPPTIIEMKSLADLKREVFGPVLHVIRFKRDHLDRLIDEINATGYGLTFGLHTRLDDTIQHVLSRVAAGNLYVNRNIIGAVVGVQPFGGRGLSGTGPKAGGPLYLGRMTEKAPKIDRIASQQDQAAVDLARWLDENGQTVAAEAARQAAALSGLGFETELAGPVGERNVYALHPRGKILLVPATEQGLYRQLAAALSTGNSVVIDNASGLEKAIYGLPASVTSRIVWADDWEKSAPFAGALVEGDAERVVAINRKIAALPGPLVLFQAATTDALSGESQPYTLDWLVEEVSVSVNTTAAGGNASLMSIG

SEQ ID NO: 1848 - DNA, 3702 bp, Sinorhizobium meliloti 1021
  CDS (1)..(3702): transl_table=11
atgagcccgaacccgcttcagaaacccgcgatcgacgccgcacctgcgcccttcgccgacttcgcaccgccagtccggccgcaaagcacgctgcgccgggcgatcacggccgcttaccgccgcccggaaacggaatgcctgccgcctctcgtcgaggcggccacgcaatcgaaggaaatacgggacgccgccgcaagcaccgcccgcaagctgatcgaggcgctgcgcggcaagcatagtggttccggcgtcgagggactggtgcaggaatattcgctttcgagccaggaaggcgtggcactcatgtgccttgcggaagcgctgctgcgcattcccgatacggcgacgcgcgacgcgctgatccgcgacaagattgccgacggcaactggaaatcgcatctcggcggcagccgttcgctcttcgtcaatgccgcgacctggggacttgtggtcaccggcaagctgacctcgacggtcaacgaccgcagcctcgcggcggcgctcacgcgtctcatctcgcgttgcggcgagccggtgatccggcgcggcgtcgacatggccatgcggatgatgggcgaacagttcgtcaccggcgagacgatccgcgaagcgctgaaacgttctaaggagctcgaggagaaaggcttcagctactcctacgacatgctcggcgaagcggcgaccacggccgccgacgccgaacgctattacagggactatgagagcgccattcacgcaatcggcaaagcctccgccggccgcggcatctatgagggcccgggcatctccatcaagctctcggcgctgcatccccgctatagccgcgcgcaagccgcgcgcgtcatgggcgaattgttgccgagggtgaaggcgctcgctctcctcgccaagaattacgatatcggcctcaacatcgacgccgaggaagccgaccggctggaactgtcgctcgatctcctcgaggtgctctgcctcgacggcgatctctccggctggaacggcatgggcttcgtcgtgcaggcctatggcaaacgctgccccttcgttctcgacttcatcatcgatcttgcccggcgctccggccggcgcatcatggtgcggctggtgaagggtgcctattgggatgccgagatcaagcgggcgcagctcgacgggctcgcggatttcccggtcttcacgcgcaagatccacaccgacgtctcctatatcgcctgcgcagccaagctgcttgccgcgaccgatgtggtgttcccgcaattcgcgacacacaatgcccagacgctcgccgccatctaccacatggccggcaaggactttcacgtgggcaaatacgaattccagtgcctgcacggcatgggcgagccgctttatgaagaggtcgtcggccgcggcaagctcgatcgcccctgccgcatctatgcgcctgtcggcacccatgagacgctgcttgcctatctggtccggcgcctcctcgaaaacggcgccaactcctccttcgtgcatcgcatcaacgacccgaaggtttcgatcgacgaactgatcgccgaccccgtcgaagtcgtccgcgccatgccggtcgtcggcgccaagcacgacaggatcgccttgccggccgaactcttcggcgatgcgcggaccaattccgccgggctcgatctttccaacgaggaaacgcttgcgtcgcttacggaagcgctgagggaaagcgcggcaatgaagtggaccgccctgccgcagctcgcaaccggccccgctgccggcgagacgcggacggttctgaaccccggcgaccatcgtgacgtcgtcggctcggtgaccgagacctcggaagaggacgcacggcgcgccgtgcgccttgccgccgacgcggcgccggattgggcggccgtgccgccctccgagcgggccgcctgcctcgaccgcgccgccgagctgatgcaggcccgcatgcccacgcttctcgggctgatcatccgcgaggcgggcaaatcggcgctgaacgccattgccgaggtgcgcgaggcgatcgatttcctgcgctactatgccgaacagacgcgccgcacgctcggccccggccacgggccgctcggcccgatcgtctgcatcagcccatggaatttcccgctggcaatcttcaccgggcagatcgccgccgcactcgtcgccggcaatcccgtgctcgccaaacccgcggaagagacgccgctgatcgccgccgagggcgtgcgcatcctgcgtgaggccggcattccggcaagcgcgctgcagcttcttccgggcgacggacgcgtcggtgcggcgctggtcgccgcggccgagaccgcgggcgtgatgttcaccggatcgacggaagtcgcgcggctgatccaggcacagcttgccgaccgcctttcgcccgccggccggccgatcccgctgatcgccgaaaccggtggccagaatgcgatgatcgtcgactcctcggcgcttgccgagcaggtggtcggcgacgtgatcacctccgccttcgacagtgccggccagcgctgctcggcactgcgtgtgctgtgcctgcaggaggatgtggccgaccgcatcctgacgatgctgaagggcgcgctgcacgaactgcatatcggccgcaccgatcgtctttccgtggatgtcggcccggtcatcacatcagaggcgaaggacaacatcgagaagcacatagagcggatgcgcgggctcggccgcaaggtcgagcagatcgggctcgcctcggagaccggagtgggcaccttcgtgccgccgacgatcatcgaactcgagaagctttccgatcttcaacgcgaggtcttcgggccggtgctgcacgtcatccgctaccggcgcgacgatctcgaccggctggtggacgacgtcaacgccaccggctacggcctgaccttcgggctccacacgcgcctcgacgagacgatcgcgcatgtgacgagccgtatcaaggcgggcaacctctacatcaaccgcaacatcatcggcgcggtcgtcggcgtccagcccttcggcggccgcggtctttccggtaccggtcccaaggccggcggtccgctttatctcggccgcctggttacgaccgcaccggtgccgccgcagcacagctcggtgcacacggacccggtccttctcgacttcgccaaatggctcgacggcaaaggcgcgcgcgcggaggccgaagcggcccgcaacgccggcagcagctcggcacttggcctggatctggaactccccggccccgtcggcgaacgcaatctctatacgctccatgcgcgcggccgcatcctcctcgtgccggcgacggagagcggtctataccaccagctcgccgctgcgctcgcgaccggcaacagcgtcgcgatcgatgccgcctccggtctgcaggcttcgctgaagaacctgccgcagaccgtcggcctgcgtgtctcctggtccaaggactgggccgccgacggcccgttcgccggtgcgctggtcgaaggtgacgccgagcgcatccgcgcggtcaacaaggctatcgccgccctgcccggcccgctgctgctcgtgcaggccgcatcgagcggggagatcgcccgcaacccggacgcctattgcctgaactggctcgtggaagaggtttccgcctcgatcaacacggctgcagccggcggcaatgccagcctgatggcgatcggctga

SEQ ID NO: 1849 - protein, 1233 aa, Sinorhizobium meliloti 1021
MSPNPLQKPAIDAAPAPFADFAPPVRPQSTLRRAITAAYRRPETECLPPLVEAATQSKEIRDAAASTARKLIEALRGKHSGSGVEGLVQEYSLSSQEGVALMCLAEALLRIPDTATRDALIRDKIADGNWKSHLGGSRSLFVNAATWGLVVTGKLTSTVNDRSLAAALTRLISRCGEPVIRRGVDMAMRMMGEQFVTGETIREALKRSKELEEKGFSYSYDMLGEAATTAADAERYYRDYESAIHAIGKASAGRGIYEGPGISIKLSALHPRYSRAQAARVMGELLPRVKALALLAKNYDIGLNIDAEEADRLELSLDLLEVLCLDGDLSGWNGMGFVVQAYGKRCPFVLDFIIDLARRSGRRIMVRLVKGAYWDAEIKRAQLDGLADFPVFTRKIHTDVSYIACAAKLLAATDVVFPQFATHNAQTLAAIYHMAGKDFHVGKYEFQCLHGMGEPLYEEVVGRGKLDRPCRIYAPVGTHETLLAYLVRRLLENGANSSFVHRINDPKVSIDELIADPVEVVRAMPVVGAKHDRIALPAELFGDARTNSAGLDLSNEETLASLTEALRESAAMKWTALPQLATGPAAGETRTVLNPGDHRDVVGSVTETSEEDARRAVRLAADAAPDWAAVPPSERAACLDRAAELMQARMPTLLGLIIREAGKSALNAIAEVREAIDFLRYYAEQTRRTLGPGHGPLGPIVCISPWNFPLAIFTGQIAAALVAGNPVLAKPAEETPLIAAEGVRILREAGIPASALQLLPGDGRVGAALVAAAETAGVMFTGSTEVARLIQAQLADRLSPAGRPIPLIAETGGQNAMIVDSSALAEQVVGDVITSAFDSAGQRCSALRVLCLQEDVADRILTMLKGALHELHIGRTDRLSVDVGPVITSEAKDNIEKHIERMRGLGRKVEQIGLASETGVGTFVPPTIIELEKLSDLQREVFGPVLHVIRYRRDDLDRLVDDVNATGYGLTFGLHTRLDETIAHVTSRIKAGNLYINRNIIGAVVGVQPFGGRGLSGTGPKAGGPLYLGRLVTTAPVPPQHSSVHTDPVLLDFAKWLDGKGARAEAEAARNAGSSSALGLDLELPGPVGERNLYTLHARGRILLVPATESGLYHQLAAALATGNSVAIDAASGLQASLKNLPQTVGLRVSWSKDWAADGPFAGALVEGDAERIRAVNKAIAALPGPLLLVQAASSGEIARNPDAYCLNWLVEEVSASINTAAAGGNASLMAIG

SEQ ID NO: 1850 - DNA, 3978 bp, Ralstonia solanacearum GMI1000
  CDS (1)..(3978): transl_table=11
atggctacgaccaccctcggggtcaagctggacgatgcttcgcgcgaacgcctcaagcgcgcagcccagtccattgaccgcacaccgcactggctgatcaagcaggcgatcttcacctatctggaccaagtggagcgggggcagctgccgaatgatgcgggcggtccggcggcggatggcctcccgtccgccgccgcagccgtcgcggacatggccgatgccgatggcaccgaggccgtggtgcaacccttcctcgaattcgcgcagagcgtgcagccgcagtcggtgctgcgcgccgccatcacggccgcctaccgccggccggaaaccgaggcgattccgatgctgctggagcaggcccgcctgccgggcgcgctggcctccgaggccaagcagctcgcccgcgaccttgccggcaagctccgtacgcaaaaggtcggcaccggccgcgaaggtctggtgcaaggtctgattcaagagttctccctgtcgagccaggagggcgtggcgctgatgtgcctggccgaggcactgctgcgcattcccgacaaggccacgcgcgatgcgctgatccgcgacaagatcagcagcggcaactggcagtcgcatctgggccagagcccgtcgttgttcgtcaacgccgccacctggggcctgctgctgacgggcaagctggtggccacgcacaacgaggccggactgtcgaaggcgctcacgcgcatcatcggcaagcgcggcgagccgctgatccgcaagggcgtcgacatggcgatgcgcctgatgggcgagcagttcgtcaccggcgagaccatttccgaagcgctggccaacgcccgcaagtacgaggccgaaggcttccgctactcctacgacatgctcggcgaagccgccatgacggaagaggatgcccagcgctacctcgcgtcgtacgagcaggccatccgcgcgatcggccaggcttcgggcgggcgcggcatctatgaggggccgggcatctcgatcaagctgtcggcgctgcacccgcgctacagccgcgcccagtacgaccgcgccatcaatgagctgtatccgcgcgtgaagggcctggccatgctggcccgcgagtacgacatcggcatcaacatcgatgcggaagaagccgaccgcctggagctgtcgctcgatctgctcgagcgcttgtgcttcgcgcccgagctggccggctggaacggcatcggcttcgtggtgcagggctaccagaagcgctgcccgttcgtgctcgactacctcatcgacctggcgcgccgcagcaagcaccgcctgatgattcgcctggtcaagggcgcctactgggacagcgagatcaagcgcgcccaggtcgacggcctggagggctatccggtctatacgcgcaaggtctacaccgacgtgtcgtacctggcctgcgcgcgcaagctgctggccgcgcccgatgtcgtgtttccgcagttcgccacgcacaacgcccatacgctggcggccatctatcacatggccgggcagaactattaccccggccagtacgaattccagtgcctgcacggcatgggcgagccgctgtacgagcaggtggtcggcaacaagccgggcaagctcaaccggccgtgccgcatctacgcgccggtcggcacgcacgagacgctgctggcctacctggtgcgccgcctgctggagaacggcgccaacacctcgttcgtcaaccgcatcgcggacgagtcgattccgctggacgaactcgtcgccgatccggtggcggtggtggagaacatgcacgccgaggaaggcgcgctcggcctgccgcatccgaaaattccgttgccgcgccatctctatggtgatgtgcgtgccaattcggcagggatcgacctggcgaacgagcatcggctggcgtcgttgtcgtctgcgctgctggccggtaccagctcggtctgggccgctgaaccgaccatcggcgatgcgccatacaccggtggcacgccgcaaccggtgcgcaacccgtcggacctgcgtgacgtggtcggccacgtgaccgaagccactgaagccgacgtcgatgccgcgctgtcggccgccgccgccgccgccccgatctggcaagccacgctgcccgaagcgcgtgccgcgctgctcgatcgcgccgccgacctgatggaaggcgagatgcagcacctgatgggcctgatcatccgcgaggcgggcaagacgctgtccaacgcgatcgccgaagtgcgcgaggcggtggacttcctgcgctactacgcggcgcaggtgcgtggcgggttctccaacgacacgcaccgcccgctgggcccggtggtctgcatcagcccgtggaacttcccgctggcgatcttcaccggccaggtgagcgcggcgctggccgccggcaacccggtgctggccaagcccgccgagcagaccccgctgatcgccgcacaggccgtgcgcatcctgcgcgaagccggcgtgccggccggcgcggtgcagctgctgccgggccgcggcgagaccgtcggggccgcactggtgaaggatgcgcgcaccaagggcgtgatgttcaccggctcgaccgaggtggcgcgcatcctgcagcgcacgctggccggccgcctggatgccaacggtgcaccgatcccgctgatcgccgagaccggcggccagaacgcgatgatcgtcgattcgtcggcgctggccgagcaggtggtggccgatgtgctgtcgtccgccttcgattccgccgggcagcgctgctcggccctgcgcgtgctgtgcctgcaggacgacgtggccgaccgcgtgctggcgatgctcaagggcggcatggccgagctggcgatgggcaatcccgatcgcctgtccaccgacgtcggcccggtgatcgacgccgaggcgcgcgacaacatcgtcggccatatcgaagggatgcgcgccaagggccggcgcgtgcaccaggcgcccgcgccggctgcctgcgcccacggcaccttcgtgccgccgacggtgatcgaactcgacagcctgtcggacctgacgcgcgagatcttcgggccggtgctgcacgtggtccgctggaagcgcacagccgacaacgccggcctcacccggctcatcgagcagatcaacggcacgggctacggcctgacgctgggcatccacacccgcatcgacgagaccattgcgcacatcgtcgagcgggcgcgggtgggcaacctgtacgtgaaccgcaatatcgtcggcgcggtggtcggcgtgcagccgttcggcggcgagggcctgtcgggcaccggcccgaaggcgggcggctcgctgtatctgctgcgcctgctgtcgacctgcccgcaggacgcgatgcgcacggcgctggagttgaccgcgggcgccggcaccgacgtcgagaccgaggagcgccgcgcgctgctggcgccgttcgacgcgctgcgtgactgggcgcgccggcagtcgcccgggctggccgcgctgtgcgaccgcctggcggcggccacggccaccggcgcggttctgacgctgccgggcccgaccggcgagcgcaacacctatatgctgctgccgcgcgacgcggtgctgtgcgtggcggccgatccggccgactggctgcgtcagctggcggccgtgctggcggtgggcagcgaggcggtcgtgcaggaaaaccctgccatcgccgaggtgctgcgtacgctgccgtcggcagtacaatcgcgcgtccggacggtggcgtcgctggaagacgcggcgttcgacgcggtgctgcaccacggcgattcggatcacctgcgcgccctgtgcgaagggctggcgcgccgtgccggtccgatcgtcggcgtgcagggcttgccgcacggcggacaggggctggcgctggagcgcctgctgatcgagcgttcgctgtcggtcaacacggccgcggcgggtggcaacgccagcctgatgaccatcggctga

SEQ ID NO: 1851 - protein, 1325 aa, Ralstonia solanacearum GMI1000
MATTTLGVKLDDASRERLKRAAQSIDRTPHWLIKQAIFTYLDQVERGQLPNDAGGPAADGLPSAAAAVADMADADGTEAVVQPFLEFAQSVQPQSVLRAAITAAYRRPETEAIPMLLEQARLPGALASEAKQLARDLAGKLRTQKVGTGREGLVQGLIQEFSLSSQEGVALMCLAEALLRIPDKATRDALIRDKISSGNWQSHLGQSPSLFVNAATWGLLLTGKLVATHNEAGLSKALTRIIGKRGEPLIRKGVDMAMRLMGEQFVTGETISEALANARKYEAEGFRYSYDMLGEAAMTEEDAQRYLASYEQAIRAIGQASGGRGIYEGPGISIKLSALHPRYSRAQYDRAINELYPRVKGLAMLAREYDIGINIDAEEADRLELSLDLLERLCFAPELAGWNGIGFVVQGYQKRCPFVLDYLIDLARRSKHRLMIRLVKGAYWDSEIKRAQVDGLEGYPVYTRKVYTDVSYLACARKLLAAPDVVFPQFATHNAHTLAAIYHMAGQNYYPGQYEFQCLHGMGEPLYEQVVGNKPGKLNRPCRIYAPVGTHETLLAYLVRRLLENGANTSFVNRIADESIPLDELVADPVAVVENMHAEEGALGLPHPKIPLPRHLYGDVRANSAGIDLANEHRLASLSSALLAGTSSVWAAEPTIGDAPYTGGTPQPVRNPSDLRDVVGHVTEATEADVDAALSAAAAAAPIWQATLPEARAALLDRAADLMEGEMQHLMGLIIREAGKTLSNAIAEVREAVDFLRYYAAQVRGGFSNDTHRPLGPVVCISPWNFPLAIFTGQVSAALAAGNPVLAKPAEQTPLIAAQAVRILREAGVPAGAVQLLPGRGETVGAALVKDARTKGVMFTGSTEVARILQRTLAGRLDANGAPIPLIAETGGQNAMIVDSSALAEQVVADVLSSAFDSAGQRCSALRVLCLQDDVADRVLAMLKGGMAELAMGNPDRLSTDVGPVIDAEARDNIVGHIEGMRAKGRRVHQAPAPAACAHGTFVPPTVIELDSLSDLTREIFGPVLHVVRWKRTADNAGLTRLIEQINGTGYGLTLGIHTRIDETIAHIVERARVGNLYVNRNIVGAVVGVQPFGGEGLSGTGPKAGGSLYLLRLLSTCPQDAMRTALELTAGAGTDVETEERRALLAPFDALRDWARRQSPGLAALCDRLAAATATGAVLTLPGPTGERNTYMLLPRDAVLCVAADPADWLRQLAAVLAVGSEAVVQENPAIAEVLRTLPSAVQSRVRTVASLEDAAFDAVLHHGDSDHLRALCEGLARRAGPIVGVQGLPHGGQGLALERLLIERSLSVNTAAAGGNASLMTIG

SEQ ID NO: 1852 - DNA, 3657 bp, Brucella melitensis 16M
  CDS (1)..(3657): transl_table=11
gtggccgttttccagaattttgcgccgccgatccgcgagcaaagcgcactgaggcaagcgatcactgccgcttatcgccgccccgaagccgaatgcgtttcagcgctggccgagcaggcaaccttgccggaggagacgcgccagcaaatccgttccaccgcccgcaagctgatcgaagcgctgcgtgccaagcataagggcaccggcatcgaaggtctggtgcatgaatattcgctgtcgagccaggaaggcgtggcgctgatgtgccttgccgaagccttgctgcgcattcccgatatggcgacgcgcgatgcgctgatccgcgacaagatatcgaatggcgactggaaatcccacattggcggcgggcgctcgcttttcgtcaatgctgcgacatggggcctggtcgttaccggcaagctcaccaataccgtcaatgatcgtggcctttccgccgctcttacccgcctcatcgcccgctgcggcgagccggtcatccgtcgcggcgtggacatggccatgcgcatgatgggcgagcagttcgtcaccggcgaaaccatcgatgaggcgttgaaacgcgccaaggagctggaagagcgcggcttccgctattcctacgacatgctgggcgaggccgcgaccaccgccgccgatgcagagcgttattataaggattatgaaaccgcgatccacgccatcggtcgtgcttccgcagggcgcggcatttatgatggtcccggcatttccatcaagctttcggcgcttcacccgcgttatacccgcgcgcaaagtgagcgcgtcatgggtgaacttctgccgaaggtgaaggcactcgcggccatcgccaagtcctataatatcggcctcaatatcgacgcggaggaggccgaccgtcttgaactgtcgctcgacctgttgcaaagcctttgcgaagaccctgatctggcaggctgggatggcatcggcttcgtggtgcaggcctatggcaagcgctgccccctcgtgcttgatttcatcatcgatctggctcgccgcaccaagcgccgcgtcatggtgcgtctggtgaagggcgcctattgggatgcggagatcaagcgtgcgcaggtggatgggctggaggattttccggtctatacccgcaaggtgcatacggacgtttcctatattgcctgcgcgcgcaagcttctggccgcgacggatgtgatctttccgcaatttgcgacccataacgcgcagacactcgccacgatctatcatctggccgggccggatttcaaaaccggtaagtttgagttccaatgcctgcacggcatgggtgagccgctttatgatgaagtcgtcggccccgaaaagctcggtcgcccggcccgcatttatgcaccggtcggcacgcatgaaacgctgctcgcctatctcgtccgccgccttcttgaaaacggcgcgaactcctccttcgtcaaccgtattggcgacaaaaacgtctcggtcgatgagctgatcgccgatccggtggaagtcgtccggtcgatggctgtcgtcggtgcgcgtcatgaccagattgcgctgccggaaaatctctatggcgcgcgccgcaattccgcaggctttgatctttccaatgaggtgacgcttgcggaactgagcaaaaccttgaaggaaacggcaggccgtgcatggaccgccgaaccgcaggtggcgggtgcaaaggtgaagggcgtaagccgtccggttctcaatcccggcgaccggaatgatgttgtcggcaccgtaacggaaatcgcagaggccgatgtggcaaaggcgatgaaggcagcgcaaaccgcgaccacaagctggtccgcggttgcgcccgcagaacgcgccgcctgtctggagcgcgcagccgatatcatgcagcgcgacatgccggctctgctcggcctcgtcatgcgcgaggcgggcaagtccatgccgaacgccattgccgaagtgcgtgaagccatcgatttcctgcgctattatgccgaacagacccgccgcacgcttggcgtcggccacaaggcgcttggccctgtcgtctgcatcagcccgtggaacttcccgctggcaatcttcaccggccagattgcggctgcacttgttgcaggcaatccggttctggcaaagcctgccgaggaaaccccgctgatcgccgctgagggcgtgcgcattctgcatgaggggggcattccggcggatgcgctccagcttctgccgggtgatggccgcattggcgccgcgctggttgcagcaccggaaacttgcggcgtaatgttcaccggctccaccgaggtggcgcggctcatccaggcgcagcttgcctcgcgcctgctgccgaacggaaagccggtcccgctcattgccgaaacgggcggtcagaacgccatgatcgtggattcctcggcacttgccgagcaggtggtgtttgatgtcatcgcttcggctttcgatagcgccggccagcgctgttcggcgctgcgtgtcctctgcttgcaggaagatgtggccgaccgcattctcaccatgctcaagggcgccttgcgtgagctttccattggccgcacggaccagctcaaggtcgatatcggcccggttatcaccgatgaggcgaagaacaccattgaaaagcatattcaggccatgcgcgatcttggccgcaaggtggaacagcttccccttggcccggaaacgcagaacggcacttttgttgcgccgacaatcatcgagattgaatcgctgcgcgatctcaagcgcgaagtgttcggcccggtcctgcatgtggttcgttacaagcgcgacgacatggaaagcctgatcgatgatatcaattcgaccggctatgggcttacttttggtttgcatacgcgccttgacgagacgattgccaatgttgcggatcgcatccgtgtcggcaatatctatatcaatcgcaacattatcggcgcagtggtgggcgtgcagcctttcggcgggcgtggcctttccggcaccggcccgaaggcgggcggtccgctctatcttggccgtctggtcgaaaccgcgccgatcccgccgcgtcacgcttcggttcataccgatgcggcgctgaaggactttgcccggtggctcggcaatcgcggcatgaacgatctggcgcaggcggcgcgcgataccggcagtgcttcggcgctcggtctcgaactcgaactgccgggcccggttggcgagcgcaatctctatgctctccacccgcgcgggcgcgtgcttctggtcccccagaccgaaattggcctctatcgccaattgacggcggtgctggcaaccggcaacactgcggtcatcgacgaggcttgcggtttgcgcgccgtgttgaaggatctgccggaaacagttgccgcgcgcgccatctggacgggcgactggcaggcggatgcgccttttgccggagcacttatcgaaggcgacagcgcgcgcatcaaggaggtgaactccaggatcgccgccctgccgggaccgctcgtactcacacaggcggcatcgccggaagatcttgcagccaatcaggatgcttattgcctcaactggctgcttgaggaagtctcgacctccatcaacaccacggcagcaggcggcaacgccagcctgatggcgatcggctga

SEQ ID NO: 1853 - protein, 1218 aa, Brucella melitensis 16M
MAVFQNFAPPIREQSALRQAITAAYRRPEAECVSALAEQATLPEETRQQIRSTARKLIEALRAKHKGTGIEGLVHEYSLSSQEGVALMCLAEALLRIPDMATRDALIRDKISNGDWKSHIGGGRSLFVNAATWGLVVTGKLTNTVNDRGLSAALTRLIARCGEPVIRRGVDMAMRMMGEQFVTGETIDEALKRAKELEERGFRYSYDMLGEAATTAADAERYYKDYETAIHAIGRASAGRGIYDGPGISIKLSALHPRYTRAQSERVMGELLPKVKALAAIAKSYNIGLNIDAEEADRLELSLDLLQSLCEDPDLAGWDGIGFVVQAYGKRCPLVLDFIIDLARRTKRRVMVRLVKGAYWDAEIKRAQVDGLEDFPVYTRKVHTDVSYIACARKLLAATDVIFPQFATHNAQTLATIYHLAGPDFKTGKFEFQCLHGMGEPLYDEVVGPEKLGRPARIYAPVGTHETLLAYLVRRLLENGANSSFVNRIGDKNVSVDELIADPVEVVRSMAVVGARHDQIALPENLYGARRNSAGFDLSNEVTLAELSKTLKETAGRAWTAEPQVAGAKVKGVSRPVLNPGDRNDVVGTVTEIAEADVAKAMKAAQTATTSWSAVAPAERAACLERAADIMQRDMPALLGLVMREAGKSMPNAIAEVREAIDFLRYYAEQTRRTLGVGHKALGPVVCISPWNFPLAIFTGQIAAALVAGNPVLAKPAEETPLIAAEGVRILHEGGIPADALQLLPGDGRIGAALVAAPETCGVMFTGSTEVARLIQAQLASRLLPNGKPVPLIAETGGQNAMIVDSSALAEQVVFDVIASAFDSAGQRCSALRVLCLQEDVADRILTMLKGALRELSIGRTDQLKVDIGPVITDEAKNTIEKHIQAMRDLGRKVEQLPLGPETQNGTFVAPTIIEIESLRDLKREVFGPVLHVVRYKRDDMESLIDDINSTGYGLTFGLHTRLDETIANVADRIRVGNIYINRNIIGAVVGVQPFGGRGLSGTGPKAGGPLYLGRLVETAPIPPRHASVHTDAALKDFARWLGNRGMNDLAQAARDTGSASALGLELELPGPVGERNLYALHPRGRVLLVPQTEIGLYRQLTAVLATGNTAVIDEACGLRAVLKDLPETVAARAIWTGDWQADAPFAGALIEGDSARIKEVNSRIAALPGPLVLTQAASPEDLAANQDAYCLNWLLEEVSTSINTTAAGGNASLMAIG

SEQ ID NO: 1854 - DNA, 3954 bp, Pseudomonas putida KT2440
  CDS (1)..(3954): transl_table=11
atggcgactaccacccttggggtcaaactcgacgacccgacccgtgagcgactcaaagcagctgcgcagtccatcgaccgcacgcctcactggttgatcaagcaagcgatcttcaattacctggagaagctcgagggtggtgccaccctgaccgaactcaacggtcatgccagcaacccggccgacgatgccggtgaagtccaggccgaccacagccaccagtgcttcctcgaatttgccgagagcatcttgccgcagtcggtactgcgctcggcgatcaccgccgcctaccgccgccccgagcaggaagtggtgccgatgctgctggagcaggcgcgcctgagcgcgccgctggccgacgccaccaacaagctggccgcaagcattgccgaaaaactgcgcaaccagaaaagcgtcggcggccgtgccggtatcgtccagggcctgctgcaggaattctcgctgtcgtctcaggaaggcgtggcgctgatgtgcctggccgaagccctgctgcgtatccccgacaaaggtacccgtgatgcgctgatccgcgacaagatcagtaccggcaactggcagccgcacctgggcaacagcccgtcactgttcgtcaacgccgccacctgggggctgctgctgaccggcaagctggtcagcacccataacgaaaccggcctcacctcctcgctcacccgcatcatcggcaagagcggcgagccgatgatccgcaagggcgtcgacatggccatgcgcctgatgggtgagcagttcgtcaccggcgagaccattgccgaagccctggccaacgccagccgtttcgaggccaaaggcttccgttactcctacgacatgcttggcgaagccgcactgaccgagcacgacgcgcagaagtacctggcgtcctacgagcaggccatccactcgatcggcaaggcctcgcatggccgtggcatctatgaaggcccaggcatctcgatcaagctgtcggcactgcacccgcgctacagccgggcccagtacgagcgcgtgatggaagagctgtacccgcgcctgctgtcgctgaccctgctggccaagcagtacgacatcggccttaacatcgacgccgaagaagccgaccgcctggagctttcgctggacctgctcgaacgcctgtgcttcgagccatccctggctggctggaacggcatcggcttcgttatccaggcctaccagaagcgctgcccgtacgtgatcgactacgtcatcgatctggccaagcgcagccgccaccgcctgatgatccgcctggtaaaaggcgcctactgggacagcgagatcaagcgtgcccaggtcgaaggcctggaaggctacccggtctatacccgcaaggtgtacaccgacgtgtcctacgtcgcctgcgcccgcaagctgctggccgtgccagaagccatctacccgcagttcgccacccacaacgcccacaccctgtcggccatctaccacattgccgggcagaactattacccgggccagtacgagttccagtgcctgcacggcatgggcgaaccgctgtacgagcaagtggtcggcaagattgccgatggcaagctgaaccgcccgtgccgcgtgtatgcaccggtcggcacccatgaaacgctgctggcctacctggtgcgccgcctgctggaaaacggcgcgaacacctcgttcgtcaaccgcattgccgaccactcgatttccatccaggaactggtcgccgacccggtggccagcatcgagcgcatgggtacccaggaaggcagtatcggcctgccgcacccacgcattcccctgccgcgcgacctgtatggcaccgaacgggccaactcggccggcatcgacatggccaatgaacaccgcctggcgtcgctgtcctgcgccatgctggccaccgctcacaacgactggaaggctgccccgctgctggcctgcgccgccagcgagagcgctgccgcaccggtgctgaacccggctgaccaccgcgacgtcgtcggccatgtgcaggaggccaccgttgccgacgttgacaacgccatccagtgcgcactgaacgccgcgccgatctggcaggccaccccaccagccgagcgtgctgccattctggagcgcaccgccgacctgatggaggccgagatccagccgctgatgggcctgctcatccgcgaggccggcaagaccttcgccaacgccattgccgaagtgcgtgaagccgtggacttcctgcgctactacgcggtgcaggcacgtaacgacttcagcaacgacgcccaccgcccactgggtcctgtggtgtgcatcagcccatggaacttcccgctggcgatcttcaccggccaggtggccgcagccctggctgccggcaacccggtactggccaagcctgccgagcaaaccccactgatcgccgcccaggccgtgcgcctgctgctggaagctggcatcccagaaggcgtgctgcagctgctgccgggccgcggtgaaactgtcggtgccggcctggtcggagacgagcgcgtcaaaggcgtgatgttcaccggctccactgaagtggcccgcctgctgcagcgcaacgtcgctggccgtctggacaaccagggccgcccgatcccgctgatcgccgaaaccggcggccagaacgcgatgatcgtcgactcctcggcactgaccgaacaggtcgtgatcgacgtggtgtcctcggccttcgacagtgccggccagcgttgctcggccctgcgcgtactgtgcttgcaggaagactccgccgaccgcgtaatcgagatgctcaagggcgccatggctgaaagccgcctgggctgcccggaccgcctggccgtggacatcggcccggtgatcgatgccgaagccaaagccggcatcgagaagcacatccagggcatgcgcgagaaaggccgcccggtctaccaagtcgccattgccgatgctgccgagatcaagcgcggcaccttcgtcatgccaaccctgatcgagctggacagcttcgacgagctgaagcgcgaaatcttcggccccgtgctgcacgtggtgcgctacaaccgccgcaatctggaccagctgatcgagcagatcaacaactccggctacggcctgaccctcggcgtgcacacccgtatcgacgagaccatcgccaaagtggtggaaaccgccaacgccggcaacatgtacgtcaaccgcaacattgtgggtgcagtggtgggcgtgcagccgttcggtggtgaaggcctgtctggcaccggcccgaaagccggcggcccgctgtacctctaccgcctgctgtcgacccgcccggccgacgccattggccgccacttccagcagcaggacggcgaaggcacgccggaccgcaccctgcacgaacagctggtaaagccgctgcacggcctgaaggcctgggccgagaacaaccagctggccgacctggccgcgctgtgcagccagttcgccagccagtcgcagagcggcatcgcccgcctgctgccaggcccgaccggcgagcgcaacagctacaccattctgccgcgtgagcacgtgctgtgcctggccgacaacgaaaccgacctgctggcgcagttcgccgcggtactggccgttggcagctcggcggtgtgggttgacggtgaaccgggcaaggccctgcgcgcccgcctgccgcgtgagctgcaggccaaggtgaagctggtcgcggactggaacaaggatgaagtggcgttcgacgccgtgatccaccatggcgactcggaccagctgcgcggcgtatgccagcaggtggccaagcgtgccggggcgatcgttggggtgcacgggctgtccagcggggatcaccagattgcgctggagcgcctggtcatcgagcgcgcggtgagcgtgaacactgcagcggcgggtggtaacgccagcctgatgaccattggctaa

SEQ ID NO: 1855 - protein, 1317 aa, Pseudomonas putida KT2440
MATTTLGVKLDDPTRERLKAAAQSIDRTPHWLIKQAIFNYLEKLEGGATLTELNGHASNPADDAGEVQADHSHQCFLEFAESILPQSVLRSAITAAYRRPEQEVVPMLLEQARLSAPLADATNKLAASIAEKLRNQKSVGGRAGIVQGLLQEFSLSSQEGVALMCLAEALLRIPDKGTRDALIRDKISTGNWQPHLGNSPSLFVNAATWGLLLTGKLVSTHNETGLTSSLTRIIGKSGEPMIRKGVDMAMRLMGEQFVTGETIAEALANASRFEAKGFRYSYDMLGEAALTEHDAQKYLASYEQAIHSIGKASHGRGIYEGPGISIKLSALHPRYSRAQYERVMEELYPRLLSLTLLAKQYDIGLNIDAEEADRLELSLDLLERLCFEPSLAGWNGIGFVIQAYQKRCPYVIDYVIDLAKRSRHRLMIRLVKGAYWDSEIKRAQVEGLEGYPVYTRKVYTDVSYVACARKLLAVPEAIYPQFATHNAHTLSAIYHIAGQNYYPGQYEFQCLHGMGEPLYEQVVGKIADGKLNRPCRVYAPVGTHETLLAYLVRRLLENGANTSFVNRIADHSISIQELVADPVASIERMGTQEGSIGLPHPRIPLPRDLYGTERANSAGIDMANEHRLASLSCAMLATAHNDWKAAPLLACAASESAAAPVLNPADHRDVVGHVQEATVADVDNAIQCALNAAPIWQATPPAERAAILERTADLMEAEIQPLMGLLIREAGKTFANAIAEVREAVDFLRYYAVQARNDFSNDAHRPLGPVVCISPWNFPLAIFTGQVAAALAAGNPVLAKPAEQTPLIAAQAVRLLLEAGIPEGVLQLLPGRGETVGAGLVGDERVKGVMFTGSTEVARLLQRNVAGRLDNQGRPIPLIAETGGQNAMIVDSSALTEQVVIDVVSSAFDSAGQRCSALRVLCLQEDSADRVIEMLKGAMAESRLGCPDRLAVDIGPVIDAEAKAGIEKHIQGMREKGRPVYQVAIADAAEIKRGTFVMPTLIELDSFDELKREIFGPVLHVVRYNRRNLDQLIEQINNSGYGLTLGVHTRIDETIAKVVETANAGNMYVNRNIVGAVVGVQPFGGEGLSGTGPKAGGPLYLYRLLSTRPADAIGRHFQQQDGEGTPDRTLHEQLVKPLHGLKAWAENNQLADLAALCSQFASQSQSGIARLLPGPTGERNSYTILPREHVLCLADNETDLLAQFAAVLAVGSSAVWVDGEPGKALRARLPRELQAKVKLVADWNKDEVAFDAVIHHGDSDQLRGVCQQVAKRAGAIVGVHGLSSGDHQIALERLVIERAVSVNTAAAGGNASLMTIG

SEQ ID NO: 1856 - DNA, 3954 bp, Pseudomonas syringae pv. tomato str. DC3000
  CDS (1)..(3954): transl_table=11
atggccaccaccactttgggcgtcaagctcgacgaccctacccgcgagcgattgaaagccgccgcccattcgatcgaccgcacgccgcactggttgatcaagcaggcgattttcaattacctggaaaagctggaaagtggtgcaaccttgcttgagctgaacggcgcgacaggcaaagacagcgaagaccgtggtgagctggcagaagatgcaggcctgcaatgctttctggattttgccgaaagcattcagccgcagtcagtgctgcgtgcggcgatcacttccgcctaccgtcgcccggagcaggaagtggtgcctatgctgctggaacaggcacgcctgacagcgcctgtcgccgaagcgaccaacaagctcgccgcgtcgattgccgaaaaactgcgcaatcaaaaaagcgcgggcgggcgcgcaggcatcgttcaaggcctgctgcaggagttttcgctgtcctcccaggaaggcgttgccctgatgtgtctggctgaagcactgctgcgtattcccgacaaaggcactcgcgatgccttgattcgcgacaagatcagcaacggcaactggcagccgcacctgggcaacagcccgtcgctgttcgtcaacgcagccacctggggcctgctgctgaccggcaagctggtcgccacgcacaacgaagcaggcctgacctcctcgctgagccggatcatcggcaagcgcggcgaaccgatgatccgcaagggcgtcgacatggccatgcgcctgatgggtgagcagttcgtcaccggcgaaaccattggcgaggctctggccaatgccagtcgtttcgaagccaagggcttccgctactcctacgacatgctgggtgaagcagcgttgaccgaacacgacgcgcagaaatatctggcgtcctacgagcaggccattcattccatcggcaaagcctcccacggtcgcggcatctacgaaggcccgggtatttccatcaagctgtcggcgctgcatccgcgctacagccgcgctcagtacgagcgcgtcatggacgagctctacccgcgcctgctgtcgctgaccctgctggccaaacagtacgacatcggcctgaacatcgacgccgaagaagccgaccgcctggagctgtcgcttgatctgcttgagcgcctgtgcttcgagccgcaactgaccggctggaacggtatcggtttcgtgattcaggcttaccagaagcgctgcccttatgtgatcgactacgtgatcgatctggctcggcgcagtcgtcatcgcctgatgatccgcctggtaaaaggcgcgtactgggacagcgaaatcaagcgtgcgcaggttgaaggtctggaaggctatccggtctacacccgcaaggtgtacaccgacgtttcctatatcgcctgcgcccgcaaactgctggccgcaccggaagtcatctatccgcagttcgccacccacaacgcccacaccctggcggccatctaccagattgccggtcagaattattaccccggccagtacgagttccagtgcctgcacggcatgggcgagccactctacgagcaggttgttggcaaagtcgccgacggcaagctgaaccgtccgtgccgcgtgtacgcgccggttggcactcacgaaacgctgctggcctatctggtccggcgcctgctggagaacggcgccaacacctcgttcgtcaaccggattgccgaccattcgatctcgattcaggaactcgtcgccgatccggtcaaccagatcgaacgcatggcaacgcaggaaggcgggttcggcttgccacacccgcgtattccgctgccgcgcgacctgtatggcaccgagcgcgccaactccagcggcatcgatatggccaacgaacatcgtctggcgtcgctgtcctcagccctgctgtcgaccgcgcacaacgactggaaagctgcgccaatgctcggctgcccggccagtgaaggcacacttgctgcggcgttgaacccgtcggatctgcgtgacgtggtcggccatgtgcaggaagcctccttgcaggatgtcgataatgccatccagtgcgccttgagcgccggcccgatctggcaggccacgccgcccgccgaacgcgccgcgattctggagcgcgccgccgacctgatggaaggcgagattcagccgctgatgggcctgctggtccgtgaagcaggcaagacgttcgcgaacgccatcgccgaagtgcgtgaagcggtggacttcctgcgctactacgcagtgcaggcgcgcaacgacttcaccaatgatgcgcaccgtcctttgggcccggtggtctgcatcagcccatggaacttcccgctggcaatcttcagtggtcaggtggcggctgcattggctgcaggtaacccggtactggccaaacccgccgagcagacgccgctgattgcagctcaggcggtacgcctgctgcttgaagccgggatcccggaaggcgtggtgcaattgctgcccggtcgcggtgaaaccgtcggggccgggctggtgggcgatgagcgcgtcaagggcgtgatgttcaccggctccaccgaagtcgcccgcctgctgcaacgcaatgtcgccgatcgcctcgactctcagggtcgccctatcccactaatcgccgaaaccggcggccagaacgcaatgatcgtggactcctcggcgctgaccgaacaagtggtcatcgacgtagtgtcctcggcgttcgacagcgccgggcaacgttgctcggcactgcgcgtgctgtgcctgcaggaagattcggccgatcgcgtcattgaaatgctcaagggcgcgatggccgaaagccgtctgggcaacccggaacgcctgtccgtggacatcgggccggtgatcgatgccgaggccaaggccggcatcgagaaacacatccaggcgatgcgcgacaagggccgcacggtttatcaggttgccatcgccgaaagcgccgaactcaagcgcggcacctacgtgatgccaaccttgatcgagctggaaagcttcgatgaactgcaacgcgaaatcttcggcccggtgctgcacgtggtgcgctacaagcgcaaggagctcggccttttgatcgaccagatcaatgcatccggctacggcctgacgctcggcgttcacacgcgcatcgacgaaaccatcgccaaggtcatcgataacgtcaacgccggtaacgtctacgtcaaccgcaacatcgtcggtgccgtggtcggggttcagccgtttggcggcgaaggcctgtctggcaccggccctaaagccggtggcccgctgtacctgtatcgcctgttgtcgacacgaccgctggatgccatcgaaaaatcgtttgtgcgtggcgatgcattggttgcacctgatacacgtctgcgcgaagtgatgagcaaaccgctgcaagccttgaaggcctgggcagcgagcagccagcacgccgaactggatgtgctgtgcggccagtacgccgagcaatcgcaaagcggcatcacccgccaactggccggcccgaccggcgagcgcaacagctacgccattctgccacgcgaacacgtgctgtgcctggctgacgacgagaacgacctgctgacccaactggcagccgtactggctgtcggcagctcagccgtatggccggaaaccgacatcagcaaaccgctcttcgctcgcctgccaaaagaagttcaggctcgcatcaagctggtgcctgactgggccaaggacgaagtcgctatcgacgctgttctgcaccacggcgactccgaccaattgcgcgccatctgccaacagatcgcccagcgcagcggcgcaatcgtcggcgtcaacggtctgtcccacggcgaaaccaacgtccctctggaacgcctggtgatcgaacgggcactgagcgtcaacacggcggctgcggggggcaatgcgagcttgatgacgataggatga

SEQ ID NO: 1857 - protein, 1317 aa, Pseudomonas syringae pv. tomato str. DC3000
MATTTLGVKLDDPTRERLKAAAHSIDRTPHWLIKQAIFNYLEKLESGATLLELNGATGKDSEDRGELAEDAGLQCFLDFAESIQPQSVLRAAITSAYRRPEQEVVPMLLEQARLTAPVAEATNKLAASIAEKLRNQKSAGGRAGIVQGLLQEFSLSSQEGVALMCLAEALLRIPDKGTRDALIRDKISNGNWQPHLGNSPSLFVNAATWGLLLTGKLVATHNEAGLTSSLSRIIGKRGEPMIRKGVDMAMRLMGEQFVTGETIGEALANASRFEAKGFRYSYDMLGEAALTEHDAQKYLASYEQAIHSIGKASHGRGIYEGPGISIKLSALHPRYSRAQYERVMDELYPRLLSLTLLAKQYDIGLNIDAEEADRLELSLDLLERLCFEPQLTGWNGIGFVIQAYQKRCPYVIDYVIDLARRSRHRLMIRLVKGAYWDSEIKRAQVEGLEGYPVYTRKVYTDVSYIACARKLLAAPEVIYPQFATHNAHTLAAIYQIAGQNYYPGQYEFQCLHGMGEPLYEQVVGKVADGKLNRPCRVYAPVGTHETLLAYLVRRLLENGANTSFVNRIADHSISIQELVADPVNQIERMATQEGGFGLPHPRIPLPRDLYGTERANSSGIDMANEHRLASLSSALLSTAHNDWKAAPMLGCPASEGTLAAALNPSDLRDVVGHVQEASLQDVDNAIQCALSAGPIWQATPPAERAAILERAADLMEGEIQPLMGLLVREAGKTFANAIAEVREAVDFLRYYAVQARNDFTNDAHRPLGPVVCISPWNFPLAIFSGQVAAALAAGNPVLAKPAEQTPLIAAQAVRLLLEAGIPEGVVQLLPGRGETVGAGLVGDERVKGVMFTGSTEVARLLQRNVADRLDSQGRPIPLIAETGGQNAMIVDSSALTEQVVIDVVSSAFDSAGQRCSALRVLCLQEDSADRVIEMLKGAMAESRLGNPERLSVDIGPVIDAEAKAGIEKHIQAMRDKGRTVYQVAIAESAELKRGTYVMPTLIELESFDELQREIFGPVLHVVRYKRKELGLLIDQINASGYGLTLGVHTRIDETIAKVIDNVNAGNVYVNRNIVGAVVGVQPFGGEGLSGTGPKAGGPLYLYRLLSTRPLDAIEKSFVRGDALVAPDTRLREVMSKPLQALKAWAASSQHAELDVLCGQYAEQSQSGITRQLAGPTGERNSYAILPREHVLCLADDENDLLTQLAAVLAVGSSAVWPETDISKPLFARLPKEVQARIKLVPDWAKDEVAIDAVLHHGDSDQLRAICQQIAQRSGAIVGVNGLSHGETNVPLERLVIERALSVNTAAAGGNASLMTIG

SEQ ID NO: 1858 - DNA, 3963 bp, Salmonella enterica subsp. enterica serovar Typhi Ty2
  CDS (1)..(3963): transl_table=11
atgggaaccaccacgatgggggttaagctggacgacgccacgcgcgaacggatcaaaatggccgcgtcgcgtatcgatcgcacgccgcactggttaataaaacaggcaatctttagctatctggacaagctggaaaatagcgatacgctaccggagctacctgcgctgtttgccggcgcggcaaatgaaagcgaggagccggtcgcgccgcaggatgagccgcatcagccctttctggagtttgccgaacagattcttccccaatccgtctctcgcgccgccatcaccgccgcctggcgccgcccggaaaccgatgcggtgtcaatgctaatggaacaggcgcgcctgtcgccgcctgtcgctgagcaggcgcataaactggcgtatcaactggcggagaaattgcgcaatcaaaaatccgccagcggtcgcgcgggtatggtgcaaggcctgttgcaggagttttccctctcttcgcaagaaggcgtagcgctgatgtgtctggcggaagcgctgctgcgtattcccgacaaagctacgcgcgatgcgttaattcgcgacaaaatcagtaatggcaactggcagtcgcatattggccgtagcccgtcgctgtttgtaaacgccgccacctgggggctgctctttaccggccgactggtctcaacgcataacgaagccaatctttcgcgctcgctgaaccgcattatcggcaagagcggcgaaccgttaatccgcaaaggcgtcgacatggcgatgcgtttaatgggcgagcagttcgtgactggcgaaaccattgctcaggcgctggcgaatgcccgaaaactggaagagaaagggttccgctattcttacgatatgctgggcgaagccgcgttaaccgccgccgatgcgcaggcctatatggtctcttaccagcaagcgattcatgccatcggcaaagcgtctaacggtcgcggtatttacgaagggccaggcatctcgattaagctgtccgccctgcatccacgctatagtcgcgcgcaatacgatcgggtaatggaggagctttatccgcgcctgaaatccctgacgctgctggcgcgccagtatgatatcggtctcaatatcgacgccgaagaggcggatcgtctggagatctcgcttgatctgctggaaaaactctgcttcgaacccgaactggcgggctggaacggcattggctttgtgattcaggcttaccagaaacgctgcccgctggtcattgattatttagtcgatctggcctcccgtagccgccgtcggctgatgattcgtctggtgaaaggcgcctactgggatagcgagatcaaacgcgcgcaaatggaagggctggagggctatccagtttatacccgcaaagtgtataccgatgtctcttatctggcctgcgcgaaaaaactgctcgccgtccctaatctgatctacccgcagttcgcgacccataacgctcacacactggcggcgatttatcatctggccgggcaaaattactatccgggtcagtacgaattccagtgcctgcacggcatgggagaaccgctgtatgaacaggtcaccggtaaagtgggggacggaaaacttaaccgtccctgccgtatttacgcgccggtgggaacacacgaaaccctgctggcctatctggtacgacgcctgctggaaaacggcgccaacacctcttttgtcaaccgcatcgccgatgccaccctaccgctcgatgaactggtggccgacccggtcgaggccgtggaaaaactggcgcagcaggaaggtcaggctggcataccgcatccaaaaattccgctgccgcgcgatctgtacggcgaaggtcggataaactccgccggacttgatttagcgaatgaacatcgcctcgcctcgctttcttctgccctgttaagcaacgccatgcagaaatggcaggccaaacctgtgctggaacaaccggtggccgacggtgagatgacgccggttatcaacccggcggaaccgaaagatattgttggctggggacgcgaagcgacagaaagcgaggttgaacaggcgttgcaaaacgcggtcaatcaggcgccggtttggtttgcgacgccgccgcaagaacgcgccgctattttgcagcgggcggcggtattgatggaagaccaaatgcagcagttgattggcctgttggtgcgtgaagcggggaaaacgttcagcaacgccattgccgaagtgcgcgaagcggtagacttcctccattattatgccggtcaagtgcgtgacgatttcgataacgaaacgcatcgcccgttagggccggtggtctgtatcagtccgtggaactttccgctggccattttcactggccaaatcgccgccgcgctggcggcaggtaacagcgttctggcgaaaccggcagagcagacatcgctgattgccgcccagggcattgccattttgctggaagcgggcgtaccgccgggcgtcgtgcaactgttgccgggacggggagaaaccgtcggcgcccagcttaccgccgatgcgcgtgtacgcggcgtgatgtttaccggttccacggaggtcgcgacgttgttgcagcgcaacatcgccacgcgtcttgacgcccaggggcgccctattccgttgattgcggaaaccggcggtatgaacgctatgattgtcgactcttccgcgctcaccgagcaggtggtcgtggatgtgctggcttccgccttcgacagcgccggacaacgctgttccgcgctccgcgtgctgtgtttgcaggacgatatcgccgaacatacgctgaaaatgttacgcggcgcgatggcggagtgtcggatggggaatccaggccgtctgacgaccgatatcgggccggtgatcgatagcgaggccaaagccaacattgaacgtcatatccagacgatgcgcgccaaaggccgcccggttttccaggccgcgcgtgaaaacagcgatgacgcgcaggaatggcagaccggtacgtttgttatgcccacgcttattgagctggaaaacttcgcagaactggaaaaagaggtcttcgggcccgtgctgcacgtcgtgcgttataaccgtaaccaactggcggagcttatcgaacagattaacgcttccggctacgggctaacgctgggcgtacatacccgtattgatgaaaccattgcgcaagtcaccggttccgcccatgtcggcaacctgtacgttaaccgtaatatggtgggcgcggtcgtcggcgtccagccgtttggcggcgaaggcctgtccggcaccgggccaaaagcgggagggccgctctatctctaccgcctgctggcacaccgcccgcccaatgcgctcaatacgacgctgactcgtcaggatgcgcgttacccggtggatgcgcagcttaaaaccacgctactcgcgccgttgaccgctctgacgcaatgggcggcggatcgcccggcgctacagacgctctgccgacaattcgccgatctggcgcaggccggcacgcagcgcctgctaccggggccgaccggcgagcgtaatacctggacgctgttgccgcgtgaacgggtgttatgcctggctgatgatgaacaggacgcgttgacgcagcttgccgccgttctcgccgtcggcagtcaggcgctatggtcagacgacgccttccaccgcgatctggcgaaacgtctccccgccgccgtcgcggcgcgtgtccagtttgcgaaagcggaaacgctgatggcgcagccgtttgacgcggtgattttccacggcgactccgacaagctgcgaaccgtgtgcgaagccgtcgccgcccgcgaaggcgcgatagtgtcggtacaggggttcgcccgcggcgaaagcaatatgctgctggaacggctctatattgaacgttcgctgagcgtaaacactgccgccgctggcggtaatgccagcctgatgacaattggctaa

SEQ ID NO: 1859 - protein, 1320 aa, Salmonella enterica subsp. enterica serovar Typhi Ty2
MGTTTMGVKLDDATRERIKMAASRIDRTPHWLIKQAIFSYLDKLENSDTLPELPALFAGAANESEEPVAPQDEPHQPFLEFAEQILPQSVSRAAITAAWRRPETDAVSMLMEQARLSPPVAEQAHKLAYQLAEKLRNQKSASGRAGMVQGLLQEFSLSSQEGVALMCLAEALLRIPDKATRDALIRDKISNGNWQSHIGRSPSLFVNAATWGLLFTGRLVSTHNEANLSRSLNRIIGKSGEPLIRKGVDMAMRLMGEQFVTGETIAQALANARKLEEKGFRYSYDMLGEAALTAADAQAYMVSYQQAIHAIGKASNGRGIYEGPGISIKLSALHPRYSRAQYDRVMEELYPRLKSLTLLARQYDIGLNIDAEEADRLEISLDLLEKLCFEPELAGWNGIGFVIQAYQKRCPLVIDYLVDLASRSRRRLMIRLVKGAYWDSEIKRAQMEGLEGYPVYTRKVYTDVSYLACAKKLLAVPNLIYPQFATHNAHTLAAIYHLAGQNYYPGQYEFQCLHGMGEPLYEQVTGKVGDGKLNRPCRIYAPVGTHETLLAYLVRRLLENGANTSFVNRIADATLPLDELVADPVEAVEKLAQQEGQAGIPHPKIPLPRDLYGEGRINSAGLDLANEHRLASLSSALLSNAMQKWQAKPVLEQPVADGEMTPVINPAEPKDIVGWGREATESEVEQALQNAVNQAPVWFATPPQERAAILQRAAVLMEDQMQQLIGLLVREAGKTFSNAIAEVREAVDFLHYYAGQVRDDFDNETHRPLGPVVCISPWNFPLAIFTGQIAAALAAGNSVLAKPAEQTSLIAAQGIAILLEAGVPPGVVQLLPGRGETVGAQLTADARVRGVMFTGSTEVATLLQRNIATRLDAQGRPIPLIAETGGMNAMIVDSSALTEQVVVDVLASAFDSAGQRCSALRVLCLQDDIAEHTLKMLRGAMAECRMGNPGRLTTDIGPVIDSEAKANIERHIQTMRAKGRPVFQAARENSDDAQEWQTGTFVMPTLIELENFAELEKEVFGPVLHVVRYNRNQLAELIEQINASGYGLTLGVHTRIDETIAQVTGSAHVGNLYVNRNMVGAVVGVQPFGGEGLSGTGPKAGGPLYLYRLLAHRPPNALNTTLTRQDARYPVDAQLKTTLLAPLTALTQWAADRPALQTLCRQFADLAQAGTQRLLPGPTGERNTWTLLPRERVLCLADDEQDALTQLAAVLAVGSQALWSDDAFHRDLAKRLPAAVAARVQFAKAETLMAQPFDAVIFHGDSDKLRTVCEAVAAREGAIVSVQGFARGESNMLLERLYIERSLSVNTAAAGGNASLMTIG

SEQ ID NO: 1860 - DNA, 3951 bp, Wigglesworthia glossinidia endosymbiont of Glossina brevipalpis
  CDS (1)..(3951): transl_table=11
atggataccagaatattaggaataaaattagacaacaaattatcccatcgtatcgaaaatatatcaagtagattaaatcgtactccacattggataattaagcaggccatttttcttcacctagatgatttagagaaaaaatcaaaatctagcgaaaaattaatagaaaataaaaatgaaattcaagattatcaagacaaaataaatgaaaaaattatttttaaacctttctttgaatttgcacaacaaatattacctcaatcttatttaagatttaatacaacaaacgcttggagtactcctgaaaaagaaattgttccaaagttattagaactatctaaatgcgaagaagaaactgaaaaaaaaattcatgagctatcaaagtatctagcaaaaggattaagagaaaaatcaaaaaagtacaatagagaacaaatggttcaagatttactacgagaatttcctttatcttctaaagaaggtatagctttaatgtgtttagcagaagccttgctaagaataccagatgtaaatacaagaaattctttaataaaagacaaaataaaaaataaagattggaaaagccattttggatccaataaaggtttatttataaattcagcagtatggggtttatgtataactaataatttaatcaaaagacataaagaaaaaaatttaagttcatatttaaataaagttattcaaaaaataggagagccaatcgtaggaaaagctataaacgtagctatgaaattaatgggaaaacaatttgttgtaggagaaaatatacaacaagctctaaaaaatacaaacattttagaaaaaaaaggtttttcatattcatatgatatgcttggagaagcagctttaacagaagaagatgcacaaaaatacatgacttcttatgaaaacgcaattcattgtataggaaaatcatctttgggaaaaggaatatataaaggaccaggtatatctattaaattatcagctattcatcctcgttattctagaaataaatatgaaaaagttatgtctgaattatatcctagattaagatcgttaactttattagctagacattatgacataggtatgaatatagatgctgaagaggcaaacagattagaaatttctatagatttattagataaattatgttgtgaaccatctttatttggatggagtggtattgggtttgtagtacaagcttatcaaaaaagatgtatgtatgtaatagaagaactaattgatatagcaaaacgtacgaaaagaagattaatggtaaggttagtaaaaggagcttattgggatagtgaaataaaaaatgcacaaattgaaggaatagaagactatccagtatttacgagaaaagcatatacagacatatcttatttagcatgtgctaaaaaacttctatcagaaagtaatcatatatatccacaatttgctactcacaatgctcatactgtatcatctatatatcattttgctggagagaattattattcaggacaatatgaatttcaatgtttacacggtatgggagaacaattatacgaaaaagtagtaggtaatgccattgataaaaaattagatcgtccatgtagaatttatgctcctgtaggtacacataaaactttacttgcttatttagtaagaagaattttagaaaacggagctaataattcatttattaatcgcatatcagataataatgtttctattgaaaaattagttttaagtccgataaaagagtctataagtatatcaaaaaaagaaaatgttgaaattggaacttctcatccaaatattcctttgccaaaaaatttatatggaaataatagagaaaattctcatggatttaatttttctaatgaaaatgttttagcaaaattatcatctgacttgttaaaaaattcagataaattttggaaagttactccaataattcattcaaaattagataaaggatctattagtaaaattataaatccagctaataaaaaagatataataggagagtgtcaaagttctactttaaaagacgttgaatctgctcttgaaagctcggtaaaaggaattgaattatggtcttcaaaagaaccattagagagatctaaaattttatatgatatttctaacaagatagaaaaaaatactaatatttttattaatttactcgttagagagtcaggaaaaacttttcctaatgccgtttccgaaataagagaagcagttgattttttaagatattactcaaatcaaataaaaccttttaataataaaacacatattcctttagggtgtgtgttatgcataagtccatggaattttcctttagctatttttttaggacaaatttcagctgctttagcttctggaaatgcagtaatagctaaacctgcagaacaaacgcctatagttgcatatgaagctattaaattaatgatagattctggaataccaagtgagtctttacagtttttacctggaagtggaaaaataataggaaattctctatctaaagatcatcgtatacacggagttatgtttacaggatctactcaagttgctcgtttattgcaattgaatttatctgatcgtttaagcaaaggaagacctgttcctctaattgctgaaactggcggtctaaatgccatgattgtagattcttcagcattaacagagcaagtagtatctgatattattgtttctgcttttgatagcgctggacagcgttgttctgctttaagactattatgtatacaagaagatgtatcagaaaaaactttaaatatgattaaaggagctattgattcttatactgtaggaaatccagaatatttttcaacagatattggtcctgtgatagataaaaatgcaaaaatcaatattgatcaacatattttgaatatgaaaaaaagcaaccattctgtatggcagagtgaaatgtcttatgacacaaaacaagatctaggaaattttgttttaccaacattgatagaattagacgatatagatcaaataaaagaagaagtatttggtccagttttacatattgttaaatttaaatatgaagaaatgaataatatatttgaaaaaataaattcttctggatatggattgactatcggtattcattctagaatagaagaaaatatagaaaaagtcacaacatcaacaaaagttggaaattattatgtaaatagaaacatagtaggagcagtagttggggttcagccttttggtggagaaggtttatctggtactgggccaaaagcaggaggtccattatatctatacagattgctttctgatagaaaagaaaaaaatattttatcttcattagaagaactagataaaaataaaaaagtagatttgactagatgcgaaaaaatacaagaatcttgtgtcagtttaatagaatggatttctgtaaactatccagatttagaaaaatattgtaattattttatttcacaatctcaatcaggaagctcaagagtgctacaaggacctactggagagaagaatacctatttgttgcttccaagagaaagaatattatgtttatcaaatgatgaaaatgatttactaattcaattagcagctgttaccagtattggagggaaagcaattttatctcataatccaattacacaaaaaatattttctattcttccacaatctgttttaaaaaatgtaattcttatcccaaattggaaaagagaagattcaatgtttgatatagttttatttcacggcgatgaattacaattaaaagaagtgttggaaattttatctaaaaaaagaggtccagtaataaatgttcatagccataaaaatggagataaaaaaatatttttagaaaaacttttaatagaacgtacaataagtttaaacactactgctgcaggtggaaatactactttattgagtatggtttaa

SEQ ID NO: 1861 - protein, 1316 aa, Wigglesworthia glossinidia endosymbiont of Glossina brevipalpis
MDTRILGIKLDNKLSHRIENISSRLNRTPHWIIKQAIFLHLDDLEKKSKSSEKLIENKNEIQDYQDKINEKIIFKPFFEFAQQILPQSYLRFNTTNAWSTPEKEIVPKLLELSKCEEETEKKIHELSKYLAKGLREKSKKYNREQMVQDLLREFPLSSKEGIALMCLAEALLRIPDVNTRNSLIKDKIKNKDWKSHFGSNKGLFINSAVWGLCITNNLIKRHKEKNLSSYLNKVIQKIGEPIVGKAINVAMKLMGKQFVVGENIQQALKNTNILEKKGFSYSYDMLGEAALTEEDAQKYMTSYENAIHCIGKSSLGKGIYKGPGISIKLSAIHPRYSRNKYEKVMSELYPRLRSLTLLARHYDIGMNIDAEEANRLEISIDLLDKLCCEPSLFGWSGIGFVVQAYQKRCMYVIEELIDIAKRTKRRLMVRLVKGAYWDSEIKNAQIEGIEDYPVFTRKAYTDISYLACAKKLLSESNHIYPQFATHNAHTVSSIYHFAGENYYSGQYEFQCLHGMGEQLYEKVVGNAIDKKLDRPCRIYAPVGTHKTLLAYLVRRILENGANNSFINRISDNNVSIEKLVLSPIKESISISKKENVEIGTSHPNIPLPKNLYGNNRENSHGFNFSNENVLAKLSSDLLKNSDKFWKVTPIIHSKLDKGSISKIINPANKKDIIGECQSSTLKDVESALESSVKGIELWSSKEPLERSKILYDISNKIEKNTNIFINLLVRESGKTFPNAVSEIREAVDFLRYYSNQIKPFNNKTHIPLGCVLCISPWNFPLAIFLGQISAALASGNAVIAKPAEQTPIVAYEAIKLMIDSGIPSESLQFLPGSGKIIGNSLSKDHRIHGVMFTGSTQVARLLQLNLSDRLSKGRPVPLIAETGGLNAMIVDSSALTEQVVSDIIVSAFDSAGQRCSALRLLCIQEDVSEKTLNMIKGAIDSYTVGNPEYFSTDIGPVIDKNAKINIDQHILNMKKSNHSVWQSEMSYDTKQDLGNFVLPTLIELDDIDQIKEEVFGPVLHIVKFKYEEMNNIFEKINSSGYGLTIGIHSRIEENIEKVTTSTKVGNYYVNRNIVGAVVGVQPFGGEGLSGTGPKAGGPLYLYRLLSDRKEKNILSSLEELDKNKKVDLTRCEKIQESCVSLIEWISVNYPDLEKYCNYFISQSQSGSSRVLQGPTGEKNTYLLLPRERILCLSNDENDLLIQLAAVTSIGGKAILSHNPITQKIFSILPQSVLKNVILIPNWKREDSMFDIVLFHGDELQLKEVLEILSKKRGPVINVHSHKNGDKKIFLEKLLIERTISLNTTAAGGNTTLLSMV

SEQ ID NO: 1862 - DNA, 3822 bp, Bordetella pertussis Tohama I
  CDS (1)..(3822): transl_table=11
atggctagcacgactctgggcgtcaaggtcgacgacgcattgcgcgatcgcctcaaagccgccgcgcagaaactgaactgcaccccgcactggctgcacaagcaggccattctttcctatctcgacagaatcgaacgcggccatctgccggcggaaatggcccatctggggcgcgacgagcgcggcgaggacgaggacgcaggcgcgtcggccgatgccatgccgcctttcttcgagttcggccaggacgtgcagccgcaatccgtgctgcgcgccgccatcaccgccgcctatcgccggcccgagccggaatgcgtgccgttgctgctggggcaggcccgcgtggccggccccgagaaggtgcacgccatggccagcaagctggtccacgcgctgtgggccaagcgcagcggcggcggcgtcgaaggactgatccaggagttctcgctgtccagccaggaaggcgtggcgctgatgtgcctggccgaggcgctgttgcgcattcccgaccgcgccacccgcgatgccctgatccgcgacaagatcgtgcacggcgactggcgctcgcacatgggcggatcgcagtcgctgtttgtcaacgccgcgacctggggcctgatgatcaccggcaagctggtcgccgtcagcagcgagcagtcgctgtccaaggcgctgacgcgcctgatcggcaagggcggcgagccgctggtgcgcaagggcgtgaacatggccatgcgcatgatgggcgagcagttcgtctcgggccagacgatctccgaggccctggccaacaaccgcaagatggaggcgcggggctttcgctactcgtacgacatgctgggcgaggccgcgaccacggccgccgacgccgaacgctattacgcggcgtacgagcaggccatccatgccatcggcaaggcggccgccggacgcggcatctacgaaggcccgggcatctcgatcaagctgtcggcgctgcatccgcgttatgcgcgcgcccagcgcgaccgggtcatggccgagctgctgccgcgcgtcaaggcgctgacgctgctggcgcgccaatacgatatcggcctgaacatagacgcggaggaagccgaccggctcgagatttcgctggacctgctggaagccttgtgtttcgtccccgagctggacgactggaatggcatcggcttcgtcatccaggcctatcagaagcgcgcgccgttcgtgatcgattacgtgatcgacctggccaagcgcagccgccaccgcctgatggtgcgcctggtcaagggggcgtattgggacacggagatcaagcgcgcccaggtcgacggcctggaggggtatccggtctacacgcgcaaggtgtacaccgacgtcgcctacctggcctgcgcgcgcaggctgctggcggcgcccgaggccacatacccgcagttcgccacccataacgcctataccctgtcggccatctaccagatggcgggacagaactactacccggggcagtacgagttccagtgcctgcacggcatgggcgaaccgctgtacgaggaggtggtcgggccgctggcgcaaggcaagctgaaccgcccgtgccgcatctatgccccggtgggcacgcacgaaaccctgctggcgtacctggtgcgccgcctgctggaaaatggcgccaacacttccttcgtcaacctgatcggcgacgacagcatcacggtcgagcaactggtggccgatccggtcgaggcggcgtcccgcatcgtgccgctgggcgcgccgcacgagaaaatccccctgccgcgcgagctgtacggcagcgtgcagcagggcgcgcgggccaactcggccggcctggacctgaccaacgagcatcgcctgggctcgctgtcggcggccctgctggccagcgccgcgaccgactggcgcgcctggcccatgctgggcgagggagatcccggctgggatccggccagcgcggtcgaagtggccaacccggccaacctgcgcgacatcgtcggccacgtcatgcaggccacgccgcaacatgtggagcaggccctgcgcgacgccgccaacgcggcgcccatctggcagtccacgccggtgcccgagcgcgcgcagtgcctgcggcgggcggcccagctgctggaagagcagatgcagacgctgctcggcctgatcgtgcgcgaggccggcaagtcgctgcccaacgccatcgccgaggtgcgcgaagcggtggacttcctgcgctattacgccgaccaggccgagcgcgagttcgacaacgatacccatcgtccgctgggccaggtgctgtgcatcagtccatggaacttcccgctggccattttcaccggccaggtcgccgccgcgctggccgccggcaacaccgtgctggccaagccggccgagcagacttcgctgatcgccggccaggcggtggccatcctgcgcgccgcgggcgtgcccgccggcgcggtgcaactgctgccgggccgtggcgaaaccgtgggggcccagctggtggccagtccgcaggtgcgcggcgtgatgttcaccggctcgaccgaggtggcgcgcatcatcgccggcgcgctggccgagcgtctggacgaccagggccacaccattccgctgatcgccgagaccggcggccagaacgccatggtgatcgattcgtcggcgctggccgagcaggtcgtgttcgatgtgctgacctcggcgttcgactccgccggccagcgctgctccgcgctgcgcgtgctgtgcctgcaggaggacagcgcggatcacgtgctgactatgctgcgcggcgcgatgcgcgagctgcgcgtgggcaatcccgaccgcctgtcggtcgacgtggggcccgtgatcgacgccgaggcgcgcaacggcatccagggccatatcgaggccatgcgctcgtccggacgcccggtcgaccaggtcgaactggcgggcgagtgccgctacggcacgttcgtgccgccgacgctgatcgagatcgaccatatcggcgagctcacgcgcgaagtgttcggcccggtgctgcacgtattgcgctaccggcgcgacgacctggacgggctgatcgagcagatcaacgccaccggttatgggctgaccttcggcgtgcatacccgcatcgacgaaaccatcgcccgcgtcaccgaacaggtgcacgccggcaacctgtatgtcaaccgcaacatcgtgggcgccgtggtcggggtgcaacccttcggaggcgaaggcctttcgggcaccggcccgaaggcgggcgggccgctgtacatgtaccggctgctggccacgcgcccggccggcctgccgcccgccctcgacccggcggcgccgatgccgcaggcgcttgccttgccgggcccgaccggcgagaccaatacctaccgggtcgagccgcgcggcgcggtctattgcgtggccgccaccgaggccggcgcccgggcgcaatgggccgtcgtgagccagaccggcaaccatgcctggttcgccgatacgccggcggcgcgcgcctggatcgacggcctggacgccaggctgcgcgagcaggctgccttgctggaagattccgaatttgatgaggccgatttccaggcggtgctgttcgagggggacggcgacgccttgcgcgcgctgaacatgcgcatcgcccaacgtcccggccccctggtgtccgtgcatggcctgagcgccgacgccctggccgccggggccagctacgcgcccgaccgcctgctggccgagcgttcgatcagcgtcaacacggcggccgctggcggcaacgccagcctgatgacgataggttga

SEQ ID NO: 1863 - protein, 1273 aa, Bordetella pertussis Tohama I
MASTTLGVKVDDALRDRLKAAAQKLNCTPHWLHKQAILSYLDRIERGHLPAEMAHLGRDERGEDEDAGASADAMPPFFEFGQDVQPQSVLRAAITAAYRRPEPECVPLLLGQARVAGPEKVHAMASKLVHALWAKRSGGGVEGLIQEFSLSSQEGVALMCLAEALLRIPDRATRDALIRDKIVHGDWRSHMGGSQSLFVNAATWGLMITGKLVAVSSEQSLSKALTRLIGKGGEPLVRKGVNMAMRMMGEQFVSGQTISEALANNRKMEARGFRYSYDMLGEAATTAADAERYYAAYEQAIHAIGKAAAGRGIYEGPGISIKLSALHPRYARAQRDRVMAELLPRVKALTLLARQYDIGLNIDAEEADRLEISLDLLEALCFVPELDDWNGIGFVIQAYQKRAPFVIDYVIDLAKRSRHRLMVRLVKGAYWDTEIKRAQVDGLEGYPVYTRKVYTDVAYLACARRLLAAPEATYPQFATHNAYTLSAIYQMAGQNYYPGQYEFQCLHGMGEPLYEEVVGPLAQGKLNRPCRIYAPVGTHETLLAYLVRRLLENGANTSFVNLIGDDSITVEQLVADPVEAASRIVPLGAPHEKIPLPRELYGSVQQGARANSAGLDLTNEHRLGSLSAALLASAATDWRAWPMLGEGDPGWDPASAVEVANPANLRDIVGHVMQATPQHVEQALRDAANAAPIWQSTPVPERAQCLRRAAQLLEEQMQTLLGLIVREAGKSLPNAIAEVREAVDFLRYYADQAEREFDNDTHRPLGQVLCISPWNFPLAIFTGQVAAALAAGNTVLAKPAEQTSLIAGQAVAILRAAGVPAGAVQLLPGRGETVGAQLVASPQVRGVMFTGSTEVARIIAGALAERLDDQGHTIPLIAETGGQNAMVIDSSALAEQVVFDVLTSAFDSAGQRCSALRVLCLQEDSADHVLTMLRGAMRELRVGNPDRLSVDVGPVIDAEARNGIQGHIEAMRSSGRPVDQVELAGECRYGTFVPPTLIEIDHIGELTREVFGPVLHVLRYRRDDLDGLIEQINATGYGLTFGVHTRIDETIARVTEQVHAGNLYVNRNIVGAVVGVQPFGGEGLSGTGPKAGGPLYMYRLLATRPAGLPPALDPAAPMPQALALPGPTGETNTYRVEPRGAVYCVAATEAGARAQWAVVSQTGNHAWFADTPAARAWIDGLDARLREQAALLEDSEFDEADFQAVLFEGDGDALRALNMRIAQRPGPLVSVHGLSADALAAGASYAPDRLLAERSISVNTAAAGGNASLMTIG

SEQ ID NO: 1864 - DNA, 3822 bp, Bordetella parapertussis 12822
  CDS (1)..(3822): transl_table=11
atggctagcacgactctgggcgtcaaggtcgacgacgcattgcgcgatcgcctcaaagccgccgcgcagaaactgaactgcaccccgcactggctgcacaagcaggccattctttcctatctcgacagaatcgaacgcggccatctgccggcggagatggcccatctggggagcgacgagcgcggcgaggacgaggacgcaggcgcgtcggccgatgccatgccgcctttcttcgagttcggccaggacgtgcagccgcaatccgtgctgcgcgccgccatcaccgccgcctatcgccggcccgagccggaatgcgtgccgttgctgctggggcaggcccgcgtggccggccccgagaaggtgcacgccatggccagcaagctggtccacgcgctgcgggccaagcgcagcggcggcggcgtcgaaggactgatccaggagttctcgctgtccagccaggaaggcgtggcgctgatgtgcctggccgaggcgctgttgcgcattcccgaccgcgccacccgcgatgccctgatccgcgacaagatcgcgcacggcgactggcgctctcacatgggcggatcgcagtcgctgtttgtcaacgccgcgacctggggcctgatgatcaccggcaagctggtcgccgtcagcagcgagcagtcgctgtccaaggcgctgacgcgcctgatcggcaagggcggcgagccgctggtgcgcaagggcgtgaacatggccatgcgcatgatgggcgagcagttcgtctcgggccagacgatctccgaagccctggccaacaaccgcaagatggaggcgcggggctttcgctactcgtacgacatgctgggcgaggccgccaccacggccgccgacgccgaacgctattacgcggcgtacgagcaggccatccatgccatcggcaaggcggccgccggacgcggcatctacgaaggcccgggcatctcgatcaagctgtcggcgctgcatccgcgttatgcgcgcgcccagcgcgaccgggtcatggccgagctgctgccgcgcgtcaaggcgctgacgctgctggcgcgccaatacgatatcggcctgaacatagacgccgaggaagccgaccggctcgagatttcgctggacctgctggaagccttgtgtttcgtccccgagctggacggctggaatggcatcggcttcgtcatccaggcctatcagaagcgcgcgccgttcgtgatcgattacgtgatcgacctggccaagcgcagccgtcaccgcctgatggtgcgcctggtcaagggggcgtattgggacacggagatcaagcgcgcccaggtcgacggcctggaggggtatcccgtctacacgcgcaaggtgtacaccgacgtcgcctacctggcctgcgcgcgcaggctgctggcggcgcccgaggccacatacccgcagttcgccacccataacgcctataccctgtcggccatctaccagatggcgggacagaactactacccggggcagtacgagttccagtgcctgcacggcatgggcgaaccgctgtacgaggaggtggtcgggccgctggcgcaaggcaagctgaaccgcccttgccgcatctatgccccggtgggcacgcacgaaaccctgctggcgtacctggtgcgccgcctgctggaaaatggcgccaacacttccttcgtcaacctgatcggcgacgacagcatcacggtcgagcaactggtggccgatccgatcgaggcggcgtcccgcatcgtgccgctgggcgcgccgcacgagaaaatccccctgccgcgcgagctgtacggcagcgtgcagcagggcgcgcgggccaactcggccggcctggacctgaccaacgagcatcgcctgggctcgctgtcggcggccctgctggccagcgccgcgatcgactggcgcgcctggcccatgctgggcgagggagatcccggctgggatccggccggcgcggtcgaagtggccaacccggccaacctgcgcgacatcgtcggccacgtcatgcaggccacgccgcaacatgtggaacaggccctgcgcgacgccgccaacgcggcgcccatctggcagtccacgccggtgcccgagcgcgcgcagtgcctgcggcgggcggcccagctgctggaagagcagatgcagacgctgcttggcctgatcgtgcgcgaggccggcaagtcgctgcccaacgccatcgccgaggtgcgcgaagcggtggacttcctgcgctattacgccgaccaggccgagcgcgagttcgacaacgatacccatcgtccgctgggccaggtactgtgcatcagtccatggaacttcccgctggccattttcaccggccaggtcgccgccgcgctggccgccggcaacaccgtgctggccaagccggccgagcagacgtcgctgatcgccggccaggcggtggccatcctgcgcgccgcgggcgtgcccgccggcgcggtgcaactgctgccgggccgtggcgaaaccgtgggggcccaactggtggccagtccgcaggtgcgcggcgtgatgttcaccggctcgaccgaggtggcgcgcatcatcgccggcgcgctggccgaacgcctggacgatcagggccacaccattccgctgatcgccgagaccggcggccagaacgccatggtgatcgattcgtcggcgctggccgagcaggtcgtgttcgatgtgctgacctcggcgttcgactccgccggccagcgctgctccgcgctgcgcgtgctgtgcctgcaggaggacagtgcggatcacgtgctggccatgctgcgcggcgcgatgcgcgagctgcgcgtgggcaatcccgaccgcctgtcggtcgacgtgggacccgtgatcgacgccgaggcgcgcaacggcattcagggccatatcgaggccatgcgctcgtccggacgcccggtcgaccaggtcgagctggcgggcgagtgccgctacggcacgttcgtgccgccgacgttgatcgagatcgaccatatcggcgagctcacgcgcgaagtgttcggcccggtactgcacgtattgcgctaccggcgcgacgacctggacgggctgatcgagcagatcaacgccaccggttatgggctgaccttcggcgtgcatacccgcatcgacgaaaccattgcccgcgtcaccgaacaggtgcacgccggcaacctgtatgtcaaccgcaacatcgtgggcgccgtggtcggggtgcaacccttcggaggcgaaggcctctcgggcaccggcccgaaggcgggggggccgctgtacatgtaccggctgctggccacgcgcccggccggcctgccgcccgccctcgacccggcggcgccgatgccgcaggcgcttgccttgccgggcccgaccggcgagaccaatacctaccgggtcgagccgcgcggcgcggtctattgcgtggccgccaccgaggccggcgcccgggcgcaatgggccgtcgtgagccagaccggcaaccatgcctggttcgccgatacgccggcggcgcgcgcctggatcgacggcctggacgccaggctgcgcgagcaggctgccttgctggaagattccgaacttgatgaggccgatttccaggcggtgctgttcgagggggacggcgacgccttgcgcgcgctgaacatgcgcatcgcccaacgtcccggccccctggtgtccgtgcatggcctgagcgccgatgccctggccgccggggccagctacgcgcccgaccgcctgctggccgagcgttcgatcagcgtcaatacggcggccgctggcggcaacgccagcctgatgacgataggttga

SEQ ID NO: 1865 - protein, 1273 aa, Bordetella parapertussis 12822
MASTTLGVKVDDALRDRLKAAAQKLNCTPHWLHKQAILSYLDRIERGHLPAEMAHLGSDERGEDEDAGASADAMPPFFEFGQDVQPQSVLRAAITAAYRRPEPECVPLLLGQARVAGPEKVHAMASKLVHALRAKRSGGGVEGLIQEFSLSSQEGVALMCLAEALLRIPDRATRDALIRDKIAHGDWRSHMGGSQSLFVNAATWGLMITGKLVAVSSEQSLSKALTRLIGKGGEPLVRKGVNMAMRMMGEQFVSGQTISEALANNRKMEARGFRYSYDMLGEAATTAADAERYYAAYEQAIHAIGKAAAGRGIYEGPGISIKLSALHPRYARAQRDRVMAELLPRVKALTLLARQYDIGLNIDAEEADRLEISLDLLEALCFVPELDGWNGIGFVIQAYQKRAPFVIDYVIDLAKRSRHRLMVRLVKGAYWDTEIKRAQVDGLEGYPVYTRKVYTDVAYLACARRLLAAPEATYPQFATHNAYTLSAIYQMAGQNYYPGQYEFQCLHGMGEPLYEEVVGPLAQGKLNRPCRIYAPVGTHETLLAYLVRRLLENGANTSFVNLIGDDSITVEQLVADPIEAASRIVPLGAPHEKIPLPRELYGSVQQGARANSAGLDLTNEHRLGSLSAALLASAAIDWRAWPMLGEGDPGWDPAGAVEVANPANLRDIVGHVMQATPQHVEQALRDAANAAPIWQSTPVPERAQCLRRAAQLLEEQMQTLLGLIVREAGKSLPNAIAEVREAVDFLRYYADQAEREFDNDTHRPLGQVLCISPWNFPLAIFTGQVAAALAAGNTVLAKPAEQTSLIAGQAVAILRAAGVPAGAVQLLPGRGETVGAQLVASPQVRGVMFTGSTEVARIIAGALAERLDDQGHTIPLIAETGGQNAMVIDSSALAEQVVFDVLTSAFDSAGQRCSALRVLCLQEDSADHVLAMLRGAMRELRVGNPDRLSVDVGPVIDAEARNGIQGHIEAMRSSGRPVDQVELAGECRYGTFVPPTLIEIDHIGELTREVFGPVLHVLRYRRDDLDGLIEQINATGYGLTFGVHTRIDETIARVTEQVHAGNLYVNRNIVGAVVGVQPFGGEGLSGTGPKAGGPLYMYRLLATRPAGLPPALDPAAPMPQALALPGPTGETNTYRVEPRGAVYCVAATEAGARAQWAVVSQTGNHAWFADTPAARAWIDGLDARLREQAALLEDSELDEADFQAVLFEGDGDALRALNMRIAQRPGPLVSVHGLSADALAAGASYAPDRLLAERSISVNTAAAGGNASLMTIG

SEQ ID NO: 1866 - DNA, 3822 bp, Bordetella bronchiseptica RB50
  CDS (1)..(3822): transl_table=11
atggctagcacgactctgggcgtcaaggtcgacgacgcattgcgcgatcgcctcaaagccgccgcgcagaaactgaactgcaccccgcactggctgcacaagcaggccattctttcctatctcgacagaatcgaacgcggccatctgccggcggagatggcccatctggggcgcgacgagcgcggcgaggacgaggacgcaggcgcgtcggccgatgccatgccgcctttcttcgagttcggccaggacgtgcaaccgcaatccgtgctgcgcgccgccatcaccgcagcctatcgccggcccgagccggaatgcgtgccgttgctgctggggcaggcccgcgtggccggccccgagaaggtgcacgccatggccagcaagctggtccacgcgctgcgggccaagcgcagcggcggcggcgtcgaaggactgatccaggagttctcgctgtccagccaggaaggcgtggcgctgatgtgcctggccgaggcgctgttgcgcattcccgaccgcgccacccgcgatgccctgatccgcgacaagatcgcgcacggcgactggcgctctcacatgggcggatcgcagtcgctgtttgtcaacgccgcgacctggggcctgatgatcaccggcaagctggtcgccgtcagcagcgagcagtcgctgtccaaggcgctgacgcgcctgatcggcaagggcggcgagccgctggtgcgcaagggcgtgaacatggccatgcgcatgatgggcgagcagttcgtctcgggccagacgatctccgaagccctggccaacaaccgcaagatggaggcgcggggctttcgctactcgtacgacatgctgggcgaggccgccaccacggccgccgacgccgaacgctattacgcggcgtacgagcaggccatccatgccatcggcaaggcggccgccggacgcggcatctacgaaggcccgggcatctcgatcaagctgtcggcgctgcatccgcgttatgcgcgcgcccagcgcgaccgggtcatggccgagctgctgccgcgcgtcaaggcgctgacgctgctggcgcgccaatacgatatcggcctgaacatagacgccgaggaagccgaccggctcgagatttcgctggacctgctggaagccttgtgtttcgtccccgagctggacggctggaatggcatcggcttcgtcatccaggcctatcagaagcgcgcgccgttcgtgatcgattacgtgatcgacctggccaagcgcagccgtcaccgcctgatggtgcgcctggtcaagggggcgtattgggacacggagatcaagcgcgcccaggtcgacggcctggaggggtatccggtctacacgcgcaaggtgtacaccgacgtcgcctacctggcctgcgcgcgcaggctgctggcggcgcccgaggccacatacccgcagttcgccacccataacgcctataccctgtcggccatctaccagatggcgggacagaactactacccggggcagtacgagttccagtgcctgcacggcatgggcgaaccgctgtacgaggaggtggtcgggccgctggcgcaaggcaagctgaaccgcccgtgccgcatctatgccccggtgggcacgcacgaaaccctgctggcgtacctggtgcgccgcctgctggaaaatggcgccaacacttccttcgtcaacctgatcggcgacgacagcatcacggtcgagcaactggtggccgatccggtcgaggcggcgtcccgcatcgtgccgctgggcgcgccgcacgagaaaatccccctgccgcgcgagctgtacggcagcgtgcagcagggcgcgcgggccaactcggccggcctggacctgaccaacgagcatcgcctgggctcgctgtcggcggccctgctggccagcgccgcgatcgactggcgcgcctggcccatgctgggcgagggagatcccggctgggatccggccggcgcggtcgaagtggccaacccggccaacctgcgcgacatcgtcggccacgtcatgcaggccacgccgcaacatgtggaacaggccctgcgcgacgccgccaacgcggcgcccatctggcagtccacgccggtgcccgagcgcgcgcagtgcctgcggcgggcggcccagctgctggaagagcagatgcagacgctgcttggcctgatcgtgcgcgaggccggcaagtcgttgcccaacgccatcgccgaggtgcgcgaagcggtggacttcctgcgctattacgccgaccaggccgagcgcgaattcgacaacgatacccatcgtccgctgggccaggtactgtgcatcagcccatggaacttcccgctggccattttcaccggccaggtcgccgccgcgctggccgccggtaacaccgtgctggccaagccggccgagcagacgtcgctgatcgccggccaggcggtggccatcctgcgcgccgcgggcgtgcccgccggcgcggtgcaactgctgccgggccgtggcgaaaccgtgggggcccagctggtggccagtccgcaggtgcgcggcgtgatgttcaccggctcgaccgaggtggcgcgcatcatcgccggcgcgctggccgaacgcctggacgatcagggccacaccattccgctgatcgccgagaccggcggccagaacgccatggtgatcgattcgtcggcgctggccgagcaggtcgtgttcgatgtgctgacctcggcgttcgactccgccggccagcgctgctccgcgctgcgcgtgctgtgcctgcaggaggacagtgcggatcacgtgctggccatgctgcgcggcgcgatgcgcgagctgcgcgtgggcaatcccgaccgcctgtcggtcgacgtggggcccgtgatcgacgccgaggcgcgcaacggcatccagggccatatcgaggccatgcgctcgtccggacgcccggtcgaccaggtcgagctggcgggcgaatgccgctacggcacgttcgtgccgccgacgctgatcgagatcgaccatatcggcgagctcacgcgcgaagtgttcggcccggtgctgcacgtattgcgctaccggcgcgacgacctggacgggctgatcgagcagatcaacgccaccggttatgggctgaccttcggcgtgcatacccgcatcgacgaaaccatcgcccgcgtcaccgaacaggtgcacgctggcaacctgtatgtcaaccgcaacatcgtgggcgccgtggtcggggtgcaacccttcggaggcgaaggcctctcgggcaccggcccgaaggcgggggggccgctgtacatgtaccggctgctggccacgcgcccggccggcctgccgcccgccctcgacccggcggcgccgatgccgcaggcgcttgccttgccgggcccgaccggcgagaccaatacctaccgggtcgagccgcgcggcgcggtctattgcgtggccgccaccgaggccggcgcccgggcgcaatgggccgtcgtgagccagaccggcaaccatgcctggttcgccgatacgccggcggcgcgcgcctggatcgccggcctggacgccaggctgcgcgagcaggctgccttgctggaagattccgaacttgatgaggccgatttccaggcggtgctgttcgagggggacggcgacgccttgcgcgcgctgaacatgcgcatcgcccaacgtcccggccccctggtgtccgtgcatggcctgagcgccgatgccctggccgccggggccagctacgcgcccgaccgcctgctggccgagcgttcgatcagcgtcaatacggcggccgctggcggcaacgccagcctgatgacgataggttga

SEQ ID NO: 1867 - protein, 1273 aa, Bordetella bronchiseptica RB50
MASTTLGVKVDDALRDRLKAAAQKLNCTPHWLHKQAILSYLDRIERGHLPAEMAHLGRDERGEDEDAGASADAMPPFFEFGQDVQPQSVLRAAITAAYRRPEPECVPLLLGQARVAGPEKVHAMASKLVHALRAKRSGGGVEGLIQEFSLSSQEGVALMCLAEALLRIPDRATRDALIRDKIAHGDWRSHMGGSQSLFVNAATWGLMITGKLVAVSSEQSLSKALTRLIGKGGEPLVRKGVNMAMRMMGEQFVSGQTISEALANNRKMEARGFRYSYDMLGEAATTAADAERYYAAYEQAIHAIGKAAAGRGIYEGPGISIKLSALHPRYARAQRDRVMAELLPRVKALTLLARQYDIGLNIDAEEADRLEISLDLLEALCFVPELDGWNGIGFVIQAYQKRAPFVIDYVIDLAKRSRHRLMVRLVKGAYWDTEIKRAQVDGLEGYPVYTRKVYTDVAYLACARRLLAAPEATYPQFATHNAYTLSAIYQMAGQNYYPGQYEFQCLHGMGEPLYEEVVGPLAQGKLNRPCRIYAPVGTHETLLAYLVRRLLENGANTSFVNLIGDDSITVEQLVADPVEAASRIVPLGAPHEKIPLPRELYGSVQQGARANSAGLDLTNEHRLGSLSAALLASAAIDWRAWPMLGEGDPGWDPAGAVEVANPANLRDIVGHVMQATPQHVEQALRDAANAAPIWQSTPVPERAQCLRRAAQLLEEQMQTLLGLIVREAGKSLPNAIAEVREAVDFLRYYADQAEREFDNDTHRPLGQVLCISPWNFPLAIFTGQVAAALAAGNTVLAKPAEQTSLIAGQAVAILRAAGVPAGAVQLLPGRGETVGAQLVASPQVRGVMFTGSTEVARIIAGALAERLDDQGHTIPLIAETGGQNAMVIDSSALAEQVVFDVLTSAFDSAGQRCSALRVLCLQEDSADHVLAMLRGAMRELRVGNPDRLSVDVGPVIDAEARNGIQGHIEAMRSSGRPVDQVELAGECRYGTFVPPTLIEIDHIGELTREVFGPVLHVLRYRRDDLDGLIEQINATGYGLTFGVHTRIDETIARVTEQVHAGNLYVNRNIVGAVVGVQPFGGEGLSGTGPKAGGPLYMYRLLATRPAGLPPALDPAAPMPQALALPGPTGETNTYRVEPRGAVYCVAATEAGARAQWAVVSQTGNHAWFADTPAARAWIAGLDARLREQAALLEDSELDEADFQAVLFEGDGDALRALNMRIAQRPGPLVSVHGLSADALAAGASYAPDRLLAERSISVNTAAAGGNASLMTIG

SEQ ID NO: 1868 - DNA, 3594 bp, Chromobacterium violaceum ATCC 12472
  CDS (1)..(3594): transl_table=11
atgcaattcgaatcctttgctcatcagcagtccgctctgcgcgatgcgatcaccgccgcttaccggcgcgatgaacgcgagtgcgtgcaggctttgttgcctcaggcggcgatgagtcccgagcaagtcgcatcagtgcaagaccttgcccgtcggctggtgaccgaggtgcgccgcgagcgcacccgttccagcggcgtggacgcgctgatgcacgagttctcgttggacagcagcgaagggatcgccctgatgtgtctggcggaggcgctgctgcgcatccccgaccgcgagacggccgacaagctgatccgcgacaagatttcccgcggcgactggaaggcccatttgggcaacagttcgtcgctgttcgtcaacgcggccgcttggggcctgctggtgaccggcaagctggtttcctctcatagcgccaacggcctgtcggcggcgatgacgcgcctgatcgccaaaggcggcgagccgctgatccgcaagggcgtcgacatggcgatgcgcatgctgggcaagcagttcgtcaccggcgagacgatcgaggaagcgctggccaacggccgcgaacgcgaagcgcgcggttaccgcttcagctacgacatgctgggcgaagcggcgatgaccgaagccgacgcccaacgctacctgaaggactacgtcaccgccatccatgcgatcggcaaggagtcgaacggccgcggcatctatgacggccccggcatctcggtgaagctgtccgcgatccacccgcgctatgcccgcctgaagcatgaacgcatgatgaccgagctgctgcctcgactgaaggcgctgttcctgttggccaagcaatacaatatcggcctgaacatcgacgccgaggaggccgaccgcctggagatctcgatggacctggtcgaagcgctggccaacgatgcggacctgaacggcttcgaaggcatcggcatcgtggtgcaggcctaccagaagcgctgtcccttcgtgatcgatttcctgatcgacctggcgcgccgcaccggccaccgcttcatggtgcggctggtgaagggcgcctactgggacgccgagatcaagcgcgcccaggtggacggcctgcctggctatccggtgtatacgcgcaaggtgtacaccgatgtgtcctaccttgcctgcgccaagaagctgctggccgcccaggacgcgatctacccgcagttcgccacgcacaacgcctacagcctgtcggcgatttacaacctggccgccggcaaggattacgagttccagtgcctgcacggcatgggcgagaccctgtacgaccaggtagtgggcaaggacaagctgggcaaggcttgccgcatctacgcgccggtcggctcgcatgagacgctgctagcctacctggtgcgccgcctgctggaaaacggcgccaactcctccttcgtcaaccgcatcgtcgacgaaaacgtgtccatcgacgaactggtgaccgatccggtggccgaggccgccggcttttccggcatgccgcacagcaagattccgctgcctgaggcgctgtacggcgaaggccgccgcaattccaaaggcctggacctgtccagcgagcacgtgctggccacgttgcagctgggcctgcaggcgtccgagcagcagcgttgggccgccttccccatgctgggagatggcgatgtcaccgacggcgagctgcaggaagtgcgcaatccggccgaccacagcgatgtggtgggcaaggtgatagaggccagcgccgccgacgtcgagcgcgcgctggccctatcggccggcatcgccgccgcctgggccgcgacgccggtagccgagcgcgcggccagcatccgccgcatggccgacctgatggaggcgcacatgccggcgctgatgggcctggcggtgcgcgaggcgggcaagacgctgaacaacgccatcgccgaagtgcgcgaggcggtggatttctgccgctactacgccgcgcagatcgtgtctgagttcgacaacgccagccaccggccgctgggtcctgtggtgtgcatcagcccgtggaacttcccgctggccattttcatcggcgaagtcgtcgcgtctttggccgccggcaatactgtactggccaagccggccgagcagaccagcctgatcgccgcctacgcggtgcgcctgctgcacgaggcgggcatcccgcgcgcggcgctgcagttcctgccgggccgcggcgaggtggtcggcgccgcgctgaccggcgacgcgcgcatccagggcgtgatcttcaccggttccaccgaggtggcgcagatcatcaaccgcacgctggcaaaacgccaagacgatccggtgctggtggcggaaaccggcggcatgaacgcgatgatcgtcgacagctcggcgctgccggaacaggtggtcaccgatgtgctgagctctgccttcgattccgccggccagcgttgctcggcgctgcgggtgctgtacctgcagaacgacatcgccgacaaggtgatcgcgatgatcaagggggcgatggatgagctgaccatcggcaatccggccaagctgaccaccgacgtcggtccggtgatcgacgccgaggcccaggccggcctgctcgcccacatcgccaggatgaagaactccgcccgcgcgatgcaccagaccaagctgtccgcggcgtgcgagcagggcactttcgtcgcgccgacgctgttcgagatcgacaatctgtcggagctcaagcgcgaagtgttcggcccggtgctgcacgtgctgcgctatgccgcgtcggatctggacaaggtggtggccgagatcaacgccaccggctatggcctgacccacggcatccacagccgcatcgacgaaaccatcgccgacatctgcggcaagatcaaagtgggcaatatctacgtcaaccgcaacatcgtcggcgcggtggtcggggtgcagcccttcggcggcgagggcaagtccggcaccggtcccaaggcaggcggtccgtactacctgtaccgcctgacccgtgccgcctggcagccgaagctggccgccgtgccggcggcggccgatttgtccgcgctggacgcgctggcggccgcggccaaggcgcagagcctggcgctggacggcgcgatcgccgccgcgcgcaaggaaagcccgctgacgcatagcgtggcgttgccggggccgaccggagaaaacaacttgctgtccttcgccggccgcggccgcataggctgcgtcgccgacgacgcgcaggcgctggccgaacagctggccgcggccttcgccgccggcaaccgcgcggtgctggccgataacgagctgggacgcaagttcgcgtccgccttgaacggccatgtgtcgctggctgccgacgtgctggaagcggatgtcgatgcggtgttgtacgccggcgccaaggccgaggaggcacggcgcgagctggccgcccgcgacggcgcgctggttccgctgatcctgcgcggcgaaaatggctacaatgtgcatcggctggtggtcgagcgcgcgcttagcgtcaataccacggcggccggcggaaacgccagcctgatgagcatgaccgaatga

SEQ ID NO: 1869 - protein, 1197 aa, Chromobacterium violaceum ATCC 12472
MQFESFAHQQSALRDAITAAYRRDERECVQALLPQAAMSPEQVASVQDLARRLVTEVRRERTRSSGVDALMHEFSLDSSEGIALMCLAEALLRIPDRETADKLIRDKISRGDWKAHLGNSSSLFVNAAAWGLLVTGKLVSSHSANGLSAAMTRLIAKGGEPLIRKGVDMAMRMLGKQFVTGETIEEALANGREREARGYRFSYDMLGEAAMTEADAQRYLKDYVTAIHAIGKESNGRGIYDGPGISVKLSAIHPRYARLKHERMMTELLPRLKALFLLAKQYNIGLNIDAEEADRLEISMDLVEALANDADLNGFEGIGIVVQAYQKRCPFVIDFLIDLARRTGHRFMVRLVKGAYWDAEIKRAQVDGLPGYPVYTRKVYTDVSYLACAKKLLAAQDAIYPQFATHNAYSLSAIYNLAAGKDYEFQCLHGMGETLYDQVVGKDKLGKACRIYAPVGSHETLLAYLVRRLLENGANSSFVNRIVDENVSIDELVTDPVAEAAGFSGMPHSKIPLPEALYGEGRRNSKGLDLSSEHVLATLQLGLQASEQQRWAAFPMLGDGDVTDGELQEVRNPADHSDVVGKVIEASAADVERALALSAGIAAAWAATPVAERAASIRRMADLMEAHMPALMGLAVREAGKTLNNAIAEVREAVDFCRYYAAQIVSEFDNASHRPLGPVVCISPWNFPLAIFIGEVVASLAAGNTVLAKPAEQTSLIAAYAVRLLHEAGIPRAALQFLPGRGEVVGAALTGDARIQGVIFTGSTEVAQIINRTLAKRQDDPVLVAETGGMNAMIVDSSALPEQVVTDVLSSAFDSAGQRCSALRVLYLQNDIADKVIAMIKGAMDELTIGNPAKLTTDVGPVIDAEAQAGLLAHIARMKNSARAMHQTKLSAACEQGTFVAPTLFEIDNLSELKREVFGPVLHVLRYAASDLDKVVAEINATGYGLTHGIHSRIDETIADICGKIKVGNIYVNRNIVGAVVGVQPFGGEGKSGTGPKAGGPYYLYRLTRAAWQPKLAAVPAAADLSALDALAAAAKAQSLALDGAIAAARKESPLTHSVALPGPTGENNLLSFAGRGRIGCVADDAQALAEQLAAAFAAGNRAVLADNELGRKFASALNGHVSLAADVLEADVDAVLYAGAKAEEARRELAARDGALVPLILRGENGYNVHRLVVERALSVNTTAAGGNASLMSMTE

SEQ ID NO: 1870 - DNA, 3981 bp, Photorhabdus luminescens subsp. laumondii TTO1
  CDS (1)..(3981): transl_table=11
atgggtagtacaacaatgggcgtgaagcttgatgaagcaacgcgtgatcgcattaaagctgcggcacaacggattgaccgcactccacattggctaattaaacaagctatttttaattatcttgaacgtcttgaaaatgatgaacagatcgctgaactctcgtccaatcaagatgttaaagaggagaagataatcgcagaagaaacggtaacagattctgctcatcaacctttcctcgacttcgctgagcatatcctgcctcaatcagtaaaacgttccgcaattactgcggcctatcgcctgccagaaacacaagccattcccatgctgttacaacaggcacaattgccggaagatcaggcacaagcaactcataagctggcttacagcattgcagaaaaattacgtaaccagaaaaacagcatgggtcgttcaggtctggttcaagggttattgcaagaattctcgctttcatctcaggaaggcgttgcactaatgtgtcttgcggaagctttactccgtatccctgataaagccactcgcgacgcgctgatccgcgacaaaatcagtaacggcaattggcattcccatctgggccaaagttcatccatgtttgtcaatgcagcaacctgggggctgctgtttaccggcaaactggtttctacccataacgaagctaaactttccaattcactgaatcgcattatcagtaagagtggcgaaccattagtgcgtaaaggcgtagatatggcaatgcgcctgatgggtgaacagtttgtgaccggagaaaccatcgctcaagcgctggcaagtgcacgtaagctggaagaaaaagggttccgttactcctacgacatgctaggtgaagccgctttaactgaggaagatgctcagaattatatggtttcctaccaacaagcaattcatgctatcgggaaagcatccaacggccgcggcatttatgaagggcccggaatttccattaagctttctgccctgcacccgcgttatagccgtgctcaatatgaacgcgtcatgaatgagctatatccacgcctgctttccctgacattacaagcacgccaatatgatgttggtatcaatattgatgccgaagaagcagatcgtctggaaatttctctcgatctgttggaaaagctctgttttgaaccgcaactggctggctggaatggcattggtttcgttattcaagcttatcagaagcgctgcccctttgttatcgatacagttattgacttagcacagcgcagccgccgccgactgatggtgcgactggtaaaaggcgcttactgggatagcgaaattaaacgtgctcaaatcgacgggctggaaggttatcccgtttacacccgcaaagtttatactgacgtttcttatctggcttgtgcccgcaaactattgtcagtacctaatctgatttatcctcagtttgctacccataacgcccatactttagctgctgtttatcatatggcgggccaaaactattatcctggccaatatgaatttcagtgtttgcatggcatgggagaaccattgtatgaacaagtggtcgggaaaatcgctgatggtaaattaaaccgcccatgccgtatttatgcaccagtaggcactcacgaaacactgttggcttatctggtccgtcgtctgttggagaacggcgctaacacctcttttgtcaaccgtatcgccgataccacattaccactggatgaactggttgccgatccagtgacaaaggtcaagaagctggccgaaaccgacggccaaatcggtcttccacatcctaaaatccctctgcctcacaatttgtatggcaaagatcgcgcaaactcagccggtttggatcttgccaacgaacatcgcctggcttctctttccagtgcactattaagttctgctaccgaagagcagtatagcgagccgcgactgggcggcaattatcaccatcaaggtgagttaccggccgccaaaccagttattaacccggcaaccccttcggatattgtcggctatgttcgtgaagcaactgaacaggaagtcagtcatgcgttggatgtcgcaacagaagctggcgcaatctggtttgcaacaccaccatcagaacgggctgccattctggttcgtgcggcggaattgatggaaaaccagatgcagccgttattaggcattttggttcgggaagccggcaaaacctttaataatgcgattgctgaagtacgtgaagcggtcgatttcctccattattacgcgggacagattcgccatgatttcgctaacgatactcatcgcccactggggccggttgtctgtatcagcccgtggaatttcccattagccatttttaccgggcagatagcggctgcattggctgccggtaacagcgtattagcaaaacctgcggaacagaccccattaattgcggcaacagcggtcaaaatactgcatcaagcaggtattccccttgatgcattgcaattattacccggccaaggtgaaaccatcggtgctcttctggtgggtgatgagagagtgcgaggtgtgatgtttactggctccactcaagtggcgagtctattacaacgtaacattgccggacgacttgatgcacaagggcgaccaacccctctggttgccgaaaccggtggcctaaatgccatgattgtcgactcttccgcgctgacagaacaagttgttatggatgtggtcgcttctgcttttgacagtgcaggtcaacgttgttctgccttgcgtatcctttgcattcaagatgatgtggcagaacgcaccatgactatgttgaaaggtgccatgtctgaatgccggatgggtaatcctgaacgcctgtctaccgatatcggcccggtcattgatgcggaagccaaagccggcattgatcgccatattcaagcaatgcgtaccaaagggcgcacgatttatcaggcagcacaagataatgtggtcgacaatcaagagtgggatcaaggcactttcgttaaaccgacactgattgaactggaaagctttgatgaattgaaacaggagattttcggcccggttctgcatgttgtccgttttaaacgtcatgaactggataaattactggatcagattaataactctaactatggtttgacccttggtgtccatacccgtattgatgaaacaattgcacaagttaccgctaaagcgaaagtcggcaatctgtatgttaaccgcaacatggtaggcgctgttgttggcgtgcaaccattcggtggtgaaggcttgtccggtaccggaccaaaagccggcggcccactctatctgtatcgtctgctctcttgccgtcctcaaaatgcgatcaaccaaacgttggaacgtcaggatgcggaatatccactggatgctaatgttcgttcagcgctaatggctccctttgatgcgctgacagaatgggcagccaatcagcacaacgaagagctaaatcagttagttcaacaatataaattgctggcacaaggtggtaccacccgtctgttgccggggccgaccggcgaacgtaatacttacaccctattacctcgtggtcaggtgctgtgtctggcggataatcaacaagatacattgatccaactggcagcaacactgtctgtaggctgtcagttgctatggcaaaatgatgaattacatcagcaactgtttcgtcaattgccagatagcgtccgtaaatcaatccatttggttcaggactggcagagtgaagatacggcattcgaagcggttatttaccacggcgactctgatcaactgcgtcaagtttgcggacaagtcgctcaacgtaaaggcattatcatttccgtacaaggttttgcccgtggagaaactaatctgctgttagaacgtctgctacatgaacgttcactgagcattaacaccgcggcagcggggggtaatgccagcctgatgactatcggttaa

SEQ ID NO: 1871 - protein, 1326 aa, Photorhabdus luminescens subsp. laumondii TTO1
MGSTTMGVKLDEATRDRIKAAAQRIDRTPHWLIKQAIFNYLERLENDEQIAELSSNQDVKEEKIIAEETVTDSAHQPFLDFAEHILPQSVKRSAITAAYRLPETQAIPMLLQQAQLPEDQAQATHKLAYSIAEKLRNQKNSMGRSGLVQGLLQEFSLSSQEGVALMCLAEALLRIPDKATRDALIRDKISNGNWHSHLGQSSSMFVNAATWGLLFTGKLVSTHNEAKLSNSLNRIISKSGEPLVRKGVDMAMRLMGEQFVTGETIAQALASARKLEEKGFRYSYDMLGEAALTEEDAQNYMVSYQQAIHAIGKASNGRGIYEGPGISIKLSALHPRYSRAQYERVMNELYPRLLSLTLQARQYDVGINIDAEEADRLEISLDLLEKLCFEPQLAGWNGIGFVIQAYQKRCPFVIDTVIDLAQRSRRRLMVRLVKGAYWDSEIKRAQIDGLEGYPVYTRKVYTDVSYLACARKLLSVPNLIYPQFATHNAHTLAAVYHMAGQNYYPGQYEFQCLHGMGEPLYEQVVGKIADGKLNRPCRIYAPVGTHETLLAYLVRRLLENGANTSFVNRIADTTLPLDELVADPVTKVKKLAETDGQIGLPHPKIPLPHNLYGKDRANSAGLDLANEHRLASLSSALLSSATEEQYSEPRLGGNYHHQGELPAAKPVINPATPSDIVGYVREATEQEVSHALDVATEAGAIWFATPPSERAAILVRAAELMENQMQPLLGILVREAGKTFNNAIAEVREAVDFLHYYAGQIRHDFANDTHRPLGPVVCISPWNFPLAIFTGQIAAALAAGNSVLAKPAEQTPLIAATAVKILHQAGIPLDALQLLPGQGETIGALLVGDERVRGVMFTGSTQVASLLQRNIAGRLDAQGRPTPLVAETGGLNAMIVDSSALTEQVVMDVVASAFDSAGQRCSALRILCIQDDVAERTMTMLKGAMSECRMGNPERLSTDIGPVIDAEAKAGIDRHIQAMRTKGRTIYQAAQDNVVDNQEWDQGTFVKPTLIELESFDELKQEIFGPVLHVVRFKRHELDKLLDQINNSNYGLTLGVHTRIDETIAQVTAKAKVGNLYVNRNMVGAVVGVQPFGGEGLSGTGPKAGGPLYLYRLLSCRPQNAINQTLERQDAEYPLDANVRSALMAPFDALTEWAANQHNEELNQLVQQYKLLAQGGTTRLLPGPTGERNTYTLLPRGQVLCLADNQQDTLIQLAATLSVGCQLLWQNDELHQQLFRQLPDSVRKSIHLVQDWQSEDTAFEAVIYHGDSDQLRQVCGQVAQRKGIIISVQGFARGETNLLLERLLHERSLSINTAAAGGNASLMTIG

SEQ ID NO: 1872 - DNA, 3801 bp, Achromobacter denitrificans
  CDS (1)..(3801): transl_table=11
atgcagatctcccagaaacactcgacagtcatggacattcactcaaagttcgatccggcatcgcgattccgcgggttcgccagcggacagccagccgcatccgagcttcgcgaacgcatcaccgcggcctgtcgaacggcggaacctgtagccgtctcagccttgcttgccatggcaaagatggagcctgaagtcgcgcgcaaggccaaccaactgtccatgcaaatagcgcagcgtctgcgtgagcgcaagaactccgcgggtcgtgcgggaatcgtgcagggcctgctgcaggagtacgcactctcttcacaggagggcgttgcgctgatgtgcctcgcggaagcactcttgcggattcccgacatggcgacgcgcgacgcgctgatcagggacaagatcgcgcgtggacattggcaggagcacgcaggccggagcccctcgttgttcatcaatgccgcaacgtgggggctgtttctgaccgggaaacttgtctccacctacagcgagtcgtcgctgtcgaccttgctcacgcggctcatcgccaagggcggcgaaccgctcattcgcaagggtgtcgacatggcgatgcggatgatgggcgagcagttcgtcaccggagaaaccatcaaggaggcgctggaccacgcgcgaggcctggaggcgcaaggtttccgctattcatacgacatgctcggcgaggcggcgatgacggccgaagacgcagaccgctaccgccagtcctacgagcgagccattcatgccatcggcgaggcatcgaacggccgaggcgtctacgagggacccggcatctcgatcaagctctcagcgctgcatccgcgttacagccgcgcgcagtacggccgagtcatggacgaactctatcccgtggtgcgcagtcttgcgctgctggctcgacgttacgacatcggtctcaacatcgacgccgaggaagccgatcgccttgaactgtcgctcgacttgctggagaagctttgcttcgaacccgccctcgcagggtggaatggcatcggcttggtgatccaggcttaccaaaagcgttgcctcttcgtgatcgaccatgtgattgaactcgcgcaacgcagccgtcatcggctgatgatccggctcgtcaagggagcctactgggacagcgagatcaagcgtgcccaggtggaggggcaggacggctttccagtttatacgcgcaaggtctacaccgacgtttcgtacctggcctgcgcgcgcaagctgctggttgctcccgcagagatctatccgcagttcgccacgcacaacgcgcacaccatggcagcgatctacaacctggcggagcccgcgaactaccagcctggtcagtatgaatttcaatgcctgcacggcatgggtgagccgctgtacgagcaggtggtcggaagcctggcggatggcaagctggggcgtccgtgccgcatctacgcacccgtgggtacacacgagacgctgttggcctacctggtgcgccggctgctcgagaacggggccaacacgtcgttcgtcaaccgcatcgccgacccgtcgattccacttgaagcgctggtggaggatcccgtcgcggccgtggagcgcatggcccaggaagagggcgaagcggggcggccgcatccttgcatcccgagcccgagcgcactctacggccaggcgcgacgcaattctcatgggctggatttgtccaacgagcagaccctgcgggggctggagccaatcctggtggacagcgcacgaacaggatggacggctgaaccgctgctcggagaatctgccgaagccgaacccacagcctggaagccggtactcaatccagccgaccatcgtgacgtggtcggaaaggtgcgcgcagccagcgagcaacaaatcgaagccgcgcttcgttcggcgacggggttcgcgccgcagtgggccgcgacgtccgccggcgatagggctttcgtactcgagcgcgccgccgacctgttgcaggaccagcttccgtatctgctggggttgctctgccgcgaagcgggaaaatcctatgccaacggtgtcgccgaagtgcgtgaggcgatcgactttctgcgcttctacgcagcacacgcacgcacggacttcgacgatccggcgcataagccgttgggacccgtggtttgcatcagcccctggaacttcccactggccatcttcgtgggccaagtctccgcggcgctggctgccggcaaccccgtcctggcgaagcccgcggagcagacatcgttgattgcggctgaggccacacggctgatgcacacggccggcgtcccgcgtgcggcgcttcaattgatcccgggccgcggctcggtcgttggggcacggatggtcgcggatgcccgggttcaaggcgtcatgttcacaggctcgacggcagtggctcgtcagctgcagcgaacgatggccgaacgactgggtccgacgggggcgccggttccgctcattgccgagacaggcgggcagaacgcaatgatcgtggactcctctgcattggtcgagcaggtcgtggcggatgtcatggcgtccgcgttcgacagtgcaggccagcgctgctccgcccttcgggttctatgtgtgcaggacgacgttgcggatcgcttgcttcatatgcttcgtggcgcgatggctgagtccaatgtcggcgacccgtcctccctgtgcaccgacgtgggacccgtgatcgaccttgcagcacgcacgacgatcgagtcccatatcgaactcatgcagagtcgcggccgtcgagtcaaccgcgcggggcgtgcagcgcacgaagtccttgaaggtggaacattcgtcctgccgacgatgattgaactggagagcatctccgagcttgagcgggaagtgttcgggcctgtactgcacgtcgtgcgatatgccaggcaggacctggacacgatgctggcgcagatcagcgcaaccggctatgggctgacgatgggcattcactcgcgcattgacgagaccatcggccgtgtggtctccagtgccaaggtcggcaacgtttatgtgaaccggaacatggtcggggcagtcgtgggtgtgcagcccttcggcggcgagggcctgtcgggcacggggccaaaggctggagggcccctctatatgtacaggcttctcgctgaaagtccgcacgatgtgctcgtgcgcgcagccgagcggggattgccaggctctgttgctgacggcagcgtgacgcaagcatcggagccgttcgaggcactgctctcctggattgagacgcatcgggaacgacctttgaccgcccgatgccggcttctcaagcggaccgccggatccgggcagatgcgcgtgctggtcgggcccaccggagagcgaaacacgtactccttgcagcctcgagttgctgcactgtgcctggctgaagacgaggactcattgttgtttcagttggctggcgcgctcgttgtgggctgccgtgccatctggccatcgaacaccgatacccaggcgctgcgagccaccttgccgttggacgttcaagcggagatcgctctcgcgcgggactgggcagcgccgaccgtggaattcgatgtcgcgctctatcaaggcagccgtgagggcctcctggcggcttcggcccggctggccgagcgccaggggccgataaccagcctgtggcggttcccgacggacagcggcaaggtgccgctggaagccctggttgtggagcaggccgtgagcacgaacacggctgccgcgggcggcaacgcaagcctgatgacgatttcttga

SEQ ID NO: 1873 - protein, 1266 aa, Achromobacter denitrificans
MQISQKHSTVMDIHSKFDPASRFRGFASGQPAASELRERITAACRTAEPVAVSALLAMAKMEPEVARKANQLSMQIAQRLRERKNSAGRAGIVQGLLQEYALSSQEGVALMCLAEALLRIPDMATRDALIRDKIARGHWQEHAGRSPSLFINAATWGLFLTGKLVSTYSESSLSTLLTRLIAKGGEPLIRKGVDMAMRMMGEQFVTGETIKEALDHARGLEAQGFRYSYDMLGEAAMTAEDADRYRQSYERAIHAIGEASNGRGVYEGPGISIKLSALHPRYSRAQYGRVMDELYPVVRSLALLARRYDIGLNIDAEEADRLELSLDLLEKLCFEPALAGWNGIGLVIQAYQKRCLFVIDHVIELAQRSRHRLMIRLVKGAYWDSEIKRAQVEGQDGFPVYTRKVYTDVSYLACARKLLVAPAEIYPQFATHNAHTMAAIYNLAEPANYQPGQYEFQCLHGMGEPLYEQVVGSLADGKLGRPCRIYAPVGTHETLLAYLVRRLLENGANTSFVNRIADPSIPLEALVEDPVAAVERMAQEEGEAGRPHPCIPSPSALYGQARRNSHGLDLSNEQTLRGLEPILVDSARTGWTAEPLLGESAEAEPTAWKPVLNPADHRDVVGKVRAASEQQIEAALRSATGFAPQWAATSAGDRAFVLERAADLLQDQLPYLLGLLCREAGKSYANGVAEVREAIDFLRFYAAHARTDFDDPAHKPLGPVVCISPWNFPLAIFVGQVSAALAAGNPVLAKPAEQTSLIAAEATRLMHTAGVPRAALQLIPGRGSVVGARMVADARVQGVMFTGSTAVARQLQRTMAERLGPTGAPVPLIAETGGQNAMIVDSSALVEQVVADVMASAFDSAGQRCSALRVLCVQDDVADRLLHMLRGAMAESNVGDPSSLCTDVGPVIDLAARTTIESHIELMQSRGRRVNRAGRAAHEVLEGGTFVLPTMIELESISELEREVFGPVLHVVRYARQDLDTMLAQISATGYGLTMGIHSRIDETIGRVVSSAKVGNVYVNRNMVGAVVGVQPFGGEGLSGTGPKAGGPLYMYRLLAESPHDVLVRAAERGLPGSVADGSVTQASEPFEALLSWIETHRERPLTARCRLLKRTAGSGQMRVLVGPTGERNTYSLQPRVAALCLAEDEDSLLFQLAGALVVGCRAIWPSNTDTQALRATLPLDVQAEIALARDWAAPTVEFDVALYQGSREGLLAASARLAERQGPITSLWRFPTDSGKVPLEALVVEQAVSTNTAAAGGNASLMTIS

SEQ ID NO: 1874 - DNA, 3957 bp, Yersinia pestis biovar Microtus str. 91001
  CDS (1)..(3957): transl_table=11
atgggcgtaaagcttgatgaagcaacacgagaccgcatcaagagtgcagcacaacgtattgaccgcacaccacactggctcattaaacaggctattttcaactacttagaaaaactggaaagtaacagtgaattgccagaactggcaacaacaagttcactctctctgcaagacacagaagatgctataccgcaactcactgaaaacactcatcagccattcttggattttgcggaacacgtgctcccgcagtcggttacccgtgccgccattactgcggcttatcgtcgcccagaaaccgaagcgatccccatgttattggaacaagcacgcctacccgcagatttagcgcaagcaacacataaactggcctattccattgctgaaaaactgcgtaatcaaaaaagtgcccatggccgcgcgggcatggtacagggattgctgcaagagttctcactctcttcacaggaaggcgtggcattgatgtgtctggctgaagccctactacgtattcctgacaagccaacccgcgatgcactgatccgcgataaaattagcaacggcaactggcattcgcatctgggacgtagcccgtcaatgtttgtcaatgcagccacttggggcctgctatttactggccgcctagtctctacccataacgaagccaaactctccggctcactgaaccgaattatcggtaaagggggtgagccgttgattcgtaaaggcgtcgatatggcgatgcgcttgatgggcgagcaattcgtcaccggtgaaaccatttcggaagcattggcaaatgcccgtaaattagaagataaagggttccgctactcttacgatatgctgggcgaagcggcattaactgaagcagatgcacaggcttacctactctcttaccaacaggcaattcatgccattggtaaagcctcaaatggccgtggtatttacgaaggcccggggatttcaatcaaactttccgccctacacccccgttatagccgtgcgcaatatgagcgagtgatggacgagttatacccgcgtctgttatcgctaacattacaggcccgtcagtatgatatcggtatcaatattgatgccgaggaggctgatcgtctggaaatctctctcgacctgttggagaggctgtgcttcgaaccccaattggcaggttggaatggcattggttttgttattcaggcataccaaaagcgttgtccgtccactattgatgccgtgattgatatggcacaacgtagccgccgccgtctgatgattcgcctcgtcaaaggggcgtattgggacagcgaaattaaacgtgctcaaattgacgggttggaaggatacccggtttatactcgtaaggtttataccgatgtgtcctatctggcctgcgcccgcaaattattggctgttccaaacctgatctatccgcaatttgcgacgcataatgcgcatactctgtcagcgatttaccaccttgccgggcaaaattactaccccggccagtatgagttccaatgcctacacggcatgggggagccactgtatgagcaagtggtcgggaaagttgccgagggtaagctcaaccgcccatgccgtatttatgctccggtcggtacccatgaaacattgctggcttaccttgtgcgccgtctgttggaaaacggtgccaacacctcgtttgtcaatcgtatcgctgatgccacattaccccttgatgaactggttgcggacccggtcagtgcggtagaagccatggcggcggctgaaggtcaacttggtttacctcatccgcgtatccccttaccacgtgagctgtttggtaaagatcgcgccaactccagcggggtggatcttgccaacgaacaccgccttgcgtcgctctccagcgcgttgctggccagtgccagccaggtatggcgtgcggagcccgtcattgatgcagagcaggacaacggtgacgcgctaccggttatcaacccggcagaacctgccgatgtggttggctatgtccgcgaggcaaccgaaggtgaagttagccgtgcattggatgctgccgcccgtgctggcgctatctggtttgccacccccccggctgaacgggctgctatcttaatccgcgccgctgagttgatggaaaatcagatgcaaacgctgatgggaatattggtgcgtgaggcgggtaaaaccttcagtaatgccatcgccgaagtccgtgaagccgtggacttcttgcattattacgccggtatagtcagggataacttcgccaatgatagccatcgcccgctcggcccggttgtttgtatcagtccgtggaacttcccactggctatctttaccggtcaggttgccgccgcgttagcagcaggcaacagtgttttggcaaaaccagcggaacaaacaccactcattgccgcacaggccgtgcgtattctgctggacgcaggcatcccacagggtgttctgcaattgctacctggccgcggtgacagtgttggcgcgctactggttaatgatgcccgtgtgcgtgcagtgatgtttaccggttctaccgaagtagccactattttacaacgtagtatcgcaggccgtcttgatccacaggggcgtccaacaccgctgatcgcggaaaccggtggcctgaatgcgatgattgttgactcttcggcactgactgaacaagttgtgaccgatgttgtcgcctctgcctttgacagtgcaggccagcgttgttctgccctgcgtattctctgcattcaggatgatgtcgctgaacatacgctgcaaatgttgcgtggtgccatggcggaatgccggatgggcaatccagaacgcctgtctacggatattggtcccgttatcgacgccgaagcgaaaactggcattgagcgccatatccaagcgatgcgagccaaagggcgtaaagtttatcaggcagcccgtaccaacagcttggatgagaaagagtggcaacgtggaacatttatcaaaccgaccttgattgaattggacagttttgatgagctgcaaaaagaagtttttggcccagtgctacatgttgtacgcttccagcgtcagcatcttaatgagttagtcgatcaaattaatgcatctggctatggcttaaccttgggcatccacacccgtattgatgaaaccatcgcccgtgtcactgaaaaagcaaaagtaggcaacctctacgttaaccgtaatatggtcggtgccgttgtcggtgtacaaccttttggtggcgaggggttatcaggtaccggtcccaaagctggcggcccattgtatttgtatcgcctgctgagtagccgcccagacgacgcactggccaataccctggcgcatcaggatggcgaacagcaacaaaatgttgcaggccgtgaagcgctgctgaccgctcaccgcgcgttcactcaatgggccacggaacaacaacatgattcgctggccactctctgccaacgctatgcctctctggcacaaggtggaaccgtgcggttattgccaggcccgaccggtgagcgcaatacctatgccctgctgcctcgtgagcgagtcctttgtcttgccgataccgaaagcgatactcttacgcagttggctgcggtgttggcgaccgggagccaggttctatggccggagaatgacgtacagaaagcactgttgcctcaattgcctactgaagtgcaatcgcggatcacccttacccacgattggcaaaccgctaacatcaccttcgatgccgttatctatcacggcgatgcggatcaactacgcacgctatgtgagcaggttgcgcaaattgatggccccattgtctctgtacaaggcttcgctcgtggtgaaaccaatatcctgctggaacgcttattaattgagcattcattgagtgtcaatacagctgccgctggtggcaacgccagtctgatgactatcggctag

SEQ ID NO: 1875 - protein, 1318 aa, Yersinia pestis biovar Microtus str. 91001
MGVKLDEATRDRIKSAAQRIDRTPHWLIKQAIFNYLEKLESNSELPELATTSSLSLQDTEDAIPQLTENTHQPFLDFAEHVLPQSVTRAAITAAYRRPETEAIPMLLEQARLPADLAQATHKLAYSIAEKLRNQKSAHGRAGMVQGLLQEFSLSSQEGVALMCLAEALLRIPDKPTRDALIRDKISNGNWHSHLGRSPSMFVNAATWGLLFTGRLVSTHNEAKLSGSLNRIIGKGGEPLIRKGVDMAMRLMGEQFVTGETISEALANARKLEDKGFRYSYDMLGEAALTEADAQAYLLSYQQAIHAIGKASNGRGIYEGPGISIKLSALHPRYSRAQYERVMDELYPRLLSLTLQARQYDIGINIDAEEADRLEISLDLLERLCFEPQLAGWNGIGFVIQAYQKRCPSTIDAVIDMAQRSRRRLMIRLVKGAYWDSEIKRAQIDGLEGYPVYTRKVYTDVSYLACARKLLAVPNLIYPQFATHNAHTLSAIYHLAGQNYYPGQYEFQCLHGMGEPLYEQVVGKVAEGKLNRPCRIYAPVGTHETLLAYLVRRLLENGANTSFVNRIADATLPLDELVADPVSAVEAMAAAEGQLGLPHPRIPLPRELFGKDRANSSGVDLANEHRLASLSSALLASASQVWRAEPVIDAEQDNGDALPVINPAEPADVVGYVREATEGEVSRALDAAARAGAIWFATPPAERAAILIRAAELMENQMQTLMGILVREAGKTFSNAIAEVREAVDFLHYYAGIVRDNFANDSHRPLGPVVCISPWNFPLAIFTGQVAAALAAGNSVLAKPAEQTPLIAAQAVRILLDAGIPQGVLQLLPGRGDSVGALLVNDARVRAVMFTGSTEVATILQRSIAGRLDPQGRPTPLIAETGGLNAMIVDSSALTEQVVTDVVASAFDSAGQRCSALRILCIQDDVAEHTLQMLRGAMAECRMGNPERLSTDIGPVIDAEAKTGIERHIQAMRAKGRKVYQAARTNSLDEKEWQRGTFIKPTLIELDSFDELQKEVFGPVLHVVRFQRQHLNELVDQINASGYGLTLGIHTRIDETIARVTEKAKVGNLYVNRNMVGAVVGVQPFGGEGLSGTGPKAGGPLYLYRLLSSRPDDALANTLAHQDGEQQQNVAGREALLTAHRAFTQWATEQQHDSLATLCQRYASLAQGGTVRLLPGPTGERNTYALLPRERVLCLADTESDTLTQLAAVLATGSQVLWPENDVQKALLPQLPTEVQSRITLTHDWQTANITFDAVIYHGDADQLRTLCEQVAQIDGPIVSVQGFARGETNILLERLLIEHSLSVNTAAAGGNASLMTIG

SEQ ID NO: 1876 - DNA, 3789 bp, Acinetobacter sp. ADP1
  CDS (1)..(3789): transl_table=11
ttgtcattggaatttggcatgaatatgatggataacgaccctcaaatggacacagcaaaacctcattttggatatatttcagaatttaaagaaaaaactgaactggagcagcatatcaacgatgcttggcgtcgtcctgaaccagaaacagttgaaactttgctacaagctgcctctatttccgatgaactcaatcataaaatttatgagctggcttttgagctagccaatggactacgtgagcgcaaaacctcttctggaaaagctggaatcgttcaaggacttttacaggagttttcgctttcttctcaggaaggtattgctttaatgtgcctggcagaagctctgctacgtattcccgatgcagccacccgagatttattgattcgagataaaatcaatcaaggcaactggaaagatcatgtgggtcagagtagcctgatgtttgtcaatgctgcagcttgggggctcatgctgacaggcaaacttatggaaacgccgaaacaaggcagtttgtctgggttattaacttcaattttggcacgtagtggtcgaggtgtgattcgtaaagcagtcgatgttgcgatgcgaatgatgggtgaacaatttgttacgggtgaaaccattgaagaagcgctcgacaatgcaaaatctcatgaacataaaggatttcgttattcctacgacatgctgggtgaagccgctctaacaacgcatgatgccgaacgttattttaatgattatacgcaggccatccatgcgattggtcaggcatcgaatggcaaaggtgtgtatgatgggccaggaatttcaattaaactttcggcactgcatccacgctaccaacgttcacaaattgcacgagtgcatgatgaactctatggcaaagtgtttaatcttgccttactctccaaaaaatatgatattggtttaaatattgatgctgaagaagcagatcgccttgagatttctttagaattacttgaacgtctatgctttgagcccgaacttgcagactggaaagggatcggttttgtgattcaagcttatcaaaagcgttgtttctacgtcgttgattatgtcgttgatctggcaaaacgtagcaaaaaacgcctgatgattcgtttggtgaaaggtgcgtattgggatagtgaaatcaaaaaagcacaaattgatggtatgcacgattatccagtctttacccgtaaagtgcatactgatttatcttatattgcttgtgccaaaaaactgttagcagcacctgagcaaatctatccgcagtttgccacgcataatgcacaatcacttgctacaatttatgaacttgctgatccaggcaaatattatgcaggccaatacgaatttcaatgcttacatggcatgggcgaacccttatacgaacaagtagtaggttctcgcagtgacaaaaaactggggattccatgccgtatctatgcacctgtaggcaatcatgaaaccttacttgcctatctggtacgtcgattgctcgaaaatggtgctaacacatcatttgtgaatcgtattgctgatcaaaatctaaaaattgaagatttaatacaatcaccttttgatgaaattgcaattaacgcacaacgtgaaggtcaagctggattaaaacatcctgccattcctttaccacacaatttgtatggatcattacgtcaaaattcgaaaggttttgatcttgccaatgatgcaactttgacagcgttgaacgaaactgcacagcagcttgaacataaagtctgggaaagtagacctttactagctcaaactgttgatcaaattgatgtaagcccgcaagcgttgctaaatccagcggttcatttagatattgtgggctacgttcaggaagcgacgcttgagcaagttgatgttgcgctcgaatctgcaactcaggctcagcaggcctgggcaaataccgagaaaaaccatcgggcagctacactcaagaaagcggcaaacttgatggaatcacgtatgcaggaactcatggtcttgctgtgccgtgaagcaggtaaaacttatgcaaacgcaatttcagaagttcgtgaagcagtagatttcttacgttattatgccactcaaatcgaaagtctgaagcctactgctcaaatcgagccgttaggtacagtcctgtgcattagcccctggaactttccattggcaatttttacaggccagattgctgcggcacttggtgctggaaactgtgtcattgcaaaacctgccgaacagacaccattaattgcggcacaggctgtacatattttacatgaagcgggtattcctaaaagtgtactacagcttttaccaggccgtggtgaaactgtcggcgccaagctcagtagtgaccagcgtattcaaggtgtcatgtttactggctcaacagaagttgccaagattttgcaaaaaacggtagcaaaacgactttcgccttctggtcatcctattcctttaattgcggaaactggtggtcaaaatgccatgattgtcgactcatctgccttgacagagcaagtggtgattgatgtcttgaattcagcttttgacagtgcaggtcaacgttgttcagctttacgtattttatgcgtacaagaagacaattcaaaaacactagtgactatgctcaaaggtgcaatgcagcaactgattatgggtaatccatttctgctcaaaaccgatattggtccagtgattgatttagaggcaaaacaaaccattgatcaacatattcagaaaatgcgcagcaaaggttatcccgtatatcagttaatttttaatcatgaagcagcatcgcaagcgcaattgagccaaggaacatttgtcactccaaccttgattgaattacccaatcttgatgatctggaacgtgaagtatttggccctgtgttacatgtcattacttataaacatggtgaaataaaacagctacttcaacatattaatgccaaaggttatggtttgactatgggattgcatactcgtatcgatgaaaccatcaatacagtggtacaacatgccgaagtgggtaatctttacattaatcgtaatatcgtgggtgcagtggtaggtgtacaaccatttgggggtgaaggcttatcaggtacagggcctaaagcaggtggtccgctttacttatatcgtttaatggcatcttgcacagaaaaagcaatacagactccttttggtataccagcagaaaatgttgcagtgccattaacgcaactctcgttattccgcgagttttcggcgtggattaaaaagcagtatcctgcccatcaacttcctaatgtcgtgccattgaatgtcggtcatgcttttgacctacaaggcccgacaggtgaaaccaaccgctatatgatgttgccacgtaaacgtatactggcaatagcaagtaatgaattggaactatgtcatcaaatgctggcgatatttgcagtaaacagtcaagttgctttattagaaagtaatccttctttgcaaaaatttggacaggatttacccacagtagttcgtcaggcgattattgaaattcgtggtgttgagcatggcgattttgatgcagtcttacatcatggttcaactgaggagttgcaagttttacaaacacagattgcaaatcgtcaaggtccgattgtcggcattactcatttgcaaaattcagagcaagtcattccactcgagcgtctcgtcattgaacatgctattagtgtaaatacggcagcggctggtggtaatgcgagtttgatgaccatgtcggagtaa

SEQ ID NO: 1877 - protein, 1262 aa, Acinetobacter sp. ADP1
MSLEFGMNMMDNDPQMDTAKPHFGYISEFKEKTELEQHINDAWRRPEPETVETLLQAASISDELNHKIYELAFELANGLRERKTSSGKAGIVQGLLQEFSLSSQEGIALMCLAEALLRIPDAATRDLLIRDKINQGNWKDHVGQSSLMFVNAAAWGLMLTGKLMETPKQGSLSGLLTSILARSGRGVIRKAVDVAMRMMGEQFVTGETIEEALDNAKSHEHKGFRYSYDMLGEAALTTHDAERYFNDYTQAIHAIGQASNGKGVYDGPGISIKLSALHPRYQRSQIARVHDELYGKVFNLALLSKKYDIGLNIDAEEADRLEISLELLERLCFEPELADWKGIGFVIQAYQKRCFYVVDYVVDLAKRSKKRLMIRLVKGAYWDSEIKKAQIDGMHDYPVFTRKVHTDLSYIACAKKLLAAPEQIYPQFATHNAQSLATIYELADPGKYYAGQYEFQCLHGMGEPLYEQVVGSRSDKKLGIPCRIYAPVGNHETLLAYLVRRLLENGANTSFVNRIADQNLKIEDLIQSPFDEIAINAQREGQAGLKHPAIPLPHNLYGSLRQNSKGFDLANDATLTALNETAQQLEHKVWESRPLLAQTVDQIDVSPQALLNPAVHLDIVGYVQEATLEQVDVALESATQAQQAWANTEKNHRAATLKKAANLMESRMQELMVLLCREAGKTYANAISEVREAVDFLRYYATQIESLKPTAQIEPLGTVLCISPWNFPLAIFTGQIAAALGAGNCVIAKPAEQTPLIAAQAVHILHEAGIPKSVLQLLPGRGETVGAKLSSDQRIQGVMFTGSTEVAKILQKTVAKRLSPSGHPIPLIAETGGQNAMIVDSSALTEQVVIDVLNSAFDSAGQRCSALRILCVQEDNSKTLVTMLKGAMQQLIMGNPFLLKTDIGPVIDLEAKQTIDQHIQKMRSKGYPVYQLIFNHEAASQAQLSQGTFVTPTLIELPNLDDLEREVFGPVLHVITYKHGEIKQLLQHINAKGYGLTMGLHTRIDETINTVVQHAEVGNLYINRNIVGAVVGVQPFGGEGLSGTGPKAGGPLYLYRLMASCTEKAIQTPFGIPAENVAVPLTQLSLFREFSAWIKKQYPAHQLPNVVPLNVGHAFDLQGPTGETNRYMMLPRKRILAIASNELELCHQMLAIFAVNSQVALLESNPSLQKFGQDLPTVVRQAIIEIRGVEHGDFDAVLHHGSTEELQVLQTQIANRQGPIVGITHLQNSEQVIPLERLVIEHAISVNTAAAGGNASLMTMSE

SEQ ID NO: 1878 - DNA, 3969 bp, Erwinia carotovora subsp. atroseptica SCRI1043
  CDS (1)..(3969): transl_table=11
atgggctctaccacgatgggtgtaaaactcgatgaggaaacgcgcgagcgtatcaaggtcgctgcacagcgtattgatcgcacaccgcactggttgatcaaacaggctattttccattacctcgaacgcctcgaaagtggcctcgacactcctgaaacaccgcaatcggcgaacatcagccgcattgaagcggaagagattatgccgcaatctcgggaagaagaaacccaccaaccctttcttgatttcgccgaacaggttcttccccagtcagttacccgcgccgcgatgacttctgcttatcgccgtcctgaaagtgaactggtgccgatattgcttgaacaggcaagacttaccgacgaaatgtcgcagttaacccagaaactggcttatcgactggcagagaaattacgcagtcagaagctcggaaatggtcgtgctggcattgtgcaagggctgctgcaggaattttcactttcttctcaggaaggcgtggcgctgatgtgtttggccgaagcgttgctgcgtattcctgataaatccacgcgcgatgcgctgatccgcgacaaaatcagccgagggaactggcaggcgcatcttggccacagcccatcgctttttgtgaatgctgcaacctgggggctactgttcaccggaaagctggtggcaacacacaatgaagcgaatctatctaattcactgaaccgcatcatcggtaaacgtggtgagccgctcgtccgcaagggtgtcgatatggccatgcggctgatgggggagcagtttgtcaccggggaaactatcggtgaggcgttggctaacgcccgtgaacgggaaaataaaggcttccgctactcttacgatatgttaggcgaagcggcgctgacggcgcacgatgctgccgcctatctgacggcctatcagcaggcgattcatgctattggcaaagcctcgaacgggcgtggaatttacgaagggccaggtatctccatcaagttgtcggcactgcacacgcgctatagccgtgcgcagtatgatcgtgtaatcgatgagttgtacccacggttgttatcactgacgctgctggcgcggcagtacgatatcgggatcaatattgatgcagaggaagcagatcgactggagatctcactcgatctactggaaaaactctgtatggagcctcagttggtggggtggaatggcattggatttgtgattcaggcttatcagaaacgctgcccgtatgttatcgatgagctgattgagctggcacagcgtagccatcggcggctgatgattcgtctggtgaaaggggcgtactgggacagtgaaatcaaacgggcgcaggttgacgggctggaaggctacccggtctacacgcgcaaggtttataccgatgtgtcttatctggcctgcgcccgcaagctattggctgtgcccaatctgatttacccgcagttcgccacgcataatgcacagacgttaagcgcgatttaccacatggcgggcaacaattattatcctggtcagtatgaattccagtgcctgcacggcatgggggaaccgctctatgatcaggtcgttggcgctgttgcggatggcaagttaaaccgtccatgtcgcatctacgccccggtcggaacccatgaaacgttgctggcttacctggtgcgacgcctgttggaaaacggcgcgaatacctcatttgttaatcgcattgcggatacgtcaatggcgctggaaacactcattgccgatccgattagcggcgtagaggcgttggcaaaagtggaatggagcatgggcgcaccgcatcctcgcattcctctgccgcgtcagctatatggccaggagcggaaaaattcgagcgggctggatctctcgaatgaacatcgattggcttcgctctccagcgcgttgctgagtcatgcggtgcagtcgtggtatgccgagccgatgattgagggtgagagtgaggcgagcgaacaaaaacctgtggtgaatcctgccgatgttcatgatgtggtgggctatgtacgtgatgcctccaccgccgatgttgaattggcgctagcggcggcggtacgtgccggtaccatttggtttgcgacaccggccacagagcgtgcggcaatattgaatcgagccgcatcgctgatggaagggcagttgcaaagcctgctggggttgctagtgcgggaagcgggtaaatccttcagtaacgcgattgcggaagtgcgtgaagcggtagatttcttacgctattacgcgggtcaggttcgggataccttcgccaatgatacttatcgtccgctggggccagtcgtctgtattagtccgtggaatttcccgctggcgatcttcaccggacaaatttctgccgcattggcggcaggaaacagcgtattggcgaaaccggctgaacaaacgccgttgattgcgacacaggccgtgcgtattttgcatgaagcgggtgttcccacgggtgtattgcaactgctgccgggacagggggaaacgatcggtgctgcgttggtgaacgacgaacgggtacgcggcgtggtgtttaccggttcgacagccgtggccaaaattctgcaacgcagcattgcgggtcggttagatccacagggacgtttgacgccgctgattgccgaaacggggggcctgaatgccatgattgtcgattcgtccgcgctgacggaacaggtggtgaatgatgtgattgcttcagcgttcgacagcgccggacagcgttgttcggcactgcgtcttttgtgcctgcaagaggatatcgcggatcgcacgctgactatgctgcgtggcgcgatggcggagtgccgaatggggaatcctgagcggttatcaaccgatatcggcccgctgattgatgccgaggcgaaagaaaacgtggagcggcatattcaaacgatgcgggcgaaaggtcatacggtgtatcaggcggtgtatccgcaggatgacgcagcgtggctgcgggggacgtttgtgaagccgacgctgattgaattgaatgacattagtgagctggaaaaagaagtttttggtccagttttacacatcgttcgttatcaaagccagcagttggatacgctaattgaacagattaacgcagcgggctacggcctgacgctaggcgtgcatacacgcattgatgaaaccatccaacgagtgacgaacagggcaaaagtgggtaaccagtacgtgaaccgcaatatggtgggagccgttgtcggcgtccagccttttggcggggaaggcttatcaggaactgggccaaaagcaggagggccgctttacctgtatcgactgctggcacaccgaccggacgacgcgcttgcggcagaattcgccaagcagaaccgtgagcaggcaccagatacctctgcccgagcattgctgttggcgggactacaggcgttggaagactgggcgattagcggagagcatcaggatctggcgaccctgtgtcagcgttataaagaatatagcgtcagcggaacaacgcgacggttgctcggtccgacaggagagagtaatacctacacgctgctgccgcgcgagcggatattgtgcctggcggacaatgatgaggatcgcttgattcaggcggctgcggtgctggcaacgggtgggaaactgctgtggccggaaggtgaacaggagaaaacgctctatgctcgcttgccggaagagttgcagtcgcgtattcagttcacacatggctggcaacggcacgaggtgtcttttcagggcgttatcttccatgggaatgccgatcggttacgtcagatcagcgaggcgctcgcagaacgcgatggcccgattattctgctgctgggctattcgaatggtgatacccatgttcaactggaacgtctgttgattgaacgctctctgagcattaatactgctgccgcgggcggtaatgccagcctgatgacgataggctag

SEQ ID NO: 1879 - protein, 1322 aa, Erwinia carotovora subsp. atroseptica SCRI1043
MGSTTMGVKLDEETRERIKVAAQRIDRTPHWLIKQAIFHYLERLESGLDTPETPQSANISRIEAEEIMPQSREEETHQPFLDFAEQVLPQSVTRAAMTSAYRRPESELVPILLEQARLTDEMSQLTQKLAYRLAEKLRSQKLGNGRAGIVQGLLQEFSLSSQEGVALMCLAEALLRIPDKSTRDALIRDKISRGNWQAHLGHSPSLFVNAATWGLLFTGKLVATHNEANLSNSLNRIIGKRGEPLVRKGVDMAMRLMGEQFVTGETIGEALANARERENKGFRYSYDMLGEAALTAHDAAAYLTAYQQAIHAIGKASNGRGIYEGPGISIKLSALHTRYSRAQYDRVIDELYPRLLSLTLLARQYDIGINIDAEEADRLEISLDLLEKLCMEPQLVGWNGIGFVIQAYQKRCPYVIDELIELAQRSHRRLMIRLVKGAYWDSEIKRAQVDGLEGYPVYTRKVYTDVSYLACARKLLAVPNLIYPQFATHNAQTLSAIYHMAGNNYYPGQYEFQCLHGMGEPLYDQVVGAVADGKLNRPCRIYAPVGTHETLLAYLVRRLLENGANTSFVNRIADTSMALETLIADPISGVEALAKVEWSMGAPHPRIPLPRQLYGQERKNSSGLDLSNEHRLASLSSALLSHAVQSWYAEPMIEGESEASEQKPVVNPADVHDVVGYVRDASTADVELALAAAVRAGTIWFATPATERAAILNRAASLMEGQLQSLLGLLVREAGKSFSNAIAEVREAVDFLRYYAGQVRDTFANDTYRPLGPVVCISPWNFPLAIFTGQISAALAAGNSVLAKPAEQTPLIATQAVRILHEAGVPTGVLQLLPGQGETIGAALVNDERVRGVVFTGSTAVAKILQRSIAGRLDPQGRLTPLIAETGGLNAMIVDSSALTEQVVNDVIASAFDSAGQRCSALRLLCLQEDIADRTLTMLRGAMAECRMGNPERLSTDIGPLIDAEAKENVERHIQTMRAKGHTVYQAVYPQDDAAWLRGTFVKPTLIELNDISELEKEVFGPVLHIVRYQSQQLDTLIEQINAAGYGLTLGVHTRIDETIQRVTNRAKVGNQYVNRNMVGAVVGVQPFGGEGLSGTGPKAGGPLYLYRLLAHRPDDALAAEFAKQNREQAPDTSARALLLAGLQALEDWAISGEHQDLATLCQRYKEYSVSGTTRRLLGPTGESNTYTLLPRERILCLADNDEDRLIQAAAVLATGGKLLWPEGEQEKTLYARLPEELQSRIQFTHGWQRHEVSFQGVIFHGNADRLRQISEALAERDGPIILLLGYSNGDTHVQLERLLIERSLSINTAAAGGNASLMTIG

SEQ ID NO: 1880 - DNA, 3972 bp, Yersinia pseudotuberculosis IP 32953
  CDS (1)..(3972): transl_table=11
atggcgagtaccacaatgggcgtaaagcttgatgaagcaacacgagaccgcatcaagagtgcagcacaacgtattgaccgcacaccacactggctcattaaacaggctattttcaactacttagaaaaactagaaagtaacagtgaattgccagaactggcaacaacaagttcactctctctgcaagacacagaagatgctataccgcaactcactgaaaacactcatcagccattcttggattttgcggaacacgtgctcccgcagtcggttacccgtgccgccattactgcggcttatcgtcgcccagaaaccgaagcgatccccatgttattggaacaagcacgcctacccgcagatttagcgcaagcaacacataaactggcctattccattgctgaaaaactgcgtaatcaaaaaagtgcccatggccgcgcgggcatggtacagggattgctgcaagagttctcactctcttcacaggaaggcgtggcattgatgtgtctggctgaagccctactacgtattcctgacaagccaacccgcgatgcactgatccgcgataaaattagcaacggcaactggcattcgcatctgggacgtagcccgtcaatgtttgtcaatgcagccacttggggcctgctatttactggccgcctagtctctacccataacgaagccaaactctccggctcactgaaccgaattatcggtaaagggggtgagccgttgattcgtaaaggcgtcgatatggcgatgcgcttgatgggcgagcaattcgtcaccggtgaaaccatttcggaagcattggcaaatgcccgtaaattagaagataaagggttccgctactcttacgatatgctgggcgaagcggcattaactgaagcagatgcacaggcttacctactctcttaccaacaggcaattcatgccattggtaaagcctcaaatggccgtggtatttacgaaggcccggggatttcaatcaaactttccgccctacacccccgttatagccgtgcgcaatatgagcgagtgatggacgagttatacccgcgtctgttatcgctaacattacaggcccgtcagtatgatatcggtatcaatattgatgccgaggaagctgatcgtctggaaatctctctcgacctgttggagaggctgtgcttcgaaccccaattggcaggttggaatggcattggttttgttattcaggcataccaaaagcgttgtccgtccactattgatgccgtgattgatatggcacaacgtagccgccgccgtctgatgattcgcctcgtcaaaggggcgtattgggacagcgaaattaaacgtgctcaaattgacgggttggaaggatacccggtttatactcgtaaggtttataccgatgtgtcctatctggcctgcgcccgcaaattattggctgttccaaacctgatctatccgcaatttgcgacgcataatgcgcatactctgtcagcgatttaccaccttgccgggcaaaattactaccccggccagtatgagttccaatgcctacacggcatgggggagccactgtatgagcaagtggtcgggaaagttgccgagggtaagctcaaccgcccatgccgtatttatgctccggtcggtacccatgaaacattgctggcttaccttgtgcgccgtctgttggaaaacggtgctaacacctcgtttgtcaatcgtatcgctgatgccacattaccccttgatgaactggttgcggacccggtcagtgcggtagaagccatggcggcggctgaaggtcaacttggtttacctcatccgcgtatccccttaccacgtgagctgtttggtaaagatcgcgccaactccagcggggtggatcttgccaacgaacaccgccttgcgtcgctctccagcgcgttgctggccagtgccagccaggtatggcgtgcggagcccgtcattgatgcagagcaggacaacggtgacgcgctaccggttatcaacccggcagaacctgccgatgtggttggctatgtccgcgaggcaaccgaaggtgaagttagccgtgcattggatgctgccgcccgtgctggcgctatctggtttgccacccccccggctgaacgggctgctatcttaatccgcgccgctgagttgatggaaaatcagatgcaaacgctgatgggaatactggtgcgtgaggcgggtaaaaccttcagtaatgccatcgccgaagtccgtgaagccgtggacttcttgcattattacgccggtatagtcagggataacttcgccaatgatagccatcgcccgctcggcccggttgtttgtatcagtccgtggaacttcccactggctatctttaccggtcaggttgccgccgcgttagcagcaggcaacagtgttttggcaaaaccagcggaacaaacaccactcattgccgcacaggccgtgcgtattctgctggacgcaggcatcccacagggtgttctgcaattgctacctggccgcggtgacagtgttggcgcgctactggttaatgatgcccgtgtgcgtgcagtgatgtttaccggttctaccgaagtagccactattttacaacgtagtatcgcaggccgtcttgatccacaggggcgtccaacaccgctgatcgcggaaaccggtggcctgaatgcgatgattgttgactcctcggcactgactgaacaagttgtgaccgatgttgtcgcctctgcctttgacagtgcaggccagcgttgttctgccctgcgtattctctgcattcaggatgatgtcgctgaacatacgctgcaaatgttgcgtggtgccatggcggaatgccggatgggcaatccagaacgcctgtctacggatattggtcccgttatcgacgccgaagcgaaaactggcattgagcgccatatccaagcgatgcgagccaaagggcgtaaagtttatcaggcagcccgtaccaacagcttggatgagaaagagtggcaacgtggaacatttatcaaaccgaccttgattgaattggacagttttgatgagctgcaaaaagaagtttttggcccagtgctacatgttgtacgcttccagcgtcagcatcttaatgagttagtcgatcaaattaatgcatctggctatggcttaaccttgggcatccacacccgtattgatgaaaccatcgcccgtgtcactgaaaaagcaaaagtaggcaacctctacgttaaccgtaatatggtcggtgccgttgtcggtgtacaaccttttggtggcgaggggttatcaggtaccggtcccaaagctggcggcccattgtatttgtatcgcctgctgagtagccgcccagacgacgcactggccaataccctggcgcatcaggatggcgaacagcaacaaaatgttgcaggccgtgaagcgctgctgaccgctcaccgcgcgttcactcaatgggccacggaacaacaacatgattcgctggccactctctgccaacgctatgcctctctggcacaaggtggaaccgtgcggttattgccaggcccgaccggtgagcgcaatacctatgccctgctgcctcgtgagcgagtcctttgtcttgccgataccgaaagcgatactcttacgcagttggctgcggtgttggcgaccgggagccaggttctatggccggagaatgacgtacagaaagcactgttgcctcaattgcctactgaagtgcaatcgcggatcacccttacccacgattggcaaaccgctaacatcaccttcgatgccgttatctatcacggcgatgcggatcaactacgcacgctatgtgagcaggttgcgcaaattgatggccccattgtctctgtacaaggcttcgctcgtggtgaaaccaatatcctgctggaacgcttattaattgagcattcattgagtgtcaatacagctgccgctggtggcaacgccagtctgatgactatcggctag

SEQ ID NO: 1881 - protein, 1323 aa, Yersinia pseudotuberculosis IP 32953
MASTTMGVKLDEATRDRIKSAAQRIDRTPHWLIKQAIFNYLEKLESNSELPELATTSSLSLQDTEDAIPQLTENTHQPFLDFAEHVLPQSVTRAAITAAYRRPETEAIPMLLEQARLPADLAQATHKLAYSIAEKLRNQKSAHGRAGMVQGLLQEFSLSSQEGVALMCLAEALLRIPDKPTRDALIRDKISNGNWHSHLGRSPSMFVNAATWGLLFTGRLVSTHNEAKLSGSLNRIIGKGGEPLIRKGVDMAMRLMGEQFVTGETISEALANARKLEDKGFRYSYDMLGEAALTEADAQAYLLSYQQAIHAIGKASNGRGIYEGPGISIKLSALHPRYSRAQYERVMDELYPRLLSLTLQARQYDIGINIDAEEADRLEISLDLLERLCFEPQLAGWNGIGFVIQAYQKRCPSTIDAVIDMAQRSRRRLMIRLVKGAYWDSEIKRAQIDGLEGYPVYTRKVYTDVSYLACARKLLAVPNLIYPQFATHNAHTLSAIYHLAGQNYYPGQYEFQCLHGMGEPLYEQVVGKVAEGKLNRPCRIYAPVGTHETLLAYLVRRLLENGANTSFVNRIADATLPLDELVADPVSAVEAMAAAEGQLGLPHPRIPLPRELFGKDRANSSGVDLANEHRLASLSSALLASASQVWRAEPVIDAEQDNGDALPVINPAEPADVVGYVREATEGEVSRALDAAARAGAIWFATPPAERAAILIRAAELMENQMQTLMGILVREAGKTFSNAIAEVREAVDFLHYYAGIVRDNFANDSHRPLGPVVCISPWNFPLAIFTGQVAAALAAGNSVLAKPAEQTPLIAAQAVRILLDAGIPQGVLQLLPGRGDSVGALLVNDARVRAVMFTGSTEVATILQRSIAGRLDPQGRPTPLIAETGGLNAMIVDSSALTEQVVTDVVASAFDSAGQRCSALRILCIQDDVAEHTLQMLRGAMAECRMGNPERLSTDIGPVIDAEAKTGIERHIQAMRAKGRKVYQAARTNSLDEKEWQRGTFIKPTLIELDSFDELQKEVFGPVLHVVRFQRQHLNELVDQINASGYGLTLGIHTRIDETIARVTEKAKVGNLYVNRNMVGAVVGVQPFGGEGLSGTGPKAGGPLYLYRLLSSRPDDALANTLAHQDGEQQQNVAGREALLTAHRAFTQWATEQQHDSLATLCQRYASLAQGGTVRLLPGPTGERNTYALLPRERVLCLADTESDTLTQLAAVLATGSQVLWPENDVQKALLPQLPTEVQSRITLTHDWQTANITFDAVIYHGDADQLRTLCEQVAQIDGPIVSVQGFARGETNILLERLLIEHSLSVNTAAAGGNASLMTIG

SEQ ID NO: 1882 - DNA, 3930 bp, Burkholderia mallei ATCC 23344
  CDS (1)..(3930): transl_table=11
atggcaagcaccacactgggcgtcaaagtcgacgatctgctgcgcgcgcgtctgaaggacgcggcgtcgcggctcgagcgcactcctcactggctgatcaagcaggcgatcttcgcgtatctcgagcggatcgagcatggtcagcttccgccggagctctccggccacacgggcgtcaccgatctgtccgacagccacgccgacggcgacgacgacggcgcgccgcacccgttcctcgaattcgcgcagagcgtgcagccgcagtcggtgctgcgcgcggcgatcacggccgcgtaccggcggccggagcccgaatgcgtgccgttcctgatcggcgaggcgcggctgcccgcgagcctcgcgtcggacgtgcaggcaatggcggcgggccttgtcgaggcgctgcgcgagaagagctcgggcggcggcgtcgaggggctgatccatgaattctcgctgtcgagccaggagggcgtcgcgctgatgtgcctcgccgaggcgctgctgcggattcccgatcgcgcgacgcgcgacgcgctgattcgcgacaagatcagcaagggcgactggcgctcgcacgtcggccacgcgccgtcgctgttcgtcaacgcggccacctggggcctgatgatcaccggcaagctcgtcacgacgaacagcgaggcgggcctgtcgtcggcgctcacgcggctgatcggcaagggcggcgagccgttgatccgaaagggcgtcgacatggcgatgcgcctgatgggcgagcagttcgtcacgggcgagacgatctccgaagcgctcgcgaacagccgcaagtacgaggcgcgcggcttccgttactcgtacgacatgctcggcgaagcggcgaccaccgaagaggacgcgctgcgctactacgcgtcgtacgagcaggcgatccacgcgatcggcaaggcggcgggcggccgcggcatctacgagggcccgggcatctcgatcaagctctcggcgctgcatgcgcgctactcgcgctcccagcaggaacgcacgatgaacgagctgctgccgcgcgtgcgctcgctcgcgctgctcgcgcgccgctatgacatcggcctgaacatcgacgccgaggaggcggaccggctcgagctctcgctcgatctgctcgaggcgctgtgcttcgatccggagctcgccggctggaacggcatcggcttcgtcgtgcaggcgtaccagaagcgctgcccgttcgtgatcgactaccttgtcgacctcgcgcgccgcagccgccatcgcctgatgatccgcctcgtgaagggcgcgtactgggattccgagatcaagcgcgcgcaggtggacggcctcgaaggctatccggtctatacgcgcaagatctacaccgacgtgtcctacctcgcgtgcgcgaagaagctgctcgccgcgccggacgccgtgtatccgcagttcgcgacgcacaacgcgtacacgctcgccgcgatctatcacctcgcgggccagaactactaccccggccagtacgagttccagtgcctgcacgggatgggcgagccgctgtacgaggaagtcaccggccgcgacaagctgaaccgcccatgccgcgtgtacgcgcccgtcggcacgcacgagacgctgcttgcgtatctcgtgcgccgcctgctggagaacggcgcgaacacgtcgttcgtgaaccggatcgccgacaagaccgtgtcggtgaaggaactggtggccgatccggtcgaggatgcgctgaaggtcgtgccgctcggcgcgccgcacgcgaagattgcgctgccgcgcgagctgtacggcgcgtcgcgcgtcaattcgatgggcctcgatctgtcgaacgagcaccggctcgcgtcgctgtcgtcggcgctgctcgcgagcgcgcatcatccgtggcgcgccgcgccgatgctcgccgacgacgcgctcgcccacgccgcgccgcgcgacgtgcgcaatccggccgatctgcgcgacgtcgtcggcacggtgagcgaagcgacgcccgacgaggtgagcgcggcgctcgcgcacgcggtcgcggccgcgccgatctggcaggcgacgcccgtcgacgcgcgcgcggactgcctcgcgcgcgcggcggacctgctcgaagcgcagatgcacacgctgatgggcctgatcgtgcgcgaggcgggaaaatcgctgccgaacgcgatcgccgagatccgcgaagcggtcgacttcctgcgctactactcggcgcagatccgcgacgaattctcgaacgacacgcaccgcccgctcggccccgtcgtctgcatcagcccgtggaacttcccgctcgcgatcttcatgggccaggtcgcagccgccctggcggcgggcaacacggtgctcgcgaagccggccgagcagacgccgctgatcgccgcgcaggcggtgcgcctgctgcgcgacgccggcgtgccggcgggcgcggtgcaactgctgccgggcaacggcgagacggtgggcgcggcgctcgtggcggacccccgcacgcgcgcggtgatgttcaccggctcgaccgaagtcgcgcgcctcatcaacaagacgctgtcgtcgcgcctcgatccggacggcaggccgatcccgctgatcgccgagacgggcggccagaacgcgatgatcgtcgattcgtcggcgctcgccgagcaggtggtcgccgacgtgctgcagtcgtcgttcgactcggccggtcaacgctgttcggcgctgcgcgttctgtgtctgcaggacgacgtcgcggatcgcacgctgacgatgctcaagggcgcgatgcgcgagctcgcgctcggcaatccggaccggctgtcggtggacgtcggcccggtgatcgacgccgacgcgaagcgcacgatcgacacacacatcgcggcgatgaaggacaaggggcacgcggtcacgcagctcgagatgccggacgcatgcgcgcagggcacgttcgtgccgccgacgatcatcgagatcggcaacgtcgacgagctcaagcgtgaagtgttcggcccggtgctgcacgtcgtgcgttatcgccgcagcggcctcgacaagctgctcgagcagatccgcgcgacgggctatgggctcacgctcggcattcacacgcggatcgacgagacgatcgcgcacgtgatctcgcgcgcgcacgtcggcaacatctacgtgaaccgcaacgtgatcggcgcggtggtgggcgtgcagccgttcggcggcgaagggctgtcgggcacggggccgaaggcgggcggcgcgctctacttgcagcgcctgctcgcgacgcgcccggccgggctgccgcgctcgctcgaggcggcgctcgtcgccgatgcgccgcaggaaggcgagacgcgcgataatccatccgctgcgctcaccgcgctgcgcgactggctgatcgagcagcgcgagccggcgctcgccgcgcgctgcgacggctatctgtcgcacgtgctcgcgggcgcaaccgccgtgctttcagggccgacgggcgagcgcaatacgtatacactcggcgcgcgcggcacggtgctgtgcatcgcggcgacggcaagcggcgcgcgcgcgcagttcgcggcggcgctcgccaccggcaaccgcgcgcttttcgcgggcgcggcgggcgaggcgctcgccgcggcgctgccggcgcaactgaaggcgcacgcgggcgtgagaaagcaggcggacgcggcgttcgacgcggtgctgttcgaaggcgacagcgacgagttgctcgcgctcgtgaaggaagtcgcgcagcgcccggggccgatcgtgtcggtgcagggcgtcgcggcgggcgcgttcgagaacggcggcgacgaagactacgcgctcgagcggctcctcaccgagcgctcggtgagcgtgaacaccgcggcggcaggcggcaatgcgaatttgatgacgattggctga

SEQ ID NO: 1883 - protein, 1309 aa, Burkholderia mallei ATCC 23344
MASTTLGVKVDDLLRARLKDAASRLERTPHWLIKQAIFAYLERIEHGQLPPELSGHTGVTDLSDSHADGDDDGAPHPFLEFAQSVQPQSVLRAAITAAYRRPEPECVPFLIGEARLPASLASDVQAMAAGLVEALREKSSGGGVEGLIHEFSLSSQEGVALMCLAEALLRIPDRATRDALIRDKISKGDWRSHVGHAPSLFVNAATWGLMITGKLVTTNSEAGLSSALTRLIGKGGEPLIRKGVDMAMRLMGEQFVTGETISEALANSRKYEARGFRYSYDMLGEAATTEEDALRYYASYEQAIHAIGKAAGGRGIYEGPGISIKLSALHARYSRSQQERTMNELLPRVRSLALLARRYDIGLNIDAEEADRLELSLDLLEALCFDPELAGWNGIGFVVQAYQKRCPFVIDYLVDLARRSRHRLMIRLVKGAYWDSEIKRAQVDGLEGYPVYTRKIYTDVSYLACAKKLLAAPDAVYPQFATHNAYTLAAIYHLAGQNYYPGQYEFQCLHGMGEPLYEEVTGRDKLNRPCRVYAPVGTHETLLAYLVRRLLENGANTSFVNRIADKTVSVKELVADPVEDALKVVPLGAPHAKIALPRELYGASRVNSMGLDLSNEHRLASLSSALLASAHHPWRAAPMLADDALAHAAPRDVRNPADLRDVVGTVSEATPDEVSAALAHAVAAAPIWQATPVDARADCLARAADLLEAQMHTLMGLIVREAGKSLPNAIAEIREAVDFLRYYSAQIRDEFSNDTHRPLGPVVCISPWNFPLAIFMGQVAAALAAGNTVLAKPAEQTPLIAAQAVRLLRDAGVPAGAVQLLPGNGETVGAALVADPRTRAVMFTGSTEVARLINKTLSSRLDPDGRPIPLIAETGGQNAMIVDSSALAEQVVADVLQSSFDSAGQRCSALRVLCLQDDVADRTLTMLKGAMRELALGNPDRLSVDVGPVIDADAKRTIDTHIAAMKDKGHAVTQLEMPDACAQGTFVPPTIIEIGNVDELKREVFGPVLHVVRYRRSGLDKLLEQIRATGYGLTLGIHTRIDETIAHVISRAHVGNIYVNRNVIGAVVGVQPFGGEGLSGTGPKAGGALYLQRLLATRPAGLPRSLEAALVADAPQEGETRDNPSAALTALRDWLIEQREPALAARCDGYLSHVLAGATAVLSGPTGERNTYTLGARGTVLCIAATASGARAQFAAALATGNRALFAGAAGEALAAALPAQLKAHAGVRKQADAAFDAVLFEGDSDELLALVKEVAQRPGPIVSVQGVAAGAFENGGDEDYALERLLTERSVSVNTAAAGGNANLMTIG

SEQ ID NO: 1884 - DNA, 3930 bp, Burkholderia pseudomallei K96243
  CDS (1)..(3930): transl_table=11
atggcaagcaccacactgggcgtcaaagtcgacgatctgctgcgcgcgcgtctgaaggacgcggcgtcgcggctcgagcgcactcctcactggctgatcaagcaggcgatcttcgcgtatctcgagcggatcgagcatggtcagcttccgccggagctctccggccacacgggcgtcgccgatctgtccgacagccacgccgacggcgacgacgacggcgcgccgcacccgttcctcgaattcgcgcagagcgtgcagccgcagtcggtgctgcgcgcggcgatcacggccgcgtaccggcggccggagcccgaatgcgtgccgttcctgatcggcgaggcgcggctgcccgcgagcctcgcgtcggacgtgcaggcaatggcggcgggcctcgtcgaggcgctgcgcgagaagagctcgggcggcggcgtcgaggggctgatccatgaattctcgctgtcgagccaggagggcgtcgcgctgatgtgcctcgccgaggcgctgctgcggattcccgatcgcgcgacgcgcgacgcgctgattcgcgacaagatcagcaagggcgactggcgctcgcacgtcggccacgcgccgtcgctgttcgtcaacgcggccacctggggcctgatgattaccggcaagctcgtcacgacgaacagcgaggcgggcctgtcgtcggcgctcacgcggctgatcggcaagggcggcgagccgttgatccgaaagggcgtcgacatggcgatgcgcctgatgggcgagcagttcgtcacgggcgagacgatctccgaagcgctcgcgaacagccgcaagtacgaggcgcgcggcttccgctactcgtacgacatgctcggcgaagcggcgaccaccgaagaggacgcgctgcgctactacgcgtcgtacgagcaggcgatccacgcgatcggcaaggcggcgggcggccgcggcatctacgagggcccgggcatctcgatcaagctctcggcgctgcatgcgcgctactcgcgctcccagcaggaacgcacgatgaacgagctgctgccgcgcgtgcgctcgctcgcgctgctcgcgcgccgctatgacatcggcctgaacatcgacgccgaggaggcggaccggctcgagctctcgctcgatctgctcgaggcgctgtgcttcgatccggagctcgccggctggaacggcatcggcttcgtcgtgcaggcgtaccagaagcgctgcccgttcgtgatcgactaccttgtcgacctcgcgcgccgcagccgccatcgcctgatgatccgcctcgtgaagggcgcgtactgggattccgagatcaagcgcgcgcaggtggacggcctcgaaggctatccggtctatacgcgcaagatctacaccgacgtgtcctacctcgcgtgcgcgaagaagctgctcgccgcgccggacgccgtgtatccgcagttcgcgacgcacaacgcgtacacgctcgccgcgatctatcacctcgcgggccagaactactaccccggccagtacgagttccagtgcctgcacgggatgggcgagccgctgtacgaggaagtcaccggccgcgacaagctgaaccgcccatgccgcgtgtacgcgcccgtcggcacgcacgagacgctgcttgcgtatctcgtgcgccgcctgctggagaacggcgcgaacacgtcgttcgtgaaccggatcgccgacaagaccgtgtcggtgaaggaactggtggccgatccggtcgaggatgcgctgaaggtcgtgccgctcggcgcgccgcacgcgaagattgcgctgccgcgcgagctgtacggcgcgtcgcgcgtcaattcgatgggcctcgatctgtcgaacgagcaccggctcgcgtcgctgtcgtcggcgctgctcgcgagcgcgcatcatccgtggcgcgccgcgccgatgctcgccgacgacgcgctcgcccacgccgcgccgcgcgacgtgcgcaatccggccgatctgcgcgacgtcgtcggcacggtgagcgaagcgacgcccgacgaggtgagcgcggcgctcgcgcacgcggtcgcggccgcgccgatctggcaggcgacgcccgtcgacgcgcgcgcggactgcctcgcgcgcgcggcggacctgctcgaagcgcagatgcacacgctgatgggcctgatcgtgcgcgaggcgggcaaatcgctgccgaacgcgatcgccgagatccgcgaagcggtcgacttcctgcgctactactcggcgcagatccgcgacgaattctcgaacgacacgcaccgcccgctcggccccgtcgtctgcatcagcccgtggaacttcccgctcgcgatcttcatgggccaggtcgcagccgccctggcggcgggcaacacggtgctcgcgaagccggccgagcagacgccgctgatcgccgcgcaggcggtgcgcctgctgcgcgacgccggcgtgccggcgggcgcggtgcaactgctgccgggcaacggcgagacggtgggcgcggcgctcgtggcggacccccgcacgcgcgcggtgatgttcaccggctcgaccgaagtcgcgcgcctcatcaacaagacgctgtcgtcgcgcctcgatccggacggcaggccgatcccgctgatcgccgagacgggcggccagaacgcgatgatcgtcgattcgtcggcgctcgccgagcaggtggtcgccgacgtgctgcagtcgtcgttcgactcggccggtcaacgctgttcggcgctgcgcgttctgtgtctgcaggacgacgtcgcggatcgcacgctgacgatgctcaagggcgcgatgcgcgagctcgcgctcggcaatccggaccggctgtcggtggacgtcggcccggtgatcgacgccgacgcgaagcgcacgatcgacacgcacatcgcggcgatgaaggacaaggggcacgcggtcacgcagctcgagatgccggacgcatgcgcgcagggcacgttcgtgccgccgacgatcatcgagatcggcaacgtcgacgagctcaagcgtgaagtgttcggcccggtgctgcacgtcgtgcgttatcgccgcagcggcctcgacaagctgctcgagcagatccgcgcgacgggctatgggctcacgctcggcattcacacgcggatcgacgagacgatcgcgcacgtgatctcgcgcgcgcacgtcggcaacatctacgtgaaccgcaacgtgatcggcgcggtggtgggcgtgcagccgttcggcggcgaagggctgtcgggcacggggccgaaggcgggcggcgcgctctacttgcagcgcctgctcgcgacgcgcccggccgggctgccgcgctcgctcgaggcggcgctcgtcgccgatgcgccgcaggaaggcgagacgcgcgataatccatccgctgcgctcaccgcgctgcgcgactggctgatcgagcagcgcgagccggcgctcgccgcgcgctgcgacggctatctgtcgcacgtgctcgcgggcgcaaccgccgtgctttcagggccgacgggcgagcgcaatacgtatacactcggcgcgcgcggcacggtgctgtgcatcgcggcgacggcaagcggcgcgcgcgcgcagttcgcggcggcgctcgccaccggcaaccgcgcgcttttcgcgggcgcggcgggcgaggcgctcgccgcggcgctgccggcgcaactgaaggcgcacgcgggcgtgagaaagcaggcggacgcggcgttcgacgcggtgctgttcgaaggcgacagcgacgagttgctcgcgctcgtgaaggaagtcgcgcagcgcccggggccgatcgtgtcggtgcagggcgtcgcggcgggcgcgttcgagaacggcggcgacgaagactacgcgctcgagcggctcctcaccgagcgctcggtgagcgtgaacaccgcggcggcaggcggcaatgcgaatttgatgacgattggctga

SEQ ID NO: 1885 - protein, 1309 aa, Burkholderia pseudomallei K96243
MASTTLGVKVDDLLRARLKDAASRLERTPHWLIKQAIFAYLERIEHGQLPPELSGHTGVADLSDSHADGDDDGAPHPFLEFAQSVQPQSVLRAAITAAYRRPEPECVPFLIGEARLPASLASDVQAMAAGLVEALREKSSGGGVEGLIHEFSLSSQEGVALMCLAEALLRIPDRATRDALIRDKISKGDWRSHVGHAPSLFVNAATWGLMITGKLVTTNSEAGLSSALTRLIGKGGEPLIRKGVDMAMRLMGEQFVTGETISEALANSRKYEARGFRYSYDMLGEAATTEEDALRYYASYEQAIHAIGKAAGGRGIYEGPGISIKLSALHARYSRSQQERTMNELLPRVRSLALLARRYDIGLNIDAEEADRLELSLDLLEALCFDPELAGWNGIGFVVQAYQKRCPFVIDYLVDLARRSRHRLMIRLVKGAYWDSEIKRAQVDGLEGYPVYTRKIYTDVSYLACAKKLLAAPDAVYPQFATHNAYTLAAIYHLAGQNYYPGQYEFQCLHGMGEPLYEEVTGRDKLNRPCRVYAPVGTHETLLAYLVRRLLENGANTSFVNRIADKTVSVKELVADPVEDALKVVPLGAPHAKIALPRELYGASRVNSMGLDLSNEHRLASLSSALLASAHHPWRAAPMLADDALAHAAPRDVRNPADLRDVVGTVSEATPDEVSAALAHAVAAAPIWQATPVDARADCLARAADLLEAQMHTLMGLIVREAGKSLPNAIAEIREAVDFLRYYSAQIRDEFSNDTHRPLGPVVCISPWNFPLAIFMGQVAAALAAGNTVLAKPAEQTPLIAAQAVRLLRDAGVPAGAVQLLPGNGETVGAALVADPRTRAVMFTGSTEVARLINKTLSSRLDPDGRPIPLIAETGGQNAMIVDSSALAEQVVADVLQSSFDSAGQRCSALRVLCLQDDVADRTLTMLKGAMRELALGNPDRLSVDVGPVIDADAKRTIDTHIAAMKDKGHAVTQLEMPDACAQGTFVPPTIIEIGNVDELKREVFGPVLHVVRYRRSGLDKLLEQIRATGYGLTLGIHTRIDETIAHVISRAHVGNIYVNRNVIGAVVGVQPFGGEGLSGTGPKAGGALYLQRLLATRPAGLPRSLEAALVADAPQEGETRDNPSAALTALRDWLIEQREPALAARCDGYLSHVLAGATAVLSGPTGERNTYTLGARGTVLCIAATASGARAQFAAALATGNRALFAGAAGEALAAALPAQLKAHAGVRKQADAAFDAVLFEGDSDELLALVKEVAQRPGPIVSVQGVAAGAFENGGDEDYALERLLTERSVSVNTAAAGGNANLMTIG

SEQ ID NO: 1886 - DNA, 3822 bp, Azoarcus sp. EbN1
  CDS (1)..(3822): transl_table=11
gtgcgtgaggccgtccaaccgtgcaagaatctcgtccacccgtcgcatgcccgccgcgctcgatcgcgggctcaggtgacggccggatgtgtacgcgaacggcagccgcagtccccgatcgcgctttcaggagtcctcctcgcgatgaagcccgaaatccctgatcccgccactgccgccctccccgccgctgcccgttccgaactgcgccggcgcatcgacactgcctggcgaacgcccgaacccgaatgcgtgccgccgctgatccgcgccgcgcggatcgatgccgcactgcaggcgcgcattcgcgcgcaggcacgcgagctggtcgcaggcctgcgcgcgacgcgcacacactccagcggcgtcgacgcgctgatgaaggagttttcgctgtcgagccaggaaggcgtcgcgctgatgtgcctcgccgaagcgctgctccgcgtgccggactccgcgactgccgaccggctgatccgcgacaagctcgcccaccgcgactggcacgcgcacctcggccacagcccgtcgttgttcgtcaatgccgcgacctggggcctgctggtgacgggacggctggtggggacgagcagcgcgcaagggctttcgagcgctctcacgcggatgctcgcgcgcggcggcgaaccgctgatccgtcgcggcatggacctggcgatgcgcctgctcggcgaacagttcgtcaccggccgcaacatcgccgaagcgctcgagcgcagcgcggcggcgcgccggcgcggctaccgctactcgttcgacatgctcggcgaagcggcgatgacggcggccgacgcgcagcgctacctcgccggctacgagcaggcgatccacgccatcggcaaggcgtcggccggccgtggcgtcgtcgacggcgacggcatttcggtcaagctgtcggcgctgcatccgcgctacgtgtggtcgcagcgcgggcgcgtgctcgccgagctgctgccgcggctgaagtcactgtgcatgctggcaaggcactacgacctcggcctgaacatcgacgccgaggaagccgaccgcctggagctgtcgctcgacctgctcgaagcgctcgcgctcgacgacgagctcgccggctggcaaggcctgggcttcgtcgtgcaggcgtaccagaaacgcgcgccgcgcgtcgtcgactggatcatcgagctggcccggcgcagcggccggcgcctgatggtgcggctcgtcaagggcgcgtactgggacgcagaaatcaagcgcgcccaggtcgagggcctcgccggctaccccgtgttcacgcgcaagctctacacggatgtcgcttacctcgcatgcgccagacagctgctcgcagcacgcgacgtcctctatccgcagttcgcgacgcacaacgcccacacgctttcggcggtgttccagctcgcgggcgacgactacgcggccggcgactacgagttccagtgcctgcacggcatgggcgagccgctctacgaccaggtcgtcggcgacaccggctcacggcgcagggtacgcatctacgctccggtcggcagccacgagacgctgcttgcgtacctcgtgcggcgcctgctcgaaaacggcgcgaactcgagcttcgtcaatcgcatcgtggatgaaaacgtcagcatcgacgcgctggtcgccgatccggtcgaggaagcgctgccgctcgccggcgcacctcacccgcggattccgctgccggccgacctgtacggcagcgagcggcgcaattcggcgggccacgacctcgcgagcgagccggtccggcagcgcatcggcgctgcgctgcagctcagccgcagcgtcgtgcgccgcgccggaccgctgctcgcgaacgggccagcatccccggcctcgcgcgacaacgtgctccctgtgcgcaatccggcggatcactccgacgtcgtcgggatggtcgttcacgccgatgagatcgacgtcgaacgggcgctcgcggcggcatccggcgccgcgccgggctgggcgatgcgggccgcggcggcgcgcgccgcctgcctcgagcgcgctgccgaactgatcgaacgcgacacggacgaactcgtcgcgctggcggtccgcgaagcgggcaagtcatgggccaatgtcctcgcggaagtgcgcgaggccgtcgatttctgccgctactacgctgcccgggtgcgcgacttcgacaacgcgagccatgccgcgctcggaccggtgctgtgcatcagcccgtggaatttcccgctggcaattttcaccggccagatcgcggcggcgctcgccgcaggcaacccggtgctcgccaaaccggccgaacagactccgctgatcgccaccgcggcagtggccctgttccgcgaagccggcgtgcccgcggccgtcctgcagttgctccccggccgcggcgacatcgtcggcgccgcgctggtggccgacccgcgcgtgcgcggcgtgctgttcaccggctcggtcgaggtcgctacgcggatcaatcgcgcgctcgccagacgtgggggcgacgtgccgctgatcgccgaaacgggcgggcagaacgcgatgatcgtcgattcgacggcgctcgccgagcaggtggtcgccgacgcgattgcgtcggccttcgactccgccggccagcgctgctcggcgctgcgcgtgctgtgcctgcaggacgatgtcgccgacgccgtgctcgcgatgctgcggggcgcgctcgatgaaatgcggctcggcgactcgtcggatgtgcgcaacgacatcggtccggtcatcgacgcggacgcgcaggcggcgctcgagcgccacgtcgccgcgatgcaggcaagcggcgcgagaatcacccgcctcgcgttgccgcagcgctgcagccggggcactttcgtcgcgccgacgatcatcgaggtcggcgacatccgcgacgtcggcgacgagcacttcggtccgatcctgcacgtgctgcgctaccgcgctgaggagctcgaccgcctcctcgacgcgatcaacgcgaccggctacggcctgacgatgggcgtgcattcgcgcatcgacgagacgatcgatgccgtcatcgcgcacgcccgcgtcggcaacctctatgtcaaccgcaacatgatcggcgccgtcgtcggcgtgcagcctttcggcggcgaaggcctgtccggcaccggaccgaaagcgggcggcccgctgtacgtccatcgcctgctgcgccgcagcccggggccggcgttggagggccgcgaccggctcccggacggcgaggcgttcggctgcctcgtcacctggctcgacggtgcagggcggacgctgatcgacgacgccggccgcgcattcctgcacgagcggatcgccgcctgccgcgcgacgcgcctcgctggcctgcggctcgccctgcccgggccgaccggcgaagacaacagcctgcgtttcgtcccgcgcggcctcgtcgccggcgtcgccacaaccaccgtcggacgcctgcaccagctcctcgccgcgctcgcgagcggcaaccgcatcgtattcacggacgatgccgcgcatcgcgcgctgttcgacgcgctgccgggcccggcccgaaaggcggtgacgctggacaccgactggccaggacacccgttcggcgcgctgctgctcgacggcaccgcggcagaggccgacgcgtggcgcgtccgcctcgccgaacgcgacggcccgatcgtgccgctgctgcagcccgaacccgactatgatgcggcgcggctcgtccatgagcgcaccgtcagcatcaacaccgccgccgccggaggcaatgccagcctgatggcgctcggcgcctga

SEQ ID NO: 1887 - protein, 1273 aa, Azoarcus sp. EbN1
MREAVQPCKNLVHPSHARRARSRAQVTAGCVRERQPQSPIALSGVLLAMKPEIPDPATAALPAAARSELRRRIDTAWRTPEPECVPPLIRAARIDAALQARIRAQARELVAGLRATRTHSSGVDALMKEFSLSSQEGVALMCLAEALLRVPDSATADRLIRDKLAHRDWHAHLGHSPSLFVNAATWGLLVTGRLVGTSSAQGLSSALTRMLARGGEPLIRRGMDLAMRLLGEQFVTGRNIAEALERSAAARRRGYRYSFDMLGEAAMTAADAQRYLAGYEQAIHAIGKASAGRGVVDGDGISVKLSALHPRYVWSQRGRVLAELLPRLKSLCMLARHYDLGLNIDAEEADRLELSLDLLEALALDDELAGWQGLGFVVQAYQKRAPRVVDWIIELARRSGRRLMVRLVKGAYWDAEIKRAQVEGLAGYPVFTRKLYTDVAYLACARQLLAARDVLYPQFATHNAHTLSAVFQLAGDDYAAGDYEFQCLHGMGEPLYDQVVGDTGSRRRVRIYAPVGSHETLLAYLVRRLLENGANSSFVNRIVDENVSIDALVADPVEEALPLAGAPHPRIPLPADLYGSERRNSAGHDLASEPVRQRIGAALQLSRSVVRRAGPLLANGPASPASRDNVLPVRNPADHSDVVGMVVHADEIDVERALAAASGAAPGWAMRAAAARAACLERAAELIERDTDELVALAVREAGKSWANVLAEVREAVDFCRYYAARVRDFDNASHAALGPVLCISPWNFPLAIFTGQIAAALAAGNPVLAKPAEQTPLIATAAVALFREAGVPAAVLQLLPGRGDIVGAALVADPRVRGVLFTGSVEVATRINRALARRGGDVPLIAETGGQNAMIVDSTALAEQVVADAIASAFDSAGQRCSALRVLCLQDDVADAVLAMLRGALDEMRLGDSSDVRNDIGPVIDADAQAALERHVAAMQASGARITRLALPQRCSRGTFVAPTIIEVGDIRDVGDEHFGPILHVLRYRAEELDRLLDAINATGYGLTMGVHSRIDETIDAVIAHARVGNLYVNRNMIGAVVGVQPFGGEGLSGTGPKAGGPLYVHRLLRRSPGPALEGRDRLPDGEAFGCLVTWLDGAGRTLIDDAGRAFLHERIAACRATRLAGLRLALPGPTGEDNSLRFVPRGLVAGVATTTVGRLHQLLAALASGNRIVFTDDAAHRALFDALPGPARKAVTLDTDWPGHPFGALLLDGTAAEADAWRVRLAERDGPIVPLLQPEPDYDAARLVHERTVSINTAAAGGNASLMALGA

SEQ ID NO: 1888 - DNA, 3903 bp, Pseudomonas syringae pv. syringae B728a
  CDS (1)..(3903): transl_table=11
ttgaaagccgcagcccactccatcgaccgtacgccgcactggttgatcaagcaggcgattttcaattacctggaaaagctcgagagtggtgcaaccctgctggagctcgacggtgctgccggcaaggacaacgaagaccgcggcgagctggcagaagaggcggggctgcaatgctttctggattttgccgagagcattcaaccgcagtccgtgttacgtgcagccatcacctccgcctaccgccgccccgagccggaagtggtacctatgctgctcgagcaggcacgcctgagcgcgccggttgccgaagccaccaacaagatggccgcgtcgattgcggagaaactgcgtaaccagaaaagcgccggcggtcgcgcgggcatcgttcagggcctgttgcaggagttttcactgtcttcccaggagggcgtcgcgctgatgtgcctggccgaagcgctgctgcgtattccggacaagggcacccgcgatgccttgattcgcgacaagatcagcaacggcaactggcagccgcacctgggcaacagcccgtcgctgttcgtcaacgccgccacctggggcctgctgctgacaggcaggctggtcgccactcacaatgaagcgggccttacatcctcgctgagccgcatcatcggcaaaagcggcgaaccgatgatccgcaagggcgtcgacatggccatgcgcctgatgggcgagcagttcgtcaccggcgaaaccatcggtgaagccctggccaatgccagtcgcttcgaagccaagggctttcgctactcctacgacatgctgggtgaagcggcgctgaccgaacatgacgcgcagaagtacctggcgtcctacgagcaggctatccactccatcggcaaagcctcgcacggtcgcggcatctacgaaggtccggggatttccatcaagctgtcggcgctgcacccgcgctacagccgcgcccagtacgagcgggtgatggatgaactgtacccgcgcctgctgtcgctgaccctgctcgccaagcagtacgacatcggcctgaacatcgacgccgaagaagccgatcgcctggagctgtcgctggatctgctcgagcgcctgtgtttcgaaccacagctcaccggctggaatggcatcggcttcgtgattcaggcgtatcagaagcgctgcccttatgtgatcgattacgtgatcgacctggcgcgccgcagccgccatcgtctgatgatccgtctggtcaagggcgcgtactgggacagcgagatcaagcgcgcccaggtcgaaggcctggaaggctatccggtgtacacgcgcaaggtgtacaccgacgtgtcctacatcgcctgcgcccgcaagttgctcgcggcaccggaagtcatctatccacaatttgccacacacaacgcccacaccctggcggcgatctaccagatcgccgggcagaattattaccctggccagtatgaattccagtgcctgcacggcatgggcgagccgttgtatgagcaggttgtaggcaaagtcgccgacggcaaactgaatcgtccttgccgcgtgtacgccccggttggcacccatgaaacgctgctggcctatctggtgcgtcgcctgctcgaaaacggcgccaacacctcgttcgtcaaccggattgccgaccactcgatctcgattcaggaactggtcgccgatccggtcagccagatcgaacgcatggcgacccaggaaggcggtttcggcctgccgcacccacgcattccgctgccacgtgacctgtacggaaccgaacgcgccaactccagcggcatcgacatggccaacgaacatcgtctggcttcgctgtcttcggccctgctggctaccgcgcacaacgactggaaagccgccccgatgctgggctgcccggccagcgcaggcacgttgagtgctgccttgaacccatcggacctgcgtgacgtggtcggtcatgtacaggaagcgtccctgcaggatgtcgataacgccatccagtgcgccttgagcgccggtccgatctggcaggccactccgcctgtcgagcgcgctgcgattctggagcgtgccgctgacttgatggaggctgaaatccagccgttgatgggcctgctggtccgtgaagcgggcaagaccttcgccaacgctatcgccgaagtgcgcgaagccgtggacttcctgcgttactacgccgtgcaggcgcgcaacgacttcaccaacgacggccaccgtccgttggggccggtggtctgcatcagcccgtggaacttcccgctggcgattttcagtggtcaggtagctgctgcattggctgccggtaacccggtgctggccaaacctgccgagcagacgccgctgatcgccgcacaggccgtgcgcctgctgcttgaagcgggcattccggaaggcgtagtgcaattgctgccgggtcgcggcgaaaccgtaggtgccggactggtcggcgatgaacgtgtgaagggtgtcatgtttaccggttcaaccgaggtagcccgcctgctgcagcgcaacgtcgcaggtcgcctcgactcacagggtcgccccattccgctgatcgccgaaaccggtggccagaacgcgatgatcgtcgactcttcggcgctgaccgaacaggtggtgatcgacgtagtgtcttcggcgttcgacagcgccggtcagcgctgctcggcactgcgcgtgctgtgcctgcaggaagattctgccgaccgcgtcatcgaaatgctcaagggcgcgatggccgagaaccgcctcggcaatccggagcgcctgtcggtagacatcggcccggtgatcgacgcagaggccaaggccggtatcgaaaaacacatccaggccatgcgcgacaagggccgcacggtctatcaggtggccatcgccgacagcgccgaactcaagcgtggcacttatgtgatgccgaccctgatcgaactggaaagcttcgatgagctgcaacgcgaaatcttcgggccggtactgcacgtggtgcgttacaagcgcaaggagcttggcctgctgatcgatcagatcaatgcctccggttatggcctgaccctgggcgtgcacacgcgcatcgacgagaccatcgccaaggtcatcgacaacgtcaatgccggcaacgtctacgtcaaccgcaacatcgtcggcgccgtggtgggtgttcagccattcggcggcgaaggcctgtccggcaccggccccaaagcgggtggcccgttgtacctgtatcgcctgctgtcgacgcgtccgcaggatgctatcgagaaatcgttcgtccgcagcgacgcgctgtctgcgccggatacccgcctgcgtgaagtcctcggcaagccgttgcaggcactgaaggcctgggctgccagcaaccagcaaagcgatctggacgcgctgtgcagtcaatacgccgagcaatcgcaaagcggcatcacccgccagttggcaggcccgaccggcgaacgcaacagctacgcgatcctgccgcgtgaacacgtactttgcctggctgacgacgagaacgacctgctgattcaactggcagccgtactggcggtcggcagctctgccgtgtggccggaaaccgacatcggcaaaccgctgcgtgctcgcctgccaaaggacgttcaggcgcgcatcaaactgatacctgactgggccaaggacgaagtcatcttcgacgccgtcctgcaccatggcgactccgatcagctacgtgccatctgccagcagatcgcacaacgcagcggtgccatcgtcggcgtaaacggcctgtcccacggcgaaaccaacgtaccgctggaacgtctggtgatcgagcgggcattgagcgtcaacactgcggcggcgggtggcaatgcgagcctgatgacgatcggctga

SEQ ID NO: 1889 - protein, 1300 aa, Pseudomonas syringae pv. syringae B728a
MKAAAHSIDRTPHWLIKQAIFNYLEKLESGATLLELDGAAGKDNEDRGELAEEAGLQCFLDFAESIQPQSVLRAAITSAYRRPEPEVVPMLLEQARLSAPVAEATNKMAASIAEKLRNQKSAGGRAGIVQGLLQEFSLSSQEGVALMCLAEALLRIPDKGTRDALIRDKISNGNWQPHLGNSPSLFVNAATWGLLLTGRLVATHNEAGLTSSLSRIIGKSGEPMIRKGVDMAMRLMGEQFVTGETIGEALANASRFEAKGFRYSYDMLGEAALTEHDAQKYLASYEQAIHSIGKASHGRGIYEGPGISIKLSALHPRYSRAQYERVMDELYPRLLSLTLLAKQYDIGLNIDAEEADRLELSLDLLERLCFEPQLTGWNGIGFVIQAYQKRCPYVIDYVIDLARRSRHRLMIRLVKGAYWDSEIKRAQVEGLEGYPVYTRKVYTDVSYIACARKLLAAPEVIYPQFATHNAHTLAAIYQIAGQNYYPGQYEFQCLHGMGEPLYEQVVGKVADGKLNRPCRVYAPVGTHETLLAYLVRRLLENGANTSFVNRIADHSISIQELVADPVSQIERMATQEGGFGLPHPRIPLPRDLYGTERANSSGIDMANEHRLASLSSALLATAHNDWKAAPMLGCPASAGTLSAALNPSDLRDVVGHVQEASLQDVDNAIQCALSAGPIWQATPPVERAAILERAADLMEAEIQPLMGLLVREAGKTFANAIAEVREAVDFLRYYAVQARNDFTNDGHRPLGPVVCISPWNFPLAIFSGQVAAALAAGNPVLAKPAEQTPLIAAQAVRLLLEAGIPEGVVQLLPGRGETVGAGLVGDERVKGVMFTGSTEVARLLQRNVAGRLDSQGRPIPLIAETGGQNAMIVDSSALTEQVVIDVVSSAFDSAGQRCSALRVLCLQEDSADRVIEMLKGAMAENRLGNPERLSVDIGPVIDAEAKAGIEKHIQAMRDKGRTVYQVAIADSAELKRGTYVMPTLIELESFDELQREIFGPVLHVVRYKRKELGLLIDQINASGYGLTLGVHTRIDETIAKVIDNVNAGNVYVNRNIVGAVVGVQPFGGEGLSGTGPKAGGPLYLYRLLSTRPQDAIEKSFVRSDALSAPDTRLREVLGKPLQALKAWAASNQQSDLDALCSQYAEQSQSGITRQLAGPTGERNSYAILPREHVLCLADDENDLLIQLAAVLAVGSSAVWPETDIGKPLRARLPKDVQARIKLIPDWAKDEVIFDAVLHHGDSDQLRAICQQIAQRSGAIVGVNGLSHGETNVPLERLVIERALSVNTAAAGGNASLMTIG

SEQ ID NO: 1890 - DNA, 3954 bp, Pseudomonas fluorescens Pf-5
  CDS (1)..(3954): transl_table=11
atggctaccaccaccctcggggtcaaactcgacgaccctacccgcgagcgcctcaaggccgccgcggcctcgatcgatcgtacgccgcactggctgatcaagcaggcgattttcaattacctggaaaaactcgagggtggtgcaaccctgaccgagctgagcagtgccaccgccaaagacggcgaggatgccggcgaggtacagaccgatcacgctcaccaatgcttcctggagttcgccgaaagcattctcccgcagtcggtgctgcgcgcctcgatcaccgccgcctaccgccgcccggaaccggaagtggtgccgatgctgctggagcaggcgcgcttgccggccgccaccgccgaagccgcgaacaagctggccgcctcgatcgccgagaagctgcgcaaccagaagagcgccggcggccgtgccggtatcgtccagggcctgctgcaggagttctccctgtcgtcccaggaaggcgtggcgctgatgtgcctggccgaagccctgctgcgcatccccgacaagggcacccgtgacgcgctgatccgcgacaagatcagcaccggcaactggcagccgcacctgggcaacagcccatcgctgttcgtcaacgccgccacctggggcctgctgctcaccggcaagctggtgtcgacccacaacgaggccggcctgacctcctccctgagccgcatcatcggcaagagcggcgagccgatgatccgcaagggcgtggacatggccatgcgcttgatgggcgaacagttcgtcaccggcgaaaccatcgccgaagccctggccaacgccagcaagttcgaagccaagggcttccgctattcctacgacatgctcggcgaagccgcactgaccgagcacgacgcacagaagtacctcgcgtcctacgagcaggccatccactccatcggcaaggcctcccacggtcgcggcatctatgaaggcccgggcatctccatcaagctctcggccctgcacccgcgctacagccgcgcccagtacgagcgcgtgatggaagagctgtacccgcgcctgctgtcccttaccctgctggccaagcagtacgacatcggcctgaacatcgacgccgaggaagccgaccgcctggagctgtccctggacctgctggagcgcctgtgcttcgagccgcaactgaccggctggaacggtatcggcttcgtgatccaggcctaccagaagcgctgcccgtacgtgatcgactatgtcatcgatctggcccgtcgcagccgtcaccgcctgatgatccgcctggtgaaaggcgcctactgggacagcgagatcaagcgcgcccaggtcgaaggcctggaaggctatccggtctacacccgcaaggtgtacaccgacgtttcctacatcgcctgcgcacgcaagctgctgtcggtgccggaagtcatctacccgcagttcgccacccacaacgcccacactttgtcggcgatctaccacattgccggtcagaactattaccccggccagtacgagttccagtgcctgcacggcatgggcgaaccgctgtacgagcaagtggtgggcaaggttgccgagggcaagctgaaccgtccatgccgcgtctatgcaccggtgggcacccacgaaaccctgctggcctacctggtacgccggctgctggaaaacggcgccaacacctcgttcgtcaaccgtatcgccgaccagtcgatttcgatccaggaactggtggccgatccggtgacccagatcgaacagatggccaccctggaaggcggcttcggcctgccgcacccgcgcattccattgccgcgtgacctgtatggcgccgagcgggccaactccgccggcatcgacatggccaacgaacaccgcctggcgtcgctgtcctgcgcactgctggccaccgcccacaacaactggaaagccgcaccgatgctcggttgcgccgccagcagcgaaaccccggcgccggtactcaacccgtcggatcatcgcgacgtggtgggccatgtccaggaagccacggtggaagacgtcgacaacgccatccagtgcgccctcaacgccgcaccgatctggcaggccacgccgccggccgaacgcgctgcaatcctggaacgcgccgccgacctgatggaaggcgagatccagccgctgatgggcctgctggcccgggaagccggcaagaccttcgccaacgccatcgccgaagtgcgtgaagccgtggacttcctgcgttactacgcggtgcaggcccgcaacgacttcagcaacgacgcccaccgtccgctgggtcctgtggtgtgcatcagcccatggaacttcccgctggcgatcttcagtggccaggtcgccgcagccttggctgccggcaacccggtcctggccaaaccggccgaacagactccgctggtagccgcccaggccgtgcgcctgctgctcgaagccgggattcccgaaggcgtgctgcaactgctgccgggccagggcgaaagcgtcggtgcccgcctggtaggtgacgagcgcgtcaagggcgtgatgttcaccggctccactgaagttgcgcgcctgctgcaacgcaacatcgccgggcgtctggacaaccagggccggccgatcccgctgatcgccgaaaccggtggccagaacgccatgatcgtcgattcctcggccctgaccgaacaggtggtcatcgacgtggtgtcctcggccttcgacagtgccggccagcgttgctcggccctgcgcgtgctgtgcctgcaggaagattccgccgaccgcgtgatcgaaatgctcaagggcgccatggccgaaaaccgcctgggcaaccctgagcgcctgtcggtggacatcggcccggtgatcgacgccgaagccaaggccggcatcgagaagcacatccaggccatgcgcgacaaaggtcgcaacgtgtaccagatggccatcgccgacggcgaagaatgcaagcgcggcacctttgtcatgccgaccctgatcgagctggaaagcttcgacgagctgcagcgcgagatcttcggtccggtgctgcacgtggtgcgctacaagcgcaaggaaatcgaccagctgatcgcccagatcaacgcttccggctacggcctgaccctgggcgtgcacacccggatcgacgagaccatcgccaaggtggtggacaacgtccacgccggtaacgtctacgtcaaccgcaacatcgtcggtgccgtggtcggcgtgcagccgttcggcggcgaaggcctgtcgggcaccggcccgaaagccggcggcccgctgtacctgtaccgcctgctgtcgacccgcccggtggatgccatcgagcagtcctttgcccgtggcgacgccgagaacgccccggacctgcgcctgcgcgaagtcctcagcaagccgttgaacgccctgcaagcctgggccgagagcagcaagctggcggaactggcgatcctgtgcaaacagttcgccggccagtcccagagcggcatcacccggcagttgaccggccctaccggcgagcgcaacagctacgccatcctgccccgcgagcacgtcctgtgcctggcggaagtcgagggtgacctgctgacccaactggcagccgtgctggccgtcggtggctcggcggtgtggccggaaagcgagatcagcaaggcgctgttcgcccgcttgccgaaggaagtccaggcacgcatccagcgcgtggccgactggagcaaggacgaagtggtattcgacgccgtcctgcaccacggtgattccgaccagctgcgcagcgtctgccagcaggtggcccagcgtgccggagccattgttggcgtccagggtctgtcccatggcgagaccgcgattgccctggagcgcctggtgatcgagcgcgccctgagcgtcaacaccgcagcggccggcggcaacgccagcctgatgaccatcggctga

SEQ ID NO: 1891 - protein, 1317 aa, Pseudomonas fluorescens Pf-5
MATTTLGVKLDDPTRERLKAAAASIDRTPHWLIKQAIFNYLEKLEGGATLTELSSATAKDGEDAGEVQTDHAHQCFLEFAESILPQSVLRASITAAYRRPEPEVVPMLLEQARLPAATAEAANKLAASIAEKLRNQKSAGGRAGIVQGLLQEFSLSSQEGVALMCLAEALLRIPDKGTRDALIRDKISTGNWQPHLGNSPSLFVNAATWGLLLTGKLVSTHNEAGLTSSLSRIIGKSGEPMIRKGVDMAMRLMGEQFVTGETIAEALANASKFEAKGFRYSYDMLGEAALTEHDAQKYLASYEQAIHSIGKASHGRGIYEGPGISIKLSALHPRYSRAQYERVMEELYPRLLSLTLLAKQYDIGLNIDAEEADRLELSLDLLERLCFEPQLTGWNGIGFVIQAYQKRCPYVIDYVIDLARRSRHRLMIRLVKGAYWDSEIKRAQVEGLEGYPVYTRKVYTDVSYIACARKLLSVPEVIYPQFATHNAHTLSAIYHIAGQNYYPGQYEFQCLHGMGEPLYEQVVGKVAEGKLNRPCRVYAPVGTHETLLAYLVRRLLENGANTSFVNRIADQSISIQELVADPVTQIEQMATLEGGFGLPHPRIPLPRDLYGAERANSAGIDMANEHRLASLSCALLATAHNNWKAAPMLGCAASSETPAPVLNPSDHRDVVGHVQEATVEDVDNAIQCALNAAPIWQATPPAERAAILERAADLMEGEIQPLMGLLAREAGKTFANAIAEVREAVDFLRYYAVQARNDFSNDAHRPLGPVVCISPWNFPLAIFSGQVAAALAAGNPVLAKPAEQTPLVAAQAVRLLLEAGIPEGVLQLLPGQGESVGARLVGDERVKGVMFTGSTEVARLLQRNIAGRLDNQGRPIPLIAETGGQNAMIVDSSALTEQVVIDVVSSAFDSAGQRCSALRVLCLQEDSADRVIEMLKGAMAENRLGNPERLSVDIGPVIDAEAKAGIEKHIQAMRDKGRNVYQMAIADGEECKRGTFVMPTLIELESFDELQREIFGPVLHVVRYKRKEIDQLIAQINASGYGLTLGVHTRIDETIAKVVDNVHAGNVYVNRNIVGAVVGVQPFGGEGLSGTGPKAGGPLYLYRLLSTRPVDAIEQSFARGDAENAPDLRLREVLSKPLNALQAWAESSKLAELAILCKQFAGQSQSGITRQLTGPTGERNSYAILPREHVLCLAEVEGDLLTQLAAVLAVGGSAVWPESEISKALFARLPKEVQARIQRVADWSKDEVVFDAVLHHGDSDQLRSVCQQVAQRAGAIVGVQGLSHGETAIALERLVIERALSVNTAAAGGNASLMTIG

SEQ ID NO: 1892 - DNA, 3954 bp, Pseudomonas syringae pv. phaseolicola 1448A
  CDS (1)..(3954): transl_table=11
atggccaccactactctgggcgtcaaacttgacgacccgacccgcgagcgattgaaagccgccgcccattcgatcgaccgcacaccgcactggttgatcaagcaggcgattttcaattacctggaaaaactggagagtggtgcaaccttgctggagctcaatggcgcgactggcaaagacagcgaagaccgaggcgaagtggcggaagacacaggcctgcaatgcttcctggattttgccgagagcattcaaccgcagtcggtactgcgggcggccatcacctccgtctaccgccgccccgagcaggaagtggtgccgatgctgctggagcaggcgcgcctgactgcacctgttgccgaagccaccaacaagatggccgcgtctattgccgaaaagctgcgcaaccagaaaagtgctggcggccgcgctggcattgttcaaggcctgttgcaggaattttcgctgtcctcgcaggaaggcgttgcactcatgtgcctggccgaagcgttgctgcgcattccggacaagggcacgcgcgatgccctgattcgcgacaagatcagcaacggcaactggcagccgcacttgggcaacagcccctcgctgttcgtcaacgctgccacctggggcctgctgctgaccggcaagctggtcgccactcacaatgaggcaggcctcacttcttcactgagccgcatcatcggcaagagcggcgaaccgatgatccgcaagggcgtcgacatggccatgcgcctgatgggcgagcagttcgtcaccggcgaaaccatcggcgaagccctggccaatgccagccgttttgaagccaagggcttccgctattcctacgacatgctgggtgaagcggcgcttaccgagcacgatgcgcagaagtatctcgcgtcctacgagcaggccatacactccatcggcaaggcctcccacggccgcggtatctacgaaggcccgggcatttccatcaagctgtcggcactgcacccgcgctatagccgcgctcagtacgagcgcgtgatggaagaactgtatccgcgcctgctgtcgctgaccctgctggccaagcagtacgacatcggcctgaacatcgatgccgaagaggctgatcgtctggagctgtcactggatctgctcgagcgcctgtgcttcgaaccgcagctgactggctggaacggcattggcttcgtgattcaggcttaccagaagcgctgcccttatgtgatcgattacgtgatcgatctggctcggcgcagccgtcaccgcctgatgatccgtctggtcaagggcgcgtattgggacagcgagatcaagcgcgcccaggtcgaaggtctggaaggctatccggtgtacacgcgcaaggtgtacaccgacgtctcgtacatcgcctgtgcccgcaagctgctggcggcaccagaagtcatttatccacaattcgccacacacaacgcccacaccctggcggctatttaccagatcgccgggcagaattattacccaggtcagtatgagttccagtgcctgcacggcatgggcgagcctttgtacgagcaggtcgtaggcaaggtcgcagacggcaagctgaaccgtccatgccgcgtgtacgctccggtcggcacgcatgaaacgctgttggcctatctggtccgtcgtctgctggaaaacggtgccaacacgtcgttcgtcaaccggattgccgaccattcgatctccattcaggaactggtggccgacccggtcagccagatcgaacgcatggcaacacaggaaggcggtttcggcttgccgcacccgcgcattccgctgccgcgcgacctgtatggcaccgagcgcgccaactccagcggcatcgacatggccaacgagcatcgtctggcttcgctgtcctcggccctgctcgccacagcgcacaatgactggaaagctgcccccatgctcggctgcccggccagcgcaggcacactgactgccgcgttgaacccatcggacctgcgtgatgtggtcggtcatattcaggaagcctcgctgcaggatgtcgagaacgccatccagtgcgccttgagcgctggcccgatctggcaggcaacaccgcctgcagaacgcgccgcaattctggaacgtgctgccgatttgatggaaagcgacatccagcccttgatgggcctgctggtccgcgaggcgggcaagaccttcgccaacgccatcgccgaggtgcgcgaagccgtcgacttcctgcgttactacgccgtacaggcgcgcaatgatttcaccaacgacgcccatcgtccgctggggccggtggtctgcatcagcccgtggaacttcccgctggcaattttcagcggtcaggtcgctgctgcactggctgcgggcaacccggtgctggccaaaccggccgagcaaacaccgttgattgccgcccaggccgtgcgcctgctgcttgaagccggtatcccggaaggcgtggtgcaattgttaccggggcgcggtgaaaccgtaggtgccgggctggtcggcgacgaacgcgtcaaaggcgtgatgttcaccggttccactgaagtcgcccgcctgctgcaacgcaacgtggcgggtcgcctggactcgcagggccgccccatcccgttgatcgccgaaaccggcggtcagaacgcgatgatcgtcgactcttcggcgctgaccgaacaggttgtcattgacgtggtttcttcggcgttcgacagcgccgggcaacgctgctcggcactgcgcgtgctgtgcctgcaggaagactctgcggaccgcgtcatcgaaatgctcaagggggcgatggccgagagccgcctcggcaacccggagcgcctgtccgtggacatcggcccggtgatcgatgccgaggccaaggcgggtatcgaaaaacacatccaggccatgcgcgacaaaggccgtacggtttatcaggtggccattgccgacagcacggagctcaagcgtggcacttacgtgatgccgaccctgatcgagctggaaagcttcgatgagctgcaacgcgaaatcttcggcccggtgctgcacgtggtgcgctacaagcgcaaggaactgggcctgctgatagaccagatcaatgcatccggctacggcctgacccttggtgttcatacccgcatcgacgaaaccatcgccaaggtcatcgacaacgtcaacgcaggcaacgtctatgtaaaccgtaacatcgtcggtgctgtggtgggcgtccagccatttggcggcgaaggcttgtccggtaccggccctaaagccggtggcccgctctacctgtaccgcctgctgtcgacgcgtccgcaggatgccatcgagaaatcgttcgtgcgcagtgatgcactgtctgctccggacacccgcctgcgtgacatcctcaacaaaccgttgcaagccttgaaggcctgggcagccagtaaccagcaaagcgatctggatgccctgtgcagccaatacgccgagcaatcgcaaagcggcatcactcgccagctggcggggccgaccggcgagcgcaacagctatgcgattctgccgcgtgaacacgtgctttgcctggcggatgacgagaacgacctgctgattcaactggcggctgtgctggctgttggcagttctgccgtgtggccggaaacagacatcagcaagccattgcgcgctcgtctgccaaaagatgtgcaggcacgcatcaagctgatccctgactggaccaaggacgaagtcatcttcgacgccgtcctgcaccacggcgactccgatcagctacgtgccatctgccagcagatcgcccagcgcagcggcgcaatcgtcggcgtcaacggcctgtcccacggcgaaaccaacgtgccgctggaacgcctggtgatagagcgggcattgagcgtcaacaccgcggcggcgggtggcaatgcgagcctgatgacgatcggctga

SEQ ID NO: 1893 - protein, 1317 aa, Pseudomonas syringae pv. phaseolicola 1448A
MATTTLGVKLDDPTRERLKAAAHSIDRTPHWLIKQAIFNYLEKLESGATLLELNGATGKDSEDRGEVAEDTGLQCFLDFAESIQPQSVLRAAITSVYRRPEQEVVPMLLEQARLTAPVAEATNKMAASIAEKLRNQKSAGGRAGIVQGLLQEFSLSSQEGVALMCLAEALLRIPDKGTRDALIRDKISNGNWQPHLGNSPSLFVNAATWGLLLTGKLVATHNEAGLTSSLSRIIGKSGEPMIRKGVDMAMRLMGEQFVTGETIGEALANASRFEAKGFRYSYDMLGEAALTEHDAQKYLASYEQAIHSIGKASHGRGIYEGPGISIKLSALHPRYSRAQYERVMEELYPRLLSLTLLAKQYDIGLNIDAEEADRLELSLDLLERLCFEPQLTGWNGIGFVIQAYQKRCPYVIDYVIDLARRSRHRLMIRLVKGAYWDSEIKRAQVEGLEGYPVYTRKVYTDVSYIACARKLLAAPEVIYPQFATHNAHTLAAIYQIAGQNYYPGQYEFQCLHGMGEPLYEQVVGKVADGKLNRPCRVYAPVGTHETLLAYLVRRLLENGANTSFVNRIADHSISIQELVADPVSQIERMATQEGGFGLPHPRIPLPRDLYGTERANSSGIDMANEHRLASLSSALLATAHNDWKAAPMLGCPASAGTLTAALNPSDLRDVVGHIQEASLQDVENAIQCALSAGPIWQATPPAERAAILERAADLMESDIQPLMGLLVREAGKTFANAIAEVREAVDFLRYYAVQARNDFTNDAHRPLGPVVCISPWNFPLAIFSGQVAAALAAGNPVLAKPAEQTPLIAAQAVRLLLEAGIPEGVVQLLPGRGETVGAGLVGDERVKGVMFTGSTEVARLLQRNVAGRLDSQGRPIPLIAETGGQNAMIVDSSALTEQVVIDVVSSAFDSAGQRCSALRVLCLQEDSADRVIEMLKGAMAESRLGNPERLSVDIGPVIDAEAKAGIEKHIQAMRDKGRTVYQVAIADSTELKRGTYVMPTLIELESFDELQREIFGPVLHVVRYKRKELGLLIDQINASGYGLTLGVHTRIDETIAKVIDNVNAGNVYVNRNIVGAVVGVQPFGGEGLSGTGPKAGGPLYLYRLLSTRPQDAIEKSFVRSDALSAPDTRLRDILNKPLQALKAWAASNQQSDLDALCSQYAEQSQSGITRQLAGPTGERNSYAILPREHVLCLADDENDLLIQLAAVLAVGSSAVWPETDISKPLRARLPKDVQARIKLIPDWTKDEVIFDAVLHHGDSDQLRAICQQIAQRSGAIVGVNGLSHGETNVPLERLVIERALSVNTAAAGGNASLMTIG

SEQ ID NO: 1894 - DNA, 3969 bp, Ralstonia eutropha JMP134
  CDS (1)..(3969): transl_table=11
atggccaccaccaccctcggcgtcaaactcgacgacgcttcgcgcgatcgcctcaagcgtgtcgcccaatccatcgaccggacgccgcactggctgatcaagcaggcgatcttcacgtatctcgagcagatcgagcgtggccacctgccgcatgaggcgatggcaggcggcgcaggggaggccgatggcgccgacggtgctgagatgagccacgccgatggcgcaccgcagccgttcctggaattcgcgcaaagcattcagccgcaatccgtactgcgcgccgcaattacttcggcctatcgccgtcctgaaaccgattgcgtgccggtgctgctggagcaggcacgcctgccgcagcaacaggccgaagccgccatcaagatggccaagaagctggccaccgcgctgcgcgagcagaaggtgggcaccggccgcgaaggcctggtgcagggcctgatccaggaattctccctgtcgtcgcaagaaggcgtagcgctgatgtgcctggccgaggccctgctgcgcattcccgacaagcccacgcgcgacgcgctgatccgcgacaagatcagcggcgccaactggcagtcgcacctgggccagagcccatcgctgttcgtcaacgccgcgacctggggcctgctgctgaccggcaagctggtcgccacccataccgaatcgggcctgagcaaggcgctcacgcgcatcatcggcaagggcggcgaaccgctgatccgcaagggcgtcgacatggccatgcgcctgatgggcgagcagttcgtcacgggcgagaccatttccgaagcgctggccaacgcgcgcaagtacgaagcgcagggcttccgctattcctacgacatgcttggcgaagcggcgatgacggaagaggatgcgcagcgctacctcgcgtcgtacgagcaggccatccatgcgattggccaggcctcgcgcggccgcggcatctatgaaggcccgggcatttcgatcaagctgtcggcgctgcatccgcgctacagccgcgcccagcacgagcgggtgatcaacgagctttatgagcgcctgaagtcgctgacgctgctggcgcgccagtacgacatcggcatcaacatcgacgccgaagaggccgaccgcctcgagatctcgctcgacctgctcgaacgcctgtgcttcgagcccgagctggccggctggaacggcatcggcttcgtggtgcagggctaccagaagcgctgcccgttcgtgatcgactacctgatcgacctcgcgcgccgcagccgccaccgcctgatgatccgcctggttaagggcgcctactgggacagcgaaatcaagcgcgcccaagtcgaaggcctggaaggctatccggtctacacgcgcaaggtctacaccgatgtgtcgtacgtggcctgcgcgcgcaagctgctgtcggtgcccgacgcgatttatccacagttcgccacgcacaacgcgcacacgctgtcggccatctaccagatcgccggccatagctactatcccggccagtacgaattccagtgcctgcacggcatgggcgagccgctgtacgaccaggtcgtcggcccgatcgccgacggcaagttcaaccgcccgtgccgtatctacgcgccggttggcacgcatgaaacgctgctcgcctacctggtgcgccgcctgctcgaaaacggcgccaacacctcgttcgtcaaccggattgccgacgacacgatttcgctcgatgaactggtggccgacccggtcgccgtggtcgagaccatgcatcgcgatgaaggcacgctgggcctgccgcatccgaagatcccgtcgccgcgcggcctttatggcaagtcgcgcgcgaactcggcgggtatcgaccttgccaacgagcatcgcctcgcttcgctgtcgtccgcgctgctggccggtacaagcgaacgcgtcgtggccgatccgatgctgggtaccgaggtcccgcgcgcagccgatgccatcaccacgccggtgctgaacccggccgaccatcgcgacgtcgtgggccaggtcactgaagccagccaggccgatgtcgacgccgcgctgcaggccgccgccaatgcggcaccgatctggcaggccacgccgcccgacgtccgtgcctccgcgcttgaacgcgccgccgacctgatggaagcgcagatgcagtcgctgatgggcatcatcatgcgcgaggccggcaagaccttctcgaacgcgatcgccgaagtgcgcgaggcggtggacttcctgcgctactacgcggccgaagtgcgccgcagcttcgacaacgagacgcaccgcccgctgggcccggtggtctgcatcagcccgtggaatttcccgctggcgatcttcaccgggcaggtggccgcagcgctggccgccggcaatacggtgctggccaagcccgccgagcagacgccgctgattgccgctgccgcggtgcgcatcctgcgcgaggccggcgtgccggcgggtgccgtgcagctgctgccgggccgtggcgagaccgtgggcgcggcactggtgggcgacgcgcgcgtcaagggcgtgatgttcacgggctcgaccgaagtcgcgcgtatcctccagcgcaatatcgccggccgtctcgatgccgccggccgtccgattccgctaatcgccgaaaccggtggccagaacgcgatgatcgtcgactcgtctgcactggccgaacaggtcgtgggcgacgtagtcaactccgcgttcgactcggccggccagcgctgctccgcgctgcgcgtgctgtgcctgcaggaagacgtggccgaccgcgtgctcgccatgctcaagggcgccatgaatgaactgaccatggccaacccggaccgcctgtccaccgatgtgggcccggtcatcgacgaagaagcgcgcggcaatatcgtgcgccatatcgatgcgatgcgcgccaagggtcgccgcgtgcaccaggccgatccgaatgccccgcagggcgccagctgccgccatggcaccttcgtgccgccgaccctgatcgaactcgacagcatcgacgaactgaagcgcgaggtgttcggccccgtgctgcacgtggtgcgcttcccgcgcgccgcgctggacaccatgatcggccagatcaacggtaccaactatggcctgacgatggggatccacacccgcatcgacgagaccatcgcgcagatcgtgcagcatgccgaggtgggcaatctgtacgtgaaccgcaatatcgtcggcgcggtggtgggtgtgcagccgtttggcggcgaggcgctgtcgggcactgggccgaaggccggtggcccgttgtacctgcaccgcctgctgtcggtctgcccgcaggatgcggtggttcgcagcgtgcgccacgcggaagcgtcgggcaacccgccggctgcgccggagcgcccagtcgccgcacaggcgctgaaggactgggcgaagaccgagatgccggaagtcgccgccgcctgcgatcgctttgccgaagcctcggcggctggcatttcggtgacgctgcgcgggccgaccggcgagcgcaacacctactcgctgctgccgcgccaccatgtcctgtgcctggcggcgcaggaacaggatctggccatccagctcgcggctgttctggcagtcggcagccaggctgtgatggcggaaaaccctgtttcgcgtgggctgtttgcacggctgcctaagggcgtacaatcgcgcgtccgcattgtgtctgactggacttcgccggagcccgcgttcgacgcggtgatccatcatggcgattccgaccagttgcgcacggtgtgcgagcaggtcgcagcgcggccggggccgatcatcggcgtgcagggcctcgcgcaaggtgagccgaatatcgctcttgaacgtttgctgatcgagcgttcgctgtcggtcaacacggcggcggccggcggcaacgccagcctgatgacgatcggctga

SEQ ID NO: 1895 - protein, 1322 aa, Ralstonia eutropha JMP134
MATTTLGVKLDDASRDRLKRVAQSIDRTPHWLIKQAIFTYLEQIERGHLPHEAMAGGAGEADGADGAEMSHADGAPQPFLEFAQSIQPQSVLRAAITSAYRRPETDCVPVLLEQARLPQQQAEAAIKMAKKLATALREQKVGTGREGLVQGLIQEFSLSSQEGVALMCLAEALLRIPDKPTRDALIRDKISGANWQSHLGQSPSLFVNAATWGLLLTGKLVATHTESGLSKALTRIIGKGGEPLIRKGVDMAMRLMGEQFVTGETISEALANARKYEAQGFRYSYDMLGEAAMTEEDAQRYLASYEQAIHAIGQASRGRGIYEGPGISIKLSALHPRYSRAQHERVINELYERLKSLTLLARQYDIGINIDAEEADRLEISLDLLERLCFEPELAGWNGIGFVVQGYQKRCPFVIDYLIDLARRSRHRLMIRLVKGAYWDSEIKRAQVEGLEGYPVYTRKVYTDVSYVACARKLLSVPDAIYPQFATHNAHTLSAIYQIAGHSYYPGQYEFQCLHGMGEPLYDQVVGPIADGKFNRPCRIYAPVGTHETLLAYLVRRLLENGANTSFVNRIADDTISLDELVADPVAVVETMHRDEGTLGLPHPKIPSPRGLYGKSRANSAGIDLANEHRLASLSSALLAGTSERVVADPMLGTEVPRAADAITTPVLNPADHRDVVGQVTEASQADVDAALQAAANAAPIWQATPPDVRASALERAADLMEAQMQSLMGIIMREAGKTFSNAIAEVREAVDFLRYYAAEVRRSFDNETHRPLGPVVCISPWNFPLAIFTGQVAAALAAGNTVLAKPAEQTPLIAAAAVRILREAGVPAGAVQLLPGRGETVGAALVGDARVKGVMFTGSTEVARILQRNIAGRLDAAGRPIPLIAETGGQNAMIVDSSALAEQVVGDVVNSAFDSAGQRCSALRVLCLQEDVADRVLAMLKGAMNELTMANPDRLSTDVGPVIDEEARGNIVRHIDAMRAKGRRVHQADPNAPQGASCRHGTFVPPTLIELDSIDELKREVFGPVLHVVRFPRAALDTMIGQINGTNYGLTMGIHTRIDETIAQIVQHAEVGNLYVNRNIVGAVVGVQPFGGEALSGTGPKAGGPLYLHRLLSVCPQDAVVRSVRHAEASGNPPAAPERPVAAQALKDWAKTEMPEVAAACDRFAEASAAGISVTLRGPTGERNTYSLLPRHHVLCLAAQEQDLAIQLAAVLAVGSQAVMAENPVSRGLFARLPKGVQSRVRIVSDWTSPEPAFDAVIHHGDSDQLRTVCEQVAARPGPIIGVQGLAQGEPNIALERLLIERSLSVNTAAAGGNASLMTIG

SEQ ID NO: 1896 - DNA, 3954 bp, Pseudomonas fluorescens PfO-1
  CDS (1)..(3954): transl_table=11
atggctaccaccacccttggggtcaaacttgacgacccgacccgcgaacgcctgaaggccgccgcaacctcgattgatcgcacaccgcactggctgatcaagcaggcaattttcaattacctggagaaactcgagggtggtgcaaccctgaccgagctgaacggtttgaccgccaaggacgccgacgacgcgggcgaagtccataccgatcacgctcaccaatgcttcctcgaattcgccgaaagcatcctgccgcaatcggtgctgcgcgcctcgatcaccgccgcttaccgacgccccgagccggaagtggtgccgatgctgatcgagcaggcgcgcctgccggcgccgatggccgaagccaccaacaaactcgccgcaaccatcgcggaaaaactgcgtaaccagaagagtgccggcggtcgtgcaggtattgttcagggcctgttgcaggaattttccctgtcgtcccaggaaggcgtggcgctgatgtgcctggccgaagcactgctgcggatcccggacaaaggcactcgcgatgcgctgatccgcgacaagatcagcaccggcaactggcagccgcacttgggcaacagcccgtcgctgttcgtcaacgcggcgacctggggtctgctgctgaccggcaaactggtttccactcacaacgaagccggcctgacttcgtccctgagccgcatcatcggcaagagcggcgagccgatgatccgcaagggcgtcgacatggccatgcgcctgatgggcgagcagttcgttaccggcgaaaccatcgccgaagccctggccaacgcgagcaagttcgaagccaagggtttccgctattcctacgacatgctcggtgaagcggcgctgaccgaacacgacgcccagaagtacctggcctcgtacgaacaagccattcactcgatcggcaaagcgtcccacggccgtgggatttatgaaggtccgggcatctcgatcaagctgtcggccctgcacccgcgttacagccgtgcccagtacgagcgcgtgatggacgagctgtacccgcgcctgctgtcgctgaccctgctggccaagcaatacgacatcggcctgaacatcgacgccgaagaagccgaccgcctggagctgtcgctggatctgctcgagcgtctgtgcttcgagccgcaactgaccggctggaacggcatcggtttcgtgatccaggcctaccagaagcgttgcccgtacgtgatcgactacgtgatcgacctggctcgccgcagccgtcatcgcctgatgatccgtctggtgaaaggcgcgtactgggacagcgaaatcaagcgcgcccaggtcgaaggcctggaaggctatccggtctacacccgcaaggtgtacaccgacgtttcctacatcgcctgcgcccgcaaactgttgtcggtgccggaagtcatttacccgcagttcgctacgcacaacgcccacaccctgtcggcgatttatcacattgccggtcagaactattacccgggccagtacgaattccagtgcctgcacggcatgggcgaaccgttgtacgaacaggttgtaggcaaggtttccgaaggcaagctgaaccgtccgtgccgcgtgtacgctccggtcggcacccacgaaaccctgctggcgtacctcgtacgtcgtctgctggaaaacggtgccaacacctcgttcgtcaaccgcatcgccgaccagtcggtttcgattcaggagctggtggccgatccggtggcacagatcgagcagatggcgaccgtggaaggtggtttcggcctgccgcacccgcgcatcccgctgccgcgtgacctgtatggctccgagcgcgccaactctgccggcatcgacatggccaacgaacatcgtctggcgtcgctgtcctgcgccctgctggccaccgcgcacaacaactggaaagccgcgccgatgctcggttgcgcctccagcaacgaagcgccggcaccggtgctgaacccgtccgatctgcgtgacgtggtcggccatgtgcaggaagccacggtcgaagacgtcgacaacgccattcaatgcgccctgaacgccgcaccgatctggcaggccaccccgccggccgaacgtgccgcgattctggaacgtgccgctgacttgatggaaggcgagatccagccgctgatgggcctgctggcccgcgaagccggcaagaccttcgccaacgccatcgccgaagtccgcgaagccgtcgatttcctgcgttattacgcggtgcaggcacgcaacgatttcagcaacgacgcccaccgcccactgggcccggtggtgtgcatcagcccatggaacttcccgctggcgatcttcagcggccaagttgccgcggcactggccgccggtaacccggtgctggccaaaccggccgaacagactccgctggtcgccgcacaagccgtacgcctgctgctcgaagccgggattccggaaggcgtgctgcaactgctgccgggtcgcggtgaaaccgtcggcgccggtctggtcggcgatgaacgcgtcaaaggcgtgatgttcaccggctccaccgaagtcgcgcgtctgctgcaacgcaacatcgccggtcgcctcgacaaccagggccgtccgattccgctgatcgccgaaaccggcggccagaacgcgatgatcgtcgactcttcggcactgaccgaacaggtggtgatcgacgtggtgtcgtcggccttcgacagcgccggtcagcgttgctcggccctgcgcgtcctgtgcttgcaggaagattccgctgatcgcgtcatcgaaatgcttaaaggtgcgatggctgaaagccgtctcggcaacccggagcgcctgtccgtggacatcggcccggtgatcgacgccgaagccaaggccggcatcgagaagcacatccagggcatgcgcgacaaaggtcgcaacgtgtaccaggtggctattgccgataccgaggaagtcaaacgcggcaccttcgtcatgccgaccctgatcgagctggaaagcttcgacgaactgcaacgcgagatcttcggcccggtgctgcacgtggtgcgctacaagcgtaaagagatcgaccagttgatcgcccagatcaacgcctccggttacggcctgaccctcggcgtgcacacccgcatcgacgagaccatcgccaaggtgatcgacaacgtcaacgccggtaacgtctacgtcaaccgcaacatcgtgggtgccgtggtcggcgtccagccattcggtggtgaaggcctgtcgggtactggcccgaaagccggtggcccgctgtacctgtaccgtctgctgtcgacgcgtcctaccgatgccatcgaacaatccttcgctcgcgctgatgctgccgtggcgccggacgttcgtctgcgcgacgccatgagcaaaccgctgaccgctctgaaagcctgggccgacagcaacaagttcgccgacctgagcaccctgtgcgtgcagtacgcggcgcagtcgcaaagcggtatcacccgcgtactggccggcccgaccggcgagaagaacagctacgcgatcctgccgcgcgagcacgtgctgtgcctggcggacatcgaaggtgatctgctgacccaactcgctgcagtactggcagtaggcggttcggcagtctggccggaatccgacaccagcaaggcattgttcgcacgcctgccgaaggaaattcaggcgcgaatcaaactggtttccgactggaacaaggacgacgtggtgttcgacgcggttctgcatcacggccattccgaccagttgcgtgcggtctgccagcagatcgccaagcgtgccggcgccatcgtcggggttcagggcctgtcccagggcgagaccaacattgcactggagcgtctggtgatcgagcgtgcgttgagcgtcaacaccgcggcagcaggcggcaacgccagtctgatgaccatcggttaa

SEQ ID NO: 1897 - protein, 1317 aa, Pseudomonas fluorescens PfO-1
MATTTLGVKLDDPTRERLKAAATSIDRTPHWLIKQAIFNYLEKLEGGATLTELNGLTAKDADDAGEVHTDHAHQCFLEFAESILPQSVLRASITAAYRRPEPEVVPMLIEQARLPAPMAEATNKLAATIAEKLRNQKSAGGRAGIVQGLLQEFSLSSQEGVALMCLAEALLRIPDKGTRDALIRDKISTGNWQPHLGNSPSLFVNAATWGLLLTGKLVSTHNEAGLTSSLSRIIGKSGEPMIRKGVDMAMRLMGEQFVTGETIAEALANASKFEAKGFRYSYDMLGEAALTEHDAQKYLASYEQAIHSIGKASHGRGIYEGPGISIKLSALHPRYSRAQYERVMDELYPRLLSLTLLAKQYDIGLNIDAEEADRLELSLDLLERLCFEPQLTGWNGIGFVIQAYQKRCPYVIDYVIDLARRSRHRLMIRLVKGAYWDSEIKRAQVEGLEGYPVYTRKVYTDVSYIACARKLLSVPEVIYPQFATHNAHTLSAIYHIAGQNYYPGQYEFQCLHGMGEPLYEQVVGKVSEGKLNRPCRVYAPVGTHETLLAYLVRRLLENGANTSFVNRIADQSVSIQELVADPVAQIEQMATVEGGFGLPHPRIPLPRDLYGSERANSAGIDMANEHRLASLSCALLATAHNNWKAAPMLGCASSNEAPAPVLNPSDLRDVVGHVQEATVEDVDNAIQCALNAAPIWQATPPAERAAILERAADLMEGEIQPLMGLLAREAGKTFANAIAEVREAVDFLRYYAVQARNDFSNDAHRPLGPVVCISPWNFPLAIFSGQVAAALAAGNPVLAKPAEQTPLVAAQAVRLLLEAGIPEGVLQLLPGRGETVGAGLVGDERVKGVMFTGSTEVARLLQRNIAGRLDNQGRPIPLIAETGGQNAMIVDSSALTEQVVIDVVSSAFDSAGQRCSALRVLCLQEDSADRVIEMLKGAMAESRLGNPERLSVDIGPVIDAEAKAGIEKHIQGMRDKGRNVYQVAIADTEEVKRGTFVMPTLIELESFDELQREIFGPVLHVVRYKRKEIDQLIAQINASGYGLTLGVHTRIDETIAKVIDNVNAGNVYVNRNIVGAVVGVQPFGGEGLSGTGPKAGGPLYLYRLLSTRPTDAIEQSFARADAAVAPDVRLRDAMSKPLTALKAWADSNKFADLSTLCVQYAAQSQSGITRVLAGPTGEKNSYAILPREHVLCLADIEGDLLTQLAAVLAVGGSAVWPESDTSKALFARLPKEIQARIKLVSDWNKDDVVFDAVLHHGHSDQLRAVCQQIAKRAGAIVGVQGLSQGETNIALERLVIERALSVNTAAAGGNASLMTIG

SEQ ID NO: 1898 - DNA, 3933 bp, Burkholderia sp. 383
  CDS (1)..(3933): transl_table=11
atggcaagcacgactctcggcgtcaaagtcgacgaccttctccgctcgcgtctcaaggacgccgccgcgcgtctcgagcgcactccccactggctgatcaagcaggcgatcttcgcgtatctcgagcggatcgagcacggccagttgccgcccgagctgtcgggtcacagcggcgtgacggagctcgccgacggccaggtcgcggacggcgacgacgacaactcgccgcatccgttcctcgagttcgcgcagaacgtgcagccgcaatcggtgctgcgcgcggcgatcacggctgcgtatcgccgccccgagccggaatgcgtgccgttcctgctcgggcaggcgcgcctgcccgcgaacctgcaggcggacgtgcaggcgctcgcgaccaagctcgtcgaggcgctgcgcgagaagagctcgggcggcggcgtcgaagggctgatccacgagttctcgctgtcgagccaggaaggcgtcgcgctgatgtgcctcgccgaagcgctgctgcgcattcccgatcgcgcgacgcgcgatgcgctgattcgcgacaagatcagcaagggcgactggcgctcgcacgtcggccacgcgccgtcgctgttcgtgaacgcggccacgtgggggctgatgatcaccggcaagctggtgacgaccaacagcgaagccgggctgtcgtcggcgctgacgcgcctgatcggccgcggcggcgagccgctgatccgcaagggcgtcgacatggcgatgcgcctgatgggcgagcagttcgtcaccggcgagacgatttccgaagcgctcgcgaacagccgcaagtacgaagcgcgcggcttccgctactcgtacgacatgctcggcgaagcggcgaccaccgaagaggatgcgcagcgctactacgcgtcgtacgaacaggcgatccacgcgatcggcaaggcagccggcggccgcggcatctacgaaggcccgggcatctcgatcaagctgtcggcgctgcacgcgcgctactcgcgctcgcagcaggaccgcacgatgagcgagctgctgccgcgcgtgcgcgcgctcgcgctgctcgcgcgccgctacgacatcggcctgaacatcgatgctgaagaagccgaccgcctcgaactgtcgctcgacctgctcgaggcgctgtgcttcgatccggatctcgcgggctggaacggcatcggctttgtggtgcagggctaccagaagcgctgcccgttcgtgatcgactacctgatcgatctcgcgcgccgcagccgtcaccgcctgatgatccgcctcgtgaagggcgcgtactgggataccgagatcaagcgtgcgcaggtcgacggcctcgaaggctatccggtctatacgcgcaagatctacaccgacgtgtcgtacctcgcgtgcgcgaagaagctgctcgcggcgccggacgccgtgtacccgcagttcgcgacgcacaacgcgcacacgctggccgcgatctaccagctcgcgggccagaactactacccgggccagtacgaattccagtgcctgcacgggatgggcgagccgctgtacgaggaagtcacgggccgcgacaagctcaaccgtccgtgccgcgtgtacgcgccggtcggcacgcacgagacgctgctcgcgtacctggtgcgccgcctgctcgagaacggcgcgaacacgtcgttcgtgaaccgcatcgcggataaaaccgtggcggtgaaggagctggttgccgatccggtcgacgaagcgtcgaaggtcgtgccgctcggcgcaccgcacgcgaagatcccgctgccgcgcaacctgtacggcgacgagcgtcccaactcgatgggtctcgacctgtcgaacgaacaccgcctcgcgtcgctgtcgtccgcgctgctcgcgagcgcgcatttcccgtggcgcgcggcgccgatgctcgccgacgacgcgctcgccgacgcaccggcccgcgacgtgcgcaacccggccgaccagcgcgacctggtcggcacggtcagcgaagcgacggccgaacacgtgagcgcggcactcgcgcacgcggtggccgccgcgccgatctggcaggcgacgccggtcgatgcacgcgccgattgcctggtgcgcgcggccgacctgctcgaagcgcagatgcacacgctgatgggcctgatcgtgcgcgaagccggcaaatcgctgcctaacgcgatcgccgagatccgcgaagcggtcgacttcctgcgctactacgccgcacagatccgcgacgaattctcgaacgacacgcaccgcccgctgggccccgtggtctgtatcagcccgtggaacttcccgctcgcgatcttcatgggccaggtcgccgcggcactcgccgccggcaacacggtgctcgcgaagccggccgaacagacgccgctgatcgccgcgcaggccgtgcgcctgctgcgcgaggccggcgtgccggccggcgcggtgcaactgctgccgggcaccggcgagaccgtcggcgcggcgctggtggccgacgcgcgtacgcgtgcggtgatgttcaccggctcgaccgaagtcgcgcgcctgatcaacaagacgctgtccgcgcgcctcgacccggacggcaagccgatcccgctgatcgccgaaacgggcggccagaacgcgatgatcgtcgactcgtcggcgctcgcggagcaggtcgtcgcggacgtgatgcagtcgtctttcgactcggccggtcaacggtgttcggcgctgcgcgttctgtgtctgcaggacgatgttgcggaccgcacgctgacgatgctgaagggcgcgatgcacgagctggcgctcggcaaccccgaccgcctgtcgacggacgtcggcccggtgatcgacggtgaagcgaagcagacgatcgacacgcacgtcgcggcgatgaaggacaaggggcacggcgtcacgcagctgccggcccccgaggcctgcgcgcacggcaccttcgtgccgccgacgctgatcgagatcggcagcatcgacgagctgaagcgcgaagtgttcggccccgtgctgcacgtggtgcgttaccgccgcagccagctcgacaagctgctggagcagatccgcgcgaccggctacggcctgacgctcggcatccacacgcggatcgacgagacgatcgcgcacgtgatctcgaatgcgcacgtcggtaacatctacgtgaaccgcaacgtgatcggcgcggtggtcggcgtgcagccgttcggcggcgaagggctgtcgggcacgggcccgaaggccggcggcgcgctgtacctgcagcgcctgctcgcgacgcgtccgtcgggcctgccgcgttcgctcgcgcagacgctgatcgcggacggcgcggtggaaggcgacgcgcgcggcaacccggcggcggcgctcacgacgctgcgtgactggctgatcgagcagcgcgagccggtgctggcggcacgttgcgacggctatctggcccaggtgccggccggtgcgaccgcagtgttgagcggtccgacgggcgagcgaaacacgtatacactcggcccgcgcggcacggtgttgtgtgtcgcggcgacgccgggcggggcgcgcgcgcagttcgcggcggtgctggcgaccggcaaccgtgcgctgttcgcgggcgcggccggcgaggcgctggtcgccgcgctgccggcatcgttgaaggcacacgcggtcgtgcgcaagcaggccgacgcgccgttcgacgcggtgctgttcgaaggcgacagcgacgaactgcagacgctcgtgaaggacgtcgcgcagcggccgggcccgatcgtgtcggtgcagggcgtgtcggtgggcgcgttcgagaacggcgatgcggaagattacgcgctggaacggctgttgacggagcgctcggtgagcgtgaacacggccgcggcgggtggcaatgcgaatttgatgacgatcggctga

SEQ ID NO: 1899 - protein, 1310 aa, Burkholderia sp. 383
MASTTLGVKVDDLLRSRLKDAAARLERTPHWLIKQAIFAYLERIEHGQLPPELSGHSGVTELADGQVADGDDDNSPHPFLEFAQNVQPQSVLRAAITAAYRRPEPECVPFLLGQARLPANLQADVQALATKLVEALREKSSGGGVEGLIHEFSLSSQEGVALMCLAEALLRIPDRATRDALIRDKISKGDWRSHVGHAPSLFVNAATWGLMITGKLVTTNSEAGLSSALTRLIGRGGEPLIRKGVDMAMRLMGEQFVTGETISEALANSRKYEARGFRYSYDMLGEAATTEEDAQRYYASYEQAIHAIGKAAGGRGIYEGPGISIKLSALHARYSRSQQDRTMSELLPRVRALALLARRYDIGLNIDAEEADRLELSLDLLEALCFDPDLAGWNGIGFVVQGYQKRCPFVIDYLIDLARRSRHRLMIRLVKGAYWDTEIKRAQVDGLEGYPVYTRKIYTDVSYLACAKKLLAAPDAVYPQFATHNAHTLAAIYQLAGQNYYPGQYEFQCLHGMGEPLYEEVTGRDKLNRPCRVYAPVGTHETLLAYLVRRLLENGANTSFVNRIADKTVAVKELVADPVDEASKVVPLGAPHAKIPLPRNLYGDERPNSMGLDLSNEHRLASLSSALLASAHFPWRAAPMLADDALADAPARDVRNPADQRDLVGTVSEATAEHVSAALAHAVAAAPIWQATPVDARADCLVRAADLLEAQMHTLMGLIVREAGKSLPNAIAEIREAVDFLRYYAAQIRDEFSNDTHRPLGPVVCISPWNFPLAIFMGQVAAALAAGNTVLAKPAEQTPLIAAQAVRLLREAGVPAGAVQLLPGTGETVGAALVADARTRAVMFTGSTEVARLINKTLSARLDPDGKPIPLIAETGGQNAMIVDSSALAEQVVADVMQSSFDSAGQRCSALRVLCLQDDVADRTLTMLKGAMHELALGNPDRLSTDVGPVIDGEAKQTIDTHVAAMKDKGHGVTQLPAPEACAHGTFVPPTLIEIGSIDELKREVFGPVLHVVRYRRSQLDKLLEQIRATGYGLTLGIHTRIDETIAHVISNAHVGNIYVNRNVIGAVVGVQPFGGEGLSGTGPKAGGALYLQRLLATRPSGLPRSLAQTLIADGAVEGDARGNPAAALTTLRDWLIEQREPVLAARCDGYLAQVPAGATAVLSGPTGERNTYTLGPRGTVLCVAATPGGARAQFAAVLATGNRALFAGAAGEALVAALPASLKAHAVVRKQADAPFDAVLFEGDSDELQTLVKDVAQRPGPIVSVQGVSVGAFENGDAEDYALERLLTERSVSVNTAAAGGNANLMTIG

SEQ ID NO: 1900 - DNA, 3930 bp, Burkholderia thailandensis E264
  CDS (1)..(3930): transl_table=11
atggcaagcaccacactgggcgtcaaagtcgacgatctgcttcgcgcgcgtttgaaggacgcggcgtcgcggctcgagcgcactcctcactggctgatcaagcaggcgatcttcgcgtatctcgagcggatcgagcacggacagctcccgccggagctgtccggccacacgggcatggccgacctgtccgacggccacgccgacggcgatgaagacggcgcgccgcacccgttcctcgaattcgcgcagaacgtgcagccgcagtcggtgctgcgcgcggcgatcacggccgcataccggcggccggagcccgagtgcgtgccgttcctgatcggcgaggcgcggctgcccgcgagcctcgcgccggacgtccagtcgatggcggcgggcctcgtcgaggcgctgcgcgagaagagctcgggcggcggcgtcgaggggctgatccacgaattctcgctgtcgagccaggaaggcgtggcgctgatgtgcctcgccgaggcgctgctgcggattcccgaccgcgcgacccgcgacgcgctgatccgcgacaagatcagcaagggcgactggcgctcgcatgtcggccacgcgccgtcgctgttcgtcaacgcggccacctggggcctgatgatcacgggcaagctcgtcacgacgaacagcgaggcgggcctgtcgtcggcgctcacgaggctgatcggcaagggcggcgagccgctgatcaggaagggcgtcgacatggcgatgcgcctgatgggcgagcagttcgtcacgggcgagacgatttccgaagcgctcgcgaacagccgcaagtacgaggcgcgcggcttccgctactcgtacgacatgctcggcgaggcggcgacgaccgaggaggacgcgctgcgctactacgcttcgtacgagcaggcgatccatgcgatcggcaaggcggcgggcggccgcggcatctacgaaggcccgggtatctcgatcaagctttcggcgctgcacgcgcgctactcgcgctcgcagcaggaacgcacgatgaacgagctgctgccgcgcgtgcgctcgctcgcgctgctcgcgcgccgctacgacatcggcctgaacatcgacgccgaggaggcggaccggctcgaactgtcgctcgatctgctcgaggcgctgtgtttcgattcggagctcgccggctggaacggcatcggcttcgtcgtgcaggcgtaccagaagcgctgcccgttcgtgatcgactacctcgtcgatctcgcgcgccgcagccgccatcgcctgatgatccgcctcgtgaagggcgcgtactgggattccgaggtcaagcgcgcgcaggtggacggcctcgaaggctatccggtctacacgcgcaagatctacaccgacgtgtcgtacctcgcatgcgcgaagaagctgctcgccgcgccggacgccgtctatccgcagttcgcgacgcacaacgcgtacacgctcgccgcgatctatcacctcgcgggccagaactattaccccggccagtatgaattccagtgcctgcacggaatgggcgagccgctgtacgaggaagtcaccggccgcgacaagctgaaccgcccgtgccgcgtatacgcgcccgtcggcacgcacgagacgctgctcgcgtacctcgtgcgccgcctgctggaaaacggcgcgaacacgtcgttcgtgaaccgcatcgccgacaagaccgtgtcggtgaaggagctggtcgccgatccggtcgaggaagccgcgaaggtcgtgccgctcggcgcgccgcacgcgaagattgcgctgccgcgcgagctgtacggcgcgtcgcgcgtcaactcgatgggcctcgatctgtcgaacgagcaccggctcgcgtcgctgtcgtcggcgctgctcgcgagcgcgcatcacccgtggcgcgccgcgccgatgctcgccgacgacgcgctcgcgcacgccgagccgcgcgacgtgcgcaatccggccgatctgcgcgacgtggtcggcacggtcagcgaggcgacgcccgaagaggtgggcgcggcgctcgcgcacgcggtcgcggccgcgccgatctggcaggccacgccggtggacgcgcgcgccgactgtctcgcgcgcgcggcggacctcctcgaagcgcagatgcacacgctgatgggcctgatcgtgcgcgaggcgggcaagtcgctgccgaacgcgatcgccgagatccgcgaagcggtcgatttcctgcgctactactcggcgcagatccgcgacgagttctcgaacgacacgcaccgcccgctcggccccgtcgtctgcatcagcccgtggaacttcccgctcgcgatcttcatgggccaggtggccgccgcgcttgcggccggcaatacggtgctcgcgaagccggccgagcagacgccgctgatcgccgcgcaggcggtgcgcctgctgcgcgacgccggcgtgccggcgggcgcggtgcaactgctgcccggcaacggcgagacggtcggcgcggcgctcgtcgccgatccccgcacgcgcgcggtgatgttcaccggctcgaccgaagtcgcgcgcctcatcaacaagacgctgtcgtcgcgcctcgatccggacggcaagccgattccgttgatcgccgagacgggcggccagaacgcgatgatcgtcgattcgtcggcgctcgccgagcaggttgtcgccgacgtgctgcagtcgtcgttcgactcggccggtcaacgctgttcggcgctgcgcgttctgtgtctgcaggacgacgtcgcggaccgcacgctgacgatgctcaagggcgcgatgcgcgagctcgcgctcggcaatccggaccggctgtcggtggacgtcggcccggtgatcgacgccgacgcgaagcgcacgatcgatgcgcacatcgcggcgatgaaggacaaggggcatgcggtcacgcagctcgagatgccggaagcgtgcgcgcagggcacgttcgtgcccccgacgatcatcgagatcggcaacgtcgacgaactgaagcgcgaggtgttcggcccggtgctgcacgtcgtgcgctatcgccgcagcggcctcgacaagctgctcgagcagatccgcgcgacgggctacggcctgacgctcggcatccacacgcggatcgacgagacgatcgcgcacgtgatctcgcgcgcgcacgtcggcaacatctacgtgaaccgcaacgtgatcggcgcggtggtcggcgtgcagccgttcggcggcgaagggctgtcgggcacggggccgaaggcgggcggcgcgctgtatctgcagcgcctgctcgcgacacgcccggccgggctgccgcgctcgctcgaggcgtcgctcgtcgccgatgcgccgcaggaaggcgagacgcgcgataatccgtccgccgcgttgaccgcgctgcgcgactggctgatcgagcagcgcgagccggcgctcgccgcgcgctgcgacggctacctgtcgcacgtgctcgcgggcgcaaccgcggtgctttcggggccgacgggcgagcgcaatacgtatacactcggcgcacgcggcacggtgctctgcatcgcggcgacggcgagcggcgcgcgcgcgcagttcgcggcggtgctcgccacgggcaaccgcgcgctcttcgcgagcgcggcgggcgaggcgctcgcggcggcgctgccggcgccgctgaaggcgcatgcggccgtgaggaagcaggcggacgcggcgttcgacgcggtgctgttcgagggcgacagcgacgagttgctcgcgctcgtgaaggaagtcgcgcagcgccccgggccgatcgtgtcggtgcagggcgtcgcggcgggcgcgttcgagaacggcggcgacgaagactacgcgctcgagcggctcctcaccgagcgctcggtgagcgtgaacaccgcggcggcaggcggcaatgcgaatttgatgacgattggctga

SEQ ID NO: 1901 - protein, 1309 aa, Burkholderia thailandensis E264
MASTTLGVKVDDLLRARLKDAASRLERTPHWLIKQAIFAYLERIEHGQLPPELSGHTGMADLSDGHADGDEDGAPHPFLEFAQNVQPQSVLRAAITAAYRRPEPECVPFLIGEARLPASLAPDVQSMAAGLVEALREKSSGGGVEGLIHEFSLSSQEGVALMCLAEALLRIPDRATRDALIRDKISKGDWRSHVGHAPSLFVNAATWGLMITGKLVTTNSEAGLSSALTRLIGKGGEPLIRKGVDMAMRLMGEQFVTGETISEALANSRKYEARGFRYSYDMLGEAATTEEDALRYYASYEQAIHAIGKAAGGRGIYEGPGISIKLSALHARYSRSQQERTMNELLPRVRSLALLARRYDIGLNIDAEEADRLELSLDLLEALCFDSELAGWNGIGFVVQAYQKRCPFVIDYLVDLARRSRHRLMIRLVKGAYWDSEVKRAQVDGLEGYPVYTRKIYTDVSYLACAKKLLAAPDAVYPQFATHNAYTLAAIYHLAGQNYYPGQYEFQCLHGMGEPLYEEVTGRDKLNRPCRVYAPVGTHETLLAYLVRRLLENGANTSFVNRIADKTVSVKELVADPVEEAAKVVPLGAPHAKIALPRELYGASRVNSMGLDLSNEHRLASLSSALLASAHHPWRAAPMLADDALAHAEPRDVRNPADLRDVVGTVSEATPEEVGAALAHAVAAAPIWQATPVDARADCLARAADLLEAQMHTLMGLIVREAGKSLPNAIAEIREAVDFLRYYSAQIRDEFSNDTHRPLGPVVCISPWNFPLAIFMGQVAAALAAGNTVLAKPAEQTPLIAAQAVRLLRDAGVPAGAVQLLPGNGETVGAALVADPRTRAVMFTGSTEVARLINKTLSSRLDPDGKPIPLIAETGGQNAMIVDSSALAEQVVADVLQSSFDSAGQRCSALRVLCLQDDVADRTLTMLKGAMRELALGNPDRLSVDVGPVIDADAKRTIDAHIAAMKDKGHAVTQLEMPEACAQGTFVPPTIIEIGNVDELKREVFGPVLHVVRYRRSGLDKLLEQIRATGYGLTLGIHTRIDETIAHVISRAHVGNIYVNRNVIGAVVGVQPFGGEGLSGTGPKAGGALYLQRLLATRPAGLPRSLEASLVADAPQEGETRDNPSAALTALRDWLIEQREPALAARCDGYLSHVLAGATAVLSGPTGERNTYTLGARGTVLCIAATASGARAQFAAVLATGNRALFASAAGEALAAALPAPLKAHAAVRKQADAAFDAVLFEGDSDELLALVKEVAQRPGPIVSVQGVAAGAFENGGDEDYALERLLTERSVSVNTAAAGGNANLMTIG

SEQ ID NO: 1902 - DNA, 3444 bp, Novosphingobium aromaticivorans DSM 12444
  CDS (1)..(3444): transl_table=11
atgacccagaccgcgcccttcgccgcattcgcgccccgccattccgtgccctccgacctgcgccgggcgattaccgccgccacccgccgcgcggaacgcgagtgcatggtcatgctcctgccggaagcaaccttgccacaggcaacccgggcttcggcacaggcgctggcacgcaagctggtcgaggccctgcgcgccaagccgcgcgggaacggggtggagcaactcgtgcaggagtatgccctctcgacgcacgaaggcgtcgccctgatgtgtcttgccgaggcgttgttgcgcattcccgataacgatacgcgcgacgatctcatccgcgacaagatcgcgggaggcgactggctggcgcacctcggcggcgaccgttcgctcttcgtcaacgccgcgacgtggggcctcgtcgtcaccgggaagcttgcctccagcgtcgacgacaccggccttggcgcggccctcacccgcctcatcgcccgtgcgggcgaacctgtcatccgccgcggcgtcgacctcgccatgcgcatgatgggcgaacagttcgtcaccggcgagaccatcgacgaggcgctgaagcgcgcccgtccgctcgaggatcgtggcttccgctacagctatgacatgctgggcgaggcggccatgactgcaagcgacgccgcccgctaccatgcagattaccaggccgccatccacgcaatcggcaaggccgccgcacgtcgcggcgtctacgaaggccccggcatctcgatcaagctctccgcgctgcacccgcgttacgcgcgcgcgcagcaggaccgcgtgttcgccgaactcctgccccgtctcaaggcgctggcttatctcgcgttgcgctacgacatcggcctcaacatcgatgccgaagaggccgaccgcctcgaactctcgctcgacctgctcgaagagctggcgatggacccggagcttgcaggctggaacggactgggcttcgtcgtccaggcctacggcaagcgctgccccttcgtaatcgactggattgtcgatcttgcccgcaggtcgggccgcaggatcatggtccgcctcgtcaagggcgcctattgggacgcagagatcaagcgtgcgcaggtcgacgggcagtccggcttcccggtctacacccgcaaggcccacaccgatgtcgcctatatcgcctgtgcccgccggctgctcgccgcgaccgacgtcgtgttcccccagttcgccacccacaacgcccagacactcgccaccatccacgagatggcaggcccggactttgctgttggccgttacgagttccagtgcctccacggcatgggcgaaccgctctatgacgaggttgtcggcaaggacaagctggaccgcccctgccgcatctacgcgccggtcggcacgcacgaaacgctgctggcctacctcgtccgccgcttgctggaaaacggcgcgaactcttcattcgtcaaccgcatcgccaacccggacgtgccggtcgatgaaatcgttgccgatcccgtggcgcaggttgccgctgatgccgatcccggcgcgccccatcccctgatcgcccttcccgccgcgctttatcccgaccgccgcaacagcagcggtctcgaccttgcggacgaaagcaccctcgccgccctcacggaccgattccaggcgatttccgcccattcgcgtcacgcccacccgtccgccgacctgccccacgtcaatccgcgcccggttctgaatccggcgaaccacagggatgtagttggccacgtcagcgaggccgcaccagcggctgctggcatggcagccagcctcgccgcagcctcgcgctggagcgcgacgcccgtagccgcccgcgccatgatcctggaacgcgcggcagacgccatgcaggcggctatgcccgaactcatcgcgctgatcgtgcgcgaggctggaaagtccgtgtccaacgccattgccgaagtgcgcgaggctgtggatttcctgcgctattacgccagccaggcgcctgccatgtccggttcgcggcctctcggggtcgccttgtgcatcagcccgtggaacttccccctcgccatcttcaccggccaggtggcggccgcgctcatggcgggcaacccggtcctcgccaagcctgccgaagaaacgccgctcattgcctctgaagccgtgcgcatcctccatgaagcgggcgtacccgacgatgccctcgtattcctgccgggagacggcgccatcggagccgcactggtcgctgcgccggaaatcgccgccgtgcttttcaccggatcgacggaagtcggccgtttgatccagcgccagctcgccacccggctttccgcggagggccgcccgatccctctgattgccgaaaccggcggccagaacgcgatgatcgtcgacagttccgcgcttgccgaacaggtcgtggccgatgtgatcgcatctgccttcgacagcgcgggccaacgctgttcggccctgcgcgtcctgtgcctccaggaggacgttgcggatcacgtcctcgccatgctgcgcggcgcgctggcggaactcacggtcggtccgaccgaccgcctcagcgccgacattggccccgtcatcgccgccgaggcgcgcgaagcgatcgaggcgcacgtcgcccgcatggaagctgccggttgcccagtccaccgcctgccgctcggcaccgccaccaacgagggcactttcgttgccccgacgatcatcgaactgtccgcccccgatctcctcacgcgcgaggtcttcgggccggtcctccacgtcatccgcttccgccgagccgacatggacgccatggtcgagcgcatcaatgcctggggctatggcctgaccttcggcctccacacccgcctcgacgagacggtcgcccgcgttacggcgaaggcccatgctggcaacatctacgtcaaccggaacgtcattggcgcggtggtcggcgtccagccgttcggcggccacggcctgtccggcacgggcccgaaagcaggcggcccgctttacctgcgccgccttgtcgccagcgcccctgccgcacccgcactggagttgactgagcgcgaactgcctggccccgtcggcgaacgcaacatctacgccctgcgccccgtaggccgggtccttgtcgccgcccagtcgccagagcgccttgccgccctcaccagccgcgtcgaacggctcggcggcacacccatcgcggccgacgatggctggcaggcgcaaggccccttcgcccgcgcccttgtcgaaggcgacgcggcgttcatcctctctttccagcaggccgtggcggccctcgacgggcccatcgcacctgtccttgcctctgcggacgacgacacgatgctggtggccgaggtgtcgctctcgatcaacaccaccgccgctggcggcaacgccagcctgatggccatggcctga

SEQ ID NO: 1903 - protein, 1147 aa, Novosphingobium aromaticivorans DSM 12444
MTQTAPFAAFAPRHSVPSDLRRAITAATRRAERECMVMLLPEATLPQATRASAQALARKLVEALRAKPRGNGVEQLVQEYALSTHEGVALMCLAEALLRIPDNDTRDDLIRDKIAGGDWLAHLGGDRSLFVNAATWGLVVTGKLASSVDDTGLGAALTRLIARAGEPVIRRGVDLAMRMMGEQFVTGETIDEALKRARPLEDRGFRYSYDMLGEAAMTASDAARYHADYQAAIHAIGKAAARRGVYEGPGISIKLSALHPRYARAQQDRVFAELLPRLKALAYLALRYDIGLNIDAEEADRLELSLDLLEELAMDPELAGWNGLGFVVQAYGKRCPFVIDWIVDLARRSGRRIMVRLVKGAYWDAEIKRAQVDGQSGFPVYTRKAHTDVAYIACARRLLAATDVVFPQFATHNAQTLATIHEMAGPDFAVGRYEFQCLHGMGEPLYDEVVGKDKLDRPCRIYAPVGTHETLLAYLVRRLLENGANSSFVNRIANPDVPVDEIVADPVAQVAADADPGAPHPLIALPAALYPDRRNSSGLDLADESTLAALTDRFQAISAHSRHAHPSADLPHVNPRPVLNPANHRDVVGHVSEAAPAAAGMAASLAAASRWSATPVAARAMILERAADAMQAAMPELIALIVREAGKSVSNAIAEVREAVDFLRYYASQAPAMSGSRPLGVALCISPWNFPLAIFTGQVAAALMAGNPVLAKPAEETPLIASEAVRILHEAGVPDDALVFLPGDGAIGAALVAAPEIAAVLFTGSTEVGRLIQRQLATRLSAEGRPIPLIAETGGQNAMIVDSSALAEQVVADVIASAFDSAGQRCSALRVLCLQEDVADHVLAMLRGALAELTVGPTDRLSADIGPVIAAEAREAIEAHVARMEAAGCPVHRLPLGTATNEGTFVAPTIIELSAPDLLTREVFGPVLHVIRFRRADMDAMVERINAWGYGLTFGLHTRLDETVARVTAKAHAGNIYVNRNVIGAVVGVQPFGGHGLSGTGPKAGGPLYLRRLVASAPAAPALELTERELPGPVGERNIYALRPVGRVLVAAQSPERLAALTSRVERLGGTPIAADDGWQAQGPFARALVEGDAAFILSFQQAVAALDGPIAPVLASADDDTMLVAEVSLSINTTAAGGNASLMAMA

SEQ ID NO: 1904 - DNA, 3930 bp, Burkholderia xenovorans LB400
  CDS (1)..(3930): transl_table=11
atggctagcaccacccttggcgtcaaggtcgacgacctcttgcgttcccggctgaaagatgccgctacccgtctcgaacgcactccgcactggctcatcaagcaggccatcttcgcgtacctcgaaaagatcgagcacggtcaattgccgcccgagctgtcgggtgtggcgggctcggccgatctgaccgagggcgccgcggtcgaacacgaggaagacggtgggtcgcacccgttcctcgatttcgcgcaaaacgtgcaaccgcaatcggtgctgcgcgccgcgatcacggccgcttaccgtcgtcctgagccggagtgtttgccgttcctgctcggtcaggcgcgtttgccggccaacctcgcgggcgacgtgcagacgatggccggcaagctcgtcgaaacgctgcgcacgaagagcaagggcggtggcgtcgaaggtctgatccacgagttctcgctgtcgagccaggaaggcgtggcgctgatgtgtctcgccgaagcgctgctgcgcattcccgaccgcgccacgcgcgacgcgctgatccgcgacaagatcagcaagggcgactggaaatcgcacatgggccaggcgccgtcgatgttcgtcaacgccgcgacctggggcttgatgatcaccggcaagctggtgacgaccaacagcgagacgagcctctcgtcggcgctcacgcgtctgatcggcaagggcggcgagccgctgatccgcaagggcgtggatatggcaatgcgcctgatgggcgagcagttcgtcacgggtgagaacatctccgaggcgctcgccaacagccgcaagtacgaagcccgcggcttccgctactcgtacgacatgctcggcgaagcggccaccaccgaagccgacgcgcagcgctactacgcgtcgtacgaacaggcgatccacgcgatcggcaaggctgccggcggccgtggcatctacgaaggcccgggcatttcgatcaagctctccgcgctgcacgcacgctactcgcgttcgcagcaggaacgcaccatgagcgaactgctgccgcgcgtgcgctcgctggcaatcctcgcgcgccgctacgacatcggcctgaacatcgacgcggaagaagccgaccgcctcgaaatctcgctcgatctgctcgaagcgctgtgcttcgatccggagctggccggctggaacggcatcggcttcgtggtgcaggcgtatcagaagcgctgcccgttcgtgatcgaatacctgatcgatctggcgcgccgcagccgtcaccgcatcatggtgcgcctcgtgaagggcgcgtactgggacaccgaaatcaagcgcgcgcaagtggacggcctcgaaggctatccggtctacacgcgcaagatctacacagacgtgtcgtatctcgcctgcgcgaagaaactgctcagcgcgcccgacgcggtctacccgcaattcgccacgcacaacgcgcacacgctgtcggcgatctatcacctcgcgggcaacaactattaccccggccagtacgagttccagtgcctgcacggcatgggcgaaccgctgtacgaagaagtcaccggccgcgacaagctgaaccgtccgtgccgggtgtacgcgccggtcggcacgcatgaaacgctgcttgcctatctcgtgcgccgtctgctggaaaacggcgcgaacacgtcgttcgtgaatcgtattgccgatgaaaccgtcgcgatcaaggacctgatcgccgatccggtcgatgaagcctcgaagatcgtcccgctcggcgcgccgcacgcgaagattccgctgccgcgcaatctgtacggttcggaacgcctcaactcgatgggtctcgacctgtcgaacgagcatcgcctggcgtcgctgtcgtcggcgttgctggcgagcgcgcatcatccgtggcgcgccgcgccgatgctcgaagacaacgagatcgccgtgggcctcgcgcgcgacgtgcgcaatccggccgatcatcgcgacctcgtcggcacggtcgtggaaacgacgccggagcacgtgagcgccgctttggcgcacgcggtggccgccgcgccgatctggcaagccacgccggtcgatgcgcgcgccgattgcctcgcgcgtgccgccgatctgctcgaagcgcagatgcatacgctgatgggcctcgtggtgcgtgaagccggcaagtcgctggccaacgccgtcgcggaaattcgcgaagcgatcgacttcctgcgttactactccacgcagattcgcgaggagttctccaacgacacgcatcgtccgctcggcccggtggtctgtatcagcccgtggaatttcccgctggcgattttcatgggccaggtggccgcggcgctcgccgccggcaacaccgtgctcgcgaagccggccgaacagacgccgctgatcgccgcgcaagccgtgcgcattctacgcgaagccggcgtgccggcgggcgcggtgcaactgctgccgggcaacggtgaaacggtcggcgccgcattggtggccgatccgcgcacccgcgcggtgatgttcaccggctcgaccgaagtcgcacgcctcatcaacaagacgctgtcgagccgactcgatccggatggcaagccgattccgctgatcgccgaaacgggcggccagaacgcgatgatcgtcgactcgtcggcgcttgccgaacaggtggtggcggacgtgctgcaatcgtcgttcgactccgccggtcaacggtgttccgcgctgcgcgttctttgtctgcaggacgatgtcgcggaccgcacgctggaaatgctgaccggcgcgatgcgcgaactggccgtgggcaatccggaccgtctgtcggtcgacgtcggcccggtgatcgacctcgacgcgaagcgcggtatcgacgcgcacgtcgcggcgatgcgcgagaagggccgcaaggtcgagcagctgccgatgccggacggttgcgcgcaaggcaccttcgtgccgccgacgttgatcgaactcgacagcatcgacgaactgaagcgtgaagtgttcggcccggtgctgcacgtggtgcgctaccgccgcagccagctggacaaactgctggagcagatccgcgcgaccggctatggcctgacgctcggcatccatacgcgtatcgacgaaacgatcgcgcatgtgatcagccgcgcgcacgtgggcaacatctacgtgaaccggaacgtgatcggcgctgtggtcggcgtgcagccgttcggtggcgaaggtttgtcgggcacgggtccgaaagcgggcggcgcgctctatctgcagcggctcctcgccacgcgtccggccggtttgccgaagtcgcttgcgcgggctttggtcgtggatgttccgcgcgcggccgaaaacggcgacaatccgtccgctgtattgacggcttaccgcgactggctgattaccgaacgcgagccgcaactggccgcgcgctgcgacggctatctgtcgcatgtgccggcgggcgccacggcggtattgtcgggaccgaccggcgagcgcaacacgtacacgctgggcgcgcgcggcacggtgctgtgtatcgcgtcgacggcgagcggtgcgcgcgtgcagtttgccgcggcgctggctacgggaaatcgcgcgttgttcgaaggcgcggctggggaacaattggtgtcgcagttgcccgcctcgctgaagtcgcacgcaagcgtgaagaagagtgccgatacgccgttcgacgccgtgctgttcgaaggcgatagcgacgaactgctggcgctggtgaaggaagtcgcgaagcgtccaggcccgatcgtgtcggtacagggcgtcgcggcacgcgcgctggaaagcggcgacgaggactacgcgctcgagcgtctgttgacggaacgctcggtcagcgtcaatacggcagctgcaggcggtaatgcgaatttgatgacgatcggttga

SEQ ID NO: 1905 - protein, 1309 aa, Burkholderia xenovorans LB400
MASTTLGVKVDDLLRSRLKDAATRLERTPHWLIKQAIFAYLEKIEHGQLPPELSGVAGSADLTEGAAVEHEEDGGSHPFLDFAQNVQPQSVLRAAITAAYRRPEPECLPFLLGQARLPANLAGDVQTMAGKLVETLRTKSKGGGVEGLIHEFSLSSQEGVALMCLAEALLRIPDRATRDALIRDKISKGDWKSHMGQAPSMFVNAATWGLMITGKLVTTNSETSLSSALTRLIGKGGEPLIRKGVDMAMRLMGEQFVTGENISEALANSRKYEARGFRYSYDMLGEAATTEADAQRYYASYEQAIHAIGKAAGGRGIYEGPGISIKLSALHARYSRSQQERTMSELLPRVRSLAILARRYDIGLNIDAEEADRLEISLDLLEALCFDPELAGWNGIGFVVQAYQKRCPFVIEYLIDLARRSRHRIMVRLVKGAYWDTEIKRAQVDGLEGYPVYTRKIYTDVSYLACAKKLLSAPDAVYPQFATHNAHTLSAIYHLAGNNYYPGQYEFQCLHGMGEPLYEEVTGRDKLNRPCRVYAPVGTHETLLAYLVRRLLENGANTSFVNRIADETVAIKDLIADPVDEASKIVPLGAPHAKIPLPRNLYGSERLNSMGLDLSNEHRLASLSSALLASAHHPWRAAPMLEDNEIAVGLARDVRNPADHRDLVGTVVETTPEHVSAALAHAVAAAPIWQATPVDARADCLARAADLLEAQMHTLMGLVVREAGKSLANAVAEIREAIDFLRYYSTQIREEFSNDTHRPLGPVVCISPWNFPLAIFMGQVAAALAAGNTVLAKPAEQTPLIAAQAVRILREAGVPAGAVQLLPGNGETVGAALVADPRTRAVMFTGSTEVARLINKTLSSRLDPDGKPIPLIAETGGQNAMIVDSSALAEQVVADVLQSSFDSAGQRCSALRVLCLQDDVADRTLEMLTGAMRELAVGNPDRLSVDVGPVIDLDAKRGIDAHVAAMREKGRKVEQLPMPDGCAQGTFVPPTLIELDSIDELKREVFGPVLHVVRYRRSQLDKLLEQIRATGYGLTLGIHTRIDETIAHVISRAHVGNIYVNRNVIGAVVGVQPFGGEGLSGTGPKAGGALYLQRLLATRPAGLPKSLARALVVDVPRAAENGDNPSAVLTAYRDWLITEREPQLAARCDGYLSHVPAGATAVLSGPTGERNTYTLGARGTVLCIASTASGARVQFAAALATGNRALFEGAAGEQLVSQLPASLKSHASVKKSADTPFDAVLFEGDSDELLALVKEVAKRPGPIVSVQGVAARALESGDEDYALERLLTERSVSVNTAAAGGNANLMTIG

SEQ ID NO: 1906 - DNA, 3963 bp, Ralstonia metallidurans CH34
  CDS (1)..(3963): transl_table=11
atggccaccaccaccctcggcgtcaagctcgacgacgcatcgcgcgaacgcctgaagcgcgttgcccagtccatcgaccgcaccccgcactggctgatcaagcaggccatcttcacgtacctggaacaggtggaacgcggccatctgccccatgaagctggtgccggcgcgactgcagataccgatggcgccgatgctggcgacgcgacgcaggccgatgccgcgccgcaacctttcctcgaattcgcgcagagcgtccagcctcagtcggtactgcgcgcggccatcacgtccgcctaccgccgtccggaaaccgaatgtgtgccggtgctgctggagcaggcgcgcctgccgcaggcgcaggccgatgccgccatcaagatggcgcgagccctggcggcccggctgcgtgagcagaaagtaggcagcggacgcgaggggctggtgcaggggctgatccaggagttctcgttgtcgtcgcaggaaggcgtggcgctgatgtgcctggccgaagcgctgctgcgcatccccgacaaggccacgcgcgatgcgctgatccgcgacaagatcagcggcgccaactggcaatcacatctgggccagagcccgtcgctgttcgtcaacgctgccacctggggcctgctgctgaccggccggctggtggccacgcacaccgaagccggactgtcgaaggcgctgacgcgcatcatcggcaagggcggcgagccgttgatccgcaagggcgtggacatggcgatgcgcctgatgggcgagcagttcgtgactggcgaaacaatctccgaggcgctggccaacgcgcgcaagtacgaggaagagggcttccgttactcgtatgacatgctcggcgaagcggcgatgaccgaggccgatgcccagcgctacctggcgtcctacgagcaggcgatccacgcgatcgggcaggcttcgcgcggccgtggcatctacgaaggcccaggcatctcgatcaagctatccgcgctgcacccgcgctacagccgcgcgcagcacgagcgcgtgatcaccgaactctacggtcgcctgaagagcctgacgatgctggcccgccagtacgacatcggtatcaacatcgacgccgaggaagcggaccgcctggaaatctcgctcgacctgcttgagcggctctgcttcgagccggagctggccggttggaacggcatcggcttcgtggtgcagggctatcagaagcgctgcccgttcgtgatcgattatctgatcgacctggcgcgccgtagccggcatcgcctgatgatccgcctggtcaagggtgcgtactgggacagcgagatcaagcgcgcccaggtcgacggcctggagggctacccggtctacacgcgcaaggtctacaccgatgtgtcgtatgtggcctgcgcccgcaagctgctgtcggtgcccgacgcgatttatccacagttcgccacccacaacgcccacacgctggcagccatctaccagatcgccggccagaactattaccccggccagtacgaattccagtgcctgcatggcatgggcgagccgctgtacgaccaggtggtcggcccggtggcggatggcaaattcaaccggccgtgccggatctacgcgccggtcggcacccacgaaacgctgctggcatacctggtgcgccgcctgctcgagaacggcgccaacacctcgttcgtgaaccggatcgccgacgagacgatcgcgctcgacgatctcgtcgctgacccggtggccgtggtcgaaaccatgcacaagacagagggcgtgcttggcctgccgcatccgcgtatcccgcagccgcgcgcgctgtatggcaaatcgcgcgccaattcggccggcatcgacctgtcgaatgaacatcggttggcgtcgctgtcgtccgcactgctggccggcaccagcgagacgccgcgcgcggaaccgctgctcggcgccgcagtggcgggcacggatgccacgtccgagccggtactgaatccggcggatcgtcgcgacgtagtggggcaggtcagcgaggcaacgccggctgagaccgaagccgcgcttgtggccgccgtcaacgtggcgccgatctggcaggccacgccgcccgaagtgcgtgccgccgcgctggaacgcgccgccgatctgatggaagcccagatgcagtcgctgatgggcatcatcatgcgcgaggccggcaagacgttttcgaacgccatcgccgaagtgcgcgaggcggtcgacttcctgcgctactacgcggtgcaggtccgcgcgtcgttctcgaacgatacccatcgcccccttggtccggtggtctgcatcagcccgtggaatttcccgctggcgatcttcaccggccaggtggccgccgcgctggcagccgggaatccggtgctggccaagccggccgaacagacgccgctgatcgccgccgccgccgtgcgtctgctgcgcgacgccggtgtgcccgcagccgcggtgcaattgctgccgggccggggcgagaccgtcggcgcggcgctggtaggcgacgcccgggtcaagggcgtgatgttcaccggctcgaccgaagttgcccgcctcctgcaacgcaacgtggcgagccgtctcgatgccgcgggccgtccgattccgctgatcgccgagacgggcgggcagaacgcgatgatcgtcgattcctcggcgctggccgagcaggtggtgggcgacgtggtgacttcggccttcgattcggccggccagcgctgttcggcgctgcgcgtgctgtgcctgcaggaagacgtggccgaccgcatcctggaaatgctcaagggtgcgatgggtgagttgacgctgggcaacccggatcgcctctccactgacgttggtcctgtgatcgacgaggaagcgcgcggcaatatcctgcgccatatcgaagcgatgcgggccaagggccgtcgtgtgcaccaggccgacccgggcgcggcggacacgccggcctgccgccatggcacgttcgtgccgccgacgctgatcgaactcgattcgatcgcggagctgaagcgggaggtgttcggtccggtgttgcatgtggtgcgcttcccgcgaaccgcgctggacaagctgatcgaccagatcaatggcactgggtatggcctgacgctcggcgtccacacgcggatcgacgagacgatcgcgcacatcgtcgaccgcgcggatgtgggcaatctctatgtgaaccggaatgtcgtcggcgccgtggtgggcgtgcagccattcggtggcgaagggctgtccggcacggggccgaaggcgggagggccactctatctgcaccggctgctgtcggtctgcccgcaggatgccgtggcgcgcgccgtgcgtgcgtcggatgcgactggtggcgtggccgccgcgccggtgtcgcccgaactggccgcgctgaaggcctgggcgcaggcgtcgctgcccgaggtggccgaggcctgcgatcgcctggccgcggcatcgccgtcggggctcggtgtgacgctgccgggtcctaccggcgagcgcaacacctactcgctgctgccgcgcgagcgtgtgctttgcctcgcccagcaggagtccgatctggtgctgcaactggccgccgtgctggccgtcggcagcgaggcgttgtgcgttgacacagcgcagaccagggccctgtctgaaaggcttcccgccgcagtacaatcgcgcgtccgcatggtttccgactggacgtcgacggatacggcattcgatgccgtgctgcaccacggcgattccgaccagcttcgcacggtttgcgagcaggtggccacccgcactggtccgatcgtcggcgtgcagggccttgcgcacggtgaaccgaatatcgctctggagcgtttgttgatcgaacgttcgctgtccgtcaatacggcggccgcgggcggcaatgcaagtttgatgacgatcggctga

SEQ ID NO: 1907 - protein, 1320 aa, Ralstonia metallidurans CH34
MATTTLGVKLDDASRERLKRVAQSIDRTPHWLIKQAIFTYLEQVERGHLPHEAGAGATADTDGADAGDATQADAAPQPFLEFAQSVQPQSVLRAAITSAYRRPETECVPVLLEQARLPQAQADAAIKMARALAARLREQKVGSGREGLVQGLIQEFSLSSQEGVALMCLAEALLRIPDKATRDALIRDKISGANWQSHLGQSPSLFVNAATWGLLLTGRLVATHTEAGLSKALTRIIGKGGEPLIRKGVDMAMRLMGEQFVTGETISEALANARKYEEEGFRYSYDMLGEAAMTEADAQRYLASYEQAIHAIGQASRGRGIYEGPGISIKLSALHPRYSRAQHERVITELYGRLKSLTMLARQYDIGINIDAEEADRLEISLDLLERLCFEPELAGWNGIGFVVQGYQKRCPFVIDYLIDLARRSRHRLMIRLVKGAYWDSEIKRAQVDGLEGYPVYTRKVYTDVSYVACARKLLSVPDAIYPQFATHNAHTLAAIYQIAGQNYYPGQYEFQCLHGMGEPLYDQVVGPVADGKFNRPCRIYAPVGTHETLLAYLVRRLLENGANTSFVNRIADETIALDDLVADPVAVVETMHKTEGVLGLPHPRIPQPRALYGKSRANSAGIDLSNEHRLASLSSALLAGTSETPRAEPLLGAAVAGTDATSEPVLNPADRRDVVGQVSEATPAETEAALVAAVNVAPIWQATPPEVRAAALERAADLMEAQMQSLMGIIMREAGKTFSNAIAEVREAVDFLRYYAVQVRASFSNDTHRPLGPVVCISPWNFPLAIFTGQVAAALAAGNPVLAKPAEQTPLIAAAAVRLLRDAGVPAAAVQLLPGRGETVGAALVGDARVKGVMFTGSTEVARLLQRNVASRLDAAGRPIPLIAETGGQNAMIVDSSALAEQVVGDVVTSAFDSAGQRCSALRVLCLQEDVADRILEMLKGAMGELTLGNPDRLSTDVGPVIDEEARGNILRHIEAMRAKGRRVHQADPGAADTPACRHGTFVPPTLIELDSIAELKREVFGPVLHVVRFPRTALDKLIDQINGTGYGLTLGVHTRIDETIAHIVDRADVGNLYVNRNVVGAVVGVQPFGGEGLSGTGPKAGGPLYLHRLLSVCPQDAVARAVRASDATGGVAAAPVSPELAALKAWAQASLPEVAEACDRLAAASPSGLGVTLPGPTGERNTYSLLPRERVLCLAQQESDLVLQLAAVLAVGSEALCVDTAQTRALSERLPAAVQSRVRMVSDWTSTDTAFDAVLHHGDSDQLRTVCEQVATRTGPIVGVQGLAHGEPNIALERLLIERSLSVNTAAAGGNASLMTIG

SEQ ID NO: 1908 - DNA, 3693 bp, Rhizobium leguminosarum bv. viciae 3841
  CDS (1)..(3693): transl_table=11
atggaccccgccccctccaacgatccgaccgacggcgcgccattctcggcctttgccccaccgatccggccgcaatccgaacttcgccaggccatcacggcagcctatcgccggccggaaaccgaatgcctgccgccgctcgttgccgcagcgcgcgtctccgaagcaaaacgctatgacattcgcagcacggcccgcagcctgatcgaggcgttgcgcgccaagcacaaggggaccggtgtcgaagggctggtgcaggaatattcgctttccagccaggaaggcgtggcgctcatgtgcctcgccgaagcgctgctgcgcattcccgataccgaaacccgggacgcgctgatccgcgacaagatcgccgagggtaactggacctcccatatcggcggcggaaaatccatgttcgtcaatgccgccacctggggcctcgtcgtcaccggcaagctcacctcgacggtcaacgaccgaagcctgtcggcagcgctgacgcggctgattgcgcgcgccggcgagccggtcatccgtcgcggcgtcgatatggcgatgcgcatgatgggcgagcagttcgtcaccggcgaaacgatcgcagaggcgctgaaacgcgcccggccgctggaagcgcgcggcttccgctattcctacgacatgctgggcgaggcagcgacgacgggcgctgatgccgagcgttattaccgggattacgaaaaggcgatccacgccatcggcaaggcgtcggacgggcgcggcatctatgacggcccgggcatatcgatcaagctttcggccctgcatccccgttacgtgaggtcgcaggccggccgggtgatgagcgagctgctgccgaaggtcaaggcgctggccgttctcgccaagacctatgatatcggcctcaatattgacgcggaggaggccgatcggctggagctttcgctcgatctcctcgaggagctttgctttgcccctgatcttgccggatggaacgggctgggcttcgtcgtgcaggcctatggcaagcgctgccccttcgtcctcgactacatcatcgatctcgcacgccgctccgggcgccgggtcatggtccgtctcgtcaagggcgcttattgggatgcggagatcaagcgtgcccagcttgacggtctcgacgactatccggtctatacccgcaagatcttcaccgacgtcgcctacgtcgcctgcgcgcgcaagctgctcgatgctccggatgcggtcttcccgcaatttgccacccataatgcgcagacgctcgccacgatctatcgtctggcgggccctgatttcaccgtcggcaaatacgagttccaatgcctgcatggcatgggcgaacctctctacgacgaggttgtcggaaaggaaaagctggaccggccctgccggatttatgcgcctgtgggaacgcatgagacgctgctcgcctatctggttcggcgtcttctggaaaatggcgccaattcctccttcgtgcaccgcatctccgatccgaatgtctcggtcgaggcgctgatcgccgatcccgccgaaatcgtcgcagccatgcctgtcgttggcgcgccgcacgcgcagatcgcctcgccgcgggcactttacggcaatgcccgggccaattccgatggtctcgatctctcgaacgaggccaccctttcggatttggctgatgcgctcatctccacggctgctgccccgtggcatgcgcttcccctccttgccgacggctctacggatggggtgacgcgcgatgttctcaatcctgccgatcaccgggatgtcgtcggcacggtgaccgaagtgaaggtcgaggaggcagcgcgtatcgttcgcatggctgcggagcatgcgccgcaatgggcggccgtgccgccggccgagcgtgccgcctgcctggagcgggcggccgatatcatgcaggcccgcatcaaggtgctgatgggcattgtcatgcgcgaggccggcaaatccgcggccaatgccgtcggcgaggtgcgtgaggccatcgacttcctgcgctactacgccgaacaggcgcgcaagacgctgggcccctcgcatgcgcccctcggcccgatcgtctgcatcagcccgtggaattttccgctggcgattttcaccggacaggtcgccgcagccttggtggccggcaatcccgtgcttgccaaacctgccggcgtcacgccgattatcgcttcggagagcgtcaagatccttcacgaggcgggcgtgcctgtcggtgccctgcagttcgtccccggcagcggccgtctcggcgccggtatggtcggggcggaggaaacggcaggcgttatgtttaccgggtcgaccgaagttgcccgcatgatccaggcgcagctggcggaacggctgtcggtgagcggcaagccgattccgctgattgccgaaaccggcggccagaacggcatgatcgtcgactcctcggctttggccgagcaggtggtggccgacgtcatcgcgtcagctttcgacagcgccggtcagcgctgctcggcgctcagggttctctgcgttcaggacgatgtcgccgacaggactctcgccatgctgaagggcgccttccgcgagctgacgatcggccgtaccgatcgcctgagcatcgatgtcggcccggtcatcaacgacagcgcaaaggcggagatcgaccagcatatcgagcatatgcgcggcttgggccgcaaggtggatcagctgccgctgcccgaaagtgccgcggcgggaaccttcgttccgcccacaatcatcgaaatcaagtccctgtcggacctgacgaaggagatcttcggaccggttctgcatgtcgtccgcttcaagcgaaacgggctcgaccgtctgatcgacgacatcaacgcatcgggttatggtctcacattcgggcttcacacccggcttgatgagacgatcgcgcatgtgaccagccgcatcaaggccggaaacctttacgtcaaccggaacatcatcggcgccgtcgtcggcgtgcagccgttcggcggccgcggcctgtcgggaaccggtccgaaggccggcggtccgctctatatcggccggctggtgcagcgtgcgcccgtgccgccgcagcaggattccgtccatacggacctcgcccttcgtgactacatcgtctggctcgacaagaagggcctgtcgggcgagggggaagtggcgcgtggatatgcgagccgctcggcgctcgggctcgaacgcgaactcaccggtccggtgggcgagctcaatctctacgcgctccatccccgcggtcgtattctcctcgtgccgcagaccgaaggcgggcttcatcgccagattgccgcagccctttcgaccggcaaccacatcgtcgtggacgcgggttccctatcgaagtcagtcctggcagaccttccggcggctgtcgccggccggatctcctggacctcggattgggaaaaggacgggccgttctccggcgcgctcgtcgaaggggatcgcgacagggttctcgccgtcaatcagaagattgctcacctgcccggtccgctgctgctggtccaggccgcgacgagcgaggaactggcgagcgatcccgaagcctattgcctcaactggttgctggaggaggtgtcgacgtcgatcaacaccgcggctgccggcggcaatgcaagcctgatggccatcggctga

SEQ ID NO: 1909 - protein, 1230 aa, Rhizobium leguminosarum bv. viciae 3841
MDPAPSNDPTDGAPFSAFAPPIRPQSELRQAITAAYRRPETECLPPLVAAARVSEAKRYDIRSTARSLIEALRAKHKGTGVEGLVQEYSLSSQEGVALMCLAEALLRIPDTETRDALIRDKIAEGNWTSHIGGGKSMFVNAATWGLVVTGKLTSTVNDRSLSAALTRLIARAGEPVIRRGVDMAMRMMGEQFVTGETIAEALKRARPLEARGFRYSYDMLGEAATTGADAERYYRDYEKAIHAIGKASDGRGIYDGPGISIKLSALHPRYVRSQAGRVMSELLPKVKALAVLAKTYDIGLNIDAEEADRLELSLDLLEELCFAPDLAGWNGLGFVVQAYGKRCPFVLDYIIDLARRSGRRVMVRLVKGAYWDAEIKRAQLDGLDDYPVYTRKIFTDVAYVACARKLLDAPDAVFPQFATHNAQTLATIYRLAGPDFTVGKYEFQCLHGMGEPLYDEVVGKEKLDRPCRIYAPVGTHETLLAYLVRRLLENGANSSFVHRISDPNVSVEALIADPAEIVAAMPVVGAPHAQIASPRALYGNARANSDGLDLSNEATLSDLADALISTAAAPWHALPLLADGSTDGVTRDVLNPADHRDVVGTVTEVKVEEAARIVRMAAEHAPQWAAVPPAERAACLERAADIMQARIKVLMGIVMREAGKSAANAVGEVREAIDFLRYYAEQARKTLGPSHAPLGPIVCISPWNFPLAIFTGQVAAALVAGNPVLAKPAGVTPIIASESVKILHEAGVPVGALQFVPGSGRLGAGMVGAEETAGVMFTGSTEVARMIQAQLAERLSVSGKPIPLIAETGGQNGMIVDSSALAEQVVADVIASAFDSAGQRCSALRVLCVQDDVADRTLAMLKGAFRELTIGRTDRLSIDVGPVINDSAKAEIDQHIEHMRGLGRKVDQLPLPESAAAGTFVPPTIIEIKSLSDLTKEIFGPVLHVVRFKRNGLDRLIDDINASGYGLTFGLHTRLDETIAHVTSRIKAGNLYVNRNIIGAVVGVQPFGGRGLSGTGPKAGGPLYIGRLVQRAPVPPQQDSVHTDLALRDYIVWLDKKGLSGEGEVARGYASRSALGLERELTGPVGELNLYALHPRGRILLVPQTEGGLHRQIAAALSTGNHIVVDAGSLSKSVLADLPAAVAGRISWTSDWEKDGPFSGALVEGDRDRVLAVNQKIAHLPGPLLLVQAATSEELASDPEAYCLNWLLEEVSTSINTAAAGGNASLMAIG

SEQ ID NO: 1910 - DNA, 3666 bp, Azoarcus sp. BH72
  CDS (1)..(3666): transl_table=11
atgaggtttgacgcggatgttccggaagcgcctggcgcgctgcgcgctgcgatcaccgcggcgacgcggcgtgacgaggcggattgcgtgcacgccctggtcgccgaactgcagcagcggcgcgcccggctggggctggacgacgcggcggtggaggcgcgcgcggcggcgctggtcgtcgacgtgcgccgccgccgccgcggggccggcggcgtcgaccagctgatgcacgagttctcgctctccacccaggagggggtggcgctgatgtgtctcgcggaggcgctgctgcgcattcccgatcacgccaccgcggaccgcctgatccgcgacaagatcggccagggcgactggcgcacccacctcggccacagcgaatccctgttcgtcaatgccgcgacctggggcctgctgatcagcgggcggctggtcgccacccgcagcgaacgcgcgctcggcagcgcgctctcgcggctgctggcgcgcggcggcgagccggtggtgcggcgcggggtcgatttcgcgatgcgcctgctgggccagcagttcgtgcttggcgaaaccatcggcgcggcgctgcgccgcagccgcgacagcgagtcgcgcggctacagccattccttcgacatgctgggcgaggcggcgctgaccgcggccgacgccgagcgctacacccgcgcctacgaggaggccatccacgctatcggcgccgccgccgcggggcacgggccgcgcgccggccccggcatctcgatcaagctgtcggcgctgcatccgcgttactgccgcgcgcagcgcagccgcgtgcgcgccgaactgctgccgcggctcgccgcgctgatgcggctcgcgcgcggctacgacatcggcgtcaacatcgacgccgaggaggccgaccgcctcgaactctcgctcgacctgttcgaggctctggtcgccgatccgctgctggcgggctgggacggcctcggcttcgtcgtccaggcctaccagaagcgcgcgcccttcgtgatcgactatctggtagacctcgcccaccgcagcggccgccgcctgatgatccggctggtcaagggcgcctactgggacagcgagatcaagcgtgcccaggtcgagggccaggccggctacccggtctacacccgcaaggcccacaccgaccttgcctacctggtgtgcgcggcgcgcctgctcgccgaggccggcgcggtctatccgcagttcgccacccacaatgcgcgcaccgtcgccgaggtgcacgagatggcgcagtgcgtgggtgccgggggcacgctgcccgcgtatgaattccagtgcctgcacggcatgggcgaaagcctgtacgacagcgtggtgggcggcgcgcggctgggggtgccgtgccgcatctacgcgccggtgggcagccaccgcacgctgctgccctacctggtgcgccgcctgctggagaacggcgccaacagctccttcgtcaatcgcatcgtcgacgacagcatgccggtcgccgcactggcggccgacccgctgcaggcggtgctcgccggcgacgtgacgccgcatccctcgatccccttgccggccgggctttacggccccgagcggcgcaactcggccgggctggatctcgccagcgacgccgtgctggcggcgctggaagcggcactcgtggcgcgtgccggcgagccgcggcgggcccaaccgctgctcggcagcggcaagttggacgaggccgccgcgcgccagcgcgcccggccggtgtgcaacccggcggaccacgccgacatcgtcggcagcgtagtggaggcgctgcccgacgaggtggaagcggcactcgccgcggctgccgccgccgcggcaggctgggccgcggtgccgcccgcagcacgggccgacgcgctgcgcgccgccgccgaccgcttcgaagcgcagcaggccgcgctggtcagcgtgctggtgcgcgaagccggcaagacctggggcaacgcagtggcggaggtgcgcgaggcggtcgatttctgccgctactacgcgcaacaggtggtgacgctgccggcgcccacgcaggcggcgccgctggtctgcatcagcccgtggaattttccgctcgcgatcttcgtcggccagctcagcgccgcccttgccgccgggcgctgcgtgctggccaaaccggcgctggccacgccgctgaccgcggcgctggcggtggaactgatgcatgcggccggtattccgcgtgccgccctgcaactgctgccagggcgcggcggcagcgtgggccagacgctggcacgcgacccgcggatcggcggcgtgctgttcaccggctccaccgacgtagcacgcggtctggcgcgctggctggccgagcgcggcgccgggcccgagccctgcctgatcgcggaaaccggcgggcagaacgcgatgatcgtggattcttccgcgctgctggagcaggtggtgcaggacgtgctggtgtcggctttcgacagcgccggccagcgctgctcggcgttgcgggtgctgtgcgtgcagcgcgacatcgccgaaccgctgctgacgatgctgaaggatgcgatgggcgaactgcgcattggcgacccggccgcgctggcgaccgatatcggcccggtgatcgacaacgcggcgcgcgacgcgctcgaggcgcatgtcgcgcgcatgcaggcggcgggccgcggcgtgttccgcgtgccgctgcccccggcctgcgagaacggcagcttcgtcgcgccgacgctgatcgagatcgacggcatcggcgacgtcgggcgcgaggtgttcggccccatcctgcacgtgttgcgcttcgatgccgagggcctcgaccgcctgatcgcgtcgatcaatgccaccggctacgggctgaccggcggcctgcacagccgcatcgacgagaccgtggagcgcgtggtggccggcttgcgggtgggcaatctctacgtcaatcgcaacatggtcggcgcggtggtgggggtgcagcccttcggcggcgaaggcctgtccgggaccgggccgaaggcaggcgggccgctctacctgcaccggctgctcggcactgcccagctcgacccggcggcgctgggtctggtggccccggccgaacccgctgcggcgctcggcgtgctggcggcctgggcgcgccagcgcggcgacagcgcgctcgccgcccgctgtgccgaggacggtgcccgcagcctcgcgggctgccactgcgcgctgccggggccgaccggcgaagcgaacacgctgcgcttcgtcgggcgcggcgtggtgctgtgcgtggcggattccgcgccggcgctgctcgcccagctggccgccgcgctcgccaccggcaacagcgccttgttcgaggccggcgccgcggcctaccgggtggcggcggagttgccgagcgcactcggcggctggctgggcgtgcgcggccacggccccgacccggttttcgcggtggcgctgttcgatggcgacaccgaggcggagtggctgttgcggcgccggctcgcggagcggcccgggccgctggtggcggtgttgcgggcggacggcgcgggccgctacccgttgcaccggctggtggccgagcgcgtcgtcagcatcaacaccgcggcggcgggcggcaatgcggcgctgatgaccctgggctga

SEQ ID NO: 1911 - protein, 1221 aa, Azoarcus sp. BH72
MRFDADVPEAPGALRAAITAATRRDEADCVHALVAELQQRRARLGLDDAAVEARAAALVVDVRRRRRGAGGVDQLMHEFSLSTQEGVALMCLAEALLRIPDHATADRLIRDKIGQGDWRTHLGHSESLFVNAATWGLLISGRLVATRSERALGSALSRLLARGGEPVVRRGVDFAMRLLGQQFVLGETIGAALRRSRDSESRGYSHSFDMLGEAALTAADAERYTRAYEEAIHAIGAAAAGHGPRAGPGISIKLSALHPRYCRAQRSRVRAELLPRLAALMRLARGYDIGVNIDAEEADRLELSLDLFEALVADPLLAGWDGLGFVVQAYQKRAPFVIDYLVDLAHRSGRRLMIRLVKGAYWDSEIKRAQVEGQAGYPVYTRKAHTDLAYLVCAARLLAEAGAVYPQFATHNARTVAEVHEMAQCVGAGGTLPAYEFQCLHGMGESLYDSVVGGARLGVPCRIYAPVGSHRTLLPYLVRRLLENGANSSFVNRIVDDSMPVAALAADPLQAVLAGDVTPHPSIPLPAGLYGPERRNSAGLDLASDAVLAALEAALVARAGEPRRAQPLLGSGKLDEAAARQRARPVCNPADHADIVGSVVEALPDEVEAALAAAAAAAAGWAAVPPAARADALRAAADRFEAQQAALVSVLVREAGKTWGNAVAEVREAVDFCRYYAQQVVTLPAPTQAAPLVCISPWNFPLAIFVGQLSAALAAGRCVLAKPALATPLTAALAVELMHAAGIPRAALQLLPGRGGSVGQTLARDPRIGGVLFTGSTDVARGLARWLAERGAGPEPCLIAETGGQNAMIVDSSALLEQVVQDVLVSAFDSAGQRCSALRVLCVQRDIAEPLLTMLKDAMGELRIGDPAALATDIGPVIDNAARDALEAHVARMQAAGRGVFRVPLPPACENGSFVAPTLIEIDGIGDVGREVFGPILHVLRFDAEGLDRLIASINATGYGLTGGLHSRIDETVERVVAGLRVGNLYVNRNMVGAVVGVQPFGGEGLSGTGPKAGGPLYLHRLLGTAQLDPAALGLVAPAEPAAALGVLAAWARQRGDSALAARCAEDGARSLAGCHCALPGPTGEANTLRFVGRGVVLCVADSAPALLAQLAAALATGNSALFEAGAAAYRVAAELPSALGGWLGVRGHGPDPVFAVALFDGDTEAEWLLRRRLAERPGPLVAVLRADGAGRYPLHRLVAERVVSINTAAAGGNAALMTLG

SEQ ID NO: 1912 - DNA, 4041 bp, Burkholderia vietnamiensis G4
  CDS (1)..(4041): transl_table=11
atgggtgcaaccggccgtgtaattcggttgcacctttttattgcgtgccgtaggatttcgcgcatcctctcacaccacatggccggacccgcgccggcgcacgaacccaccatggcaagcacgactctcggcgtcaaagtcgacgaccttctccgctcgcgcctgaaagacgcggcgacgcgtctcgagcgcactccccactggctgatcaagcaggcgatcttcgcgtatctcgagcgcatcgagcacggtcagttgccgcccgagctgtcgggcagcagcggcgtgaccgagctcgccgacggccacgcggcggaggacgacgacaactcgccgcatccgttcctcgagttcgcgcagaacgtgcagccgcaatcggtgctgcgcgcggcgatcaccgccgcgtatcgccgccccgagccggaatgcgtgccgttcctgctgggccaggcgcgcctgccggcgaacctgcaggcggacgtgcagacgctcgcgacgcacctcgtcgagacgctgcgcgagaagagctcgggcggcggcgtcgaagggctgatccacgagttttcgctgtcgagccaggaaggcgtcgcgctgatgtgcctcgccgaagcgctgctgcgcatccccgaccgcgcgacgcgcgatgcgctgatccgcgacaagatcagcaagggcgactggcgctcgcacgtcggccacgcgccgtcgctgttcgtgaacgcggcgacctggggcctgatgatcaccggcaagctggtgacgaccaacagcgaagcggggctgtcgtcggcgctcacgcgcctgatcgggcgcggcggcgagccgctgatccgcaagggcgtcgacatggcgatgcgcctgatgggcgagcagttcgtcaccggcgagacgatttcggaagcgctggcgaacagccgcaagtacgaagcgcgcggcttccgctactcgtacgacatgctcggcgaagcggcgaccaccgaagaggacgcgctgcgctactacgcgtcgtacgagcaggcgatccacgcgatcggcaaggccgcgggcggccgcggcatctacgagggcccgggcatctcgatcaagctgtcggcgctgcacgcgcgctactcgcgctcgcagcaggaccgcacgatgagcgagctgctgccgcgcgtgcgtgcgctcgcgctgctcgcgcgccgctacgacatcggcctgaacatcgacgcggaagaagccgaccggctcgagctgtcgctcgacctgctcgaggcgctgtgtttcgatccggatctcgccggctggaacggcatcggtttcgtcgtgcagggctatcagaagcgttgcccgttcgtgatcgactacctgatcgatctcgcgcgccgcagccgtcaccgcctgatgatccgcctcgtgaagggcgcgtactgggacagcgaaatcaagcgcgcgcaggtcgacggcctcgaaggctatccggtctatacgcgcaagatctacaccgacgtgtcgtacctcgcgtgcgcgaagaagctgctcgcggcgcccgacgccgtgtacccgcagttcgcgacgcacaacgcgtacacgctcgccgcgatctatcacctggccggccagaactactacccgggccagtacgaattccagtgcctgcacgggatgggcgagccgctgtacgaggaagtcaccggccgcgacaagctgaaccgcccgtgccgcgtctacgcgccggtcggcacgcacgaaacgctgctcgcgtacctcgtgcgccgcctgctggagaacggcgcgaacacgtcgttcgtgaaccgcatcgccgacaagacggtatcggtgaaggagctggtcgccgacccggtcgacgaggcgtcgaaggtcgtgccgctcggcgcgccgcacgcgaagatcccgctgccgcgcaacctgtacggcgacgagcgcgccaactcgatgggcctcgacctgtcgaacgagcaccgtctcgcgtcgctgtcgtcggcgctgctcgcgagcgcgcatcatccgtggcgcgcggcgccgatgctggccgacgacgcgctcgccgacgccccggcgcgcgacgtgcgcaacccggccgaccagcgcgacgtggtcggcgcggtcagcgaagcgacgtccgagcacgtgagcgcggcgctcgcccacgcggtcgcggccgcgccgatctggcaggcgacgccggtcgatgcgcgcgccgactgcctggtgcgcgcagccgatctgctcgaagcgcagatgcacacgctgatgggcctgatcgtgcgcgaagccggcaagtcgctgccgaacgcgatcgccgaaatccgcgaagccgtcgacttcctgcgctactacgcggcgcagatccgcggcgagttctcgaacgacacgcaccgtccgctcggcccggtggtctgtatcagcccgtggaacttcccgctcgcgatcttcatggggcaggtggccgccgcgctcgcggccggcaacacggtgctcgccaagccggccgaacagacgccgctgatcgccgcgcaggccgtgcgcctgctgcgcgaggccggcgtgccggccggcgcggtgcagctgctgccgggcaccggcgaaaccgtcggcgcggcgctggtcgccgatccgcgcacgcgcgcggtgatgttcaccggctcgaccgaagtcgcgcgcctgatcaacaagacgctgtccgcgcggctcgacccggacggcaagccgattccgctgatcgccgaaacgggcggccagaacgcgatgatcgtcgactcgtcggcgctcgcggagcaggtcgtcgcggacgtgatgcaatcgtcgttcgactcggccggtcaacgctgctcggcgctgcgcgttctgtgtctgcaggacgatgtcgccgaccgtacgctgacgatgctcaagggcgcgatgcacgagctggcgctcggcaacccggaccgtctgtcgaccgacgtcggcccggtgatcgacgccgaagcgaagcagacgatcgacacgcacgtcgccgcgatgaaggacaagggccacgcggtcacgcagctgccgatgcccgacgcctgcgcgcacggcaccttcgtgccgccgacgctgatcgagatcggcagcatcgacgagttgaagcgcgaggtgttcggccccgtgctgcacgtggtgcgttaccgccgcagccagctcgacaagctgctcgagcagatccgcgcgaccggttacgggctcacgctcggcatccacacgcggatcgacgagacgatcgcgcacgtgatcgccaatgcgcacgtcggcaacatctacgtgaaccgcaacgtgatcggcgcggtggtcggcgtgcagccgttcggcggcgaagggctgtcgggcacgggcccgaaggccggcggcgcgctgtacctgcagcgtctgctcgcgacgcgtccgtcgggcttgccgaaggcgctcgcgcagacgctgatcgccgacggcgtggccgaaggcgagcagcgcggcaatccggcggcggcgctcaccgcgctgcgcgactggctgatcgagcagcgcgagccggcgctggcggcgcgctgcgacggctatctgtcccaggtgccggccggtgcgacggccgtgctgaccgggccgacgggcgagcgaaacacgtatacactcggcccgcgcggcacggtgctgtgtgtcgcggccacgccgagcggcgcgcgcgcgcagttcgcggcggtgctggcgacgggcaaccgggcgctgttcgccggctcggcgggcgaggcgctggtcgccgcgctgccggccgcgctgaagggccatgcggccgtgcgcaagcaggccgacgcgccgttcgacgccgtgctgttcgaaggcgacagcgacgagctgcagacgctcgtgaaggacgtcgcgcagcgcccggggccgatcgtgtcggtgcagggcgtgtcggcgggcgcgttcgagaacggcgacgcggaagactacgcgctcgagcggctgctgaccgagcgctcggtcagcgtgaacacggccgcggcgggcggcaatgcgaatttgatgacgatcggctga

SEQ ID NO: 1913 - protein, 1346 aa, Burkholderia vietnamiensis G4
MGATGRVIRLHLFIACRRISRILSHHMAGPAPAHEPTMASTTLGVKVDDLLRSRLKDAATRLERTPHWLIKQAIFAYLERIEHGQLPPELSGSSGVTELADGHAAEDDDNSPHPFLEFAQNVQPQSVLRAAITAAYRRPEPECVPFLLGQARLPANLQADVQTLATHLVETLREKSSGGGVEGLIHEFSLSSQEGVALMCLAEALLRIPDRATRDALIRDKISKGDWRSHVGHAPSLFVNAATWGLMITGKLVTTNSEAGLSSALTRLIGRGGEPLIRKGVDMAMRLMGEQFVTGETISEALANSRKYEARGFRYSYDMLGEAATTEEDALRYYASYEQAIHAIGKAAGGRGIYEGPGISIKLSALHARYSRSQQDRTMSELLPRVRALALLARRYDIGLNIDAEEADRLELSLDLLEALCFDPDLAGWNGIGFVVQGYQKRCPFVIDYLIDLARRSRHRLMIRLVKGAYWDSEIKRAQVDGLEGYPVYTRKIYTDVSYLACAKKLLAAPDAVYPQFATHNAYTLAAIYHLAGQNYYPGQYEFQCLHGMGEPLYEEVTGRDKLNRPCRVYAPVGTHETLLAYLVRRLLENGANTSFVNRIADKTVSVKELVADPVDEASKVVPLGAPHAKIPLPRNLYGDERANSMGLDLSNEHRLASLSSALLASAHHPWRAAPMLADDALADAPARDVRNPADQRDVVGAVSEATSEHVSAALAHAVAAAPIWQATPVDARADCLVRAADLLEAQMHTLMGLIVREAGKSLPNAIAEIREAVDFLRYYAAQIRGEFSNDTHRPLGPVVCISPWNFPLAIFMGQVAAALAAGNTVLAKPAEQTPLIAAQAVRLLREAGVPAGAVQLLPGTGETVGAALVADPRTRAVMFTGSTEVARLINKTLSARLDPDGKPIPLIAETGGQNAMIVDSSALAEQVVADVMQSSFDSAGQRCSALRVLCLQDDVADRTLTMLKGAMHELALGNPDRLSTDVGPVIDAEAKQTIDTHVAAMKDKGHAVTQLPMPDACAHGTFVPPTLIEIGSIDELKREVFGPVLHVVRYRRSQLDKLLEQIRATGYGLTLGIHTRIDETIAHVIANAHVGNIYVNRNVIGAVVGVQPFGGEGLSGTGPKAGGALYLQRLLATRPSGLPKALAQTLIADGVAEGEQRGNPAAALTALRDWLIEQREPALAARCDGYLSQVPAGATAVLTGPTGERNTYTLGPRGTVLCVAATPSGARAQFAAVLATGNRALFAGSAGEALVAALPAALKGHAAVRKQADAPFDAVLFEGDSDELQTLVKDVAQRPGPIVSVQGVSAGAFENGDAEDYALERLLTERSVSVNTAAAGGNANLMTIG

SEQ ID NO: 1914 - DNA, 3576 bp, Acidovorax sp. JS42
  CDS (1)..(3576): transl_table=11
atggcgcaggacatccaggcgcgtgccctgcgcctggcgcaagggctgcgccagcgcgaacatgccagcggccggtccggcctggtacaggggctgctgcagcggttcgcgctgtcctcgcaagaaggcgtggcgctgatgtgcctggccgaagcgctgctgcgcattcccgacgcggccacgcgcgacgcgctgatccgcgacaagatcggtacgggcgactgggccgcgcacctgggcaagagcccgtcactgttcgtcaatgcggccacctggggcctgctgctcaccggacggctggtgaccacacacagcgaagggggcttgaaggatgcgctgcgccgcatcaccgcacgcgggggagagccgctgatccgcaagggtgtggacgtcgccatgcgcatgatgggcgagcagttcgtcaccggcgagaccatcgaacaggcgctgggcaaggcgcgcaccctggaggcacggggctttcgctattcctacgacatgctgggcgaggccgcgctcacggggcacgacgccgatcgctacatgcagtcctatgtggatgccatccacgccatcggccgcgccagcgcgggccgcggcgtgtacgaagggcccggcatttccatcaagctcagcgcgctgcacccgcgctacgcccgcgcgcagtggcagcgcgtgatggacgagctgtacccgcgcgtgctgcaactggcggaactggcgcgcggctatgacatcggcctgaacatcgacgccgaagaggccgaccggctggaactgtcgctggacctgctggagcgcctttgccatgcgccgtccctcgcgggcttcaagggcatcggcttcgtgatccaggcctaccaaaagcgctgcccgcgcgtgatcgactactgcatcgatctggcgcgccgcagcggccaccgcctgatgatccggctggtcaagggcgcgtactgggacagcgagatcaagcgcgcccaggtcgatggcctggcggactaccccgtgtacacgcgcaaggcgcacaccgatatttcctacatcgcctgcgcacgcaagctgctgggcgcacccgacgcggtgtacccccagttcgccacgcacaacgcgcagacgctggccaccatctatgagctggcgggccccgcggactatcgccccggccagtacgagttccagtgcctgcacggcatgggcgagccgctgtacgagcaggtggtgcccgagcgcccctgccgcatctacgccccggtgggtacgcatgaaacgctgctggcgtacctggtgcgccgcctgctggaaaacggcgccaacacctcgttcgtgaaccgcgtggccgacgccacgctgccgctggaggcgctgatcgacaaccccgtggacacggtggatgccgaggcccgcgccgaaggcggcgccggcctgccgcacccgcgcatcgcgctgcccccgcagctctacggcccggcgcgtgccaattcgcagggcctggacctggcggccgagcccacgctgcagtgcgtggccgacgcgctggccgccagcgccgccacgccgctggaagccacacccctcatcgccgccggcgctcccgccggcccgcgcgtccccgtgcgcaaccctgccgatgccaccgatatggtcgggcaggtgcaagaagccaccaccgccgatgtggacgccgcgctgcgggctgccgccgcggcgcagcccgcctgggctgccacgccacccgcagaacgtgcacggctgctgcgcgctgcggccgatgggctggaacgcgatatgcctgccctgctggccctgctgatgcgcgaagccggcaagacctgcgccaacgccgtggccgaggtgcgcgaggcggtggacttcctgcgctattacgcggcgcaggtggatgggcacttcgacaacgccacccacccgccgctggggccggtcacctgcatcagcccctggaacttcccgctggccatcttcatgggccaggtggccgccgcactggccgcaggcaatgtagtgctggccaagccggcagaacaaacgcccctcattgcctgccaggccgtgcgcctgctgcaccaggccggcgtgcctgccgccgccgtgcaactgctgcccggcagcggcgagacggtgggcgcggcgctggtgggcgacgcgcgcgtgatgggcgtgatgttcaccggctccaccgaggtggcgcggctgctgcagcgcagcctggccgcacggctggacgccagcggccggcccattccgctgattgcggagacaggcgggcaaaacgccatggtcgtggactcctccgccctgctggagcaggtggtcgcggacgtgctcacctcggccttcgacagcgcgggccagcgctgctccgccctgcgcgtgctgtgcgtgcagcgcgactgcgcggaccgcctgctgcagatgctgcgcggcgccatgcaggaactgcacatgggcaaccccacgcaactggcggtggacgtaggcccggtgatcgacgaggaggcgcgcgccacgatcgcgcgccacatcgagcgcctgcgcgccagcggccggccggtgttccaaagccatgccggtgggcagggcacggcgcatggcaccttcgtgccgcccacgctgatcgagctgaacagcatcaccgagctggagcgcgaggtcttcggccccgtgctgcacgtggtgcgctacgagcgcgacgagctggacacgctgctcgcgcagatcagcgccacgggctacggcctcacccagggcctgcacacccgcatcgacgaaaccgtggcccaggtgctggcccacagcacggccggcaacgtctatgtgaaccgcaacatggtgggcgccgtggtcggcgtgcagcctttcggcggcgagggcctgtcgggcacgggccccaaggcaggcggcccgctgtatctgctgcgcctgctgtcgcgccacccggccaacgccacgcacggcgcgctggcggcgacggccgtgcaggtgcccgacgccagcgcacagcccgcgctgctcgccccgctgtcggcgctggagcactgggcccaggcgcaaggcaacgcagcgctggcacaggcctgcgcggcccaggcgcaggccagttgcgcgggcctggcctgcaccctgcccggccccaccggcgagcgcaacacctatcggctgctgccgcgcgaacgcgtgctgtgcctggccgatacggacgaggcgctgctgctgcagttgagcgcggtgctggccgcgggcgcgcttgcgctctggccgcaggacgcgcaggccctgtgcgccacgctgccgagcgaggtgcaggcgcgcatcgccctggtgtccgactggcgcggcgatggcctgggctacgacgccgtgctgcacagcggcagcccggaaacgcgccgcgtggaatgccagcgcgtggccctgcgccccggccccatcgtgggcgtgacggcgatggacggcgccgccgatgcgctgcaggcgcccctgcgcctgttgctggagcgcgcggtcagcatcaacaccacggcggcaggcggcaatgccagcctgatgaccatggcgtga

SEQ ID NO: 1915 - protein, 1191 aa, Acidovorax sp. JS42
MAQDIQARALRLAQGLRQREHASGRSGLVQGLLQRFALSSQEGVALMCLAEALLRIPDAATRDALIRDKIGTGDWAAHLGKSPSLFVNAATWGLLLTGRLVTTHSEGGLKDALRRITARGGEPLIRKGVDVAMRMMGEQFVTGETIEQALGKARTLEARGFRYSYDMLGEAALTGHDADRYMQSYVDAIHAIGRASAGRGVYEGPGISIKLSALHPRYARAQWQRVMDELYPRVLQLAELARGYDIGLNIDAEEADRLELSLDLLERLCHAPSLAGFKGIGFVIQAYQKRCPRVIDYCIDLARRSGHRLMIRLVKGAYWDSEIKRAQVDGLADYPVYTRKAHTDISYIACARKLLGAPDAVYPQFATHNAQTLATIYELAGPADYRPGQYEFQCLHGMGEPLYEQVVPERPCRIYAPVGTHETLLAYLVRRLLENGANTSFVNRVADATLPLEALIDNPVDTVDAEARAEGGAGLPHPRIALPPQLYGPARANSQGLDLAAEPTLQCVADALAASAATPLEATPLIAAGAPAGPRVPVRNPADATDMVGQVQEATTADVDAALRAAAAAQPAWAATPPAERARLLRAAADGLERDMPALLALLMREAGKTCANAVAEVREAVDFLRYYAAQVDGHFDNATHPPLGPVTCISPWNFPLAIFMGQVAAALAAGNVVLAKPAEQTPLIACQAVRLLHQAGVPAAAVQLLPGSGETVGAALVGDARVMGVMFTGSTEVARLLQRSLAARLDASGRPIPLIAETGGQNAMVVDSSALLEQVVADVLTSAFDSAGQRCSALRVLCVQRDCADRLLQMLRGAMQELHMGNPTQLAVDVGPVIDEEARATIARHIERLRASGRPVFQSHAGGQGTAHGTFVPPTLIELNSITELEREVFGPVLHVVRYERDELDTLLAQISATGYGLTQGLHTRIDETVAQVLAHSTAGNVYVNRNMVGAVVGVQPFGGEGLSGTGPKAGGPLYLLRLLSRHPANATHGALAATAVQVPDASAQPALLAPLSALEHWAQAQGNAALAQACAAQAQASCAGLACTLPGPTGERNTYRLLPRERVLCLADTDEALLLQLSAVLAAGALALWPQDAQALCATLPSEVQARIALVSDWRGDGLGYDAVLHSGSPETRRVECQRVALRPGPIVGVTAMDGAADALQAPLRLLLERAVSINTTAAGGNASLMTMA

SEQ ID NO: 1916 - DNA, 3687 bp, Agrobacterium tumefaciens
  CDS (1)..(3687): transl_table=11
atggccgatggtgcaagcaaagccgatgtaaacccgcagcagacggtgaacggtattttccagaattttgcaccgcccgtgcgcgagcagagcccgttgcgcaaagcaattaccgccgcttaccgccgcccagaggaagagtgcctggcgcctctgatcgatgctgcgaccgtcacgcccgagcaggccgcagccattcgcaccacggcaaccaagctgatcgaggcgttgcgcgccaagacgaaaggcaccggcgtcgaggggctggtgcaggaatattcgctctccagccatgagggcgtggccctgatgtgccttgccgaagcactgctgcgcattcccgacaccgccacccgcgacgcgctgatccgcgacaagatcgcccgcggcgactggaagtcccacatcggcggcgggcgctcgctgttcgtcaacgccgcaacctggggtcttgtcatcaccggcaagctgacctcgacggtcaatgacagcggcctttcggcggcgctgaccaagctgatcgccagggctggcgaacccgtcattcgccgcggcgtcgatatggcgatgcgcatgatgggcgaccaattcgtgaccggcgaaacgattggggaagcgatcaagcgctcgaaaccgctggaggaacagggtttccaatattcctacgacatgctcggcgaagcggcgaccaccgccaaggatgcggagcgttattacaaggactacgaaaacgcgatccacgccattggcaaggcctccgccgggcgtggcatctatggtggccccggaatttccatcaagctttcggccctgcatccgcgttatgcccgtgtgcaggcagagcgggtaatggcggagcttctgccgcgtgtgaaatccctgatgctgctcagcaagaaatacgatatcggcctcaacattgacgccgaggaagccgaccggctggaactgtcgctcgatcttctggaggaactggcgctcgacaaggatcttgccggttggaacggcctaggcttcgttgtgcaggcctatggccgccgctgcccctttgttctcgactacatcatcgatctcgcccaacgtgccggtcgccgcatcatggtgcgtcttgtcaagggcgcctactgggatgcggagatcaagcgcgcacaggtggacgggctggaagacttcccggtcttcacccgcaaagtgcacacggatgtctcctatatcgcctgcgcccgcaagctgcttgccgcgcgtgacgtcgtgttcccgcaatttgcgacccacaacgcccagtccatggctaccatctaccatctcgctggtccggacttcaaactcggtgattacgagttccagtgcctgcacggcatgggcgaaccgctttacagcgaagtcgtcggcaagaaaaagctcgatcgtccctgccgcttttatgcgcctgttggcacccacgagacgctgcttgcctatctcgtccgccgtctgctggaaaacggcgcgaactcctccttcgtcaaccgcatagcagatcccgccgtgccggtggcttccctgctggaagatccggtcaccgtggtcaaggcttaccccgttcccggcgcacggcacgaccgcattgctgcacccgctggtctcttcggccccgaacgggcaaattccgccggcctcgatctttcgaatgaaacggcacttgccgcgctggacaacgtccttaaggcaggtgcgacgacggaatggaaagccgcagcaccgcatgcaggcggaaagacacgcccggtcctcaatcccggcgaccacaatgatgtcgtcggttatgtaaccgaaccgacagaggccgatgtcgaagcggcaatgcaacgggccgcagcctccaactggtcttccacgccggtcgaggagcgcgccgcctgcctggagcgcgctgccgaccggatgcaggccgaaatgccggccctgcttggcctcatcatgcgcgaggccggaaaatccatgccgaacgccattgccgaggtgcgcgaagcgattgacttcctgcgttattacgcagcggaagcccggaagaccttcaaggccaacgagacaccgctcggcccggtcgtctgcatcagcccgtggaacttcccgcttgccatcttcatcggccaggtaacggcagcactggttgccggtaatccggtactggcaaagcccgccgaagaaaccccgttgatcgccgcgcagggggtacgcctgctgcatgaggcaggcgttccgcaggacgccgtgcagcttctgccaggtgacggcaagaccggtgcggcactagtcggctcagcgctcacggcgggtgtgatgttcaccggatccactgaagtggcgcggctcatccagggtcaactcgcaggccgggttctcgcaaacggccagcccgttcccctgattgccgagaccggcggccagaacgccatgatcgtcgattcctcagcgcttgccgagcaggtcgtcgccgacgtcatcgcctctgccttcgacagtgccggccagcgttgctcggcgcttcgcattctctgcctgcaggaagatgtggccgaccgaaccctgacgatgctgaagggcgcgctgcacgaattgcgcatcgggcgcaccgatagcctttccgtcgatgtcggccccgtgatcaccgctgaagctaaaggcatcatcgaaaaacacgttgacagcatgcgcgcactcggccaccggatcgagcagatttcgcttgccggcgaaaccggcaagggcaccttcgtgccaccgacaatcatcgagatgaaatcgctcgccgatcttaagaaagaggtcttcgggccggtgctgcacgtcatccggttcaagcgcgacaatctcgaccggctgatcgacgagatcaacgccaccggctatggcctgaccttcggcctgcatacgcgtcttgacgataccatccagcatgtcctgtcgcgcgtcgcggccggtaatctctatgtgaaccgcaacatcatcggcgccgtggtcggcgtccagccctttggcgggcgaggcctctccggcaccggccccaaggcgggcggtccgctctatctcggccgcgtcacacaaaccgcgccgaagatcgaccgcgttgccagccagcaggaccaggcggctgtcgatctcgcccgctggctggatgaaaacggccagagcgttgcagccgaagccgcaagacaggccgcagccctatccggcctcggtttcgaaaccgaactggcaggcccagtcggcgaacgcaacgtctatgcgctgcatccgcgcggcaaggtgctgcttattccggccacggagcaagggctctatcgccagcttgcggcagcgcttgccaccggcaactcggtcgttatcgataatgcgtcggggctggaaaagtcgatctacggattgccggcaaccgtcacctcgcgcatcacatgggctgacagctgggaaaaatccgcaccgttcgccggcgcgctgatcgagggcgatgcggaacgtgtcgttgcgatcaacaagaaaatccccgccctgcccggtcctctggttctggttcaggccgccacgacggaagcgcttgaccgtgaaacccagccctacaatctcgactggctggtggaagaagtctccgtcagcgtcaacacaacggctgccggcggcaatgccagcctgatgagcatcggctga

SEQ ID NO: 1917 - protein, 1228 aa, Agrobacterium tumefaciens
MADGASKADVNPQQTVNGIFQNFAPPVREQSPLRKAITAAYRRPEEECLAPLIDAATVTPEQAAAIRTTATKLIEALRAKTKGTGVEGLVQEYSLSSHEGVALMCLAEALLRIPDTATRDALIRDKIARGDWKSHIGGGRSLFVNAATWGLVITGKLTSTVNDSGLSAALTKLIARAGEPVIRRGVDMAMRMMGDQFVTGETIGEAIKRSKPLEEQGFQYSYDMLGEAATTAKDAERYYKDYENAIHAIGKASAGRGIYGGPGISIKLSALHPRYARVQAERVMAELLPRVKSLMLLSKKYDIGLNIDAEEADRLELSLDLLEELALDKDLAGWNGLGFVVQAYGRRCPFVLDYIIDLAQRAGRRIMVRLVKGAYWDAEIKRAQVDGLEDFPVFTRKVHTDVSYIACARKLLAARDVVFPQFATHNAQSMATIYHLAGPDFKLGDYEFQCLHGMGEPLYSEVVGKKKLDRPCRFYAPVGTHETLLAYLVRRLLENGANSSFVNRIADPAVPVASLLEDPVTVVKAYPVPGARHDRIAAPAGLFGPERANSAGLDLSNETALAALDNVLKAGATTEWKAAAPHAGGKTRPVLNPGDHNDVVGYVTEPTEADVEAAMQRAAASNWSSTPVEERAACLERAADRMQAEMPALLGLIMREAGKSMPNAIAEVREAIDFLRYYAAEARKTFKANETPLGPVVCISPWNFPLAIFIGQVTAALVAGNPVLAKPAEETPLIAAQGVRLLHEAGVPQDAVQLLPGDGKTGAALVGSALTAGVMFTGSTEVARLIQGQLAGRVLANGQPVPLIAETGGQNAMIVDSSALAEQVVADVIASAFDSAGQRCSALRILCLQEDVADRTLTMLKGALHELRIGRTDSLSVDVGPVITAEAKGIIEKHVDSMRALGHRIEQISLAGETGKGTFVPPTIIEMKSLADLKKEVFGPVLHVIRFKRDNLDRLIDEINATGYGLTFGLHTRLDDTIQHVLSRVAAGNLYVNRNIIGAVVGVQPFGGRGLSGTGPKAGGPLYLGRVTQTAPKIDRVASQQDQAAVDLARWLDENGQSVAAEAARQAAALSGLGFETELAGPVGERNVYALHPRGKVLLIPATEQGLYRQLAAALATGNSVVIDNASGLEKSIYGLPATVTSRITWADSWEKSAPFAGALIEGDAERVVAINKKIPALPGPLVLVQAATTEALDRETQPYNLDWLVEEVSVSVNTTAAGGNASLMSIG

SEQ ID NO: 1918 - DNA, 3933 bp, Escherichia coli
  CDS (1)..(3933): transl_table=11
atgggaaccaccacgatgggggttaagctggacgacgccacgccgcgaacggatcaaatggccgcgtcgcgtatcgatcgcccgccgcactggttaataaaacaggcaatctttagctatctggacaagctggaaaatagcgatacgctaccggagctacctgcgctgtttgtcggcgcggcaaatgaaagcgaggagccggtcgcgccgcagaatggagccgcatcagccctttctggagtttgccgaacaaattcttccccaatccgtctctcggccgccatcagcgcctggcgccgcccggaaaccgatgcggtgtcaatgctaatggaacaggcgcgcctgccgccgcctgtcgctgagcaggcgcataaactggcgtatcaactggcggagaaattgcgcaatcaaaaatccgccagcggtcgcgcgggtatggtgcaaggcctgttgcaggagttttccctctcttcgcaagaaggcgtagcgctgatgtctggcggaagcgctgctgcgtattcccgacaaagctacgcgcgatgcgttaattcgcgacaaaatcagtactggaactggcagtcgcatattggccgtagcccgtcgctgtttgtaaccgccgccacctgggggctgctctttaccggccgactggtctcaacgcattacgaagccaatctatcgcgctcgctgaaccgcattatcggcaagagcggcgagccgttaatccgcaaaggcgtcgacatggcgatgcgtttaatgggcgagcagttcgtgactggcgaaaccattgctcaggcgctggcgaatgcccgaaaattggaagagaaagggttccgctattcttacgatatgctgggcgaacgcgcgttaaccgccgccgatgcgcaggcctatatggtttcttaccagcaagcgattcatgccatcggcaaagcgtctaacggtcgcggtatttacgaagggccagcatctcgattaagctgtccgccctgcatccacgctatagcgcgcgcaatacgatcgggaatggaggagctttatccgcgcctgaaatccctgacgctgctggcgcgccagtcgacattgggtctcaatatcgacgtccgtaagaggcggatcgtctggagatctcgctcgatctgctggaaaaactctgcttcgaacccgaactggcgggctggaacgggcattggctttgtgattcaggcttaccagaaacgctgcccgctggtcattgtttatttagtcgatctggcctcccgtagccgccgtccggtgatgattcgtctggtgaaaggcgcctactgggatagcgagatcaacgcgcgcaaatggaagggctggaggctatccggtttatacccgcaaagtgtataccgatgtctcttatctggcctgcgcgaaaaaactgctcgccgtcctaatctgatctacccgcagttcgcgtcccataacgctcacacactggcggcgatttatcatctggccgggcaaaattactatccgggtcagtacgaattccagtgcctgcacggcatgggcgaaccactgtatgaacaggtcaccggtaaagtggcggacggaaaacttaaccgtccctgccgtatttacgcgccggtgggaacacacgaaaccctgctggcctatctggtacgacgcctgctggaaaacggcgccaacacctcttttgtcaaccgtatcgccgatgccaccctaccgctcgatgaactggtggcggacccggtcgaggccgtggaaaaactggcgcagcaggaaggtcaggctggcataccgcatccgaaattgctgccgcgcgatctgtacggcgaaggtcggataaactccgccggacttgatttagcgtatgaacatcgcctcgcctcgctttcttctgccctgttaagcaacgccatgcagaaatggcaggccaaacctgtgctggaacaaccggtggccgacggtgagatgacgccggttatcaacccggcggaaccgaaagatattgttggctggggaccgaagcgacagaaagcgaggttgaacaggcattgcaaaacgcggtcaatcaggcgccggtttggtttgcgacgccgccgcaagaacgccgctattttgcagcgggcggtatttaatggaaagaccaaaatgcagcaagttgatttggcctgttggtccgtgaagcgggaaacgttcagcaacgccattgccgaagtgcgcgaagcggtagacttcctccattattatgccggtcaagtgcgtgacgatttcgataacgaaacgcatcgcccgttagggccggtagtctgcatcagtccgtggaacttcccgctggccattttcaccggccaaaatcgccgcgcgctggcggcaggtaacagcgttctggcgaaaccggcagagcagacatcgctgattgccgcccagggcattgccattttgctggaagcgcgtaccgccgggcgtcgtgcaactgttgccgggacggggagaaaccgtcggcgcccagcttaccgccgatgcgcgtgtacgcgcgtgatgtttaccggctccacggaggtcgcgacgttgttgcagcgcaacatcgccacgcgtcttgacgcccagggccgccctattccgttgattgcggaaaccggcggtatgaacgctatgattgtcgactcttccgcgctcaccgagcaggtggtcgtggatgtgctggcttccgctttcgagagcgccggacaacgctgttccgcgctccgcgtgctgtgtttgcaggacgatatcgccgaacatacgctgaaaatgttacgccggccgcatggcggagtgtcggtaggggaatcaggccgtctgacgaccgatatcgggccggtgatcgatagcgaggccaaagccaacattgaacgtcacatccagacgatgcgcgccaaaggccgcccggtttcccaggccgcacgtgaaaacagcgatgatgcgcaggaatggcagaccggtacgtttgttatgcccacgcttattgagctggaaaacttcgcagaactggaaaaagaggtcttcgggcccgtgctgcacgtcgtgcgttataaccgtaaccaactggcggagcttatcgaacagattaacgcttccggctacggcgtaacgctgggcgtacatacccgtattgatgaaaccattgcgcaagtcaccggttcgcccatgtcggcaacctgtacgttaaccgtaatatggcgggcgcggtcgtcggcgtccaagccgtttggcgcgaaggcctgtccggcaccgggccaaaagcgggaggacccgctctatctctaccgcctgctggcacaccgcccgcccaatgcgctcaatacgacgctgactcgtcaggatgcgcgttacccggtggatgcgcagcttaaaaccacgctactcgcgccgttgaccgccctgacacaatgggcgcggatcgcccggcgctacagacgctctgccgacaattcgccgatctggcccaggccggcacgcagcgcctgctaccggggccgaccggcgagcgcaatacctggacgttgttgccgcgtgaacgggtattatgcctggctgatgatgaacaggacgcgttcacaggcttgccgccgttctcgccgtcgggtcaggcctatggtcagacgacgccttccaccgcgatctggcgaaacgtctccccgccgccgtccgcgtgtccagtttgcgaaacggaaacgctgttgcgcacggtttgacgcggtgattttccacggcgactccgaacaagctgcgaaccgtgtcgaagccgtcgccgcccgcgaaggcgcgatagtgtcggtacaggggttcgcccgcggcgaaagcaatatactgctggaacggctctatattgaacgttcgctgagcgtaaacactgccgccgctggcggtaatgccagcctgatgacaattggctaa

SEQ ID NO: 1919 - protein, 1310 aa, Escherichia coli
MGTTTMGVKLDDATPRTDQMAASRIDRPPHWLIKQAIFSYLDKLENSDTLPELPALFVGAANESEEPVAPQNGAASALSGVCRTNSSPIRLSAAISAWRRPETDAVSMLMEQARLPPPVAEQAHKLAYQLAEKLRNQKSASGRAGMVQGLLQEFSLSSQEGVALMSGGSAAAYSRQSYARCVNSRQNQYWNWQSHIGRSPSLFVTAATWGLLFTGRLVSTHYEANLSRSLNRIIGKSGEPLIRKGVDMAMRLMGEQFVTGETIAQALANARKLEEKGFRYSYDMLGERALTAADAQAYMVSYQQAIHAIGKASNGRGIYEGPASRLSCPPCIHAIARAIRSGMEELYPRLKSLTLLARQSTLGLNIDVRKRRIVWRSRSICWKNSASNPNWRAGTGIGFVIQAYQKRCPLVIVYLVDLASRSRRPVMIRLVKGAYWDSEINARKWKGWRLSGLYPQSVYRCLLSGLREKTARRPNLIYPQFASHNAHTLAAIYHLAGQNYYPGQYEFQCLHGMGEPLYEQVTGKVADGKLNRPCRIYAPVGTHETLLAYLVRRLLENGANTSFVNRIADATLPLDELVADPVEAVEKLAQQEGQAGIPHPKLLPRDLYGEGRINSAGLDLAYEHRLASLSSALLSNAMQKWQAKPVLEQPVADGEMTPVINPAEPKDIVGWGPKRQKARLNRHCKTRSIRRRFGLRRRRKNAAILQRAVFNGKTKMQQVDLACWSVKRETFSNAIAEVREAVDFLHYYAGQVRDDFDNETHRPLGPVVCISPWNFPLAIFTGQNRRALAAGNSVLAKPAEQTSLIAAQGIAILLEARTAGRRATVAGTGRNRRRPAYRRCACTRVMFTGSTEVATLLQRNIATRLDAQGRPIPLIAETGGMNAMIVDSSALTEQVVVDVLASAFESAGQRCSALRVLCLQDDIAEHTLKMLRRPHGGVSVGESGRLTTDIGPVIDSEAKANIERHIQTMRAKGRPVSQAARENSDDAQEWQTGTFVMPTLIELENFAELEKEVFGPVLHVVRYNRNQLAELIEQINASGYGVTLGVHTRIDETIAQVTGSPMSATCTLTVIWRARSSASKPFGAKACPAPGQKREDPLYLYRLLAHRPPNALNTTLTRQDARYPVDAQLKTTLLAPLTALTQWARIARRYRRSADNSPIWPRPARSACYRGRPASAIPGRCCRVNGYYAWLMMNRTRSQACRRSRRRVRPMVRRRLPPRSGETSPRRRPRVQFAKRKRCCARFDAVIFHGDSEQAANRVEAVAAREGAIVSVQGFARGESNILLERLYIERSLSVNTAAAGGNASLMTIG

SEQ ID NO: 1920 - DNA, 3684 bp, Brucella suis
  CDS (1)..(3684): transl_table=11
atgaccgataatattcctgtttccaaagtggccgttttccagaattttgcgccgccgatccgcgagcaaagcgcactgaggcaagcgatcactgccgcttatcgccgccccgaagccgaatgcgtttcagcgctggccgagcaggcaaccttgccggaggagacgcgccagcaaatccgttccaccgcccgcaagctgatcgaagcgctgcgtgccaagcataagggcaccggcgtcgaaggtctggtgcatgaatattcgctgtcgagccaggaaggcgtggcgctgatgtgccttgccgaagccttgctgcgcattcccgatatggcgacgcgcgatgcgctgatccgcgacaagatatcgaatggcgactggaaatcccacattggcggcgggcgctcgcttttcgtcaatgctgcgacatggggcctggtcgttaccggcaagctcaccaataccgtcaatgatcgtggcctttccgccgctcttacccgcctcatcgcccgctgcggcgagccggtcatccgtcgcggcgtggacatggccatgcgcatgatgggcgagcagttcgtcaccggcgaaaccatcgatgaggcgttgaaacgcgccaaggagctggaagagcgcggcttccgctattcctacgacatgctgggcgaggccgcgaccaccgccgccgatgcagagcgttattataaggattatgaaaccgcgatccacgccatcggtcgtgcttccgcagggcgcggcatttatgatggtcccggcatttccatcaagctttcggcgcttcacccgcgttatacccgcgcgcaaagtgagcgcgtcatgggtgaacttctgccgaaggtgaaggcactcgcggccatcgccaagtcctataatatcggcctcaatatcgacgcggaggaggccgaccgtcttgaactgtcgctcgacctgttgcaaagcctttgcgaagaccctgatctggcaggctgggatggcatcggcttcgtggtgcaggcctatggcaagcgctgccccttcgtgcttgatttcatcatcgatctggctcgccgcaccaagcgccgcgtcatggtgcgtctggtgaagggcgcctattgggatgcggagatcaagcgtgcgcaggtggatgggctggaggattttccggtctatacccgcaaggtgcatacggacgtttcctatattgcctgcgcgcgcaagcttctggccgcgacggatgtgatctttccgcaatttgcgacccataacgcgcagacactcgccacgatctatcatctggccgggccggatttcaaaaccggtaagtttgagttccaatgcctgcacggcatgggtgagccgctttatgatgaagtcgtcggccccgaaaagctcggtcgcccggcccgcatttatgcaccggtcggcacgcatgaaacgctgctcgcctatctcgtccgccgccttcttgaaaacggcgcgaactcctccttcgtcaaccgtattggcgacaaaaacgtctcggtcgatgagctgatcgccgatccggtggaagtcgtccggtcgatggctgtcgtcggtgcgcgtcatgaccagattgcgctgccggaaaatctctatggcgcgcgccgcaattccgcaggctttgatctttccaatgaggtgacgcttgcggaactgagcaaaaccttgaaggaaacggcaggccgtgcatggaccgccgaaccgcaggtggcgggtgcaaaggtgaagggcgtaagccgtccggttctcaatcccggcgaccggaatgatgttgtcggcaccgtaacggaaatcgcagaggccgatgtggcaaaggcgatgaaggcagcgcaaaccgcgaccacaagctggtccgcggttgcgcccgcagaacgcgccgcctgtctggagcgcgcagccgatatcatgcagcgcgacatgccggctctgctcggcctcgtcatgcgcgaggcgggcaagtccatgccgaacgctattgccgaagtgcgtgaagccatcgatttcctgcgctattatgccgaacagacccgccgcacgcttggcgtcggccacaaggcgcttggccctgtcgtctgcatcagcccgtggaacttcccgctggcaatcttcaccggccagattgcggctgcacttgttgcaggcaatccggttctggcaaagcctgccgaggaaaccccgctgatcgccgctgagggcgtgcgcattctgcatgaggggggcattccggcggatgcgctccagcttctgccgggtgatggccgcattggcgccgcgctggttgcagcaccggaaacttgcggcgtaatgttcaccggctccaccgaggtggcgcggctcatccaggcgcagcttgcctcgcgcctgctgccgaacggaaagccggtcccgctcattgccgaaacgggcggtcagaacgccatgatcgtggattcctcggcacttgccgagcaggtggtgtttgatgtcatcgcttcggctttcgatagcgccggccagcgctgttcggcgctgcgtgtcctctgcttgcaggaagatgtggccgaccgcattctcaccatgctcaagggcgccttgcgtgagctttccattggccgcacggaccagctcaaggtcgatatcggcccggttatcaccgatgaggcgaagaacaccattgaaaagcatattcaggccatgcgcgatcttggccgcaaggtggaacagcttccccttggcccggaaacgcagaacggcacttttgttgcgccgacaatcatcgagattgaatcgctgcgcgatctcaagcgcgaagtgttcggcccggtcctgcatgtggttcgttacaagcgcgacgacatggaaagcctgatcgatgatatcaattcgaccggctatgggcttacttttggtttgcatacgcgccttgacgagacgattgccaatgttgcggatcgcatccgtgtcggcaatatctatatcaatcgcaacattatcggcgcagtggtgggcgtgcagcctttcggcgggcgtggcctttccggcaccggcccgaaggcgggcggtccgctctatcttggccgtctggtcgaaaccgcgccgatcccgccgcgtcacgcttcggttcataccgatgcggcgctgaaggactttgcccgctggctcggcaatcgcggcatgaacgatctggcgcaggcggcgcgcgataccggcagtgcttcggcgctcggtctcgaactcgaactgccgggcccggttggcgagcgcaatctctatgctctccacccgcgcgggcgcgtgcttctggtcccccagaccgaaattggcctctatcgccaattgacggcggtgctggcaaccggcaacactgcggtcatcgacgaggcttgcggtttgcgcgccgtgttgaaggatctgccggaaacagttgccgcgcgcgccatctggacgggcgactggcaggcggatgcgccttttgccggagcacttatcgaaggcgacagcgcgcgcatcaaggaggtgaactccaggatcgccgccctgccgggaccgctcgtactcacacaggcggcatcgccggaagatcttgcagccaatcaggatgcttattgcctcaactggctgcttgaggaagtctcgacctccatcaacaccacggcagcaggcggcaacgccagcctgatggcgatcggctga

SEQ ID NO: 1921 - protein, 1227 aa, Brucella suis
MTDNIPVSKVAVFQNFAPPIREQSALRQAITAAYRRPEAECVSALAEQATLPEETRQQIRSTARKLIEALRAKHKGTGVEGLVHEYSLSSQEGVALMCLAEALLRIPDMATRDALIRDKISNGDWKSHIGGGRSLFVNAATWGLVVTGKLTNTVNDRGLSAALTRLIARCGEPVIRRGVDMAMRMMGEQFVTGETIDEALKRAKELEERGFRYSYDMLGEAATTAADAERYYKDYETAIHAIGRASAGRGIYDGPGISIKLSALHPRYTRAQSERVMGELLPKVKALAAIAKSYNIGLNIDAEEADRLELSLDLLQSLCEDPDLAGWDGIGFVVQAYGKRCPFVLDFIIDLARRTKRRVMVRLVKGAYWDAEIKRAQVDGLEDFPVYTRKVHTDVSYIACARKLLAATDVIFPQFATHNAQTLATIYHLAGPDFKTGKFEFQCLHGMGEPLYDEVVGPEKLGRPARIYAPVGTHETLLAYLVRRLLENGANSSFVNRIGDKNVSVDELIADPVEVVRSMAVVGARHDQIALPENLYGARRNSAGFDLSNEVTLAELSKTLKETAGRAWTAEPQVAGAKVKGVSRPVLNPGDRNDVVGTVTEIAEADVAKAMKAAQTATTSWSAVAPAERAACLERAADIMQRDMPALLGLVMREAGKSMPNAIAEVREAIDFLRYYAEQTRRTLGVGHKALGPVVCISPWNFPLAIFTGQIAAALVAGNPVLAKPAEETPLIAAEGVRILHEGGIPADALQLLPGDGRIGAALVAAPETCGVMFTGSTEVARLIQAQLASRLLPNGKPVPLIAETGGQNAMIVDSSALAEQVVFDVIASAFDSAGQRCSALRVLCLQEDVADRILTMLKGALRELSIGRTDQLKVDIGPVITDEAKNTIEKHIQAMRDLGRKVEQLPLGPETQNGTFVAPTIIEIESLRDLKREVFGPVLHVVRYKRDDMESLIDDINSTGYGLTFGLHTRLDETIANVADRIRVGNIYINRNIIGAVVGVQPFGGRGLSGTGPKAGGPLYLGRLVETAPIPPRHASVHTDAALKDFARWLGNRGMNDLAQAARDTGSASALGLELELPGPVGERNLYALHPRGRVLLVPQTEIGLYRQLTAVLATGNTAVIDEACGLRAVLKDLPETVAARAIWTGDWQADAPFAGALIEGDSARIKEVNSRIAALPGPLVLTQAASPEDLAANQDAYCLNWLLEEVSTSINTTAAGGNASLMAIG

SEQ ID NO: 1922 - DNA, 3603 bp, Pseudomonas paucimobilis
  CDS (1)..(3603): transl_table=11
atgacgaacccgccccccttcaccgatttcgcccctgtcatccggcctcagtcgccgctccgccaggcgatcaccgccgcctatcgccgcgacgaagcggagtgcatggcgcccctgctggaagccgccgcgctgcccgacgccatgcggcgtggagtgcgggacatggcgcgcaggctggtgacgacgctgcgcgccaatggcaagggcagcggggtcgaggcgctggtgcaggaatattcgctctccagccaggagggcgtggcgctgatgtgcctggccgaagcgctgctgcgcattcccgacgatgcgacccgcgatgcgctgatccgcgacaagatcgccgacggcgactggggcgggcatctgggcggcggcaggtcgctgttcgtcaatgcggcgacctgggggctggtggtgacgggcaagctggtcggcagcgtcgatgaccggggcctcggcgcggcgctgacgcggctggtggcgcggctgggcgagccggtgatccggcgcggcgtcgacctcgccatgcggatgatgggcgagcagttcgtgaccggcgagaccatcggcgaagcgctgaagcgggcgcgggcgcaggaggccaagggcttccagtacagctatgacatgctgggcgaagcggcggcgacggcggcggacgcggcgcgctacctggaggattaccggcaggcgatccatgccatcggccgggcgtcggccgggcgcggcgtctatgcggggccgggcatttcgatcaagctgtcggcgctgcatccgcgttattcccgcgcacaggcggagcgggtcatgggggaattgctgccgcgggtgaaggagctggcgttgctcgcccgcggctatgacatcggactcaacatcgatgcggaggaggcggatcggctcgaattgtcgctcgacctgctggagagtctggcgctggacccggagcttgcggggtggaacgggctgggcttcgtggtgcaggcctatggcaagcgctgccccttcgtgatcgactggatcgtcgatctggccgggcgggccgggcggcggatcatggtgcggctggtcaagggcgcctattgggacgcggagatcaagcgggcgcaggtcgacgggctggccgatttcccggtctatacgcgcaaagtccataccgacgtcgcctatatcgcctgcgcgaggaagctgctggcggcgcgggaccgggtgtttccgcaattcgcgacgcataacgcgcagacgctggcgacggtccatcatctggcggggcatgatttcacgctgggcgattatgaatatcagtgcctgcacggcatgggcgagccgctgtacgagcaggtggtggggaagggcgatctcgaccggccctgccgcatctacgcgccggtcggcacgcatgagacgctgctggcctatctggtgcggcggctgctggaaaatggcgcgaacagctccttcgtgcaccgcatcgccgatccggcggtgccggtggaggagatgatcgccgacccggtcgagcaggtgcgggcgatgccgcatccgggggcgcggcatgcggacatcgccctgccgtccgggctttatcccgaccggcgcaattccgacgggatcgacctcagcgatgaaaatgcgctggccatgctgacgcgggcgctggcggaaagcgcgcagatcggctggacggcccggccggagggcggggagggcgcggcgcggcccgtgctcaaccccgccgaccggcgcgatgtcgtggggacggtgttcgaggcgtcgacggattttgcgcgggcggcggtcgcgcgggcggacggaagcggctgggcgagggcgcccgtgacggaacgcgccgcgatattggagcgggcggccgacgcgatgcaggcgcgcatgccgatcctgctgggcctgatcgtgcgggaggcgggcaagtcgctgcccaacgccattgccgaagtgcgggaggcgatcgatttcctgcgctattatgcggcgcaggcgcggtcgaccttcggcccggcgcaggagcctttggggccggtggtgtgcatttcgccctggaatttcccgctggcgatcttcaccggccaggtggcggcggcgctggtcgcgggcaatgcggtgctggccaagcccgccgaggaaaccccgctgatcgcggcggaggcggttcgcctgctgcacgaggctggggtgccgggcgatgcgttgcagcttgtgcccggcgcgggggagatcggcgcggcgctggtggcggcgccgcaaaccgcaggagtgctgttcaccggatcgaccgaggtggcgcggctgatccagcggcaactggcctcgcgcctctccgcttcgggcaggcccattccgctggtcgcggagacgggcgggcagaatgcgatgatcgtcgacagctccgcgctggcggaacaggtggtggcggatgtcatcgcctccgccttcgacagcgcggggcagcgctgttcggcgctgcgcatcctctgcctgcaggaggatgtggcggaccggacgctggcgatgctgaagggggcgctcagggaattgcgcatcgggcggaccgaccggctggcggtcgacatcgggccggtcatcaccgacgaggcgcaggaaggaatcgggcggcacatagaggcgatgcgcgccctgcgctgcgcggtggagcagcagccattgccggaggaaagcgcgcatggcagcttcgtgccgccgacgatcatcgagatcgacgacatcgcgcagttgcggcgggaggtgttcgggccggtgctgcacgtcatccgcttcccccgcgcagggctggacgcgctggtggatgcgatcaacgcgaccggctatggcctgaccttcggcctgcatacgcggctggacgataccgtcgcccaggtgacggggcgggtgaaggcgggcaatctctatgtgaaccgcaatgtgatcggcgccatcgtgggggtgcagccctttggcgggcgcgggctgtcgggaaccggacccaaggcgggcgggccgctctatctggggcggcttgtgcgcgtgccgccggcctttgccgggcgggccggttcgttcccgtcggcgctcgccgatttcgccgactggctggcggcggagggcgaggcggaggcttcggccatggcgcggcgctgcggcgatgcctcggcgctgggggtggagatggcgctgccggggccggtgggggagcgcaacctctatgcgttgcatccccgcggatggatcgggatgcggcccgcgacgcggcagggccttttggggcagatggcggcggtgctggcgacgggcaatcgcggggtgctgcaggacatggcgctgccgcggggattgcccccgcatatcgccgcgcatttcgcgtctcggccggaagggccgctgggggcggtgctggtagagggcgatgccgggcggatcggcgcggcggttcgggacgtggccggcctgccggggccggtcgtcagcgtccatgcggcgggggcggatgggatgtatccgctccactggctgctggaggaggtgtcgacctccatcaacacgacggccgccggtgggaatgcgagcctgatgatgatcggatga

SEQ ID NO: 1923 - protein, 1200 aa, Pseudomonas paucimobilis
MTNPPPFTDFAPVIRPQSPLRQAITAAYRRDEAECMAPLLEAAALPDAMRRGVRDMARRLVTTLRANGKGSGVEALVQEYSLSSQEGVALMCLAEALLRIPDDATRDALIRDKIADGDWGGHLGGGRSLFVNAATWGLVVTGKLVGSVDDRGLGAALTRLVARLGEPVIRRGVDLAMRMMGEQFVTGETIGEALKRARAQEAKGFQYSYDMLGEAAATAADAARYLEDYRQAIHAIGRASAGRGVYAGPGISIKLSALHPRYSRAQAERVMGELLPRVKELALLARGYDIGLNIDAEEADRLELSLDLLESLALDPELAGWNGLGFVVQAYGKRCPFVIDWIVDLAGRAGRRIMVRLVKGAYWDAEIKRAQVDGLADFPVYTRKVHTDVAYIACARKLLAARDRVFPQFATHNAQTLATVHHLAGHDFTLGDYEYQCLHGMGEPLYEQVVGKGDLDRPCRIYAPVGTHETLLAYLVRRLLENGANSSFVHRIADPAVPVEEMIADPVEQVRAMPHPGARHADIALPSGLYPDRRNSDGIDLSDENALAMLTRALAESAQIGWTARPEGGEGAARPVLNPADRRDVVGTVFEASTDFARAAVARADGSGWARAPVTERAAILERAADAMQARMPILLGLIVREAGKSLPNAIAEVREAIDFLRYYAAQARSTFGPAQEPLGPVVCISPWNFPLAIFTGQVAAALVAGNAVLAKPAEETPLIAAEAVRLLHEAGVPGDALQLVPGAGEIGAALVAAPQTAGVLFTGSTEVARLIQRQLASRLSASGRPIPLVAETGGQNAMIVDSSALAEQVVADVIASAFDSAGQRCSALRILCLQEDVADRTLAMLKGALRELRIGRTDRLAVDIGPVITDEAQEGIGRHIEAMRALRCAVEQQPLPEESAHGSFVPPTIIEIDDIAQLRREVFGPVLHVIRFPRAGLDALVDAINATGYGLTFGLHTRLDDTVAQVTGRVKAGNLYVNRNVIGAIVGVQPFGGRGLSGTGPKAGGPLYLGRLVRVPPAFAGRAGSFPSALADFADWLAAEGEAEASAMARRCGDASALGVEMALPGPVGERNLYALHPRGWIGMRPATRQGLLGQMAAVLATGNRGVLQDMALPRGLPPHIAAHFASRPEGPLGAVLVEGDAGRIGAAVRDVAGLPGPVVSVHAAGADGMYPLHWLLEEVSTSINTTAAGGNASLMMIG

SEQ ID NO: 1924 - DNA, 3801 bp, Burkholderia cepacia
  CDS (1)..(3801): transl_table=11
atgcagatctcccagaaacactcgacagtcatggacattcactcaaagttcgatccggcatcgcgattccgcgggttcgccagcggacagccagccgcatccgagcttcgcgaacgcatcaccgcggcctgtcgaacggcggaacctgtagccgtctcagccttgcttgccatggcaaagatggagcctgaagtcgcgcgcaaggccaaccaactgtccatgcaaatagcgcagcgtctgcgtgagcgcaagaactccgcgggtcgtgcgggaatcgtgcagggcctgctgcaggagtacgcactctcttcacaggagggcgttgcgctgatgtgcctcgcggaagcactcttgcggattcccgacatggcgacgcgcgacgcgctgatcagggacaagatcgcgcgtggacattggcaggagcacgcaggccggagcccctcgttgttcatcaatgccgcaacgtgggggctgtttctgaccgggaaacttgtctccacctacagcgagtcgtcgctgtcgaccttgctcacgcggctcatcgccaagggcggcgaaccgctcattcgcaagggtgtcgacatggcgatgcggatgatgggcgagcagttcgtcaccggagaaaccatcaaggaggcgctggaccacgcgcgaggcctggaggcgcaaggtttccgctattcatacgacatgctcggcgaggcggcgatgacggccgaagacgcagaccgctaccgccagtcctacgagcgagccattcatgccatcggcgaggcatcgaacggccgaggcgtctacgagggacccggcatctcgatcaagctctcagcgctgcatccgcgttacagccgcgcgcagtacggccgagtcatggacgaactctatcccgtggtgcgcagtcttgcgctgctggctcgacgttacgacatcggtctcaacatcgacgccgaggaagccgatcgccttgaactgtcgctcgacttgctggagaagctttgcttcgaacccgccctcgcagggtggaatggcatcggcttggtgatccaggcttaccaaaagcgttgcctcttcgtgatcgaccatgtgattgaactcgcgcaacgcagccgtcatcggctgatgatccggctcgtcaagggagcctactgggacagcgagatcaagcgtgcccaggtggaggggcaggacggctttccagtttatacgcgcaaggtctacaccgacgtttcgtacctggcctgcgcgcgcaagctgctggttgctcccgcagagatctatccgcagttcgccacgcacaacgcgcacaccatggcagcgatctacaacctggcggagcccgcgacctaccagcctggtcagtatgaatttcaatgcctgcacggcatgggtgagccgctgtacgagcaggtggtcggaagcctggcggatggcaagctggggcgtccgtgccgcatctacgcacccgtgggtacacacgagacgctgttggcctacctggtgcgccggctgctcgagaacggggccaacacgtcgttcgtcaaccgcatcgccgacccgtcgattccacttgaagcgctggtggaggatcccgtcgcggccgtggagcgcatggcccaggaagagggcgaagcggggcggccgcatccttgcatcccgagcccgagcgcactctacggccaggcgcgacgcaattctcatgggctggatttgtccaacgagcagaccctgcgggggctggagccaatcctggtggacagcgcacgaacaggatggacggctgaaccgctgctcggagaatctgccgaagccgaacccacagcctggaagccggtactcaatccagccgaccatcgtgacgtggtcggaaaggtgcgcgcagccagcgagcaacaaatcgaagccgcgcttcgttcggcgacggggttcgcgccgcagtgggccgcgacgtccgccggcgatagggctttcgtactcgagcgcgccgccgacctgttgcaggaccagcttccgtatctgctggggttgctctgccgcgaagcgggaaaatcctatgccaacggtgtcgccgaagtgcgtgaggcgatcgactttctgcgcttctacgcagcacacgcacgcacggacttcgacgatccggcgcataagccgttgggacccgtggtttgcatcagcccctggaacttcccactggccatcttcgtgggccaagtctccgcggcgctggctgccggcaaccccgtcctggcgaagcccgcggagcagacatcgttgattgcggctgaggccacacggctgatgcacacggccggcgtcccgcgtgcggcgcttcaattgatcccgggccgcggctcggtcgttggggcacggatggtcgcggatgcccgggttcaaggcgtcatgttcacaggctcgacggcagtggctcgtcagctgcagcgaacgatggccgaacgactgggtccgacgggggcgccggttccgctcattgccgagacaggcgggcagaacgcaatgatcgtggactcctctgcattggtcgagcaggtcgtggcggatgtcatggcgtccgcgttcgacagtgcaggccagcgctgctccgcccttcgggttctatgtgtgcaggacgacgttgcggatcgcttgcttcatatgcttcgtggcgcgatggctgagtccaatgtcggcgacccgtcctccctgtgcaccgacgtgggacccgtgatcgaccttgcagcacgcacgacgatcgagtcccatatcgaactcatgcagagtcgcggccgtcgagtcaaccgcgcggggcgtgcagcgcacgaagtccttgaaggtggaacattcgtcctgccgacgatgattgaactggagagcatctccgagcttgagcgggaagtgttcgggcctgtactgcacgtcgtgcgatatgccaggcaggacctggacacgatgctggcgcagatcagcgcaaccggctatgggctgacgatgggcattcactcgcgcattgacgagaccatcggccgtgtggtctccagtgccaaggtcggcaacgtttatgtgaaccggaacatggtcggggcagtcgtgggtgtgcagcccttcggcggcgagggcctgtcgggcacggggccaaaggctggagggcccctctatatgtacaggcttctcgctgaaagtccgcacgatgtgctcgtgcgcgcagccgagcggggattgccaggctctgttgctgacggcagcgtgacgcaagcatcggagccgttcgaggcactgctctcctggattgagacgcatcgggaacgacctttgaccgcccgatgccggcttctcaagcggaccgccggatccgggcagatgcgcgtgctggtcgggcccaccggagagcgaaacacgtactccttgcagcctcgagttgctgcactgtgcctggctgaagacgaggactcattgttgtttcagttggctggcgcgctcgttgtgggctgccgtgccatctggccatcgaacaccgatacccaggcgctgcgagccaccttgccgttggacgttcaagcggagatcgctctcgcgcgggactgggcagcgccgaccgtggaattcgatgtcgcgctctatcaaggcagccgtgagggcctcctggcggcttcggcccggctggccgagcgccaggggccgataaccagcctgtggcggttcccgacggacagcggcaaggtgccgctggaagccctggttgtggagcaggccgtgagcacgaacacggctgccgcgggcggcaacgcaagcctgatgacgatttcttga

SEQ ID NO: 1925 - protein, 1266 aa, Burkholderia cepacia
MQISQKHSTVMDIHSKFDPASRFRGFASGQPAASELRERITAACRTAEPVAVSALLAMAKMEPEVARKANQLSMQIAQRLRERKNSAGRAGIVQGLLQEYALSSQEGVALMCLAEALLRIPDMATRDALIRDKIARGHWQEHAGRSPSLFINAATWGLFLTGKLVSTYSESSLSTLLTRLIAKGGEPLIRKGVDMAMRMMGEQFVTGETIKEALDHARGLEAQGFRYSYDMLGEAAMTAEDADRYRQSYERAIHAIGEASNGRGVYEGPGISIKLSALHPRYSRAQYGRVMDELYPVVRSLALLARRYDIGLNIDAEEADRLELSLDLLEKLCFEPALAGWNGIGLVIQAYQKRCLFVIDHVIELAQRSRHRLMIRLVKGAYWDSEIKRAQVEGQDGFPVYTRKVYTDVSYLACARKLLVAPAEIYPQFATHNAHTMAAIYNLAEPATYQPGQYEFQCLHGMGEPLYEQVVGSLADGKLGRPCRIYAPVGTHETLLAYLVRRLLENGANTSFVNRIADPSIPLEALVEDPVAAVERMAQEEGEAGRPHPCIPSPSALYGQARRNSHGLDLSNEQTLRGLEPILVDSARTGWTAEPLLGESAEAEPTAWKPVLNPADHRDVVGKVRAASEQQIEAALRSATGFAPQWAATSAGDRAFVLERAADLLQDQLPYLLGLLCREAGKSYANGVAEVREAIDFLRFYAAHARTDFDDPAHKPLGPVVCISPWNFPLAIFVGQVSAALAAGNPVLAKPAEQTSLIAAEATRLMHTAGVPRAALQLIPGRGSVVGARMVADARVQGVMFTGSTAVARQLQRTMAERLGPTGAPVPLIAETGGQNAMIVDSSALVEQVVADVMASAFDSAGQRCSALRVLCVQDDVADRLLHMLRGAMAESNVGDPSSLCTDVGPVIDLAARTTIESHIELMQSRGRRVNRAGRAAHEVLEGGTFVLPTMIELESISELEREVFGPVLHVVRYARQDLDTMLAQISATGYGLTMGIHSRIDETIGRVVSSAKVGNVYVNRNMVGAVVGVQPFGGEGLSGTGPKAGGPLYMYRLLAESPHDVLVRAAERGLPGSVADGSVTQASEPFEALLSWIETHRERPLTARCRLLKRTAGSGQMRVLVGPTGERNTYSLQPRVAALCLAEDEDSLLFQLAGALVVGCRAIWPSNTDTQALRATLPLDVQAEIALARDWAAPTVEFDVALYQGSREGLLAASARLAERQGPITSLWRFPTDSGKVPLEALVVEQAVSTNTAAAGGNASLMTIS

SEQ ID NO: 1926 - DNA, 3948 bp, Pseudomonas putida
  CDS (1)..(3948): transl_table=11
atggcgactaccacccttggggtcaaactcgacgacccgacccgtgagcgactcaaagcagctgcgcagtccatcgaccgcacgcctcactggttgatcaagcaagcgatcttcaattacctggagaagctcgagggtggtgccaccctgaccgaactcaacggtcatgccagcaacccggccgacgatgccggtgaagtccaggccgaccacagccaccagtgcttcctcgaatttgccgagagcatcttgccgcagtcggtactgcgctcggcgatcaccgccgcctaccgccgccccgagcaggaagtggtgccgatgctgctggagcaggcgcgcctgagcgcgccgctggccgacgccaccaacaagctggccgcaagcattgccgaaaaactgcgcaaccagaaaagcgtcggcggccgtgccggtatcgtccagggcctgctgcaggaattctcgctgtcgtctcaggaaaggcgtggcgtgtgcctggccgaagccctgctgcgtatccccgacaaaggtacccgtgatgcgctgatccgcgacaagatcagtaccggcaactggcagccgcacctgggcaacagcccgtcactgttcgtcaacgccgccacctgggggctgctgctgaccggcaagctggtcagcacccataacgaaaccggcctcacctcctcgctcacccgcatcatcggcaagagcggcgagccgatgatccgcaagggcgtcgacatggccatgcgcctgatgggtgagcagttcgtcaccggcgagaccattgccgaagccctggccaacgccagccgtttcgaggccaaaggcttccgttactcctacgacatgcttggcgaagccgcactgaccgagcacgacgcgcagaagtacctggcgtcctacgagcaggccatccactcgatcggcaaggcctcgcatggccgtggcatctatgaaggcccaggcatctcgatcaagctgtcggcactgcacccgcgctacagccgggcccagtacgagcgcgtgatggaagagctgtacccgcgcctgctgtcgctgaccctgctggccaagcagtacgacatcggccttaacatcgacgccgaagaagccgaccgcctggagctttcgctggacctgctcgaacgcctgtgcttcgagccatccctggctggctggaacggcatcggcttcgttatccaggcctaccagaagcgctgcccgtacttgatcaactacttcttcgatctggccaagcgcaccccccaccgcctgataatccgcctgttaaaaggcgcctactgggacagcgagatcaagcgtgcccaggtcgaaggcctggaaggctacccggtctatacccgcaaggtgtacaccgacgtgtcctacgtcgcctgcgcccgcaagctgctggccgtgccagaagccatctacccgcagttcgccacccacaacgcccacaccctgtcggccatctaccacattgccgggcagaactattacccgggccagtacgagttccagtgcctgcacggcatgggcgaaccgctgtacgagcaagtggtcggcaagattgccgatggcaagctgaaccgcccgtgccgcgtgtatgcaccggtcggcacccatgaaacgctgctggcctacctggtgcgccgcctgctggaaaacggcgcgaacacctcgttcgtcaaccgcattgccgaccactcgatttccatccaggaactggtcgccgaccggtggccagcatcgatcgcatgggtacccaggaaaggcagtatcggcctgccgcacccacgcattcccctgccgcgcgacctgtatggcaccgaacgggccaaattggccggtattgaaatggccaatgaacaccgcctggggttgttgtcctgcgccatggtggccaccgctcacaaacagtgggaggctgccccgctgctggcctgcgccgccagggagagcgctgccgcaccggtgctgaacccggctgaccaccgcaacgtcgtcggccatgtgcaggaggccaccgttgccaaatttgacaacgccatccattgcgcactgaaccccgcgccgatctggcaggccaccccaccagccgagcgtgctgccattctggagcgcaccgccgacctgatggaggccgaaatccacccgctgatgggcctgctcatccgcgaggccggcaaaaccttccccaacgccattgccgaattgcgtgaagccgtggacttcctgcgctactacgcggtgcaggcacttaacgacttcagcaacgacgcccaccgcccactgggtcctgtggtgtgcatcagcccatggaacttcccgctggcgatcttcaccggccaggtggccgcagccctggctgccggcaacccggtactggccaagcctgccgagcaaaccccactgatcgccgcccaggccgtgcgcctgctgctggaagctggcatcccagaaggcgtgctgcagctgctgccgggccgcggtgaaactgtcggtgccggcctggtcggagacgagcgcgtcaaaggcgtgatgttcaccggctccactgaagtggcccgcctgctgcagcgcaacgtcgctggccgtctggacaaccagggccgcccgatcccgctgatcgccgaaaccggcggccagaacgcgatgatcgtcgactcctcggcactgaccgaacaggtcgtgatcgacgtggtgtcctcggccttcgacagtgccggccagcgttgctcggccctgcgcgtactgtgcttgcaggaagactccgccgaccgcgtaatcgagatgctcaagggcgccatggctgaaagccgcctgggctgcccggaccgcctggccgtggacatcggcccggtgatcgatgccgaagccaaagccggcatcgagaagcacatccagggcatgcgcgagaaaggccgcccggtctaccaagtcgccattgccgatgctgccgagatcaagcgcggcaccttcgtcatgccaaccctgatcgagctggacagcttcgacgagctgaagcgcgaaatcttcggccccgtgctgcacgtggtgcgctacaaccgccgcaatctggaccagctgatcgagcagatcaacaactccggctacggcctgaccctcggcgtgcacacccgtatcgacgagaccatcgccaaagtggtggaaaccgcaacgccggcaacatgtcgtcaccgcaacattgtgggtgcagtggtgggcgtgcagccgttcggtggtgaaggcctgtctggcaccggcccgaaagccggcggcccgctgtacctctaccgcctgctgtcgacccgcccggccgacgccattggccgccacttccagcagcaggacggcgaaggcacgccggaccgcaccctgcacgaacagctggtaaagccgctgcacggcctgaaggcctgggccgagaacaaccagctggccgacctggccgcgctgtgcagccagttcgccagccagtcgcagagcggcatcgcccgcctgctgccaggcccgaccggcgagcgcaacagctacaccattctgccgcgtgagcacgtgctgtgcctggccgacaacgaaaccgacctgctggcgcagttcgccgcggtactggccgttggcagctcggcggtgtgggttgacggtgaaccgggcaaggccctgcgcgcccgcctgccgcgtgagctgcaggccaaggtgaagctggtcgcggactggaacaaggatgaagtggcgttcgacgccgtgatccaccatggcgactcggaccagctgcgcggcgtatgccagcaggtggccaagcgtgccggggcgatcgttggggtgcacgggctgtccagcggggatcaccagattgcgctggagcgcctggtcatcgagcgcgcggtgagcgtgaacactgcagcggcgggtggtaacgccagcctgatgaccattggctaa

SEQ ID NO: 1927 - protein, 1315 aa, Pseudomonas putida
MATTTLGVKLDDPTRERLKAAAQSIDRTPHWLIKQAIFNYLEKLEGGATLTELNGHASNPADDAGEVQADHSHQCFLEFAESILPQSVLRSAITAAYRRPEQEVVPMLLEQARLSAPLADATNKLAASIAEKLRNQKSVGGRAGIVQGLLQEFSLSSQERRGVCLAEALLRIPDKGTRDALIRDKISTGNWQPHLGNSPSLFVNAATWGLLLTGKLVSTHNETGLTSSLTRIIGKSGEPMIRKGVDMAMRLMGEQFVTGETIAEALANASRFEAKGFRYSYDMLGEAALTEHDAQKYLASYEQAIHSIGKASHGRGIYEGPGISIKLSALHPRYSRAQYERVMEELYPRLLSLTLLAKQYDIGLNIDAEEADRLELSLDLLERLCFEPSLAGWNGIGFVIQAYQKRCPYLINYFFDLAKRTPHRLIIRLLKGAYWDSEIKRAQVEGLEGYPVYTRKVYTDVSYVACARKLLAVPEAIYPQFATHNAHTLSAIYHIAGQNYYPGQYEFQCLHGMGEPLYEQVVGKIADGKLNRPCRVYAPVGTHETLLAYLVRRLLENGANTSFVNRIADHSISIQELVADRWPASIAWVPRKGSIGLPHPRIPLPRDLYGTERAKLAGIEMANEHRLGLLSCAMVATAHKQWEAAPLLACAARESAAAPVLNPADHRNVVGHVQEATVAKFDNAIHCALNPAPIWQATPPAERAAILERTADLMEAEIHPLMGLLIREAGKTFPNAIAELREAVDFLRYYAVQALNDFSNDAHRPLGPVVCISPWNFPLAIFTGQVAAALAAGNPVLAKPAEQTPLIAAQAVRLLLEAGIPEGVLQLLPGRGETVGAGLVGDERVKGVMFTGSTEVARLLQRNVAGRLDNQGRPIPLIAETGGQNAMIVDSSALTEQVVIDVVSSAFDSAGQRCSALRVLCLQEDSADRVIEMLKGAMAESRLGCPDRLAVDIGPVIDAEAKAGIEKHIQGMREKGRPVYQVAIADAAEIKRGTFVMPTLIELDSFDELKREIFGPVLHVVRYNRRNLDQLIEQINNSGYGLTLGVHTRIDETIAKVVETATPATCRHRNIVGAVVGVQPFGGEGLSGTGPKAGGPLYLYRLLSTRPADAIGRHFQQQDGEGTPDRTLHEQLVKPLHGLKAWAENNQLADLAALCSQFASQSQSGIARLLPGPTGERNSYTILPREHVLCLADNETDLLAQFAAVLAVGSSAVWVDGEPGKALRARLPRELQAKVKLVADWNKDEVAFDAVIHHGDSDQLRGVCQQVAKRAGAIVGVHGLSSGDHQIALERLVIERAVSVNTAAAGGNASLMTIG

SEQ ID NO: 1928 - DNA, 3939 bp, Klebsiella aerogenes
  CDS (1)..(3939): transl_table=11
atgggcaccaccaccatgggtgttaagcttgacgacgcaacccgcgagcgcattaaatccgccgcgagccgtattgaccgcacgccgcactggctgattaagcaggccatctttaattatctggaaaaactggagaacgacgagacgctgcctgagctgccggccctgctctccggggccgccaacgaaagcgatgacgccagcgaaccaacggaagagccctatcagccattcctcgaattcgccgagcagatcctgccgcagtcggtgaggcgcgcggcgatcaccgccgcctggcgacgtccggaaaccgacgcggtaccgatgctgctggagcaggcccgtctgccgcagccgctgggcgaacaggcgcacaagctggcgtatcagctggcggaaaaactgcgcaaccagaaaaccgccagcggccgcgccggcatggtgcagagcctgctgcaggagttctccctctcttcacaggaaggggtggcgctgatgtgcctggcggaagccctgctgcgtattccggataaagccacccgcgatgcgctgatccgcgacaaaatcagcaacggcaactggcagtcgcacatcggccgcagcccgtcgctgttcgtcaacgccgccacctgggggctgctgttcaccggaaaactggtgtcgacccataacgagaccagcctctcccgctccctgaaccgcatcatcggcaagagcggcgaaccgctgatccgcaaaggcgtggatatggcgatgcgcctgatgggcgagcagttcgtcaccggggaaaccatcgccgaagcgctggccaacgcccgcaagctggaagaaaaagggttccgctactcctacgatatgctcggcgaagccgccctgaccgccgctgacgcccaggcctatatggtttcttatcagcaggcgatccatgccatcggcaaagcctccaacggccgcggcatttatgaaggtccgggtatctccattaagctctccgcgctgcacccgcgctacagccgcgcgcagtatgaccgggtgatggaagagctttacccgcggctgaaatcgctgaccctgctggcgcgccagtatgacatcggcatcaatattgacgccgaagaggcagaccgtctggagatctccctcgacctgctggaaaaactgtgcttcgagccggaactggccggctggaacgggattggcttcgtgattcaggcctaccagaagcgctgtccgtttgtcattgattacctgattgacctcgccacccgcagccgccgtcgcctgatgatccgtctggtgaaaggcgcctactgggatagcgaaattaaacgcgcgcagatggaaggtctcgaaggctatccggtatacacccgcaaggtttacaccgacgtctcctacctcgcctgcgcgaagaagctgctggcggtgccgaacctgatttacccgcagtttgccacccataacgcccatactctggcggctatctaccagctggcaggccagaactactacccgggccagtatgagttccagtgcctgcacggcatgggcgaaccgctttacgagcaggtggtgggcaaggtcgccgacggcaaactgaatcggccgtgccgcatctacgccccggtgggcacccacgagacgctgctggcgtatctggtgcgtcgtctgctggagaacggcgccaatacctctttcgtcaaccgtatcgcggacaataccctgccgctggacgagctggtggccgacccggtcagcgcggtagaaaaactggcgcagcaggaaggccaggccggcctgccgcatccgaaaatcccgctgccgcgcgatctctacggcagcggccggagcaactccgccggtctcgatctggcgaacgagcaccgtctggcctccctctcctcttccctgctcaacagcgcgctgcataaatggcaggcattgccgatgctggagcagccggtggccgaaggcgagatgcagccggtggttaacccggcagagccgaaagatatcgtcggctacgtccgcgaagccagcgacgctgaagtgcagcaggcgctgaccagcgctatcaacaatgcgccgatctggttcgccactccgccgcaggagcgcgccgccattcttgagcgcgccgcggtgctgatggaaagccaaatgccgaccctgatggggatcctggtgcgcgaggcgggtaaaaccttcagcaacgccatcgctgaagtgcgcgaagccgttgacttcctgcactattacgccggccaggtgcgcgacgatttcgataatgaaactcaccgcccgctgggtccggtggtctgtatcagcccgtggaacttcccgctggcgatcttcaccggccagattgccgccgcgctggcggccggcaacagcgtgctggcgaaacctgccgagcagacgccgcttatcgccgcccagggcgtggcgattctactggaagccggcgtgccgccgggcgttattcaactgctgccgggtcgcggggagaccgtgggcgccgcgctaacctccgatgagcgcgtacgcggcgtgatgttcaccggctccaccgaagtggccaccctgctgcagcgcaatatcgccagccgcctcgatccccagggccgcccgacgccgctgatcgccgaaaccggcgggatgaacgcgatgatcgtcgattcgtcggcgctcaccgagcaggtagtgatcgacgtgctggcttccgcgttcgacagcgctggccagcgctgctccgccctgcgcgtgctttgcctgcaggaagaggtcgccgatcacaccttaaccatgctgcgcggcgccatgagcgagtgccggatgggcaatccggggcgcctgaccaccgatatcggtccggttatcgatgcggaagcgaaagagaatatcgaacgccatattcaggcgatgcgcgccaaaggccgcaccgtctaccaggcggtgcgcgagaatagcgaagacgcccgcgaatggcgtcacgggaccttcgtgccgccgacgcttatcgagctcgacagcttcgacgagctgaaaaaagaggtcttcggcccggtactgcacgtggtgcgctataaccgtaacgagctggacaaactggtcgagcagattaacgcctctggctacggcctgaccctcggcgtgcatacccgtatcgacgaaaccatcgcccaggtcaccggcagcgcgaaggtgggcaacctgtacgtcaaccgcaatatggttggcgcggtggtcggcgtgcagccgttcggcggcgaagggctgtccggtaccggtccgaaagccggcggtccgctgtatctgtaccgtctgctctccagccgtccgcaggacgcggttggcgtgaccttcgcccgccaggatgcagagcgtccgctggacgcccagctgaaaacgctgctggaaaaaccgctgcaggcgctgcagcagtgggccgcgggccgtcctgagctgcaggcgctgtgccagcagtacagcgagcaggcgcaaagcggcactcaacgcctgctgccggggccaaccggcgagcgcaacaccctgacgctgatgccgcgcgagcgcgtgctgtgcgtagcggataacgaacaggatgcgctgatccagctggcggctgtgctggcggtgggttgtgaagtactgtggccggacagcgccctgcagcgcgatctggcgaagaaactgccgcgggaggtcagcgagcgcattcgctttgccaaagcggagcagttgcctgtccaggccttcgacgcggttatctaccacggcgattccgaccagctgcgcgagctgtgcgagcaggtggcggcgcgcgatggggcgattgtctccgtgcagggcttcgcccgcggcgaaaccaatctgctgctggagcggctgtatatcgagcgttcgctgagcgttaacaccgccgcggcaggcgcgtaa

SEQ ID NO: 1929 - protein, 1312 aa, Klebsiella aerogenes
MGTTTMGVKLDDATRERIKSAASRIDRTPHWLIKQAIFNYLEKLENDETLPELPALLSGAANESDDASEPTEEPYQPFLEFAEQILPQSVRRAAITAAWRRPETDAVPMLLEQARLPQPLGEQAHKLAYQLAEKLRNQKTASGRAGMVQSLLQEFSLSSQEGVALMCLAEALLRIPDKATRDALIRDKISNGNWQSHIGRSPSLFVNAATWGLLFTGKLVSTHNETSLSRSLNRIIGKSGEPLIRKGVDMAMRLMGEQFVTGETIAEALANARKLEEKGFRYSYDMLGEAALTAADAQAYMVSYQQAIHAIGKASNGRGIYEGPGISIKLSALHPRYSRAQYDRVMEELYPRLKSLTLLARQYDIGINIDAEEADRLEISLDLLEKLCFEPELAGWNGIGFVIQAYQKRCPFVIDYLIDLATRSRRRLMIRLVKGAYWDSEIKRAQMEGLEGYPVYTRKVYTDVSYLACAKKLLAVPNLIYPQFATHNAHTLAAIYQLAGQNYYPGQYEFQCLHGMGEPLYEQVVGKVADGKLNRPCRIYAPVGTHETLLAYLVRRLLENGANTSFVNRIADNTLPLDELVADPVSAVEKLAQQEGQAGLPHPKIPLPRDLYGSGRSNSAGLDLANEHRLASLSSSLLNSALHKWQALPMLEQPVAEGEMQPVVNPAEPKDIVGYVREASDAEVQQALTSAINNAPIWFATPPQERAAILERAAVLMESQMPTLMGILVREAGKTFSNAIAEVREAVDFLHYYAGQVRDDFDNETHRPLGPVVCISPWNFPLAIFTGQIAAALAAGNSVLAKPAEQTPLIAAQGVAILLEAGVPPGVIQLLPGRGETVGAALTSDERVRGVMFTGSTEVATLLQRNIASRLDPQGRPTPLIAETGGMNAMIVDSSALTEQVVIDVLASAFDSAGQRCSALRVLCLQEEVADHTLTMLRGAMSECRMGNPGRLTTDIGPVIDAEAKENIERHIQAMRAKGRTVYQAVRENSEDAREWRHGTFVPPTLIELDSFDELKKEVFGPVLHVVRYNRNELDKLVEQINASGYGLTLGVHTRIDETIAQVTGSAKVGNLYVNRNMVGAVVGVQPFGGEGLSGTGPKAGGPLYLYRLLSSRPQDAVGVTFARQDAERPLDAQLKTLLEKPLQALQQWAAGRPELQALCQQYSEQAQSGTQRLLPGPTGERNTLTLMPRERVLCVADNEQDALIQLAAVLAVGCEVLWPDSALQRDLAKKLPREVSERIRFAKAEQLPVQAFDAVIYHGDSDQLRELCEQVAARDGAIVSVQGFARGETNLLLERLYIERSLSVNTAAAGA

SEQ ID NO: 1930 - DNA, 3675 bp, Rhizobium meliloti
  CDS (1)..(3675): transl_table=11
atgagcccgaacccgcttcagaaacccgcgatcgacgccgcacctgcgcccttcgccgacttcgcaccgccagtccggccgcaaagcacgctgcgccgggcgatcacggccgcttaccgccgcccggaaacggaatgcctgccgcctctcgtcgaggcggccacgcaatcgaaggaaatacgggacgccgccgcaagcaccgcccgcaagctgatcgaggcgctgcgcggcaagcatagtggttccggcgtcgagggactggtgcaggaatattcgctttcgagccaggaaggcgtggcactcatgtgccttgcggaacggcctgtgcgcattcccgatacggcgacgcgcgacgcgctgatccgcgacaagattgccgacggcaactggaaatcgcatctcggcaggagccgttcgctcttcgtcaatgccgcgacctggggacttgtggtcaccggcaagctgacctcgacggtcaacgaccgcacgctcgcggcgcgcgtcacgcgtctcatctcgcgttgcggcgagccggtgatccggcgcggcgtcgacatggccatgcggatgatgggcgaacagttcgtcaccggcgagacgatcgaagcgctgaaacgttctaaggagctcgaggagaaaggcttcagctactcctacgacatgctgcgcgaacggcccacggccgccgacgccgaacgctattacagggactatgagagcgccattcacgcaactgcaaagcctcgcggccgcggcatctatgagggcccgggcatctccatcaagctctcggcgctgcatccccgctataggcaagccgcgcgcgtcatgggcgaattgttgccgagggtgaaggcgctcgctctcctcgccaagaattacgatatcggcctcaacatcgacgccgaggaagccgaccggctggaactgtcgctcgatctcctcgaggtgctctgcctcgacggcgatctctccggctggaacggcatgggcttcgtcgtgcaggcctatggcaaacgctgccccttcgttctcgacttcatcatcgatcttgcccggcgctccggccggcgcatcatggtgcggctggtgaagggtgcctattgggatgccgagatcaagcgggcgcagctcgacgggctcgcggatttcccggtcttcacgcgcaagatccacaccgacgtctcctatatgcctcggacccaagctgcttgccgcgaccgatgtggtgttccgcaattcgcgacacacaatgcccaaacgctcgccgccatctaccacatggccggcaaggactttcacgtgggcaaatacgaattccagtgcctgcacggcatgggcgagccgctttatgaagaggtcgtcggccgcggcaagctcgatcgcccctgccgcatctatgcgcctgtcggcacccatgagacgctgcttgcctatctggtccggcgcctcctcgaaaacggcgccaactcctccttcgtgcatcgcatcaacgacccgaaggtttcgatcgacgaactgatcgccgaccccgtcgaagtcgtccgcgccatgccggtcgtcggcgccaagcacgacaggatcgccttgccggccgtactcttcggcgatgcgcggaccaattccgccgggttcgatctttccaacgaggaaacgcttgcgtcgcttacggaagcgctgagggaaagcgcggcaatgaagtggaccgccctgccgcagttcgcaaccggccccgctgccggcgagacgcggacggttctgaaccccggcgaccatcgtgacgttgtcggctcggtgaccgagactcggaagaggacgcacggcgcgccgtgcgcttgccgcagacgcggcgccggattgggcggccgtctcgccgagcgggccgcctgcctcgaccgcgccgccgagctgatgcaggcccgcatgcccacgcttctcgggctgatcatccgcgaggcgggcaaatcggcgctgaacgccattgccgaggtgcgcgaggcgatcgatttcctgcgctactatgccgaacagacgcgccgcacgctcggcccggccacgccgctcggcccgatcgtctgcatcagcccatggaatttcccgctggcaatcttcaccgggcagatcgccgccgcactcgtcgccggcaatcccgtgctcgccaaacccgcggaagagacgccgctgatcgccgccgagggcgtgcgcatcctgcgtgaggccggcattccggcaagcgcgctgcagcttcttccgggcgacggacgcgtcggtgcggcgctggtcgccggccgagacgcgggcgtgatgttcaccggatcgacggaagtcgcgcggctgatccaggcacagcttgccgaccgcctttcgcccgccggccggccggtcccgctgatcgccgaaaccggtggccagaatgcgatgatcgtcgactcctcggcgcttgccggacaggtggtcggcgacgtgatcacctccgccttcgacagtgccggccagcgctgctcggcactgcgtgtgctgtgcctgcaggaggatgtggccggaccgcatcctgacgatgctgaagggcgcgctgcacgacactgcatatcggccgcaccgatcgtcttttccgtggatgtcggcccggtcatcacatcagaggcgaaggacaacatcgagaagcacatagagcggatgcgcgggctcggccgcaaggtcgagcagatcgggctcgcctcggagaccggagtgggcaccttcgtgccgccgacgatcatcgaactcgagaagctttccgatcttcaacgcgaggtcttcgggccggtgctgcacgtcatccgctaccggcgcgacgatctcgaccggctggtggacgacgtcaacgccaccggctacggcctgaccttcgggctccacacgcgcctcgacgagacgatcgcgcatgtgacgagccgtatcaaggcgggcaacctctacatcaaccgcaacatcatcggcgcggtcgtcggcgtccagcccttcggcggccgcggtctttccggtaccggtcccaaggccggcggtccgctttatctcggccgcctggttacgaccgcaccggtgccgccgcagcacagctcggtgcacacggacccggtccttctcgacttcgccaaatggctcgacggcaaaggcgcgcgcgcggaggtcgaagcggcccgcaacgccggcagcagctcggcacttggcctggatctggaactccccggccccgtcggcgaacgcaatctctatacgctccatgcgcgcggccgcatcctcctcgtgccggcgacggagagcggtctataccaccagctcgccgctgcgctcgcgaccggcaacagcgtcgcgatcgatgccgcctccggtctgcaggcttcgctgaagaacctgccgcagaccgtcggcctgcgtgtctcctggtccaaggactgggccgccgacggcccgttcgccggtgcgctggtcgaaggtgacgccgagcgcatccgcgcggtcaacaaggctatcgccgccctgcccggcccgctgctgctcgtgcaggccgcatcgagcggggagatcgcccgcaacccggacgcctattgcctgaactggctcgtggaagaggtttccgcctcgatcaacacggctgcagccggcgggaatgccagcctgatggcgatcggctga

SEQ ID NO: 1931 - protein, 1224 aa, Rhizobium meliloti
MSPNPLQKPAIDAAPAPFADFAPPVRPQSTLRRAITAAYRRPETECLPPLVEAATQSKEIRDAAASTARKLIEALRGKHSGSGVEGLVQEYSLSSQEGVALMCLAERPVRIPDTATRDALIRDKIADGNWKSHLGRSRSLFVNAATWGLVVTGKLTSTVNDRTLAARVTRLISRCGEPVIRRGVDMAMRMMGEQFVTGETIEALKRSKELEEKGFSYSYDMLRERPTAADAERYYRDYESAIHATAKPRGRGIYEGPGISIKLSALHPRYRQAARVMGELLPRVKALALLAKNYDIGLNIDAEEADRLELSLDLLEVLCLDGDLSGWNGMGFVVQAYGKRCPFVLDFIIDLARRSGRRIMVRLVKGAYWDAEIKRAQLDGLADFPVFTRKIHTDVSYMPRTQAACRDRCGVPQFATHNAQTLAAIYHMAGKDFHVGKYEFQCLHGMGEPLYEEVVGRGKLDRPCRIYAPVGTHETLLAYLVRRLLENGANSSFVHRINDPKVSIDELIADPVEVVRAMPVVGAKHDRIALPAVLFGDARTNSAGFDLSNEETLASLTEALRESAAMKWTALPQFATGPAAGETRTVLNPGDHRDVVGSVTETRKRTHGAPCACRRRGAGLGGRLAERAACLDRAAELMQARMPTLLGLIIREAGKSALNAIAEVREAIDFLRYYAEQTRRTLGPATPLGPIVCISPWNFPLAIFTGQIAAALVAGNPVLAKPAEETPLIAAEGVRILREAGIPASALQLLPGDGRVGAALVAGRDAGVMFTGSTEVARLIQAQLADRLSPAGRPVPLIAETGGQNAMIVDSSALAGQVVGDVITSAFDSAGQRCSALRVLCLQEDVAGPHPDDAEGRAARHCISAAPIVFSVDVGPVITSEAKDNIEKHIERMRGLGRKVEQIGLASETGVGTFVPPTIIELEKLSDLQREVFGPVLHVIRYRRDDLDRLVDDVNATGYGLTFGLHTRLDETIAHVTSRIKAGNLYINRNIIGAVVGVQPFGGRGLSGTGPKAGGPLYLGRLVTTAPVPPQHSSVHTDPVLLDFAKWLDGKGARAEVEAARNAGSSSALGLDLELPGPVGERNLYTLHARGRILLVPATESGLYHQLAAALATGNSVAIDAASGLQASLKNLPQTVGLRVSWSKDWAADGPFAGALVEGDAERIRAVNKAIAALPGPLLLVQAASSGEIARNPDAYCLNWLVEEVSASINTAAAGGNASLMAIG

SEQ ID NO: 1932 - DNA, 20 bp, Artificial sequence
  primer
atgggaaccaccaccatggg

SEQ ID NO: 1933 - DNA, 25 bp, Artificial sequence
  primer
ttaacctatagtcattaagctggcg

SEQ ID NO: 1934 - protein, 1283 aa, Artificial sequence
  consensus sequence
  Variant (2)..(3): Xaa in position 2 to 3 is any amino acid
  Variant (5)..(9): Xaa in position 5 to 9 is any amino acid
  Variant (10)..(10): Xaa in position 10 is any or no amino acid
  Variant (13)..(14): Xaa in position 13 to 14 is any amino acid
  Variant (16)..(16): Xaa in position 16 is any amino acid
  Variant (20)..(20): Xaa in position 20 is any amino acid
  Variant (22)..(22): Xaa in position 22 is any amino acid
  Variant (25)..(25): Xaa in position 25 is any amino acid
  Variant (27)..(32): Xaa in position 27 to 32 is any amino acid
  Variant (34)..(36): Xaa in position 34 to 36 is any amino acid
  Variant (38)..(45): Xaa in position 38 to 45 is any amino acid
  Variant (46)..(58): Xaa in position 46 to 58 is any or no amino acid
  Variant (60)..(65): Xaa in position 60 to 65 is any amino acid
  Variant (68)..(73): Xaa in position 68 to 73 is any amino acid
  Variant (75)..(75): Xaa in position 75 is any amino acid
  Variant (76)..(78): Xaa in position 76 to 78 is any or no amino acid
  Variant (80)..(80): Xaa in position 80 is any amino acid
  Variant (83)..(84): Xaa in position 83 to 84 is any amino acid
  Variant (86)..(86): Xaa in position 86 is any amino acid
  Variant (109)..(110): Xaa in position 109 to 110 is any amino acid
  Variant (121)..(121): Xaa in position 121 is any amino acid
  Variant (122)..(122): Xaa in position 122 is any or no amino acid
  Variant (124)..(124): Xaa in position 124 is any amino acid
  Variant (126)..(127): Xaa in position 126 to 127 is any amino acid
  Variant (129)..(129): Xaa in position 129 is any amino acid
  Variant (131)..(133): Xaa in position 131 to 133 is any amino acid
  Variant (145)..(146): Xaa in position 145 to 146 is any amino acid
  Variant (149)..(149): Xaa in position 149 is any amino acid
  Variant (151)..(152): Xaa in position 151 to 152 is any amino acid
  Variant (154)..(158): Xaa in position 154 to 158 is any amino acid
  Variant (160)..(162): Xaa in position 160 to 162 is any amino acid
  Variant (164)..(164): Xaa in position 164 is any amino acid
  Variant (166)..(166): Xaa in position 166 is any amino acid
  Variant (168)..(170): Xaa in position 168 to 170 is any amino acid
  Variant (174)..(174): Xaa in position 174 is any amino acid
  Variant (177)..(177): Xaa in position 177 is any amino acid
  Variant (185)..(185): Xaa in position 185 is any amino acid
  Variant (197)..(197): Xaa in position 197 is any amino acid
  Variant (201)..(206): Xaa in position 201 to 206 is any amino acid
  Variant (208)..(209): Xaa in position 208 to 209 is any amino acid
  Variant (223)..(223): Xaa in position 223 is any amino acid
  Variant (225)..(226): Xaa in position 225 to 226 is any amino acid
  Variant (229)..(230): Xaa in position 229 to 230 is any amino acid
  Variant (232)..(234): Xaa in position 232 to 234 is any amino acid
  Variant (236)..(237): Xaa in position 236 to 237 is any amino acid
  Variant (244)..(244): Xaa in position 244 is any amino acid
  Variant (246)..(246): Xaa in position 246 is any amino acid
  Variant (247)..(247): Xaa in position 247 is any or no amino acid
  Variant (253)..(253): Xaa in position 253 is any amino acid
  Variant (269)..(269): Xaa in position 269 is any amino acid
  Variant (271)..(271): Xaa in position 271 is any amino acid
  Variant (273)..(274): Xaa in position 273 to 274 is any amino acid
  Variant (276)..(276): Xaa in position 276 is any amino acid
  Variant (278)..(278): Xaa in position 278 is any amino acid
  Variant (281)..(281): Xaa in position 281 is any amino acid
  Variant (284)..(286): Xaa in position 284 to 286 is any amino acid
  Variant (288)..(289): Xaa in position 288 to 289 is any amino acid
  Variant (292)..(293): Xaa in position 292 to 293 is any amino acid
  Variant (298)..(298): Xaa in position 298 is any amino acid
  Variant (310)..(310): Xaa in position 310 is any amino acid
  Variant (317)..(317): Xaa in position 317 is any amino acid
  Variant (318)..(318): Xaa in position 318 is any or no amino acid
  Variant (321)..(322): Xaa in position 321 to 322 is any amino acid
  Variant (324)..(324): Xaa in position 324 is any amino acid
  Variant (326)..(326): Xaa in position 326 is any amino acid
  Variant (329)..(329): Xaa in position 329 is any amino acid
  Variant (331)..(331): Xaa in position 331 is any amino acid
  Variant (335)..(335): Xaa in position 335 is any amino acid
  Variant (339)..(339): Xaa in position 339 is any amino acid
  Variant (344)..(344): Xaa in position 344 is any amino acid
  Variant (346)..(346): Xaa in position 346 is any amino acid
  Variant (348)..(350): Xaa in position 348 to 350 is any amino acid
  Variant (354)..(354): Xaa in position 354 is any amino acid
  Variant (357)..(358): Xaa in position 357 to 358 is any amino acid
  Variant (360)..(360): Xaa in position 360 is any amino acid
  Variant (362)..(362): Xaa in position 362 is any amino acid
  Variant (372)..(372): Xaa in position 372 is any amino acid
  Variant (379)..(380): Xaa in position 379 to 380 is any amino acid
  Variant (383)..(385): Xaa in position 383 to 385 is any amino acid
  Variant (392)..(393): Xaa in position 392 to 393 is any amino acid
  Variant (397)..(397): Xaa in position 397 is any amino acid
  Variant (399)..(399): Xaa in position 399 is any amino acid
  Variant (403)..(403): Xaa in position 403 is any amino acid
  Variant (407)..(413): Xaa in position 407 to 413 is any amino acid
  Variant (422)..(422): Xaa in position 422 is any amino acid
  Variant (425)..(426): Xaa in position 425 to 426 is any amino acid
  Variant (429)..(430): Xaa in position 429 to 430 is any amino acid
  Variant (433)..(434): Xaa in position 433 to 434 is any amino acid
  Variant (435)..(438): Xaa in position 435 to 438 is any or no amino acid
  Variant (440)..(440): Xaa in position 440 is any amino acid
  Variant (441)..(442): Xaa in position 441 to 442 is any or no amino acid
  Variant (457)..(458): Xaa in position 457 to 458 is any amino acid
  Variant (460)..(460): Xaa in position 460 is any amino acid
  Variant (462)..(463): Xaa in position 462 to 463 is any amino acid
  Variant (464)..(466): Xaa in position 464 to 466 is any or no amino acid
  Variant (469)..(469): Xaa in position 469 is any amino acid
  Variant (474)..(474): Xaa in position 474 is any amino acid
  Variant (499)..(499): Xaa in position 499 is any amino acid
  Variant (506)..(506): Xaa in position 506 is any amino acid
  Variant (508)..(514): Xaa in position 508 to 514 is any amino acid
  Variant (516)..(516): Xaa in position 516 is any amino acid
  Variant (521)..(527): Xaa in position 521 to 527 is any amino acid
  Variant (528)..(534): Xaa in position 528 to 534 is any or no amino acid
  Variant (536)..(537): Xaa in position 536 to 537 is any amino acid
  Variant (539)..(540): Xaa in position 539 to 540 is any amino acid
  Variant (542)..(542): Xaa in position 542 is any amino acid
  Variant (545)..(546): Xaa in position 545 to 546 is any amino acid
  Variant (550)..(550): Xaa in position 550 is any amino acid
  Variant (551)..(555): Xaa in position 551 to 555 is any or no amino acid
  Variant (557)..(557): Xaa in position 557 is any amino acid
  Variant (560)..(560): Xaa in position 560 is any amino acid
  Variant (562)..(562): Xaa in position 562 is any amino acid
  Variant (565)..(565): Xaa in position 565 is any amino acid
  Variant (568)..(569): Xaa in position 568 to 569 is any amino acid
  Variant (571)..(572): Xaa in position 571 to 572 is any amino acid
  Variant (574)..(576): Xaa in position 574 to 576 is any amino acid
  Variant (578)..(580): Xaa in position 578 to 580 is any amino acid
  Variant (582)..(584): Xaa in position 582 to 584 is any amino acid
  Variant (586)..(586): Xaa in position 586 is any amino acid
  Variant (588)..(588): Xaa in position 588 is any amino acid
  Variant (590)..(598): Xaa in position 590 to 598 is any amino acid
  Variant (599)..(607): Xaa in position 599 to 607 is any or no amino acid
  Variant (609)..(609): Xaa in position 609 is any amino acid
  Variant (612)..(615): Xaa in position 612 to 615 is any amino acid
  Variant (617)..(617): Xaa in position 617 is any amino acid
  Variant (620)..(620): Xaa in position 620 is any amino acid
  Variant (622)..(629): Xaa in position 622 to 629 is any amino acid
  Variant (630)..(631): Xaa in position 630 to 631 is any or no amino acid
  Variant (633)..(635): Xaa in position 633 to 635 is any amino acid
  Variant (637)..(640): Xaa in position 637 to 640 is any amino acid
  Variant (641)..(642): Xaa in position 641 to 642 is any or no amino acid
  Variant (644)..(649): Xaa in position 644 to 649 is any amino acid
  Variant (650)..(650): Xaa in position 650 is any or no amino acid
  Variant (653)..(654): Xaa in position 653 to 654 is any amino acid
  Variant (656)..(656): Xaa in position 656 is any amino acid
  Variant (660)..(668): Xaa in position 660 to 668 is any amino acid
  Variant (670)..(670): Xaa in position 670 is any amino acid
  Variant (672)..(674): Xaa in position 672 to 674 is any amino acid
  Variant (680)..(682): Xaa in position 680 to 682 is any amino acid
  Variant (692)..(692): Xaa in position 692 is any amino acid
  Variant (700)..(700): Xaa in position 700 is any amino acid
  Variant (702)..(709): Xaa in position 702 to 709 is any amino acid
  Variant (710)..(712): Xaa in position 710 to 712 is any or no amino acid
  Variant (731)..(731): Xaa in position 731 is any amino acid
  Variant (734)..(735): Xaa in position 734 to 735 is any amino acid
  Variant (739)..(739): Xaa in position 739 is any amino acid
  Variant (743)..(743): Xaa in position 743 is any amino acid
  Variant (751)..(751): Xaa in position 751 is any amino acid
  Variant (757)..(759): Xaa in position 757 to 759 is any amino acid
  Variant (761)..(762): Xaa in position 761 to 762 is any amino acid
  Variant (764)..(765): Xaa in position 764 to 765 is any amino acid
  Variant (768)..(768): Xaa in position 768 is any amino acid
  Variant (770)..(773): Xaa in position 770 to 773 is any amino acid
  Variant (779)..(779): Xaa in position 779 is any amino acid
  Variant (781)..(782): Xaa in position 781 to 782 is any amino acid
  Variant (783)..(783): Xaa in position 783 is any or no amino acid
  Variant (786)..(786): Xaa in position 786 is any amino acid
  Variant (789)..(794): Xaa in position 789 to 794 is any amino acid
  Variant (795)..(795): Xaa in position 795 is any or no amino acid
  Variant (806)..(812): Xaa in position 806 to 812 is any amino acid
  Variant (814)..(814): Xaa in position 814 is any amino acid
  Variant (817)..(817): Xaa in position 817 is any amino acid
  Variant (818)..(819): Xaa in position 818 to 819 is any or no amino acid
  Variant (821)..(821): Xaa in position 821 is any amino acid
  Variant (823)..(823): Xaa in position 823 is any amino acid
  Variant (832)..(832): Xaa in position 832 is any amino acid
  Variant (843)..(843): Xaa in position 843 is any amino acid
  Variant (848)..(848): Xaa in position 848 is any amino acid
  Variant (851)..(852): Xaa in position 851 to 852 is any amino acid
  Variant (867)..(867): Xaa in position 867 is any amino acid
  Variant (870)..(870): Xaa in position 870 is any amino acid
  Variant (872)..(872): Xaa in position 872 is any amino acid
  Variant (874)..(874): Xaa in position 874 is any amino acid
  Variant (876)..(880): Xaa in position 876 to 880 is any amino acid
  Variant (883)..(883): Xaa in position 883 is any amino acid
  Variant (885)..(885): Xaa in position 885 is any amino acid
  Variant (887)..(888): Xaa in position 887 to 888 is any amino acid
  Variant (890)..(892): Xaa in position 890 to 892 is any amino acid
  Variant (894)..(897): Xaa in position 894 to 897 is any amino acid
  Variant (899)..(900): Xaa in position 899 to 900 is any amino acid
  Variant (902)..(902): Xaa in position 902 is any amino acid
  Variant (907)..(909): Xaa in position 907 to 909 is any amino acid
  Variant (911)..(913): Xaa in position 911 to 913 is any amino acid
  Variant (915)..(916): Xaa in position 915 to 916 is any amino acid
  Variant (919)..(920): Xaa in position 919 to 920 is any amino acid
  Variant (922)..(924): Xaa in position 922 to 924 is any amino acid
  Variant (926)..(927): Xaa in position 926 to 927 is any amino acid
  Variant (929)..(929): Xaa in position 929 is any amino acid
  Variant (931)..(939): Xaa in position 931 to 939 is any amino acid
  Variant (940)..(945): Xaa in position 940 to 945 is any or no amino acid
  Variant (950)..(950): Xaa in position 950 is any amino acid
  Variant (953)..(953): Xaa in position 953 is any amino acid
  Variant (956)..(961): Xaa in position 956 to 961 is any amino acid
  Variant (963)..(964): Xaa in position 963 to 964 is any amino acid
  Variant (966)..(966): Xaa in position 966 is any amino acid
  Variant (974)..(974): Xaa in position 974 is any amino acid
  Variant (976)..(977): Xaa in position 976 to 977 is any amino acid
  Variant (979)..(980): Xaa in position 979 to 980 is any amino acid
  Variant (981)..(984): Xaa in position 981 to 984 is any or no amino acid
  Variant (986)..(987): Xaa in position 986 to 987 is any amino acid
  Variant (989)..(991): Xaa in position 989 to 991 is any amino acid
  Variant (993)..(995): Xaa in position 993 to 995 is any amino acid
  Variant (1001)..(1001): Xaa in position 1001 is any amino acid
  Variant (1003)..(1003): Xaa in position 1003 is any amino acid
  Variant (1007)..(1007): Xaa in position 1007 is any amino acid
  Variant (1012)..(1013): Xaa in position 1012 to 1013 is any amino acid
  Variant (1015)..(1020): Xaa in position 1015 to 1020 is any amino acid
  Variant (1023)..(1023): Xaa in position 1023 is any amino acid
  Variant (1029)..(1030): Xaa in position 1029 to 1030 is any amino acid
  Variant (1042)..(1042): Xaa in position 1042 is any amino acid
  Variant (1058)..(1058): Xaa in position 1058 is any amino acid
  Variant (1061)..(1063): Xaa in position 1061 to 1063 is any amino acid
  Variant (1064)..(1064): Xaa in position 1064 is any or no amino acid
  Variant (1066)..(1071): Xaa in position 1066 to 1071 is any amino acid
  Variant (1072)..(1122): Xaa in position 1072 to 1122 is any or no amino acid
  Variant (1124)..(1127): Xaa in position 1124 to 1127 is any amino acid
  Variant (1129)..(1129): Xaa in position 1129 is any amino acid
  Variant (1132)..(1132): Xaa in position 1132 is any amino acid
  Variant (1135)..(1135): Xaa in position 1135 is any amino acid
  Variant (1137)..(1137): Xaa in position 1137 is any amino acid
  Variant (1139)..(1142): Xaa in position 1139 to 1142 is any amino acid
  Variant (1144)..(1146): Xaa in position 1144 to 1146 is any amino acid
  Variant (1148)..(1158): Xaa in position 1148 to 1158 is any amino acid
  Variant (1160)..(1160): Xaa in position 1160 is any amino acid
  Variant (1163)..(1163): Xaa in position 1163 is any amino acid
  Variant (1165)..(1166): Xaa in position 1165 to 1166 is any amino acid
  Variant (1168)..(1176): Xaa in position 1168 to 1176 is any amino acid
  Variant (1177)..(1185): Xaa in position 1177 to 1185 is any or no amino acid
  Variant (1188)..(1193): Xaa in position 1188 to 1193 is any amino acid
  Variant (1194)..(1209): Xaa in position 1194 to 1209 is any or no amino acid
  Variant (1211)..(1216): Xaa in position 1211 to 1216 is any amino acid
  Variant (1219)..(1228): Xaa in position 1219 to 1228 is any amino acid
  Variant (1229)..(1229): Xaa in position 1229 is any or no amino acid
  Variant (1231)..(1233): Xaa in position 1231 to 1233 is any amino acid
  Variant (1235)..(1247): Xaa in position 1235 to 1247 is any amino acid
  Variant (1248)..(1256): Xaa in position 1248 to 1256 is any or no amino acid
  Variant (1258)..(1258): Xaa in position 1258 is any amino acid
  Variant (1259)..(1259): Xaa in position 1259 is any or no amino acid
  Variant (1261)..(1262): Xaa in position 1261 to 1262 is any amino acid
  Variant (1264)..(1266): Xaa in position 1264 to 1266 is any amino acid
  Variant (1268)..(1268): Xaa in position 1268 is any amino acid
  Variant (1271)..(1271): Xaa in position 1271 is any amino acid
  Variant (1278)..(1278): Xaa in position 1278 is any amino acid
  Variant (1281)..(1281): Xaa in position 1281 is any amino acid
FXXFXXXXXXQSXXRXAITXAXRRXEXXXXXXLXXXAXXXXXXXXXXXXXXXXXXXXXAXXXXXXLRXXXXXXGXXXXVXGLXXEXSLSSQEGVALMCLAEALLRIPDXXTRDALIRDKIXXGXWXXHXGXXXSLFVNAATWGLXXTGXLXXTXXXXXLXXXLXRXIXXXGEPXIRXGVDMAMRXMGEQFVTGETIXEALXXXXXXEXXGFRYSYDMLGEAAXTXXDAXXYXXXYXXAIHAIGXAXXGRGIYXGPGISIKLSALHPRYXRXQXXRXMXELXPRXXXLXXLAXXYDIGXNIDAEEADRLEXSLDLLEXXLCXXPXLXGWXGXGFVXQAYXKRCPXVXDXXXDLAXRSXXRXMXRLVKGAYWDXEIKRAQXXGLXXXPVYTRKXXTDVXYXACAXKLLXXXXXXXPQFATHNAXTLXXIYXXAGXXXXXXGXXXYEFQCLHGMGEPLYXXVXGXXXXXKLXRPCRXYAPVGTHETLLAYLVRRLLENGANXSFVNRIXDXXXXXXXLXADPVXXXXXXXXXXXXXXGXXHXXIXLPXXLYGXXXXXXRXNSXGXDLXNEXXLXXLXXXLXXXAXXXWXAXPXXXXXXXXXXXXXXXXXXVXNPXXXXDXVGXVXXXXXXXXXXAXXXAXXXXXXWXXXXXXXRAXXLXRAAXXXXXXXXXLXGXXXREAGKXXXNAIAEVREAXDFLRYYAXQXXXXXXXXXXXPLGPVVCISPWNFPLAIFXGQXXAALXAGNXVLAKPAEXTPLIAXXXVXXLXXAGXPXXXXQLLPGXGXXXGAXLVXXXXXXXVMFTGSTEVAXXXXXXXAXRLXXXGXPXPLIAETGGXNAMIVDSSALXEQVVXDVXXSAFDSAGQRCSALRXLCXQXDXAXXXXXMLXGXAXXEXXXGXXXXLXXDXGPVIXXXAXXXIXXHIXXMXXXGXXVXQXXXXXXXXXXXXXXXGTFVXPTXIEXXXXXXLXXEXFGPVLHVXRXXRXXXXXXLXXLXXXIXXXGYGLTXGXHTRXDETIXXVXXXXXXGNXYVNRNXXGAVVGVQPFGGXGLSGTGPKAGGPLYLXRLXXXXPXXXXXXXXXXXXXXXXXXXXXXXXXXXXXXXXXXXXXXXXXXXXXXXXXXXXXXXXXGXXXXLXGPXGEXNXYXXXXRXXXLXXXXXXXXXXXQXAAXLXXGXXXXXXXXXXXXXXXXXXLPXXXXXXXXXXXXXXXXXXXXXXFXXXXXXGDXXXXXXXXXXXAXXXGXXXXXXXXXXXXXXXXXXXXXXLXXLXXEXXXSXNTXAAGGNAXLMXIG

SEQ ID NO: 1935 - protein, 46 aa, Artificial sequence
  protein pattern
  Variant (3)..(3): Xaa in position 3 is Ile or Val
  Variant (5)..(5): Xaa in position 5 is Ala or Gly
  Variant (7)..(7): Xaa in position 7 is Gly or Gln
  Variant (8)..(8): Xaa in position 8 is Lys or Arg
  Variant (10)..(10): Xaa in position 10 is Ala or Cys
  Variant (11)..(12): Xaa in position 11 to 12 is any amino acid
  Variant (13)..(13): Xaa in position 13 is Thr or Val
  Variant (14)..(14): Xaa in position 14 is Ile, Leu or Val
  Variant (15)..(15): Xaa in position 15 is Asp or Glu
  Variant (16)..(16): Xaa in position 16 is any amino acid
  Variant (17)..(17): Xaa in position 17 is Ile, Leu or Val
  Variant (18)..(18): Xaa in position 18 is Ile or Val
  Variant (19)..(19): Xaa in position 19 is Asp or Glu
  Variant (20)..(20): Xaa in position 20 is Ile, Leu or Met
  Variant (22)..(22): Xaa in position 22 is any amino acid
  Variant (24)..(24): Xaa in position 24 is any amino acid
  Variant (25)..(25): Xaa in position 25 is any or no amino acid
  Variant (27)..(27): Xaa in position 27 is any or no amino acid
  Variant (29)..(29): Xaa in position 29 is Ile, Leu or Val
  Variant (31)..(31): Xaa in position 31 is Ile or Val
  Variant (41)..(41): Xaa in position 41 is Ala, Ser or Thr
  Variant (43)..(43): Xaa in position 43 is Ile or Val
  Variant (45)..(45): Xaa in position 45 is Asn or Arg
FVXQXYXXRXXXXXXXXXXXAXRXXRXRXMXRLVKGAYWDXEXKXA

SEQ ID NO: 1936 - protein, 60 aa, Artificial sequence
  protein pattern
  Variant (9)..(9): Xaa in position 9 is any amino acid
  Variant (13)..(13): Xaa in position 13 is any or no amino acid
  Variant (15)..(15): Xaa in position 15 is any or no amino acid
  Variant (21)..(21): Xaa in position 21 is Ala, Thr or Val
  Variant (26)..(26): Xaa in position 26 is any amino acid
  Variant (28)..(28): Xaa in position 28 is Ile or Val
  Variant (29)..(29): Xaa in position 29 is Ile, Leu, Met or Val
  Variant (30)..(30): Xaa in position 30 is any amino acid
  Variant (32)..(32): Xaa in position 32 is Ala or Ser
  Variant (34)..(34): Xaa in position 34 is Asp or Glu
  Variant (45)..(45): Xaa in position 45 is Ile, Leu or Val
  Variant (48)..(48): Xaa in position 48 is Ile, Leu or Val
  Variant (50)..(51): Xaa in position 50 to 51 is Asp or Glu
  Variant (52)..(52): Xaa in position 52 is any amino acid
  Variant (53)..(53): Xaa in position 53 is Ala or Ser
  Variant (54)..(54): Xaa in position 54 is Asp, Glu or Lys
  Variant (55)..(56): Xaa in position 55 to 56 is any amino acid
  Variant (57)..(57): Xaa in position 57 is Ile, Leu or Val
  Variant (58)..(58): Xaa in position 58 is any amino acid
  Variant (60)..(60): Xaa in position 60 is Ile or Leu
PLIAETGGXNAMXIXDSSALXEQVVXDXXXSXFXSAGQRCSALRXLCXQXXXXXXXXXMX

SEQ ID NO: 1937 - protein, 40 aa, Artificial sequence
  protein pattern
  Variant (2)..(2): Xaa in position 2 is Asp, Gly or Asn
  Variant (5)..(5): Xaa in position 5 is Ala or Cys
  Variant (7)..(7): Xaa in position 7 is Phe, Ile or Val
  Variant (32)..(32): Xaa in position 32 is Ser or Thr
  Variant (36)..(37): Xaa in position 36 to 37 is any amino acid
  Variant (39)..(39): Xaa in position 39 is Ala, Gly, Asn or Ser
  Variant (40)..(40): Xaa in position 40 is Asp or Asn
LXRPXRXYAPVGTHETLLAYLVRRLLENGANXSFVXXIXX

SEQ ID NO: 1938 - protein, 42 aa, Artificial sequence
  protein pattern
  Variant (2)..(2): Xaa in position 2 is any amino acid
  Variant (3)..(3): Xaa in position 3 is Ala, Ile or Val
  Variant (4)..(4): Xaa in position 4 is any amino acid
  Variant (17)..(17): Xaa in position 17 is any amino acid
  Variant (20)..(20): Xaa in position 20 is Ile or Val
  Variant (21)..(21): Xaa in position 21 is Ala, Ser or Thr
  Variant (25)..(25): Xaa in position 25 is any or no amino acid
  Variant (27)..(27): Xaa in position 27 is any or no amino acid
  Variant (30)..(30): Xaa in position 30 is any amino acid
  Variant (38)..(38): Xaa in position 38 is Glu or Gln
  Variant (40)..(40): Xaa in position 40 is Pro or Ser
GXXXCISPWNFPLAIFXGQXXAALXAXGNXVLAKPAEXTXLI

SEQ ID NO: 1939 - protein, 27 aa, Artificial sequence
  protein pattern
  Variant (8)..(8): Xaa in position 8 is Glu or Arg
  Variant (20)..(20): Xaa in position 20 is Ala or Pro
  Variant (23)..(23): Xaa in position 23 is Ile, Leu or Met
  Variant (24)..(24): Xaa in position 24 is any amino acid
  Variant (27)..(27): Xaa in position 27 is Leu, Met or Val
GVQPFGGXGLSGTGPKAGGXLYXXRLX

SEQ ID NO: 1940 - protein, 19 aa, Artificial sequence
  protein pattern
  Variant (2)..(3): Xaa in position 2 to 3 is any amino acid
  Variant (5)..(5): Xaa in position 5 is any amino acid
  Variant (7)..(7): Xaa in position 7 is any amino acid
  Variant (8)..(8): Xaa in position 8 is Ala, Asp, Gly or Ser
  Variant (9)..(9): Xaa in position 9 is any amino acid
  Variant (13)..(13): Xaa in position 13 is Ile or Val
  Variant (17)..(17): Xaa in position 17 is Ala or Thr
WXXHXGXXXSLFXNAAXWG

SEQ ID NO: 1941 - protein, 14 aa, Artificial sequence
  protein pattern
YEFQCLHGMGEPLY

SEQ ID NO: 1942 - protein, 29 aa, Artificial sequence
  protein pattern
  Variant (2)..(4): Xaa in position 2 to 4 is any or no amino acid
  Variant (7)..(7): Xaa in position 7 is Leu, Met or Val
  Variant (10)..(10): Xaa in position 10 is Lys or Arg
  Variant (12)..(12): Xaa in position 12 is Met or Val
  Variant (14)..(14): Xaa in position 14 is Leu, Met or Val
  Variant (18)..(19): Xaa in position 18 to 19 is Leu or Met
  Variant (21)..(21): Xaa in position 21 is Asp, Glu or Lys
  Variant (27)..(27): Xaa in position 27 is Glu or Arg
  Variant (28)..(28): Xaa in position 28 is Asn or Thr
GXXXEPXIRXGXDXAMRXXGXQFVTGXXI

SEQ ID NO: 1943 - protein, 21 aa, Artificial sequence
  protein pattern
  Variant (4)..(4): Xaa in position 4 is Ile or Val
  Variant (6)..(6): Xaa in position 6 is Asp, Glu or Gly
  Variant (19)..(19): Xaa in position 19 is Ala, Pro or Thr
GRGXYXGPGISIKLSALHXRY

SEQ ID NO: 1944 - protein, 29 aa, Artificial sequence
  protein pattern
  Variant (2)..(2): Xaa in position 2 is Ile, Met or Val
  Variant (3)..(3): Xaa in position 3 is Asp or Glu
  Variant (5)..(6): Xaa in position 5 to 6 is any amino acid
  Variant (7)..(7): Xaa in position 7 is Asp or Gly
  Variant (8)..(8): Xaa in position 8 is Phe or Tyr
  Variant (11)..(11): Xaa in position 11 is Phe or Tyr
  Variant (15)..(15): Xaa in position 15 is Ala, Ile, Leu or Val
  Variant (16)..(16): Xaa in position 16 is His or Tyr
  Variant (20)..(20): Xaa in position 20 is Ala or Ser
  Variant (22)..(22): Xaa in position 22 is Ile, Leu or Val
  Variant (26)..(26): Xaa in position 26 is Lys or Arg
  Variant (27)..(27): Xaa in position 27 is any amino acid
QXXGXXXXPVXTRKXXTDVXYXACAXXLL

SEQ ID NO: 1945 - protein, 32 aa, Artificial sequence
  protein pattern
  Variant (2)..(2): Xaa in position 2 is Phe or Tyr
  Variant (3)..(3): Xaa in position 3 is Ile or Val
  Variant (4)..(4): Xaa in position 4 is any amino acid
  Variant (7)..(7): Xaa in position 7 is Ile, Leu or Met
  Variant (10)..(10): Xaa in position 10 is Ile, Leu or Met
  Variant (11)..(15): Xaa in position 11 to 15 is any amino acid
  Variant (17)..(18): Xaa in position 17 to 18 is any amino acid
  Variant (20)..(20): Xaa in position 20 is Ile or Val
  Variant (28)..(28): Xaa in position 28 is Ile, Leu or Val
  Variant (30)..(30): Xaa in position 30 is Phe or Tyr
  Variant (31)..(31): Xaa in position 31 is any amino acid
TXXXPTXIEXXXXXXLXXEXFGPVLHVXRXXR

SEQ ID NO: 1946 - protein, 19 aa, Artificial sequence
  protein pattern
  Variant (4)..(4): Xaa in position 4 is Ser or Thr
  Variant (8)..(8): Xaa in position 8 is any amino acid
  Variant (11)..(11): Xaa in position 11 is any or no amino acid
  Variant (13)..(16): Xaa in position 13 to 16 is any amino acid
  Variant (17)..(17): Xaa in position 17 is any or no amino acid
QFAXHNAXTLXAXXXXXAG

SEQ ID NO: 1947 - protein, 20 aa, Artificial sequence
  protein pattern
  Variant (2)..(2): Xaa in position 2 is any amino acid
  Variant (3)..(3): Xaa in position 3 is Ala, Asp, Glu, Gly, Gln or Ser
  Variant (5)..(5): Xaa in position 5 is Ala, Thr or Val
  Variant (6)..(6): Xaa in position 6 is any amino acid
  Variant (7)..(7): Xaa in position 7 is Ala, Asp, Glu, Gly, Asn or Ser
  Variant (10)..(10): Xaa in position 10 is any amino acid
  Variant (12)..(12): Xaa in position 12 is any amino acid
  Variant (13)..(15): Xaa in position 13 to 15 is any or no amino acid
  Variant (17)..(18): Xaa in position 17 to 18 is any amino acid
  Variant (20)..(20): Xaa in position 20 is Ala, Ser or Thr
QXXRXXXELXPXXXXLXXLX

SEQ ID NO: 1948 - protein, 11 aa, Artificial sequence
  protein pattern
  Variant (2)..(2): Xaa in position 2 is Phe or Tyr
  Variant (6)..(6): Xaa in position 6 is Phe or Tyr
GXRYSXDMLGE

SEQ ID NO: 1949 - protein, 10 aa, Artificial sequence
  protein pattern
  Variant (4)..(4): Xaa in position 4 is Ile or Val
  Variant (8)..(8): Xaa in position 8 is His or Arg
REAXDFLXYY

SEQ ID NO: 1950 - DNA, 1065 bp, Escherichia coli
  CDS (1)..(1065): transl_table=11
atggtaacgtcctgtactggacatgttttagataatcaacgcgccaccactcgcggagttttctcctccggtagtcatctcgtcactttgcattttcaacctcatcctttcttttcatgtgttaccgacgccgtaaacggtgcgcgtagccgtttttcggcattttatccaaaagcaaactatggcttacaaggaagccaaccctctgatgttcgtgcgcataatcgcgctgccaacggcgcgtgtgatgaatacaaacaactcaaggtgctctccatgggaagacaaaaagcagtgatcaaagctcgtcgcgaggcaaaacgtgtgctgagacgggattcgcgcagccataagcagcgtgaagaagaatcggtcacctcgcttgtgcagatgggcggcgtagaagccattggtatggcccgcgacagtcgcgatacttcgcccatcctcgcgcgaaatgaagcgcaattgcactatctgaaggctattgagagtaagcagctgatattcgccacgggcgaagccgggtgcggaaaaacctggatcagcgcagcaaaagcggcagaggccctgatacataaggatgtcgacaggattatcgtcacccgtccagttctgcaagccgatgaagatcttggcttcttacctggagatatcgcagaaaagtttgctccctattttcgcccggtctacgacgtgctggtccggcgcttaggggcttcctttatgcagtactgcctgcgaccggaaatagggaaggtggaaattgcgccgttcgcctatatgcgtggacgtacctttgaaaatgcagtcgtcattcttgacgaggcgcagaatgtgactgccgcgcaaatgaaaatgtttttaacccgcctcggggagaacgtgacggttatcgtcaacggtgatatcacgcaatgcgatttgcctcgcggcgtgtgctccggattaagtgacgcgctggaacgtttcgaagaagatgaaatggttgggatcgtccggttcggtaaagaggactgcgtacgttcggcactttgccaacgtacgctgcatgcctacagttaa

SEQ ID NO: 1951 - protein, 354 aa, Escherichia coli
MVTSCTGHVLDNQRATTRGVFSSGSHLVTLHFQPHPFFSCVTDAVNGARSRFSAFYPKANYGLQGSQPSDVRAHNRAANGACDEYKQLKVLSMGRQKAVIKARREAKRVLRRDSRSHKQREEESVTSLVQMGGVEAIGMARDSRDTSPILARNEAQLHYLKAIESKQLIFATGEAGCGKTWISAAKAAEALIHKDVDRIIVTRPVLQADEDLGFLPGDIAEKFAPYFRPVYDVLVRRLGASFMQYCLRPEIGKVEIAPFAYMRGRTFENAVVILDEAQNVTAAQMKMFLTRLGENVTVIVNGDITQCDLPRGVCSGLSDALERFEEDEMVGIVRFGKEDCVRSALCQRTLHAYS

SEQ ID NO: 1952 - DNA, 834 bp, Salmonella enterica subsp. enterica serovar Typhi str. CT18
  CDS (1)..(834): transl_table=11
atgacttacctattatttgtcggtatagttctttcagtgactcacttgaaaggactcaatatgggaaacaaacgtaaacaggcgcgtcgcgcagctcgtcaggcactgaagtcaaaaccacgcatccacggctacgaaattgacacaattatcgttgacgagctggccgccgcccctgctctgccaccaaaacctaaacgcgacaactctcccatcgaggcgcgtaacgaggcccaggcccactatctcatctccctcgataccaaacctctgacgttcgccactggtgaagccggttgcggcaagacctacctggctgctgccgtcgcagcgcagcgtctgttggataaggaagtcgggaagatcatcatgacgcgtccggtattgcaagcagaagaagatctgggcttccttccgggagacatgagcgagaagttcgctccgttcttccggcccgtctatgacgtgctacagaagcgtttgggtggctcgttccttgaatattgcttaaagccagaggtggccaaagtagagattgcccccttcgcttacatgcgtggacgcacgttcgagaacgctgtagtcattctggatgaggcacaaaacgttacggcgtcacaaatgaaaatgttcctgacccgtatgggcgagaacgtaacagtcattgtgaacggagacgtgacgcaatgcgacctgcctggcaacgttaagtctggtctggaagatgcactggagcgttttaaaccttcctcccatgttggccttattgagttttcgaccgaagactgcgtgcgttctgagctatgcaaagtcgcactggaagcctatcagtaa

SEQ ID NO: 1953 - protein, 277 aa, Salmonella enterica subsp. enterica serovar Typhi str. CT18
MTYLLFVGIVLSVTHLKGLNMGNKRKQARRAARQALKSKPRIHGYEIDTIIVDELAAAPALPPKPKRDNSPIEARNEAQAHYLISLDTKPLTFATGEAGCGKTYLAAAVAAQRLLDKEVGKIIMTRPVLQAEEDLGFLPGDMSEKFAPFFRPVYDVLQKRLGGSFLEYCLKPEVAKVEIAPFAYMRGRTFENAVVILDEAQNVTASQMKMFLTRMGENVTVIVNGDVTQCDLPGNVKSGLEDALERFKPSSHVGLIEFSTEDCVRSELCKVALEAYQ

SEQ ID NO: 1954 - DNA, 924 bp, Shigella flexneri 2a str. 301
  CDS (1)..(924): transl_table=11
gtgcgtagccgtttttcggcattttatccaaaagcaaactatggcttacaaggaagccaaccctctgatgttcgtgcgcataatcgcgctgccaacggcgcgtgtgatgaatacaaacaactcaaggtgctctccatgggaagacaaaaagcagtgatcaaagctcgtcgcgaggcaaaacgtgtgctgagacgggattcgcgcagccataagcagcgtgaagaagaatcggtcacctcgcttgtgcagatgagcggcgtagaagccattggtatggcccgcgacagtcgcgatacctcgcccatccttgcgcgaaatgaagcgcaattgcactatctgcaggctattgagagtaagcagctgatattcgccacgggcgaagccgggtgcggaaaaacctggatcagcgcagcaaaagcggcagaggccctgatacataaggatgtcgacaggattatcgtcacccgtccagttctgcaagccgatgaagatcttggcttcttacctggtgatatcgcagaaaagtttgctccctattttcgcccggtctacgacttgctggtccggcgcttaggggcttcctttatgcagtactgcctgcgaccggaaatagggaaggtggaaaccgcgccgttcgcctatatgcgtggacgtacctttgaaaatgcagttgtcattcttgacgaggcgcagaatgtgactgccgcgcaaatgaaaatgtttttaacccgcctcggggagaacgtgacggttatcgtcaacggtgatatcacgcaatgcgatttgcctcgcggcgtgtgctccggattaagtgacgcgctggaacgtttcgaagaagatgaaatggttgggatcgtccggttcggaaaagaggattgcgtacgttcggcactttgccaacgtacgctgcatgcatacagttaa

SEQ ID NO: 1955 - protein, 307 aa, Shigella flexneri 2a str. 301
MRSRFSAFYPKANYGLQGSQPSDVRAHNRAANGACDEYKQLKVLSMGRQKAVIKARREAKRVLRRDSRSHKQREEESVTSLVQMSGVEAIGMARDSRDTSPILARNEAQLHYLQAIESKQLIFATGEAGCGKTWISAAKAAEALIHKDVDRIIVTRPVLQADEDLGFLPGDIAEKFAPYFRPVYDLLVRRLGASFMQYCLRPEIGKVETAPFAYMRGRTFENAVVILDEAQNVTAAQMKMFLTRLGENVTVIVNGDITQCDLPRGVCSGLSDALERFEEDEMVGIVRFGKEDCVRSALCQRTLHAYS

SEQ ID NO: 1956 - DNA, 996 bp, Synechococcus sp. WH 8102
  CDS (1)..(996): transl_table=11
gtgcctgaggacggcgctcgcagccgcttcatttttgatcttcccgatcctgaggccgctttggcccttgctggagctgcagaaaccactctgcatcgcctcgaggctctgacaggagcgtcgttggtgttgcggggccttcaattaatgatcaccgggcggccgacgcagatcgagcgggccgctgcggtggtggaactggtgaggccgatctggcaggacgggcaagccgtctccagcgtggatcttcaggctgctcttggtgccctcagccgcggtcagggcgacgaccatgctgcgatgggagagcaggtgctggcgcgcagtcagaccggttcgatgctcagaccgcggacgctgcggcagaagcattacgtcgatgccatggagcggcacgacctcaccttcgcgcttggacccgcgggaacgggcaagacctttctggccacggttctggcagtgcggatgctaacggagcgcaaggtggaacgattgatcctgacccgaccagctgttgaggcgggagagcgactggggtttcttcccggcgatctgcagcagaaggtggatccctaccttcggccgctgtacgacgctctacatgccctgctggggccggacaaaacaacggtgttgctggagaaaggtgtgattgaggtggctccgctggcctacatgcggggacgcaccctcagtgacgcgtttgtgatccttgatgaggcgcagaacaccacaccggcccagatgcgcatggtcctgacccgcttgggcgagcgctctcggatggtggtcaccggtgacatcacccaagttgatcttccccagggcgttccgagtggtctggtggaagcttccgatgtgctggatggcgttgaaggcgttgccgtgtgtcggttgacgtcagccgatgtggtgcgacatccgctggtgcagcgggtggtggaggcctatgccagcctcgacgaccagcgctcgtcaaggcctgtgcgtcgatag

SEQ ID NO: 1957 - protein, 331 aa, Synechococcus sp. WH 8102
MPEDGARSRFIFDLPDPEAALALAGAAETTLHRLEALTGASLVLRGLQLMITGRPTQIERAAAVVELVRPIWQDGQAVSSVDLQAALGALSRGQGDDHAAMGEQVLARSQTGSMLRPRTLRQKHYVDAMERHDLTFALGPAGTGKTFLATVLAVRMLTERKVERLILTRPAVEAGERLGFLPGDLQQKVDPYLRPLYDALHALLGPDKTTVLLEKGVIEVAPLAYMRGRTLSDAFVILDEAQNTTPAQMRMVLTRLGERSRMVVTGDITQVDLPQGVPSGLVEASDVLDGVEGVAVCRLTSADVVRHPLVQRVVEAYASLDDQRSSRPVRR

SEQ ID NO: 1958 - DNA, 789 bp, Photorhabdus luminescens subsp. laumondii TTO1
  CDS (1)..(789): transl_table=11
atgagtagacagaaagcagtgattaaatcgcgtcgagaggcaaaacggatgatgaaaagggatttgcgccatcaatgttatcgggatgataatgtaacctctttagtgcaacccggtggcgtagaagctattggtatggcacgtgataaccgggatacttcggaaattttgccacggactgaaacgcaatggcgttatatgcgcgcaataaactataaaaaactgattattgccagtggggaggcgggttgcggtaaaacgtttattagtgcggcaatggctgcggatgcattgattaataaggaaattgatagaatcattgttacccgtcctgtattacaggcggatgaagatctcggctttttgcccggagatatggctgaaaaatttgcgccttatttccgaccggtttatgacgttttattaaaacgtatgggcgcatcgtttttgcaatattgcttgcggcctgaaattggcaaagtggaaattgcgccttttgcctatatgcggggcagaacatttgaaaatgcatttgtaattctggatgaagcccagaatgtcacggttaatcagatgaaaatgtttctgacccggcttggggaaaatgttactgtgattgtaaatggtgatataagtcaatgtgatttgccagtgggagtggtatcaggattgcgtgatgcactgggaagattttcagatgatgaagtcgtcagtgttatccattttaatcaagaggattgtgttcgttctcaattgtgccagaaaacgttgctggcttattgtaaataa

SEQ ID NO: 1959 - protein, 262 aa, Photorhabdus luminescens subsp. laumondii TTO1
MSRQKAVIKSRREAKRMMKRDLRHQCYRDDNVTSLVQPGGVEAIGMARDNRDTSEILPRTETQWRYMRAINYKKLIIASGEAGCGKTFISAAMAADALINKEIDRIIVTRPVLQADEDLGFLPGDMAEKFAPYFRPVYDVLLKRMGASFLQYCLRPEIGKVEIAPFAYMRGRTFENAFVILDEAQNVTVNQMKMFLTRLGENVTVIVNGDISQCDLPVGVVSGLRDALGRFSDDEVVSVIHFNQEDCVRSQLCQKTLLAYCK

SEQ ID NO: 1960 - DNA, 789 bp, Erwinia carotovora subsp. atroseptica SCRI1043
  CDS (1)..(789): transl_table=11
atgggaagacaaaaagcagtgatcaaagctcgtcgtgaagcaaaacgcgttatccgtcgtgattcgcgtagccatcgtcagcgtgaggaagagtcggtcacttctctggtacagatgggcgggattgaaacaatcggaatggcgcgtgagaatcgtgataattccgcgattcaagctcgtaccgccgcccaggaacattacttgtctgagatagaaaataaacagttgatttttgccacaggcgaagctggctgcggtaaaacgtatctgagcgctgcgaaagcggcggaggcactaatccataaagaggttgagcgcattattgttacgcggccggtattacaggccgatgaggatcttggctttttacccggagatatttcggagaagtttgcgccttatttccgcccagtttacgacatactcttacgccggctgggatcatcttttatgcagtattgcttacggccggaaataggcaaagtcgaaatcgcgccttttgcctatatgcgcgggcggacgtttgaaaatgcggttgtgattctagatgaagcgcaaaacgtgacggtgaaccaaatgaaaatgttcctgacgcgtttaggcgagaatgtcaccgttatcgtgaatggtgatgtgacgcagtgtgacttgcctgctggggttaaatccggcctgcgagacgcactggagcgttttgttgaggatgacatgattggcgtggtctctttcggtaaagaggactgcgtgcgctcggcattgtgccagcgtacgctccatgcctatggctga

SEQ ID NO: 1961 - protein, 262 aa, Erwinia carotovora subsp. atroseptica SCRI1043
MGRQKAVIKARREAKRVIRRDSRSHRQREEESVTSLVQMGGIETIGMARENRDNSAIQARTAAQEHYLSEIENKQLIFATGEAGCGKTYLSAAKAAEALIHKEVERIIVTRPVLQADEDLGFLPGDISEKFAPYFRPVYDILLRRLGSSFMQYCLRPEIGKVEIAPFAYMRGRTFENAVVILDEAQNVTVNQMKMFLTRLGENVTVIVNGDVTQCDLPAGVKSGLRDALERFVEDDMIGVVSFGKEDCVRSALCQRTLHAYG

SEQ ID NO: 1962 - DNA, 789 bp, Yersinia pseudotuberculosis IP 32953
  CDS (1)..(789): transl_table=11
atgggaagacagaaagcagtgatcaaagctcgtcgtgaagcgaaacgcgtgattagacgtgattcacgtagtcatcgtcaacgtgaggaagaaagcgtgacatcgttagtacaaatggggggtgttgaatccataggtatggcgcgggatagccgtgatacctcggttattcaggcgcgaacggaagctcagggtcattacttatcagccatagaaagtaaacagctcatcttcgccaccggtgaagcagggtgcggtaaaacctatatcagcgctgcaaaagcagcagaagcgttaattcataaagaagttgatcgaatcatcgtcacgcgacctgtgctacaggcagatgaagacctgggttttctgcccggtgatatctctgagaaatttgcgccttatttccgcccggtgtatgacatcttactgcgtcgcctgggctcgtcatttatgcaatattgcttgcgacctgaaatcggtaaagtggagattgcgcctttcgcctatatgcgcgggcgtacctttgaaaatgcggtggtgatcctcgacgaggcacaaaatgtaaccgccagccaaatgaagatgtttctgacccgcctcggtgaaaatgtcacggtcatcgttaatggtgatattacccaatgcgatctgcctagaggcgtgaaatcgggtctcagcgatgcactggagcgttttactgaggatgagatgatcggcatcatccgttttgataaacaggactgtgttcgttcggtactctgtcagcgaacattaaatgcttattcatag

SEQ ID NO: 1963 - protein, 262 aa, Yersinia pseudotuberculosis IP 32953
MGRQKAVIKARREAKRVIRRDSRSHRQREEESVTSLVQMGGVESIGMARDSRDTSVIQARTEAQGHYLSAIESKQLIFATGEAGCGKTYISAAKAAEALIHKEVDRIIVTRPVLQADEDLGFLPGDISEKFAPYFRPVYDILLRRLGSSFMQYCLRPEIGKVEIAPFAYMRGRTFENAVVILDEAQNVTASQMKMFLTRLGENVTVIVNGDITQCDLPRGVKSGLSDALERFTEDEMIGIIRFDKQDCVRSVLCQRTLNAYS

SEQ ID NO: 1964 - DNA, 996 bp, Synechococcus sp. CC9605
  CDS (1)..(996): transl_table=11
gtgtctgacgacggcgaacgcggccgtttcgttctcgacctgcctgatcccgatgctgcactggccttggctggtgaagcggaaacaaccctgcatcgcctggaagctctgacaggagcctccatggtgttgcggggtcttcaactggtgatcaccgggcggccaacgcagattgagagggctgctgcggttgtggaattggtgcgcccgatctggcaggacggccagtcggtgtcaccggtggacctccagtcggcgctgggagcgctcaacaccggccgcggcgatgaccacgccgccatgggcgagcaggtgttggcgaagagccagaagggcaatctgcttcgcccgcgcaccctgcgccagaagaaatacgtggatgccatggagcgccacgacctcacctttgccctcggccctgccggcaccggcaaaacctttctcgccaccgttctcgcggttcggatgcttaccgaacgcaaggtggagcgtttgattctcacccggccggctgttgaagctggggagcgcctggggttcctgcccggcgacctgcagcagaaggtggacccctatctgcgtccgctctatgacgccttgcattccctgctcggcgcggagaaaacccacgtgctgctggagaagggtgtgattgaggtcgctcccctggcctacatgcggggccgcactctcagcgatgcctttgtgatcctggatgaggcgcagaacaccacgccggcccagatgcgcatggtgctcacccgtctgggagagcgttcgcgaatggtcgtgaccggtgacatcacccaggtggatctgcctgccactgtgcagagcggtttggtggaggcatctgaggttttggagggcgttgaaggggtcgccgtctgccgccttacttcggcggatgtggtgcgtcaccccctcgtgcagcgggtggtggaggcctatgcccgacgggacgaacgcaaaacgccaaaagttcaacgtcgatag

SEQ ID NO: 1965 - protein, 331 aa, Synechococcus sp. CC9605
MSDDGERGRFVLDLPDPDAALALAGEAETTLHRLEALTGASMVLRGLQLVITGRPTQIERAAAVVELVRPIWQDGQSVSPVDLQSALGALNTGRGDDHAAMGEQVLAKSQKGNLLRPRTLRQKKYVDAMERHDLTFALGPAGTGKTFLATVLAVRMLTERKVERLILTRPAVEAGERLGFLPGDLQQKVDPYLRPLYDALHSLLGAEKTHVLLEKGVIEVAPLAYMRGRTLSDAFVILDEAQNTTPAQMRMVLTRLGERSRMVVTGDITQVDLPATVQSGLVEASEVLEGVEGVAVCRLTSADVVRHPLVQRVVEAYARRDERKTPKVQRR

SEQ ID NO: 1966 - DNA, 23 bp, Artificial sequence
  primer
atggtaacgtcctgtactggaca

SEQ ID NO: 1967 - DNA, 23 bp, Artificial sequence
  primer
ttaactgtaggcatgcagcgtac

SEQ ID NO: 1968 - protein, 267 aa, Artificial sequence
  consensus sequence
  Variant (3)..(6): Xaa in position 3 to 6 is any amino acid
  Variant (7)..(8): Xaa in position 7 to 8 is any or no amino acid
  Variant (10)..(31): Xaa in position 10 to 31 is any amino acid
  Variant (32)..(37): Xaa in position 32 to 37 is any or no amino acid
  Variant (39)..(42): Xaa in position 39 to 42 is any amino acid
  Variant (44)..(48): Xaa in position 44 to 48 is any amino acid
  Variant (50)..(56): Xaa in position 50 to 56 is any amino acid
  Variant (58)..(61): Xaa in position 58 to 61 is any amino acid
  Variant (62)..(65): Xaa in position 62 to 65 is any or no amino acid
  Variant (67)..(69): Xaa in position 67 to 69 is any amino acid
  Variant (71)..(72): Xaa in position 71 to 72 is any amino acid
  Variant (74)..(81): Xaa in position 74 to 81 is any amino acid
  Variant (83)..(83): Xaa in position 83 is any amino acid
  Variant (86)..(86): Xaa in position 86 is any amino acid
  Variant (88)..(88): Xaa in position 88 is any amino acid
  Variant (91)..(91): Xaa in position 91 is any amino acid
  Variant (95)..(100): Xaa in position 95 to 100 is any amino acid
  Variant (102)..(104): Xaa in position 102 to 104 is any amino acid
  Variant (106)..(109): Xaa in position 106 to 109 is any amino acid
  Variant (111)..(111): Xaa in position 111 is any amino acid
  Variant (113)..(113): Xaa in position 113 is any amino acid
  Variant (115)..(115): Xaa in position 115 is any amino acid
  Variant (119)..(121): Xaa in position 119 to 121 is any amino acid
  Variant (123)..(123): Xaa in position 123 is any amino acid
  Variant (125)..(125): Xaa in position 125 is any amino acid
  Variant (133)..(135): Xaa in position 133 to 135 is any amino acid
  Variant (137)..(138): Xaa in position 137 to 138 is any amino acid
  Variant (141)..(141): Xaa in position 141 is any amino acid
  Variant (144)..(144): Xaa in position 144 is any amino acid
  Variant (147)..(147): Xaa in position 147 is any amino acid
  Variant (149)..(151): Xaa in position 149 to 151 is any amino acid
  Variant (154)..(160): Xaa in position 154 to 160 is any amino acid
  Variant (162)..(163): Xaa in position 162 to 163 is any amino acid
  Variant (165)..(165): Xaa in position 165 is any amino acid
  Variant (167)..(168): Xaa in position 167 to 168 is any amino acid
  Variant (170)..(170): Xaa in position 170 is any amino acid
  Variant (173)..(173): Xaa in position 173 is any amino acid
  Variant (181)..(183): Xaa in position 181 to 183 is any amino acid
  Variant (185)..(185): Xaa in position 185 is any amino acid
  Variant (194)..(194): Xaa in position 194 is any amino acid
  Variant (196)..(197): Xaa in position 196 to 197 is any amino acid
  Variant (200)..(200): Xaa in position 200 is any amino acid
  Variant (202)..(202): Xaa in position 202 is any amino acid
  Variant (209)..(213): Xaa in position 209 to 213 is any amino acid
  Variant (215)..(215): Xaa in position 215 is any amino acid
  Variant (218)..(218): Xaa in position 218 is any amino acid
  Variant (221)..(221): Xaa in position 221 is any amino acid
  Variant (225)..(226): Xaa in position 225 to 226 is any amino acid
  Variant (228)..(228): Xaa in position 228 is any amino acid
  Variant (232)..(233): Xaa in position 232 to 233 is any amino acid
  Variant (235)..(252): Xaa in position 235 to 252 is any amino acid
  Variant (254)..(254): Xaa in position 254 is any amino acid
  Variant (257)..(258): Xaa in position 257 to 258 is any amino acid
  Variant (260)..(260): Xaa in position 260 is any amino acid
  Variant (262)..(265): Xaa in position 262 to 265 is any amino acid
GRXXXXXXAXXXXXXXXXXXXXXXXXXXXXXXXXXXXLXXXXGXXXXXMXXXXXXXSXXXXXXXXRXXXQXXYXXXXXXXXLXFAXGXAGXGKTXXXXXXAXXXLXXXXVXRXIXTRPXXXAXEXLGFLPGDXXXKXXPYXRPXYDXLXXXLGXXXXXXXLXXEXGXXEXAPXAYMRGRTXXXAXVILDEAQNXTXXQMXMXLTRLGEXXXXXVXGDXTQXDLPXXVXSGLXXAXXXXXXXXXXXXXXXXXXDXVRXXLXQXXXXAY

SEQ ID NO: 1969 - protein, 60 aa, Artificial sequence
  protein pattern
  Variant (2)..(2): Xaa in position 2 is any or no amino acid
  Variant (4)..(4): Xaa in position 4 is any or no amino acid
  Variant (6)..(6): Xaa in position 6 is any amino acid
  Variant (9)..(9): Xaa in position 9 is Phe or Leu
  Variant (17)..(17): Xaa in position 17 is Phe or Leu
  Variant (18)..(18): Xaa in position 18 is Glu or Ser
  Variant (19)..(19): Xaa in position 19 is Asp or Asn
  Variant (21)..(21): Xaa in position 21 is any or no amino acid
  Variant (30)..(30): Xaa in position 30 is Thr or Val
  Variant (32)..(32): Xaa in position 32 is Ala, Pro or Val
  Variant (33)..(33): Xaa in position 33 is Ala, Asn or Ser
  Variant (36)..(36): Xaa in position 36 is Lys or Arg
  Variant (38)..(38): Xaa in position 38 is Phe or Val
  Variant (45)..(45): Xaa in position 45 is Asn or Arg
  Variant (46)..(46): Xaa in position 46 is Ser or Val
  Variant (47)..(47): Xaa in position 47 is any amino acid
  Variant (48)..(48): Xaa in position 48 is Met or Val
  Variant (49)..(49): Xaa in position 49 is Ile or Val
  Variant (51)..(51): Xaa in position 51 is Asn or Thr
  Variant (54)..(54): Xaa in position 54 is Ile or Val
  Variant (55)..(55): Xaa in position 55 is Ser or Thr
  Variant (57)..(57): Xaa in position 57 is Cys or Val
GXVXEXAPXAYMRGRTXXXAXVILDEAQNXTXXQMXMXLTRLGEXXXXXVXGDXXQXDLP

SEQ ID NO: 1970 - protein, 61 aa, Artificial sequence
  protein pattern
  Variant (2)..(2): Xaa in position 2 is any amino acid
  Variant (5)..(5): Xaa in position 5 is Cys or Thr
  Variant (9)..(10): Xaa in position 9 to 10 is any amino acid
  Variant (11)..(11): Xaa in position 11 is any or no amino acid
  Variant (13)..(14): Xaa in position 13 to 14 is any amino acid
  Variant (15)..(15): Xaa in position 15 is any or no amino acid
  Variant (17)..(17): Xaa in position 17 is Ala or Val
  Variant (18)..(18): Xaa in position 18 is Glu, Gln or Arg
  Variant (19)..(19): Xaa in position 19 is any amino acid
  Variant (21)..(21): Xaa in position 21 is any amino acid
  Variant (22)..(22): Xaa in position 22 is Asp, Glu or His
  Variant (23)..(23): Xaa in position 23 is Lys or Arg
  Variant (24)..(24): Xaa in position 24 is Asp, Glu or Lys
  Variant (26)..(26): Xaa in position 26 is Asp, Glu or Gly
  Variant (27)..(27): Xaa in position 27 is Lys or Arg
  Variant (28)..(28): Xaa in position 28 is Ile or Leu
  Variant (30)..(30): Xaa in position 30 is Leu, Met or Val
  Variant (34)..(34): Xaa in position 34 is Ala or Val
  Variant (35)..(35): Xaa in position 35 is Leu or Val
  Variant (36)..(36): Xaa in position 36 is Glu or Gln
  Variant (38)..(38): Xaa in position 38 is Asp, Glu or Gly
  Variant (40)..(40): Xaa in position 40 is Asp or Arg
  Variant (48)..(48): Xaa in position 48 is Ile, Leu or Met
  Variant (49)..(49): Xaa in position 49 is Ala, Gln or Ser
  Variant (50)..(50): Xaa in position 50 is Glu or Gln
  Variant (52)..(52): Xaa in position 52 is Phe or Val
  Variant (53)..(53): Xaa in position 53 is Ala or Asp
  Variant (55)..(55): Xaa in position 55 is Phe or Tyr
  Variant (56)..(56): Xaa in position 56 is Phe or Leu
  Variant (59)..(59): Xaa in position 59 is Leu or Val
GXAGXGKTXXXAXXXAXXXLXXXXVXXXIXTRPXXXAXEXLGFLPGDXXXKXXPXXRPXYD

SEQ ID NO: 1971 - protein, 39 aa, Artificial sequence
  protein pattern
  Variant (2)..(2): Xaa in position 2 is any amino acid
  Variant (3)..(5): Xaa in position 3 to 5 is any or no amino acid
  Variant (7)..(7): Xaa in position 7 is any amino acid
  Variant (8)..(8): Xaa in position 8 is Asp, Glu or Gly
  Variant (9)..(9): Xaa in position 9 is any amino acid
  Variant (10)..(10): Xaa in position 10 is Phe or Leu
  Variant (11)..(11): Xaa in position 11 is any amino acid
  Variant (12)..(12): Xaa in position 12 is Asp, Glu or Gly
  Variant (13)..(13): Xaa in position 13 is Asp or Val
  Variant (14)..(14): Xaa in position 14 is Asp or Glu
  Variant (15)..(15): Xaa in position 15 is any amino acid
  Variant (16)..(16): Xaa in position 16 is Ile or Val
  Variant (17)..(17): Xaa in position 17 is Ala, Gly or Ser
  Variant (18)..(18): Xaa in position 18 is Ile or Val
  Variant (19)..(20): Xaa in position 19 to 20 is any amino acid
  Variant (21)..(21): Xaa in position 21 is Phe or Leu
  Variant (22)..(22): Xaa in position 22 is Asp, Gly, Asn or Thr
  Variant (23)..(23): Xaa in position 23 is any amino acid
  Variant (24)..(24): Xaa in position 24 is Ala, Glu or Gln
  Variant (26)..(26): Xaa in position 26 is Cys or Val
  Variant (29)..(30): Xaa in position 29 to 30 is any amino acid
  Variant (32)..(32): Xaa in position 32 is Cys or Val
  Variant (34)..(34): Xaa in position 34 is Lys or Arg
  Variant (35)..(35): Xaa in position 35 is Thr or Val
  Variant (36)..(36): Xaa in position 36 is Leu or Val
  Variant (37)..(37): Xaa in position 37 is any amino acid
SXXXXAXXXXXXXXXXXXXXXXXXDXVRXXLXQXXXXAY

SEQ ID NO: 1972 - protein, 29 aa, Artificial sequence
  protein pattern
  Variant (2)..(5): Xaa in position 2 to 5 is any amino acid
  Variant (6)..(9): Xaa in position 6 to 9 is any or no amino acid
  Variant (11)..(11): Xaa in position 11 is Asn or Thr
  Variant (12)..(13): Xaa in position 12 to 13 is any amino acid
  Variant (15)..(15): Xaa in position 15 is any amino acid
  Variant (16)..(16): Xaa in position 16 is His or Lys
  Variant (18)..(18): Xaa in position 18 is Leu or Val
  Variant (19)..(19): Xaa in position 19 is any amino acid
  Variant (20)..(20): Xaa in position 20 is Ala, Glu or Ser
  Variant (21)..(21): Xaa in position 21 is Ile, Leu or Met
  Variant (22)..(22): Xaa in position 22 is Asp or Glu
  Variant (23)..(23): Xaa in position 23 is any amino acid
  Variant (24)..(24): Xaa in position 24 is His or Lys
  Variant (25)..(25): Xaa in position 25 is Asp, Pro or Gln
  Variant (27)..(27): Xaa in position 27 is any amino acid
SXXXXXXXXRXXXQXXYXXXXXXXXLXFA

SEQ ID NO: 1973 - protein, 27 aa, Artificial sequence
  protein pattern
  Variant (2)..(2): Xaa in position 2 is any amino acid
  Variant (3)..(3): Xaa in position 3 is Ala or Glu
  Variant (4)..(4): Xaa in position 4 is any amino acid
  Variant (5)..(5): Xaa in position 5 is Ala or Ile
  Variant (6)..(6): Xaa in position 6 is any amino acid
  Variant (7)..(7): Xaa in position 7 is Ala or Ser
  Variant (8)..(9): Xaa in position 8 to 9 is any amino acid
  Variant (11)..(11): Xaa in position 11 is Ala or Leu
  Variant (12)..(12): Xaa in position 12 is any amino acid
  Variant (14)..(14): Xaa in position 14 is any amino acid
  Variant (15)..(15): Xaa in position 15 is Ile, Leu or Met
  Variant (16)..(16): Xaa in position 16 is any amino acid
  Variant (17)..(17): Xaa in position 17 is Gln or Arg
  Variant (19)..(19): Xaa in position 19 is any amino acid
  Variant (20)..(23): Xaa in position 20 to 23 is any or no amino acid
  Variant (25)..(26): Xaa in position 25 to 26 is any amino acid
  Variant (27)..(27): Xaa in position 27 is Glu, Arg or Ser
QXXXXXXXXEXXRXXXXDXXXXXQXXX

SEQ ID NO: 1974 - protein, 13 aa, Artificial sequence
  protein pattern
  Variant (2)..(2): Xaa in position 2 is any or no amino acid
  Variant (4)..(4): Xaa in position 4 is Ala, Gly or Ser
  Variant (6)..(6): Xaa in position 6 is Phe, Leu or Met
  Variant (7)..(7): Xaa in position 7 is Leu, Met or Val
  Variant (8)..(9): Xaa in position 8 to 9 is any amino acid
  Variant (10)..(10): Xaa in position 10 is Cys or Gly
  Variant (12)..(12): Xaa in position 12 is any amino acid
  Variant (13)..(13): Xaa in position 13 is Leu or Pro
LXGXSXXXXXLXX

SEQ ID NO: 1975 - DNA, 660 bp, Escherichia coli
  CDS (1)..(660): transl_table=11
atgtatcaacatcacaactggcaaggtgcgctgctggattatccggtgagtaaagtagtctgtgttggcagtaactatgccaaacatattaaagagatgggcagcgcagtgcccgaagagccagtgctgtttattaaaccagaaacggcactgtgcgatctgcggcagccattggcgatcccatccgatttcggttcagttcatcatgaagtcgaactggcggtgttgattggcgcgacactgcgtcaggctacggaagagcatgtccgcaaagccattgccggttatggcgtggcgctcgatctgacattgcgtgatgttcagggaaaaatgaagaaagccgggcagccgtgggaaaaggctaaagcgtttgataactcttgtccgctttccgggtttattcccgcggcggaatttaccggcgacccgcaaaatacaacgctgagcctgagcgtaaacggcgaacaacgccagcaaggtacgactgcggacatgatccataaaatcgttccgctgatcgcttatatgagcaagttttttaccctcaaggccggtgacgttgtgttgacaggcacgcctgatggcgtcggcccgttgcaaagcggtgatgagctgacagtcactttcgatgggcattctttgacaactcgcgttttgtaa

SEQ ID NO: 1976 - protein, 219 aa, Escherichia coli
MYQHHNWQGALLDYPVSKVVCVGSNYAKHIKEMGSAVPEEPVLFIKPETALCDLRQPLAIPSDFGSVHHEVELAVLIGATLRQATEEHVRKAIAGYGVALDLTLRDVQGKMKKAGQPWEKAKAFDNSCPLSGFIPAAEFTGDPQNTTLSLSVNGEQRQQGTTADMIHKIVPLIAYMSKFFTLKAGDVVLTGTPDGVGPLQSGDELTVTFDGHSLTTRVL

SEQ ID NO: 1977 - DNA, 699 bp, Burkholderia vietnamiensis G4
  CDS (1)..(699): transl_table=11
atgtccgcatacgtcatcgacgctcccgagcgtccttccgtcgaagtcgatcaatcgtccgcgcgctttccggtacgccgcgtgttctgcgtgggccgcaactacgccgaccacgcgcgggaaatgggcgccgatcccgaccgcgaaccgccgttcttcttcacgaagccggccgatgcggtcgtgccggccgccggcaccgtcccgtatccgccgctgacgaacgacctccatcacgagatcgagctggtcgtcgcgatcggcaaggacggccgctcgatcgagccggccgacgcgctgtcgcacgtgtggggttacggcgtcggcgtcgacctcacgcgtcgcgacctgcaggccgaagccaagaagctgggccgcccgtgggactgggcgaagggcttcgacgcgtcggggccgatgagcccgctgcgcgccgcgagcgcgaccggccacccggcgagcggacggatctggctcgcggtgaacggcgacacgcgtcagcaaggcgatctcgccgacatgatctgggccgtgcccgacgtgatcgcctacgtgtcgcgctcggtcgcgttgaaggccggcgacctgatcttcaccggcacgccggccggcgtgggcgcgctgcagccgggcgatcgcgtgacgggcggggtggacggcgtcgcgacgttcgagttcgtggtcggcgcgaagccgtaa

SEQ ID NO: 1978 - protein, 232 aa, Burkholderia vietnamiensis G4
MSAYVIDAPERPSVEVDQSSARFPVRRVFCVGRNYADHAREMGADPDREPPFFFTKPADAVVPAAGTVPYPPLTNDLHHEIELVVAIGKDGRSIEPADALSHVWGYGVGVDLTRRDLQAEAKKLGRPWDWAKGFDASGPMSPLRAASATGHPASGRIWLAVNGDTRQQGDLADMIWAVPDVIAYVSRSVALKAGDLIFTGTPAGVGALQPGDRVTGGVDGVATFEFVVGAKP

SEQ ID NO: 1979 - DNA, 681 bp, Oryza sativa (japonica cultivar-group)
  CDS (1)..(681)
atggcggcggcggcgcagaggctcctggcggccagcacgaagatcgtaggggtgggccgcaacttcgtcgcccacgccaaggagctcgggaaccccgtccccaaggagccggtgctgttcctgaagcccacctcgtcgttcctccacgcgggcgtggccggcgccgccatcgaggtgccggagccggtcgagtcgctgcaccacgaggtcgagcttgccgttgtcatctcccagcgcgcgcgcgacgtccccgaagcatccgccatggacttcgtaggaggttatgcacttgctttggacatgacagcaagagaacttcagtctgcggctaagtctgcaggtcttccttggactttgggtaaagcacaggacaccttcactccaattagtgcagtgattccaaaatcagatgtagctaatcctgatgatctagagctctggctaaaggttgatgatgaacttaggcagaagggatctacaagtgatatgatattcaagataccatctctaataagttatatcagttccatcatgacattaatggagggtgatgttatactgaccggtactcctgagggtgtaggcccagtacgaccaggacagaagatcaaagctggtataaccggcctcattgatgttgagtttgatgttcagaagcgcaagcggtcattttctacttga

SEQ ID NO: 1980 - protein, 226 aa, Oryza sativa (japonica cultivar-group)
MAAAAQRLLAASTKIVGVGRNFVAHAKELGNPVPKEPVLFLKPTSSFLHAGVAGAAIEVPEPVESLHHEVELAVVISQRARDVPEASAMDFVGGYALALDMTARELQSAAKSAGLPWTLGKAQDTFTPISAVIPKSDVANPDDLELWLKVDDELRQKGSTSDMIFKIPSLISYISSIMTLMEGDVILTGTPEGVGPVRPGQKIKAGITGLIDVEFDVQKRKRSFST

SEQ ID NO: 1981 - DNA, 675 bp, Arabidopsis thaliana
  CDS (1)..(675)
atggcgacttcgatgattcagagattgttcaaacaaggcacaaagatcgtcggcgttggactcaattacgcttctcacgccaaagaacttggcaatgccctcccaaaggacccgattgtgttcttaaagccaacttcgtcgtacctggaaaacggtggaacaatagagatcccacatccactggattcacttcaccatgaggtggaacttgctgtagtaattggacagaaagcaagagatgtcccagaacggttagccatgaattacattggaggatatgcgcttgctcttgatatgactgctagggaactccaagtttctgccatggcatctggtctcccatgtacgcttgctaaaggacaggataccttcacccccatcagctccgttctaccaaaggcaatggtgctggatcccaataacctggaactctggctaaaggtagatgatgagacaagacagaaaggttggacaaaggatatgatcttcaaggtcccatatctcatcagctacataagttctgtaatgacccttttcaaaggagatgtcatattgacaggtacaccagaaggtataggacctgtaaagataggtcagaagataaccgccggaatcaccggtctttctgaagttcagttcgacgtcggtaggcggctaaagccattgttgagatag

SEQ ID NO: 1982 - protein, 224 aa, Arabidopsis thaliana
MATSMIQRLFKQGTKIVGVGLNYASHAKELGNALPKDPIVFLKPTSSYLENGGTIEIPHPLDSLHHEVELAVVIGQKARDVPERLAMNYIGGYALALDMTARELQVSAMASGLPCTLAKGQDTFTPISSVLPKAMVLDPNNLELWLKVDDETRQKGWTKDMIFKVPYLISYISSVMTLFKGDVILTGTPEGIGPVKIGQKITAGITGLSEVQFDVGRRLKPLLR

SEQ ID NO: 1983 - DNA, 669 bp, Arabidopsis thaliana
  CDS (1)..(669)
atggcgacgtcgatgatacagaggatgttcaagcaagggacgaagatcgtctgcgtcggccgtaactacgccgctcacgccaaagaactaggcaacgccgtccccaaggaaccagttatattcttgaagccaacatcatcatacttagaaaatggaggaacaattgagatcccacatcctttggattcacttcaccatgaagtagaactcgctttagtgattggacagaaagctagagatgtacctgaatcaatagccatggattacattggaggatatgcggttgctcttgatatgactgctagggaactccaagcttctgctaaggcatctggtctcccatggacggttgcgaaaggacaagataccttcactcctatcagctctgttctgccaaaggcgatggtgcgtgatcccgataatctagaactttggctcaaggttgatggtgaaacaagacagaagggtttgaccaaagatatgatattcaaggtcccctacctcattagctacataagttctataatgaccctttacggagatgtcatcttgacaggcacaccagaaggtgttggacctgtaaagataggtcagaagataacggccggaatcaccggtctatctgaagttcaattcgatgtggagaggcgtgtaaagcccttgagctaa

SEQ ID NO: 1984 - protein, 222 aa, Arabidopsis thaliana
MATSMIQRMFKQGTKIVCVGRNYAAHAKELGNAVPKEPVIFLKPTSSYLENGGTIEIPHPLDSLHHEVELALVIGQKARDVPESIAMDYIGGYAVALDMTARELQASAKASGLPWTVAKGQDTFTPISSVLPKAMVRDPDNLELWLKVDGETRQKGLTKDMIFKVPYLISYISSIMTLYGDVILTGTPEGVGPVKIGQKITAGITGLSEVQFDVERRVKPLS

SEQ ID NO: 1985 - DNA, 753 bp, Deinococcus radiodurans R1
  CDS (1)..(753): transl_table=11
atgttgattgttcgtgtggagcagcggggcgccgcgcagtggggcgtgctggaaggcgagaccattcacctgaccagggggctgaccggcccgcgcaccggggagacgctggccctgagtgaggcgcggctgctcgcgcccgccgagccgagcaaaatcgtgtgcgtggggcgcaattatctggaccacattcgcgaactcggcaacgacactggcgacttgcccgccgaacccggcatttttctcaaagggccgaacgcgctcgccgaacccggcggcacggtagagtacccgagctggagcgagaatttccacttcgaaggtgaactcgcgctggtcatcgggcagcgggcacgcaacctcaaggccgacgaggcgctcggcgcggtcctcggctacacctgcggactcgacctcaccgcccgtgaccggcaaaagaccgacctgcaatggttccgtgccaaggccgccgaccgcttctgcccgctcgggccgtggctggtcactcagttcgaccccagcgacgtgcgtgtgcagacccgcgtgaacggcgaaccccgccaggacgggcgcaccagtcacatgattttcgacgtggtgcagattctgacctacctcacccgcttcgtcacgctagaacccggcgacgtggtgctcaccggcacgcccgaaggggtgggccccttgcagcgcggggaccgggtggaagtcgaagtggacggcatcggggtgctggaaacgttcatcgggtga

SEQ ID NO: 1986 - protein, 250 aa, Deinococcus radiodurans R1
MLIVRVEQRGAAQWGVLEGETIHLTRGLTGPRTGETLALSEARLLAPAEPSKIVCVGRNYLDHIRELGNDTGDLPAEPGIFLKGPNALAEPGGTVEYPSWSENFHFEGELALVIGQRARNLKADEALGAVLGYTCGLDLTARDRQKTDLQWFRAKAADRFCPLGPWLVTQFDPSDVRVQTRVNGEPRQDGRTSHMIFDVVQILTYLTRFVTLEPGDVVLTGTPEGVGPLQRGDRVEVEVDGIGVLETFIG

SEQ ID NO: 1987 - DNA, 687 bp, Sinorhizobium meliloti 1021
  CDS (1)..(687): transl_table=11
atgcagacagccctgacacccccgccgctcatcctgctgccgatctccggcagttccgtcgggtttccggtgcgccgggtctattgtgtcggccgcaactatgcggcccacgcccgcgagatgggtcacgacccggaccgggaggcacccttcttctttcagaagaacgccgacaatcttctgccgccgggcgagaatttcccctatccgacgcgctcttccgacgttcaccacgaggttgaactggtcgtcgcgatgcgcaccggcggagcggacattcccgtctcggaagcggcagatcacatcttcggttatggcgtcggcatcgacttcacccgccgggacctgcaggcggaagcgaagaaggccggcaagccgtggacggccgccaaggcgttcgagcattccgctccggtctccgcgatcgtccccgtcaccgcgatcggtcatcccgcaagcggcaacatatggctcaaggtcaatggcgaactgcgccagcagggcgatcttgatcaaatgatctggaaggtgcccgaaatcatcgccgaactgtcccgcctcttcactctcgcaccgggcgatatcatcatgaccgggacgccatcaggtgtgggtcccgtcacgcaaggcgatgtcgtcgcctgcggcatcgacgggatcggcgcgatctccgtcaatatcgtttga

SEQ ID NO: 1988 - protein, 228 aa, Sinorhizobium meliloti 1021
MQTALTPPPLILLPISGSSVGFPVRRVYCVGRNYAAHAREMGHDPDREAPFFFQKNADNLLPPGENFPYPTRSSDVHHEVELVVAMRTGGADIPVSEAADHIFGYGVGIDFTRRDLQAEAKKAGKPWTAAKAFEHSAPVSAIVPVTAIGHPASGNIWLKVNGELRQQGDLDQMIWKVPEIIAELSRLFTLAPGDIIMTGTPSGVGPVTQGDVVACGIDGIGAISVNIV

SEQ ID NO: 1989 - DNA, 681 bp, Caulobacter crescentus CB15
  CDS (1)..(681): transl_table=11
atgacgacctacgcttttcccccgcacgccatcccgacggtcccggtggagggatcgggcgccctgttcccggtgcgtcgcatcctgtgtgtcggccgcaactacgccgcccaccgccgcgagatggggggcgatgatcgcgacccgccgtttttcttcgccaagcccgccgacgcgatcgcgcagctggccgacgcgatcgcctatccgccggcgaccagcgacctgcatcacgagatcgagctggtcgtggccctaaaggcgggcggcgcggatctgtcgatcgaacaggccctggcctgcgtgttcggctatgcggtcggcgtcgacctgacgcgccgcgacctgcaagctgcggccaaggccaagggccagccctgggaagccggcaaggccttcgatcagagcgccccgatcagcgccatccgggtgatggacgctccggcggccgaagcggcggtcaccctgtcggtcaacggccaggagcgccagcgcggacaggtcggcgacatgatctggaacatcggcgaggtgatcgccaaggccagccagctgtggaccctggccgccggcgacctgatcttcaccggcacgcctgagggcgtcgccgccatcgtccgcggcgacaaggtcgtcggcgagatcgagggcgtcggccgcctggacttcaccctcgtctag

SEQ ID NO: 1990 - protein, 226 aa, Caulobacter crescentus CB15
MTTYAFPPHAIPTVPVEGSGALFPVRRILCVGRNYAAHRREMGGDDRDPPFFFAKPADAIAQLADAIAYPPATSDLHHEIELVVALKAGGADLSIEQALACVFGYAVGVDLTRRDLQAAAKAKGQPWEAGKAFDQSAPISAIRVMDAPAAEAAVTLSVNGQERQRGQVGDMIWNIGEVIAKASQLWTLAAGDLIFTGTPEGVAAIVRGDKVVGEIEGVGRLDFTLV

SEQ ID NO: 1991 - DNA, 660 bp, Salmonella typhimurium LT2
  CDS (1)..(660): transl_table=11
atgtatcaacatcgtaactggcaaggcgccttgcttgattacccggtaagtaaagtggtctgcgtgggcagtaattacgcaaatcacatcaaggagatgggcagcgcgacgccggaagaacccgtgctttttatcaagccggaaaccgcattgtgtgatattcgccagccgctggcgattccggcggatatgggggctgttcatcatgaagttgagcttgctgtgctgattggcgcaacgctccgccaggcgaccgaagatcatgtacgtaaagcgatagccggttatggcgtggcgcttgatttaaccctgcgcgatattcaagggaaaatgaaaaaggccggacagccctgggaaaaagccaaaggttttgataacgcatgtccgatttcaggcttcatccctgtcgcggccttctgcggcgatccgcaaaatacggttatcggacttaacgttaatggcgaggttcgccagcaagggtcgaccgcggatatgattcatcctattgtgccccttatcgcctatatgagccgctattttacgctcaaagccggggacgtggtgctaaccggcacgccggcaggcgtggggccattattaagcggcgatgagctggacattcgttttaatggcgaaacgttgtctacccgcgttctgtaa

SEQ ID NO: 1992 - protein, 219 aa, Salmonella typhimurium LT2
MYQHRNWQGALLDYPVSKVVCVGSNYANHIKEMGSATPEEPVLFIKPETALCDIRQPLAIPADMGAVHHEVELAVLIGATLRQATEDHVRKAIAGYGVALDLTLRDIQGKMKKAGQPWEKAKGFDNACPISGFIPVAAFCGDPQNTVIGLNVNGEVRQQGSTADMIHPIVPLIAYMSRYFTLKAGDVVLTGTPAGVGPLLSGDELDIRFNGETLSTRVL

SEQ ID NO: 1993 - DNA, 690 bp, Agrobacterium tumefaciens str. C58
  CDS (1)..(690): transl_table=11
atggccgccaccgtcatccccgctccgaaacccgttctgctgcccgtcgaaggcacggacgacatgttccccgtgcggcgggtctactgcgtcggccgcaattatgccgatcacgccatcgagatgggccacgatccctcgcgtgaaccgcccttttatttccagaagaacccggacaatctgctgccagcaggtaatgatttcccctacccgccgctatcctccaacgtgcattacgaagtcgagtgcgtcgtcgtcctgaagagcggcggcgcggatattccggcgtcggaagcgctgaaccacgtctggggttacgccgtcggcatcgacatgacccgccgcgacctgcaggatgggttgaagaaaatggggcgctcatgggaaggcgccaaggcgtttgaacattccgcaccagtctctgccatcgttcccgccgataaaatcggccatcccgctaccggcgcgatctggctcgatgtcaacggcgaacgcaagcagacgggcgatctcgcccagatgatctggaaggtgccggaagtgattgccgagctttccaagctgttcacccttgccgccggggatgtgatcatgaccggcacgccggcgggcgtcggccccattgtgcgtggtgacaggatcgagtgtggcgtcgatggtgtcggcacgctctcggtcaaaatcgcctga

SEQ ID NO: 1994 - protein, 229 aa, Agrobacterium tumefaciens str. C58
MAATVIPAPKPVLLPVEGTDDMFPVRRVYCVGRNYADHAIEMGHDPSREPPFYFQKNPDNLLPAGNDFPYPPLSSNVHYEVECVVVLKSGGADIPASEALNHVWGYAVGIDMTRRDLQDGLKKMGRSWEGAKAFEHSAPVSAIVPADKIGHPATGAIWLDVNGERKQTGDLAQMIWKVPEVIAELSKLFTLAAGDVIMTGTPAGVGPIVRGDRIECGVDGVGTLSVKIA

SEQ ID NO: 1995 - DNA, 729 bp, Thermoanaerobacter tengcongensis MB4
  CDS (1)..(729): transl_table=11
atgaggattgtgagagtggataaagaacctgacagttatggtatcctagaaaacgacaaggtcatcttattgaaggaaggggaaacttttttatatggattaaatgaagtaaaacttcttcctccctgtattccttctaaggctatatgcgtaggtttaaattataaagaccacatagaggagatgggggataaaattccagaggaacctaccttatttataaaaccttccactgcagtaattgggcctgatgattacataattcttcctgaaatgtctcgaagggtggattatgaaggagaattggctgttgtcataggaagaaaagctaaaaatgtttctatagaggaagcaaaaaattacatacttggctatactatagcaaatgatgtgacagcaagagatctgcaggcaaaagatggccagtggacaagagccaagtcttttgatacctttttgcctatagggccttggattgtgacagacctagaccctacttctttaaatataactacatatgtaaacggggaagtaaagcaaaagagcaatacaaagtatttgatatttaatgtatttaagcttgtaagttttatatctcacataatgactctaaacccgggagatgtcatattgactggcactccttcaggtgttggacccttaaagtcaggagatgttgtgacaattgaaatagaggggataggaaagttgacaaatagagtaaaataa

SEQ ID NO: 1996 - protein, 242 aa, Thermoanaerobacter tengcongensis MB4
MRIVRVDKEPDSYGILENDKVILLKEGETFLYGLNEVKLLPPCIPSKAICVGLNYKDHIEEMGDKIPEEPTLFIKPSTAVIGPDDYIILPEMSRRVDYEGELAVVIGRKAKNVSIEEAKNYILGYTIANDVTARDLQAKDGQWTRAKSFDTFLPIGPWIVTDLDPTSLNITTYVNGEVKQKSNTKYLIFNVFKLVSFISHIMTLNPGDVILTGTPSGVGPLKSGDVVTIEIEGIGKLTNRVK

SEQ ID NO: 1997 - DNA, 786 bp, Streptomyces coelicolor A3(2)
  CDS (1)..(786): transl_table=11
gtgcgcatcgccaggttctccatcgacgggaacgtcgccttcggcgcggtcgagggcgaccagccggaccagctcgtcctcgacatcatcaagggcatcccgttcgcggactacgagctctccggcaccaaggtgcccctgagtaaggtgcggctcctgccgccggtactccccagcaaggtcgtcgccttcggccgcaactacgccgagcacgcccgcgaactcggcaacgaggtgcccgacgcgccgttcgccttcttcaagccgtccacctccgtgatcggccccggcgacgccgtccagtacccctccttcaccgaggaactgcaccacgaggccgaactggccgtcgtcatcggccgcatgtgccgcgaggtcccgcgcgagcgcgtccaggacgtgatcttcggctacacctgcgccaacgacatcaccgcccgcgacgtgcagcgccgcgagaagcagtgggccagggccaagggcttcgactcctcctgcccgctcggcccctgggtggagacggacctcgacctcgcggccgcgggcgacctcaccgtgcagctcacggtcaacggcgcccagcgccagctcggccgcaccagcgagatgatccactccatcgaggacctgatcgtcaacatctccgaggcgatgacgctgctccccggtgacgtgatcctcacgggcactccggccggcgtcggccccctcaacgtcggcgacgaggtcgccgtcaccatcgaaggcatcggcactctcaccaacaaggttgtcaagcgtggctag

SEQ ID NO: 1998 - protein, 261 aa, Streptomyces coelicolor A3(2)
MRIARFSIDGNVAFGAVEGDQPDQLVLDIIKGIPFADYELSGTKVPLSKVRLLPPVLPSKVVAFGRNYAEHARELGNEVPDAPFAFFKPSTSVIGPGDAVQYPSFTEELHHEAELAVVIGRMCREVPRERVQDVIFGYTCANDITARDVQRREKQWARAKGFDSSCPLGPWVETDLDLAAAGDLTVQLTVNGAQRQLGRTSEMIHSIEDLIVNISEAMTLLPGDVILTGTPAGVGPLNVGDEVAVTIEGIGTLTNKVVKRG

SEQ ID NO: 1999 - DNA, 714 bp, Chlorobium tepidum TLS
  CDS (1)..(714): transl_table=11
atgaaaacattttcatctctgtcaaaaccagccactcatcgctcgatttactgtgtcggcaaaaactaccctgatcacgctcgtgaaatggcttcatgggagactgacaagcccgagccgctgcatgaaaaggagcctgttatctttatgaaacccggcacggcgctttctactgacggctgcacctcgataccgcggttcgaagggcagctggtgagcagaaaccttcattacgaaggcgagctggtgctgctgattggcgcggacgccgatgaagtatcgcttgccgatgcttcggcgatcatcgccggttacgccgccgggctcgatatgacgctgcgcgatgtacagctcgaagccaaaaatgccggaaatccctggctgaaaagcaaggggtttcgccagagcgcactcgtctcggagttcatcgctccggaatcggctggcccgtgggctgaactcgccatttcgctgcggctgaacggagagcagaagcagtactcgaaggtctcgaaaatgactttttcaccggcctatctggtgcattatttatcgtatatttacgggctgcgagccggagaccttgtctttaccggcactcctgcgggcgtcggaagcgtgctgccgggcgatcgtctcgacgtttcgcttgaaactgccgacgaccattcgcaggcaaaaatactggtatcgctccaggcgactgtttcctga

SEQ ID NO: 2000 - protein, 237 aa, Chlorobium tepidum TLS
MKTFSSLSKPATHRSIYCVGKNYPDHAREMASWETDKPEPLHEKEPVIFMKPGTALSTDGCTSIPRFEGQLVSRNLHYEGELVLLIGADADEVSLADASAIIAGYAAGLDMTLRDVQLEAKNAGNPWLKSKGFRQSALVSEFIAPESAGPWAELAISLRLNGEQKQYSKVSKMTFSPAYLVHYLSYIYGLRAGDLVFTGTPAGVGSVLPGDRLDVSLETADDHSQAKILVSLQATVS

SEQ ID NO: 2001 - DNA, 693 bp, Yersinia pestis KIM
  CDS (1)..(693): transl_table=11
gtgtgtctattagggtataaattcaagagaggcagtatgtatcaacatagagactggcaaggggctttgctggatttccccgtaaataaagtggtttgcgtcggcagtaactatgccgaacatatcaaagagatggggagtactgcctctgtggagcctgtactgtttatcaaacctgaaaccgcattatgcgatatccgccaaccggtatcgataccgaaagattttggctcagtgcatcatgaaattgaattagccgtgttgatcggaacgccgttaaagcaagccagcgaagatagagtcgcacgggcgattgccggttacggtgtggcattggacttaacgctacgtgagctgcaggcaggttttaaaaaagcggggcaaccatgggaaaaagccaaggcgtttgatggttcttgcccgatatccggttttattcccgttgctgagtttggtgatgcacagcaggcagatttatcgctaacgattaatggggaaatccgtcaacagggaaatacccgtgacatgattacaccaattattccgttaatcagttacatgagccgtttctttaccttacgtgctggcgatatcgtgctgaccggtacgccgcaaggcgtagggccgatgcagtcaggtgatatgcttaaaattatgctcaatggcaaaacagtgaatacccgcataatataa

SEQ ID NO: 2002 - protein, 230 aa, Yersinia pestis KIM
MCLLGYKFKRGSMYQHRDWQGALLDFPVNKVVCVGSNYAEHIKEMGSTASVEPVLFIKPETALCDIRQPVSIPKDFGSVHHEIELAVLIGTPLKQASEDRVARAIAGYGVALDLTLRELQAGFKKAGQPWEKAKAFDGSCPISGFIPVAEFGDAQQADLSLTINGEIRQQGNTRDMITPIIPLISYMSRFFTLRAGDIVLTGTPQGVGPMQSGDMLKIMLNGKTVNTRII

SEQ ID NO: 2003 - DNA, 690 bp, Brucella suis 1330
  CDS (1)..(690): transl_table=11
atgacgacttatgtttttgcgccacgcccgcagacgtttctgcccgtgaagggaacggatgcacgctttcccgtgcaccgcatttattgcgtcggccagaactatgccgatcacgctatagaaatgggcggcgatccgacgcgcaacccgcccttcttcttccagaaaaacccggattgccttgtgatcgagggcggcgattttccttatccgccaaagaccgaggatgtgcatcacgagatcgagctggtggtggcgttgaagagcggcggcagcgatatccctgtagaaaaggcgctggaccatgtttacggctatgcggtcggcatcgacatgacgcgccgtgacttgcaggccgtggccaaaaaggcgggccgcccgtgggaagtggccaaggcgtttgaacattcggccccctgttcggctgtcgtgcctgccgctgaaacaggccacccggagcaggcggcgatttcgcttgccatcaacggtgagatgcgccagtccggcaatctcaaccagatgatctggaaagtgccggaaaccatttcctacctgtcgtcgctctttgatctgcaacccggcgatcttatctttacaggtacgcctgcgggcgtcgggccggtgaagcgcggcgaccgtctggagggcaaggtggatggagtgggaatactatccgtaaccgtggtttga

SEQ ID NO: 2004 - protein, 229 aa, Brucella suis 1330
MTTYVFAPRPQTFLPVKGTDARFPVHRIYCVGQNYADHAIEMGGDPTRNPPFFFQKNPDCLVIEGGDFPYPPKTEDVHHEIELVVALKSGGSDIPVEKALDHVYGYAVGIDMTRRDLQAVAKKAGRPWEVAKAFEHSAPCSAVVPAAETGHPEQAAISLAINGEMRQSGNLNQMIWKVPETISYLSSLFDLQPGDLIFTGTPAGVGPVKRGDRLEGKVDGVGILSVTVV

SEQ ID NO: 2005 - DNA, 666 bp, Pseudomonas putida KT2440
  CDS (1)..(666): transl_table=11
atgagttaccagcaccagtacgtagacggcacgcgcattcacttccccttgggcaaggtggtgtgcatcggccgtaactatgccgagcatgccaaggaactggacaacccgatccccaccgagccgctgctgttcatcaagccaggcagctgcgtggtgccggccgaaggtggcttcaagatcccggccgagcgcgggtcggtgcactatgaggttgaaatcgccgtgctgctgggcaagccgctgtcgacccacccgagcgaggaagaggtgctggacgccatttccggttacgcaccggcgctggacctgaccctgcgcgacgtgcaggccaaactgaaggaaaaggggctgccctgggagctggccaagtgctttgacggcgcttgcgtgctgccaccgttcgtctcggccgccagcttcgaggacgtgacagacatcccggtgcgcctgaccgtgaacggcgaagtacgccaggatggtaatagcgcgatgatgctgaacccgatcgtgccgatgattcagtacatggcagcgcatttctcgctacaagcgggggatgtgatcctcaccggtaccccggccggcgtcgggccgttcaatgtcggtgacgagctggtgctggagctgccgggtgtgagccgcttcgaaagccgggtgctttga

SEQ ID NO: 2006 - protein, 221 aa, Pseudomonas putida KT2440
MSYQHQYVDGTRIHFPLGKVVCIGRNYAEHAKELDNPIPTEPLLFIKPGSCVVPAEGGFKIPAERGSVHYEVEIAVLLGKPLSTHPSEEEVLDAISGYAPALDLTLRDVQAKLKEKGLPWELAKCFDGACVLPPFVSAASFEDVTDIPVRLTVNGEVRQDGNSAMMLNPIVPMIQYMAAHFSLQAGDVILTGTPAGVGPFNVGDELVLELPGVSRFESRVL

SEQ ID NO: 2007 - DNA, 666 bp, Pseudomonas syringae pv. tomato str. DC3000
  CDS (1)..(666): transl_table=11
atgagctaccagcacaaatatgtcgatggaacgagcattcacttcccgctgggcaaagtggtctgcatcggccgcaactatgccgagcacgccaaggaattgggcaacccggtgcccaccgagccgctgctgttcatgaagcctggcagtgcggtagttgcactggaaggcggtttcaccatcccggccgatcgtggctcggtgcattacgaagccgagattgtggtgttgatcggcaagcccctgagcaagaatccgtcccgcgaagaagtgctcgacgcgatcagcggctttgcacccggcctggacctgaccctgcgtgacgtgcagtcccgtctgcgcgagaaaggcctgccgtgggaactggccaagtgcttcgacggcgctgcggtgatccctccattcgtcccggctggcaccttcacggacctgacagacatcggcattcgtctgaccatcaacggcaaagtggtgcaggacggcaacagcagcctgatgctcaaccccatcgtgccgatgattcagcacatggcggccaacttctcgttgcaggccggtgacctgatcatgaccggtacgcctgctggcgtggggccgtttgaagccggtgacgaaatcgttctggaactgaccggtcaaacgccattcaccagcgtcgttcgctga

SEQ ID NO: 2008 - protein, 221 aa, Pseudomonas syringae pv. tomato str. DC3000
MSYQHKYVDGTSIHFPLGKVVCIGRNYAEHAKELGNPVPTEPLLFMKPGSAVVALEGGFTIPADRGSVHYEAEIVVLIGKPLSKNPSREEVLDAISGFAPGLDLTLRDVQSRLREKGLPWELAKCFDGAAVIPPFVPAGTFTDLTDIGIRLTINGKVVQDGNSSLMLNPIVPMIQHMAANFSLQAGDLIMTGTPAGVGPFEAGDEIVLELTGQTPFTSVVR

SEQ ID NO: 2009 - DNA, 777 bp, Streptomyces avermitilis MA-4680
  CDS (1)..(777): transl_table=11
gtgcgcatcgccagattctccatcgacggcaacgtcgctttcggcgcggtcgagggcgacaagccggacgagctcgtcctcgacatcatcaagggcatcccgttcgcggacttcgagctctccggtacgaaggttcccctcaacaaggtgcgcctgctgccgcccgtgctccccaacaaggtcgtggccttcggccgcaactacgcggagcacgccaaggagctgggcaacgaggtgcccgacgccccgttcgccttcttcaagccgtcgacctcggtgatcggccccggcgacccgatccagtacccgtccttctcgaacgagctgcaccacgaggccgagctggcggtggtcatcggccgcatgtgccgcgaggtaccgcgtgagcgcgtcaaggacgtcatcctcggctacacctgcgccaacgacatcaccgcgcgtgacgtccagaagcgcgagaagcagtgggcccgggccaagggcttcgacagctcctgcccgctcggcccctgggtggagacggacctcgacccgagcgacgtcaccatccagctcacggtcaacgggcaacagcggcagctcggccgcaccagcgagatgatccactcgatcgaggatctgatcgtcaacatcaccgaggccatgacgctgctccccggcgacgtgatcctcacgggcaccccggctggggtcggccccctcaacgtcggcgacgaggtcgccgtcaccatcgaaggcatcggcactctcaccaacaaggtgatcaagcgtggctaa

SEQ ID NO: 2010 - protein, 258 aa, Streptomyces avermitilis MA-4680
MRIARFSIDGNVAFGAVEGDKPDELVLDIIKGIPFADFELSGTKVPLNKVRLLPPVLPNKVVAFGRNYAEHAKELGNEVPDAPFAFFKPSTSVIGPGDPIQYPSFSNELHHEAELAVVIGRMCREVPRERVKDVILGYTCANDITARDVQKREKQWARAKGFDSSCPLGPWVETDLDPSDVTIQLTVNGQQRQLGRTSEMIHSIEDLIVNITEAMTLLPGDVILTGTPAGVGPLNVGDEVAVTIEGIGTLTNKVIKRG

SEQ ID NO: 2011 - DNA, 660 bp, Shigella flexneri 2a str. 2457T
  CDS (1)..(660): transl_table=11
atgtatcaacatcacaactggcaaggtgcgctgctggattatccggtgagtaaagtagtctgtgttggcagtaactatgccaaacatattaaagagatgggcagcgcagtgcccgaagagccagtgctgtttattaaaccagaaacggcactgtgcgatctgcggcagccattggcgatcccatccgatttcggttcagttcatcatgaagtcgaactggcggtgttgattggcgcgacgctgcgtcaggcaacggaagagcatgtccgcaaagccattgccggttacggcgtggcgcttgatctgacattgcgtgatgttcagggaaaaatgaagaaagccgggcagccgtgggaaaaggctaaagcgtttgataactcttgtccgctttccgggtttatccccgcggcggaatttaccggcgatccacaaaatacaacgctgggcctgagcgtaaacggcgaaaaacgccagcaaggtacgactgcggacatgatccataaaatcgttccgttgatcgcttatatgagcaagttttttaccctcaaggccggtgacgttgtgttgacaggcacgcctgatggcgtcggcccgttgcaaagcggtgatgagctgacagtcactttcgatgggcattctttgacaactcgcgttttgtaa

SEQ ID NO: 2012 - protein, 219 aa, Shigella flexneri 2a str. 2457T
MYQHHNWQGALLDYPVSKVVCVGSNYAKHIKEMGSAVPEEPVLFIKPETALCDLRQPLAIPSDFGSVHHEVELAVLIGATLRQATEEHVRKAIAGYGVALDLTLRDVQGKMKKAGQPWEKAKAFDNSCPLSGFIPAAEFTGDPQNTTLGLSVNGEKRQQGTTADMIHKIVPLIAYMSKFFTLKAGDVVLTGTPDGVGPLQSGDELTVTFDGHSLTTRVL

SEQ ID NO: 2013 - DNA, 657 bp, Photorhabdus luminescens subsp. laumondii TTO1
  CDS (1)..(657): transl_table=11
atgtatcaacacagagactggcagggggcattactggatcttcctgtcaataaagtggtttgcgttggtagtaattacgctaaacatattaaagagatggggtctaagccagcggaagagccagtcgtttttattaagccggaaactgcactgtgtgatatacatcagccaattgccattccaaaggattttggtgttgttcatcatgaagttgaactggctgtactgattggtacgccgttgaaacaagcaaatgaagagcgagttggtgccgctatcgcgggtttggctgttgcattggatctcaccttgcgtgatttgcaatctaaattcaagcaagcgggtcaaccgtgggaaaaaagtaaggcgtttgatggctcttgcccgatatctgggtttattcgaataagccactttggtgatccacagaatgtccagttttcactgacggtcaataatgagctacggcagaacggtaatagtaacgatatgttgacacccatcgttcccctgatcagccatatgtcgcacttttttactttgcggccgggagatgtgattctcactggtacaccggaaggtgttggcgcactgaaacctggtgatgtgttaaaggttactctgaatgataattcactcactaccagagtgatttga

SEQ ID NO: 2014 - protein, 218 aa, Photorhabdus luminescens subsp. laumondii TTO1
MYQHRDWQGALLDLPVNKVVCVGSNYAKHIKEMGSKPAEEPVVFIKPETALCDIHQPIAIPKDFGVVHHEVELAVLIGTPLKQANEERVGAAIAGLAVALDLTLRDLQSKFKQAGQPWEKSKAFDGSCPISGFIRISHFGDPQNVQFSLTVNNELRQNGNSNDMLTPIVPLISHMSHFFTLRPGDVILTGTPEGVGALKPGDVLKVTLNDNSLTTRVI

SEQ ID NO: 2015 - DNA, 657 bp, Geobacter sulfurreducens PCA
  CDS (1)..(657): transl_table=11
atgaaaaccgccaggctttccccgtcggggaatgagtttcccatcggcaagatactctgcatcggccgcaattacgccgagcacatcaaggagttgggcaacgaaactcccgacgcgccggttgttttcatgaagcccgccacggccgtcatcggcgacggggaaaccatcatcatcccctcctattcgcgcgaatgtcaccatgaggccgagctggcgctcctcatcggaaaaggggggaaagacatcccgcccgaacgggcactggagcatgtggccggttacggggttgccatcgatttgacgctgcgggacgtgcaggccgaattgaagaagaaggggttgccctgggagatcgccaagggattcgacacctcctgccccctttcctcttttgtcccggcagaccgggtggccgatccccacgacctgcacattaccctccgggtgaacggagagatgcgccaggacggctcctcttccctcatgatccaccggattccccagatcctcagttacatgtcgggagttttcaccctggaaccgggagacgtgatcctgaccgggacccccgccggcgtcggccccctcgcggcgggagacgccgtggaagccgaggtcgtcggcgtggcggcgatccgggttaccgttaaataa

SEQ ID NO: 2016 - protein, 218 aa, Geobacter sulfurreducens PCA
MKTARLSPSGNEFPIGKILCIGRNYAEHIKELGNETPDAPVVFMKPATAVIGDGETIIIPSYSRECHHEAELALLIGKGGKDIPPERALEHVAGYGVAIDLTLRDVQAELKKKGLPWEIAKGFDTSCPLSSFVPADRVADPHDLHITLRVNGEMRQDGSSSLMIHRIPQILSYMSGVFTLEPGDVILTGTPAGVGPLAAGDAVEAEVVGVAAIRVTVK

SEQ ID NO: 2017 - DNA, 693 bp, Magnaporthe grisea 70-15
  CDS (1)..(693)
atggcgacactacgaaacgcacgcaaggtggtctgcattggtcgcaactacgcagatcacattgccgagttgaacagcgccaagcccaagcagccgtttttcttcctcaagccgccgtcatcaattgttgcgcccggtgctggccccgtgatccgacccaaaggtgtcgatcttcactatgaggtggagctggctctcatcattggcaaggaggtcaagaacttgaaggcagacgacgaccagggtgctttggatgccattgaaagctatgccctcagcatcgacatgacggcccgcaacgtccaaaacgaggccaagaagaagggactcccctgggacattgccaagggcttcgacacgttcctgccgttcagcaacatcatccccaagtcggccatcccggaccctcacaacgtcgagctgtacctcagcgtcaacggtgaggtccgccagcaggactccaccaatctgctcctgttcaggatcccccgcgtcctggccgacatctcgagcgtcatgactctcgagaagggagacattgtgctcactggcacccccaagggcgtcggtcccgtcgtgcccggggacgtcatgcgtgccggaatccgcgtcaatggcaaggagatcgaggaggcccggattgagattcctgtggaggagtctaccagcgactatttttacaaggagacttag

SEQ ID NO: 2018 - protein, 230 aa, Magnaporthe grisea 70-15
MATLRNARKVVCIGRNYADHIAELNSAKPKQPFFFLKPPSSIVAPGAGPVIRPKGVDLHYEVELALIIGKEVKNLKADDDQGALDAIESYALSIDMTARNVQNEAKKKGLPWDIAKGFDTFLPFSNIIPKSAIPDPHNVELYLSVNGEVRQQDSTNLLLFRIPRVLADISSVMTLEKGDIVLTGTPKGVGPVVPGDVMRAGIRVNGKEIEEARIEIPVEESTSDYFYKET

SEQ ID NO: 2019 - DNA, 879 bp, Gibberella zeae PH-1
  CDS (1)..(879)
atggatactacaacatttaagcgtcttgtgcggtttgtccccaagtctgactcaactcgcatcctgatcggtgaaccatcacaagaagatctagatatcggtgttgccacgcgtgatgggaaagatgtcactgtcaatgtattcacggggtcttccgttctttctcctggcactcgaacagacagaaccgaatctattgagaggatcttgtcgcctttggcacaagaggaagtcggaaccattcgctgcattggactaaactatgtccaacacgcgaatgaagtgaagatggacattccaaagatcccaactcttttccttaagcctagcactgctttgggagacccttggcctgctcccacctttcttcccaagataacccaaaatgacggaagtggtgattatgaatcggagctggcagtagttattggcaaaaccgccaagaatgtctctgaggagaacgctatggactacgtcttgggctacacggctgccaacgatgtctcgagtcgtgtttcgcagcttaaccagtctcagtggtgcttctccaagggattcgatggagcatgcccaattgggcctgttcttgtctcaacttcggctgttcctgatccttcgaagctgcacattcgtggcctgaagaacggaaaggtacttcaagactgttcgctggacgatctcatctttagcatccccaagctagtcagtttcttatcacaaggcactacacttccagctggcacagtaattatcacgggcacgcctgctggagtaggaatggggaagagccccaaagagaacttggaacatggtgacgaattcagagttgagattttgcctcacatcggaacgctggttagcaagtttgagaacgagtag

SEQ ID NO: 2020 - protein, 292 aa, Gibberella zeae PH-1
MDTTTFKRLVRFVPKSDSTRILIGEPSQEDLDIGVATRDGKDVTVNVFTGSSVLSPGTRTDRTESIERILSPLAQEEVGTIRCIGLNYVQHANEVKMDIPKIPTLFLKPSTALGDPWPAPTFLPKITQNDGSGDYESELAVVIGKTAKNVSEENAMDYVLGYTAANDVSSRVSQLNQSQWCFSKGFDGACPIGPVLVSTSAVPDPSKLHIRGLKNGKVLQDCSLDDLIFSIPKLVSFLSQGTTLPAGTVIITGTPAGVGMGKSPKENLEHGDEFRVEILPHIGTLVSKFENE

SEQ ID NO: 2021 - DNA, 717 bp, Gibberella zeae PH-1
  CDS (1)..(717)
atggccaacctggcgcctcaagcttcatcaagcctcaagcaagcaggcaaggtcatatgtattggccgcaactttgcggaacatattgccgagctcaacagcgccaagccaaagcagcccttcttcttcctcaagcccacctcatccatcgtgctccctggtgagggtgctgtcctgagacccaagggcattgagatgcactatgaagttgagctggctcttgttatcggcaagctgaccaaagatctccaagcctctgatgttcagggcgctatggatgctgtaaaggcttacgctgttgccattgactttactgcccgcaacgctcagaatgaggccaagaagaagggtcttccgtggtcgattgccaagggcttcgacactttcctgcccatgagcaacatcattcccaagaccgccatccaggaccctcacaacgtggagctcttcctccagctcaacggcgagaccaagcagcagggctcgaccaacctgatgatctaccagatccctcgcattctaagcgacatctcaaaggtcatgactctccacccgggtgacattgtcctcactggtacacctgctggtgttggtcctgctgcgcctggtgacgttgttcgtgctggtctgaggattgacggaaaggaggtggaggagggtgctattgagattcccgtcgaggagtcgcctagttcctacactttctccgagacttaa

SEQ ID NO: 2022 - protein, 238 aa, Gibberella zeae PH-1
MANLAPQASSSLKQAGKVICIGRNFAEHIAELNSAKPKQPFFFLKPTSSIVLPGEGAVLRPKGIEMHYEVELALVIGKLTKDLQASDVQGAMDAVKAYAVAIDFTARNAQNEAKKKGLPWSIAKGFDTFLPMSNIIPKTAIQDPHNVELFLQLNGETKQQGSTNLMIYQIPRILSDISKVMTLHPGDIVLTGTPAGVGPAAPGDVVRAGLRIDGKEVEEGAIEIPVEESPSSYTFSET

SEQ ID NO: 2023 - DNA, 786 bp, Candida glabrata CBS 138
  CDS (1)..(786)
atgagctacacttacctgaaggacgcaaagaagataatttgtattggtagaaactatgctgcacacatcaaagagttgaacaatgcaactccaaaacagccattcttcttcttgaagccaatgtccagtgttgtaacaccagtcgatgagaaacacgccataaaagagttgcctaagcaagcaagctaccatggtttgaacgatgacggtaccaacccaggcactatccagataccaaaaggtacggtagtccatcatgagattgaagttgcattggtgatggacaagtacatctcgaatgccaacgagtctgaattcactgcagctgatgtttacgattccatcagaggtgtagccctggcgctggacttaactgctcgtaatgttcaggacgaagccaagaagaaaggtctaccgtggtccatcggcaaaggtttcgatacgttcttgcccatgtcacatatgatcccaaagaccaaattcgaagccaataaagaaaatctacaggaagcattcagagttacttgcgatgtcaacggcactcgcagacaagacggtaacacaaacctgatgctatatccactccacaaaatcatccagcatatctcaacaatgatgactttggagccaggcgacatcatcctcacaggtacacctgctggtgtgggcccaattgctgccggtgacaacatcagcggtcagttgtactacacagacgacttgctcattgacttcaatttcgactgcgtagttcgccctggtccttacgaatacaaagaaacttag

SEQ ID NO: 2024 - protein, 261 aa, Candida glabrata CBS 138
MSYTYLKDAKKIICIGRNYAAHIKELNNATPKQPFFFLKPMSSVVTPVDEKHAIKELPKQASYHGLNDDGTNPGTIQIPKGTVVHHEIEVALVMDKYISNANESEFTAADVYDSIRGVALALDLTARNVQDEAKKKGLPWSIGKGFDTFLPMSHMIPKTKFEANKENLQEAFRVTCDVNGTRRQDGNTNLMLYPLHKIIQHISTMMTLEPGDIILTGTPAGVGPIAAGDNISGQLYYTDDLLIDFNFDCVVRPGPYEYKET

SEQ ID NO: 2025 - DNA, 786 bp, Kluyveromyces lactis NRRL Y-1140
  CDS (1)..(786)
atgtcctacgagtacttaaacagggccaaaaaaatcatttgcattggccgcaattatgctgctcatattaaagaattgaacaatgccactcctaagcaaccattcttctttttgaagccaacctcatctttggtgactccagtgggtcctatgtcaaaatccagattgaatccagaagaatccgctaccttcaatggtttaaatgaggatggtagcaaccctggtccaatttatgttcctaagggtactatcattcaccatgaggttgaattagcgttagtggttgataaacatttgagtaatctgaacaaggaaagcttcggccccgaacaagtatgggactcaattagcggtgtttcattggcgctggatctcacggctagaaacgtacaagatgaagctaagaagaaaggtttaccatggactattggtaaagggtttgataccttctgccccatttcacacttcattccgaaggaagaattatttaacaagaccaatctacaggactctttcaggctaagttgctctgttaatggtcaattgagacaaaatgattccacgtcattgatgttgaacccgttgcatactatcttgcagcatatttccactatgatctctttagagcccaacgacattgttttgactggtactccagcgggggttggagagcttcaccctggtgataccattgaatgtgaactataccaagacgacaagctgttggttagttttgaatttgattgtgagcaaagaccaggtccgtacgagtacaaagaagtgtga

SEQ ID NO: 2026 - protein, 261 aa, Kluyveromyces lactis NRRL Y-1140
MSYEYLNRAKKIICIGRNYAAHIKELNNATPKQPFFFLKPTSSLVTPVGPMSKSRLNPEESATFNGLNEDGSNPGPIYVPKGTIIHHEVELALVVDKHLSNLNKESFGPEQVWDSISGVSLALDLTARNVQDEAKKKGLPWTIGKGFDTFCPISHFIPKEELFNKTNLQDSFRLSCSVNGQLRQNDSTSLMLNPLHTILQHISTMISLEPNDIVLTGTPAGVGELHPGDTIECELYQDDKLLVSFEFDCEQRPGPYEYKEV

SEQ ID NO: 2027 - DNA, 882 bp, Debaryomyces hansenii CBS767
  CDS (1)..(882)
atgtctaactggaatagattaattagattcgttgcaaatgacggcaagatttacagaggtgaaccaattgtctctgattccaactatgatgtcggaaagttgtttgcagctggtgaaaccatcaaggctaaggttgttgtcggcgaaaacattttcactgatgctaaggttacagatgaagtcttggaagtcaagaaattattaggtccacttacagctgatgatgtaccaattatcaagtgtgttggtttaaattacatgaagcacatccaagaaggtggtagaactcctccaccttacccatcaatcttttataagccacgcttcagtgttgctgaccacggtgaaccaattccaattccaaagatcgcccaaacgaatcaatgcgattacgaaggtgaattatgtgtggtgattggtaaaaccggaagagacatcaaggaagaagaagctttaagctacgtcgctggttacgtttctggtaatgatgtttctgctcgtacttggcaaagagacccagctcatgctggtggtgtcccacaatggtgtttctccaagggtttcgacaagtatgccccattaggtccagctcttgtttccaccaaggttatcgctgatccaggtgttcttcaactccaaaccagagtcaacggtgatgtccgtcaaaacaccaacaccgatgatcttttattcaatgttccaaagatcattgcttttatcagtcaaagcaccaccttagaagccggaactgttatcatgaccggtactccaagtggtgttgctatgggtatgaaggagccaaaatacttgaacaacggtgatgtggttgaagtttctatcgaacaaatcggtaccctttccaacaagatggactttgtctag

SEQ ID NO: 2028 - protein, 293 aa, Debaryomyces hansenii CBS767
MSNWNRLIRFVANDGKIYRGEPIVSDSNYDVGKLFAAGETIKAKVVVGENIFTDAKVTDEVLEVKKLLGPLTADDVPIIKCVGLNYMKHIQEGGRTPPPYPSIFYKPRFSVADHGEPIPIPKIAQTNQCDYEGELCVVIGKTGRDIKEEEALSYVAGYVSGNDVSARTWQRDPAHAGGVPQWCFSKGFDKYAPLGPALVSTKVIADPGVLQLQTRVNGDVRQNTNTDDLLFNVPKIIAFISQSTTLEAGTVIMTGTPSGVAMGMKEPKYLNNGDVVEVSIEQIGTLSNKMDFV

SEQ ID NO: 2029 - DNA, 870 bp, Debaryomyces hansenii CBS767
  CDS (1)..(870)
atgtcgagttggaacagattaattagatttgaggctaacgacggcaaaatttatagaggagacgctatcgtctcggattctgattatgacattggtaaacaatttgctgaagggaaaaccatcaaagccagggtcgtgattggtagtaatatctttactgacgccaaggtgactgacgaggtattggaagttaagaaattattgggacctcttactggcgaggatgtccctgttgttaaatgtattggaatgaattacaaggaacatctaatgggtataatcgagccaccaccatatccacaactcttttataagccacgcacgagtgtcgctgaccagaatgaggatattccaatcccactgttcgcacaaaatacttgtgattatgaaggtgaattatgtgtcgtcataggaaagacaggtaaaaatataaatgaggaagacgccttgagttatgttgcaggatatgtttcaggaaatgatctatcagctcgggattggcaatacttcccagaatatgcaggaaaagtaccacaattgggattttctaagagttttgatagatacgcacctttgggaccagcaatagtttcttctaaaatcatcaaagatccccatgcacttcaactccaaactagaattaatggcgaccttcgccaaaactgtggtaccgatgatcttttgtttggtatttcaagaatcattgcctttattagtcaagagactactttggaacagggaacagtgattatgacaggtactcctaatggttgcggtggtattgatggaaaatacttaaaagatggggaccttgtagaggttactattgatcaaatcggaacactctctcataagacgaaattcctttaa

SEQ ID NO: 2030 - protein, 289 aa, Debaryomyces hansenii CBS767
MSSWNRLIRFEANDGKIYRGDAIVSDSDYDIGKQFAEGKTIKARVVIGSNIFTDAKVTDEVLEVKKLLGPLTGEDVPVVKCIGMNYKEHLMGIIEPPPYPQLFYKPRTSVADQNEDIPIPLFAQNTCDYEGELCVVIGKTGKNINEEDALSYVAGYVSGNDLSARDWQYFPEYAGKVPQLGFSKSFDRYAPLGPAIVSSKIIKDPHALQLQTRINGDLRQNCGTDDLLFGISRIIAFISQETTLEQGTVIMTGTPNGCGGIDGKYLKDGDLVEVTIDQIGTLSHKTKFL

SEQ ID NO: 2031 - DNA, 702 bp, Yarrowia lipolytica CLIB122
  CDS (1)..(702)
atggctacccgatttgcccagcaggcccgaaaaatcctgtgcattggccgaaactacgtcgagcacatcaaggagctcaataacacggctccctccaagcccttcttcttcctcaagccctcgtcttccatcctgctccccaacgagggtcccatgctcgtgccctcgggaactgttgtgcactacgaggtagagctggctgcaattctcggcaaggagctcaagaacctcaaccccaagactttcactgagcaggacgccattgacgccattgatggctacgctctggctgttgacatgactgctcgaaacgtgcaggacgaggcgaagaagaagggtctgccctggtcaattggcaaggggttcgataccttcctgcccatctccaacttcattcccaagagccagatccccgatcctcacaacgtgcatcttcaccttgaaatcaacggacaaactaaacagtccgataacaccaacctgatgatcttcaagctgccccagattctgtccaccatgagcagcatcatgactcttcagcccggtgatattattctcactggaacccccaagggagtgggtcctgttaaccctggagatcgaatgaccgccggtatctctgttgatggaaaggagctcgaggccaaggtcgatgttcaggttgagcagaagcctggtccttacgtttattctcagatctaa

SEQ ID NO: 2032 - protein, 233 aa, Yarrowia lipolytica CLIB122
MATRFAQQARKILCIGRNYVEHIKELNNTAPSKPFFFLKPSSSILLPNEGPMLVPSGTVVHYEVELAAILGKELKNLNPKTFTEQDAIDAIDGYALAVDMTARNVQDEAKKKGLPWSIGKGFDTFLPISNFIPKSQIPDPHNVHLHLEINGQTKQSDNTNLMIFKLPQILSTMSSIMTLQPGDIILTGTPKGVGPVNPGDRMTAGISVDGKELEAKVDVQVEQKPGPYVYSQI

SEQ ID NO: 2033 - DNA, 690 bp, Aspergillus nidulans FGSC A4
  CDS (1)..(690)
atggcagcttcgataaaatcaaattgccgcaagctgactctagatcgcagcgaccacatcgcagagctcaacaacacaaaacccaagcagcctttcttcttcctgaagccctcctcttcaatactctgccctggcgaaggtccagtcttgcgccccaaaggcacaagcctccactatgaggtggaattggctttggtaatgggcaagaaagttcgcgacctcgatccaaacgatgacaagggagcgttggatgcgatccagagctacctcctcgccattgacatgaccgcgcgcaatgtccaagatgaagccaagaagaaaggtcttccttggactatcgcaaagggtttcgacaccttcctccccatatcgcaggagattttgaagtctcaaattcccgatccacacaacgcattccttcgtctgagcgtcaactcgcagcagcgtcaggctgattcctcagggctgatgctgtaccgtattcccaggttgctggcggagatctcgcgcgtgatgacgttggagaagggagatctggttttaacggggacgcctaagggcgttggggaggtgaagagtggtgatgtgatgaaggcgtcgattgaggttgatgggaaggagatcgagcagggacggattgaggttgaggtgcaggatcgggagggcaggtacgagtactgcgagacttag

SEQ ID NO: 2034 - protein, 229 aa, Aspergillus nidulans FGSC A4
MAASIKSNCRKLTLDRSDHIAELNNTKPKQPFFFLKPSSSILCPGEGPVLRPKGTSLHYEVELALVMGKKVRDLDPNDDKGALDAIQSYLLAIDMTARNVQDEAKKKGLPWTIAKGFDTFLPISQEILKSQIPDPHNAFLRLSVNSQQRQADSSGLMLYRIPRLLAEISRVMTLEKGDLVLTGTPKGVGEVKSGDVMKASIEVDGKEIEQGRIEVEVQDREGRYEYCET

SEQ ID NO: 2035 - DNA, 696 bp, Candida albicans SC5314
  CDS (1)..(696): transl_table=12
atgtcattgaaatacttagacaccgccagaaagatcctttgtattggtcgtaattatgctgcccacatcaaggaattaaacaatgccaccccgcaacagccatttttctttttaaaaccatcttcatcagtattaaagcccgactctggcccattcttggttcccaagggagttattgttcatcatgaagtggaattggcatttacgttaaacaaagacttgaaaaacttgccatctactttttctcctgaagaagctattgacagcattgaagggtatgccttgactattgatatgacagcaagaaacgttcaggatgaagccaaaaagaaaggattgccttggtcaattggtaaagggttcgacacctttttgccagtgtctaaattcatcgccaaggaaaaaatcccagacccatacaaagttgagttggtgttgaaaattaacggtgaagtcaaacaacaagataaaaccgacttgatgttgttccccattcataaaattttgagccacatgtcagcaattatgacattggaaaagggagacttaattttgactgggaccccaaaaggtgttggtcaagttaagccgggcgataaggttgaagctcaattgttggttaacggtaaagtcattgaagagattaaattcgacgccgaagaaaaaccaggtccttacgaatataaacagatatag

SEQ ID NO: 2036 - protein, 231 aa, Candida albicans SC5314
MSLKYLDTARKILCIGRNYAAHIKELNNATPQQPFFFLKPSSSVLKPDSGPFLVPKGVIVHHEVELAFTLNKDLKNLPSTFSPEEAIDSIEGYALTIDMTARNVQDEAKKKGLPWSIGKGFDTFLPVSKFIAKEKIPDPYKVELVLKINGEVKQQDKTDLMLFPIHKILSHMSAIMTLEKGDLILTGTPKGVGQVKPGDKVEAQLLVNGKVIEEIKFDAEEKPGPYEYKQI

SEQ ID NO: 2037 - DNA, 879 bp, Candida albicans SC5314
  CDS (1)..(879): transl_table=12
atgagctggaaaagactaatcagatttgtcgctcgagatgggaagatttataggggagaaccaattttcacagatacgaattatgatgtaggtaaaaaatatcttgctggtgatcaactcaaagcgaaagttataaaaggaacaaatatttttgaaaacacaattgtcacagacgagattttggaggtagtaaagttgttaggtccattaaccccagaagatgtccccattgtcaaatgcattggtttaaactacacgaagcatattgaagaaagtggtataccagcaccaccttaccctccgttgttttacaaacctcgaacttgtgtagcggactttaatgaaccgatcccaatttcaaaaattgctcaagtagatcaatgtgattatgaaggtgaattatgtgttgtcataggaaaatctgggaaaaatattgccaaagagaacgcattagaatatgttggtgggtatgttgttggtaatgatgtttctgccagaacttggcaattagatccaaaatatgcaggtggggctccacaatggtgtttctctaaatcttttgataaatatgctcccttaggtcctcagttggtttcacctgctgttttaacagatccctcagctttacatttacaaactcgagttaatggagagttacgacaagattcccctacatcagatttgttgttcaacgtttcagaaataattgcctttctttctcaatcaacaacattagaacgaggcacagtcataatgacaggaacaccaagtggtgttgcaatgggaatgaaagaccagaaatatttacaagatggtgatgaagttgaggtgagtatcactcaaattggtaccttggttaataaaatgagatttgagtga

SEQ ID NO: 2038 - protein, 292 aa, Candida albicans SC5314
MSWKRLIRFVARDGKIYRGEPIFTDTNYDVGKKYLAGDQLKAKVIKGTNIFENTIVTDEILEVVKLLGPLTPEDVPIVKCIGLNYTKHIEESGIPAPPYPPLFYKPRTCVADFNEPIPISKIAQVDQCDYEGELCVVIGKSGKNIAKENALEYVGGYVVGNDVSARTWQLDPKYAGGAPQWCFSKSFDKYAPLGPQLVSPAVLTDPSALHLQTRVNGELRQDSPTSDLLFNVSEIIAFLSQSTTLERGTVIMTGTPSGVAMGMKDQKYLQDGDEVEVSITQIGTLVNKMRFE

SEQ ID NO: 2039 - DNA, 879 bp, Candida albicans SC5314
  CDS (1)..(879): transl_table=12
atgagctggaaaagactaatcagatttgtcgctcgagatgggaagatttataggggagaaccaattttcacagatacgaattatgatgtaggtaaaaaatatcttgctggtgatcaactcaaagcgaaagttataaaaggaacaaatatttttgaaaacacaattgtcacagacgagattttggaggtagtaaagttgttaggtccattaaccccagaagatgtccccattgtcaaatgcattggtttaaactacacgaagcatatcgaagaaagtggtataccagcaccaccttaccctccgttgttttacaaacttcgaacttgtgtagcggactttaatgaaccgatcccaatttcaaaaattgctcaagtagatcaatgtgattatgaaggtgaattatgtgttgtcataggaaaatctgggaaaaatattgccaaagagaacgcattagaatatattggtgggtatgttgttggtaatgatgtttctgccagaacttggcaattagatccaaaatatgcaggtggggctccacaatggtgtttctctaaatcttttgataaatatgctcccttaggtcctcagttggtttcacctgctgttttaacagatccctcagctttacatttacaaactcgagttaatggagagttacgacaagattcccctacatcagatttgttgttcaacgtttcagaaataattgcctttctttctcaatcaacaacattagaacgaggcacagtcataatgacaggaacaccaagtggtgttgcaatgggaatgaaagaccagaaatatttacaagatggcgatgaagttgaggtaagtatcactcaaattggtaccttggttaataaaatgagatttgagtaa

SEQ ID NO: 2040 - protein, 292 aa, Candida albicans SC5314
MSWKRLIRFVARDGKIYRGEPIFTDTNYDVGKKYLAGDQLKAKVIKGTNIFENTIVTDEILEVVKLLGPLTPEDVPIVKCIGLNYTKHIEESGIPAPPYPPLFYKLRTCVADFNEPIPISKIAQVDQCDYEGELCVVIGKSGKNIAKENALEYIGGYVVGNDVSARTWQLDPKYAGGAPQWCFSKSFDKYAPLGPQLVSPAVLTDPSALHLQTRVNGELRQDSPTSDLLFNVSEIIAFLSQSTTLERGTVIMTGTPSGVAMGMKDQKYLQDGDEVEVSITQIGTLVNKMRFE

SEQ ID NO: 2041 - DNA, 759 bp, Ustilago maydis 521
  CDS (1)..(759)
atggcctcctcatttctgacacggggaaagaaaatcgttgcgatcactcatgctgacaacgacgtacgattctctcttggtcatggtctcttgaactgcattgcattgcatcacagtatcggacgtaactatgcagctcatgccaaggagctcaacaatgccgtgcctaccgaaccttttttcttcctgaaacccactacttcctaccttgccaacaatggtaccgttgagattcccaaaaacatccttgcacacttcgaggttgagcttggcgtggtcatcggcagccctcgagttcgcgatgtcttggctgctgatgcaatgaagcacgttgcaggctacaccctctccatcgatatgaccgcacgcaacctgcaagacaaggttaaatccaaaggccttccttggtcctctgcgaaagggtttgatactttcaccccaacctcaggattcatcgacaagtctcgtgttcgtgacccatccaagctgagattgtggctcaaggtcaacgatcaggtcaagcagaatggcacaacgggtgatatgatctttggtatcccagagttgatcgagcacgtttcgtcaattatgacgctggaggagggggatctgctgctgacaggtacaccgcagggtgtaggcgaggtcaaggatggcgatgtaatcaagtgcggtctggaagatcagtcaggtaacctgcttgaacagctcaagatcaacgtagccaatcgtgttggtggatacgagttcaaactctaa

SEQ ID NO: 2042 - protein, 252 aa, Ustilago maydis 521
MASSFLTRGKKIVAITHADNDVRFSLGHGLLNCIALHHSIGRNYAAHAKELNNAVPTEPFFFLKPTTSYLANNGTVEIPKNILAHFEVELGVVIGSPRVRDVLAADAMKHVAGYTLSIDMTARNLQDKVKSKGLPWSSAKGFDTFTPTSGFIDKSRVRDPSKLRLWLKVNDQVKQNGTTGDMIFGIPELIEHVSSIMTLEEGDLLLTGTPQGVGEVKDGDVIKCGLEDQSGNLLEQLKINVANRVGGYEFKL

SEQ ID NO: 2043 - DNA, 687 bp, Cryptococcus neoformans var. neoformans B-3501A
  CDS (1)..(687)
atgtccaactttatcaaagcaggaaggaagattgtcgctattggtcgcaactacgctgatcacgccaaggagcttggtaacgccattcctaaggagcctttcttctttttgaaacccacttcttcttaccttgtccctgacaatggacctgttgagatccctcggggggttatcgtgcatcatgaagttgagcttggtgttgtcatcggtaagaacggtcgagacatctccccttctgctgccttcgaccatgttgctggatactctcttgctgtcgacatgactgcccgtaatgttcaggataaggccaaggctaaaggtttgccttggtctgctgccaagggcttcgatactttctgccctattggtcctttcattcccaagcacttcattgccgatcctactaaagtcggcctccatttttcggtcaacggtactgttaagcagtctggcctcacctccgacatgatcttcgacattccccagctcattgcatttgtctctggtatcatgaagcttgaagaaggtgacttggtacttactggaacccctagtggggtgggaaagattaagaggggggaaattttcgaggcgaagttgacttaccctggattagatggtgaggtcttgagcaagtatgaaatcgaatgcgtggagaggcaaggaggttacgagtttatgccttaa

SEQ ID NO: 2044 - protein, 228 aa, Cryptococcus neoformans var. neoformans B-3501A
MSNFIKAGRKIVAIGRNYADHAKELGNAIPKEPFFFLKPTSSYLVPDNGPVEIPRGVIVHHEVELGVVIGKNGRDISPSAAFDHVAGYSLAVDMTARNVQDKAKAKGLPWSAAKGFDTFCPIGPFIPKHFIADPTKVGLHFSVNGTVKQSGLTSDMIFDIPQLIAFVSGIMKLEEGDLVLTGTPSGVGKIKRGEIFEAKLTYPGLDGEVLSKYEIECVERQGGYEFMP

SEQ ID NO: 2045 - DNA, 780 bp, Desulfovibrio vulgaris subsp. vulgaris str. Hildenborough
  CDS (1)..(780): transl_table=11
atgcgcgtcatcagagtccgccatcgcggcagcgtcttcttcgccgcccttcaggacgacggcgtggtgtgcctcaaccggcaactggggtacgaagcccccatcccgctgagcgaaatcacgctcctgccagtggtcgcgccttccaaggtcgtctgcgtgggtctcaactaccgcgggcacgcaggcgaactgggcatggacgtccccgacgaaccggtgtttttcctcaaggcccccactgccatcatcggcacgggcgagcccatcgtcctgcctcctgccgtcggtcgagtagactacgagggcgaactcgcactggtggtgggcaagcaatgccgcaacatcaccccggaacaggcacgcgagcacatcttcggcttcacgtgcgccaacgacgtcaccgcgcgcgacatccagaagcgtgacgggctgttcggacgatgcaaggggtacgacaccttctgccccgtggggccgtggatagagacggcactcgaagaccccggcaacctcaccctccgcaccgttgtgaacggtgaagtccgtcagcagggcaacaccgctgacatgctggttcaccccttcgagttgctcagttccatctctcgcgtgatgacactgctgcccggagacctggtgctgaccggaacccccgaaggcatcggccccatccacgccggtgacgaggtacgcgtcgaaatcgacgaggtggggctgctgaccaaccccgtcatccccgccgacgaagacgcaactggcgatacgcccctccagtag

SEQ ID NO: 2046 - protein, 259 aa, Desulfovibrio vulgaris subsp. vulgaris str. Hildenborough
MRVIRVRHRGSVFFAALQDDGVVCLNRQLGYEAPIPLSEITLLPVVAPSKVVCVGLNYRGHAGELGMDVPDEPVFFLKAPTAIIGTGEPIVLPPAVGRVDYEGELALVVGKQCRNITPEQAREHIFGFTCANDVTARDIQKRDGLFGRCKGYDTFCPVGPWIETALEDPGNLTLRTVVNGEVRQQGNTADMLVHPFELLSSISRVMTLLPGDLVLTGTPEGIGPIHAGDEVRVEIDEVGLLTNPVIPADEDATGDTPLQ

SEQ ID NO: 2047 - DNA, 645 bp, Acinetobacter sp. ADP1
  CDS (1)..(645): transl_table=11
ctgatgaatacacgtccatcaaaaattatttgtatcggaagaagctatgctgcacatgcaaaagaattaggcaatgcgatttcagatcgtccagtcctgtttattaagccaccgagtagtttaattggtttggaacagggcattgaatggaataccaaacatggcagttgccattttgagtgtgagttgactctacgaattgaccagcctcttaaaaatgaaacagacccccaaaaagctttagctgcaattggcgccgtaacgatgggattggatttgactttgcgggatttacaagatgacttgaaaagtaaagggcatccgtgggagcgttgtaaagcatttgatggtgcatgtgtattggcagattgggttgatgtgagtgaaattgaagactggaagcatgtgacctatacctttcatatcaatgatcagttacgtcaggaaggcgatacagcatatctactcttaagcattggtgaatacctgtgtgatattagtcaggcatttagcatcgaagcgggcgatgtggtcatgacaggcacaccagcaggtgtagggccgttgcatcacggcgatcagcttaaaatgacgcttcatggtaaaacccagcaatttgtgtggaacacctttgtacatgaataa

SEQ ID NO: 2048 - protein, 214 aa, Acinetobacter sp. ADP1
MMNTRPSKIICIGRSYAAHAKELGNAISDRPVLFIKPPSSLIGLEQGIEWNTKHGSCHFECELTLRIDQPLKNETDPQKALAAIGAVTMGLDLTLRDLQDDLKSKGHPWERCKAFDGACVLADWVDVSEIEDWKHVTYTFHINDQLRQEGDTAYLLLSIGEYLCDISQAFSIEAGDVVMTGTPAGVGPLHHGDQLKMTLHGKTQQFVWNTFVHE

SEQ ID NO: 2049 - DNA, 657 bp, Erwinia carotovora subsp. atroseptica SCRI1043
  CDS (1)..(657): transl_table=11
atgtatcaacacagagactggcagggcgcgctgcttgatttcccagtaaataaagtcgtttgcgtcgggagcaactactcagaacacatcaaagaaatgggaagtgcgaccccgagcgagccagttttattcatcaagcctgaaaccgcactgtgtgatttacgtcaacccgtcgctattcctaaaaatctgggctcggttcaccacgaagttgagctggcggtgctgatcggtacgccgttaaagcaggcgaatgaagaacgcgttgcacgagccatcgcgggttatggcgtggcgttggatttgacgctgcgtgatttgcagtccgaattcaaaaaagcaggccagccgtgggaaaaagccaaagcctttgacggttcctgcccgatctccggttttattccggttgctgagtttggcgatccgcagcaaaccgaactgggtgtaaaagtgaatgatgaagtgcgccagcagggcaacacgcgtgatatgattacgtcgattctgccgctgattgcctacatgagccgtttctttacgctgcgcgcgggcgatattattttaacgggtacgccaaaaggagtcggtccgatcctgtcaggcgatatgctgacgattacggtaaatgaccggacgctgagcacccgtattatctaa

SEQ ID NO: 2050 - protein, 218 aa, Erwinia carotovora subsp. atroseptica SCRI1043
MYQHRDWQGALLDFPVNKVVCVGSNYSEHIKEMGSATPSEPVLFIKPETALCDLRQPVAIPKNLGSVHHEVELAVLIGTPLKQANEERVARAIAGYGVALDLTLRDLQSEFKKAGQPWEKAKAFDGSCPISGFIPVAEFGDPQQTELGVKVNDEVRQQGNTRDMITSILPLIAYMSRFFTLRAGDIILTGTPKGVGPILSGDMLTITVNDRTLSTRII

SEQ ID NO: 2051 - DNA, 786 bp, Leifsonia xyli subsp. xyli str. CTCB07
  CDS (1)..(786): transl_table=11
gtgaagatcgcacggttcagccacacccgcaccgaccagaccaccgcatccatcgactacggcatcgtggacgaggacgcgatcgttgtcctctccggcgatccgatgttcgcgggttttgacacgaccggcgaacgcgtgccgcgcgggagggtcggttcgctgctggcgccggtcataccgcgctccaaagtggtcgcggtgggcaagaactaccgcgagcacgcggccgaaatgggcgcagaggccccggtcgagccgctgttgttcctcaagccgaacacggctgtgatcgggctgggcgaagctatcgtcctcccgccgcagtccgagcgcgtcgactacgaaggcgagctggcggtcgtgatcggcaagatcgcccggaatgtcgccgaagaggacgcagccggtcacatcttcggctacaccgttgcgaacgatgtgacggctcgtgacctgcagcagagagatggccagtggacgcgcgccaagggcttcgacactttctgcccgctcgggccggtcatcgagaccgagctcgatccggaggcgtccctgcgcacgcgcgttaacggcgaactgagacaggaggcgcggatctcggagatggtgcatggcatcccagcgatcgtcgcctacgcttcgagcgtgttcacattgctgccgggggatgtcattctcaccggcacaccgtccgaggtcggacagctgcacgcgggcgacaccgtcgaggtcgaggtttccggtgtcgggtcgctcgtgaatccggtgtgggcggccaagtag

SEQ ID NO: 2052 - protein, 261 aa, Leifsonia xyli subsp. xyli str. CTCB07
MKIARFSHTRTDQTTASIDYGIVDEDAIVVLSGDPMFAGFDTTGERVPRGRVGSLLAPVIPRSKVVAVGKNYREHAAEMGAEAPVEPLLFLKPNTAVIGLGEAIVLPPQSERVDYEGELAVVIGKIARNVAEEDAAGHIFGYTVANDVTARDLQQRDGQWTRAKGFDTFCPLGPVIETELDPEASLRTRVNGELRQEARISEMVHGIPAIVAYASSVFTLLPGDVILTGTPSEVGQLHAGDTVEVEVSGVGSLVNPVWAAK

SEQ ID NO: 2053 - DNA, 666 bp, Pseudomonas syringae pv. syringae B728a
  CDS (1)..(666): transl_table=11
atgagctaccagcacaaatatgtcgatggcaccaacattcacttcccgctgggtaaagtggtctgcatcgggcgtaactacgccgaacacgccaaggaactgggcaacgcggtgcctaccgagccgctgctgttcatgaagcccggcagcgcggtggttgcgctggagggtggcttcagcatcccggcagaccgcggttcggtgcattacgaagccgagatcgtggtgttgatcggcaagcccctgagcaagaacccttcgcgcgaagaagtactcgacgcgatcagcggctttgcgcctggtctggacctgacgttgcgtgatgtccagtcgcgtctgcgtgagaaaggcctgccgtgggagctggccaagtgttttgacggcgctgcggtgatcccgccgttcgtgcccgccgagaccttccctgatctggaggacatcggtatccgcctgaccctcaatggcaaggtggttcaggacggcaacagcaacatgatgctcaacccgatcgtgccgatgatccagcacatggcagccaacttctcgctgcaggccggcgacctgatcatgaccggcacacctgccggtgtcgggccgttcgaagctggcgaccagatcgccctggaactggtcgggcagacgccgttcgagagcgtcgtcaggtaa

SEQ ID NO: 2054 - protein, 221 aa, Pseudomonas syringae pv. syringae B728a
MSYQHKYVDGTNIHFPLGKVVCIGRNYAEHAKELGNAVPTEPLLFMKPGSAVVALEGGFSIPADRGSVHYEAEIVVLIGKPLSKNPSREEVLDAISGFAPGLDLTLRDVQSRLREKGLPWELAKCFDGAAVIPPFVPAETFPDLEDIGIRLTLNGKVVQDGNSNMMLNPIVPMIQHMAANFSLQAGDLIMTGTPAGVGPFEAGDQIALELVGQTPFESVVR

SEQ ID NO: 2055 - DNA, 666 bp, Pseudomonas fluorescens Pf-5
  CDS (1)..(666): transl_table=11
atgagctatcagcaccagtatgtcgacggtacccggatccattttccggtgggcaaggtggtgtgcatcggtcgcaactacgccgagcacgccaaggagctggacaacccggtacctaccgaacccctgttgtttatcaagccgggcagttgtgtggtgcccctggaaggtgggttcgcgattcccaccgagcgtggttcggtgcactacgaagcggaaatcgcggtgttgatcggcaagccgctctccaccaaacccagccgcgaagaagtgctggatgccatttccggctttgccccggcactggacctgaccctgcgggacaagcaggccgaactcaaagccaagggcctgccctgggaaatcgccaagtcgttcgacggcgcggcggtgatcgcgccctttgtggtgggcagtaccttcgccgacctgaccgacatcggcatccgcctgaccatcaacggtgaagtacgccaggacggcaacagcgccatcatgctcaaccccatagtgccgatgatccagtacatggccggttgtttctccctgcaggccggcgatgtgatcctcacgggcacgccggtcggggttgggccgctgaatgtcggcgatgagctggtgctggagcttcccggtgccagccgtttcaccagcagcgtccgttga

SEQ ID NO: 2056 - protein, 221 aa, Pseudomonas fluorescens Pf-5
MSYQHQYVDGTRIHFPVGKVVCIGRNYAEHAKELDNPVPTEPLLFIKPGSCVVPLEGGFAIPTERGSVHYEAEIAVLIGKPLSTKPSREEVLDAISGFAPALDLTLRDKQAELKAKGLPWEIAKSFDGAAVIAPFVVGSTFADLTDIGIRLTINGEVRQDGNSAIMLNPIVPMIQYMAGCFSLQAGDVILTGTPVGVGPLNVGDELVLELPGASRFTSSVR

SEQ ID NO: 2057 - DNA, 717 bp, Psychrobacter arcticus 273-4
  CDS (1)..(717): transl_table=11
atgagccaatcaccatctatatccttagtcgatacaattgctgccagtgccaatgatgacgcgagcaacgccactgttaatgatagcgtacgtgcatctattggcaaggtcgtttgcgtcggtcgtaactatgtggcgcacgctcaagagttgggtaatgaagtgccaacgtcgcccatcttatttatgaaaccagcatcgtcagtggtcagtgtgcatcatgatattgtgcgtccagattcagaacagtttggtgagacacattatgaagctgagctgtgtattcagctgtcagcggatttatctaaggcaaccatcgcacaagcacagcaagctattggcggcgtaactttagggcttgatttaaccttacgcgagctgcaaagcaagctaaaagacaaaggtcatccttgggagcgagccaagtgctttgatggtgcttgcgtgctggctgattggattgcgccgcaagcatttggtgactttaaaaatgtcgaatatcagttttacattaataatgagctcaagcaaaatggtgatagtgcgttgatgttgtttccagtttatgagttgttggttgatatcagtcatgcctttagtctacaagcaggcgatgtcattatgactggtacgccaagtggcgttgggatacttcaggcaggtgatgcgctaaaactcaagttagatgctcatgaatggcaggttcaggttcgataa

SEQ ID NO: 2058 - protein, 238 aa, Psychrobacter arcticus 273-4
MSQSPSISLVDTIAASANDDASNATVNDSVRASIGKVVCVGRNYVAHAQELGNEVPTSPILFMKPASSVVSVHHDIVRPDSEQFGETHYEAELCIQLSADLSKATIAQAQQAIGGVTLGLDLTLRELQSKLKDKGHPWERAKCFDGACVLADWIAPQAFGDFKNVEYQFYINNELKQNGDSALMLFPVYELLVDISHAFSLQAGDVIMTGTPSGVGILQAGDALKLKLDAHEWQVQVR

SEQ ID NO: 2059 - DNA, 666 bp, Pseudomonas syringae pv. phaseolicola 1448A
  CDS (1)..(666): transl_table=11
atgagctaccagcacaaatatgtcgatggcaccaacattcacttcccgctgggtaaagtggtctgcatcgggcgtaactacgccgaacacgccaaggaactgggcaacgcggtgcctaccgagccactgctgttcatgaaacccggcagcgcggtggttgcgctggagggtggcttcactatcccggcagaccgcggctcggtgcattacgaagcagagatcgtggtgttgatcggcaagcccctgagcaagaacccttcgcgcgaagaagtgctggacgcgatcagcggctttgcgcccggcctggacctgaccctgcgtgacgtgcagtcgcgtctgcgtgagaaaggccttccatgggagctggccaagtgtttcgacggcgctgcggtgattccgccgttcgtgcccgccgagaccttccctgatctggaggacatcggtatccgcctgaccctcaatggcaaggtggttcaagacggcaacagcaacatgatgctcaacccgatcgtgccgatgatccagcacatggcagccaacttctcgctgcaggccggtgacctgatcatgaccggcacgcctgccggtgtcgggccgttcgaaaccggcgaccagatcgcgctggaactggtcgggcagacgccgttcgagagcgtcgtcaggtaa

SEQ ID NO: 2060 - protein, 221 aa, Pseudomonas syringae pv. phaseolicola 1448A
MSYQHKYVDGTNIHFPLGKVVCIGRNYAEHAKELGNAVPTEPLLFMKPGSAVVALEGGFTIPADRGSVHYEAEIVVLIGKPLSKNPSREEVLDAISGFAPGLDLTLRDVQSRLREKGLPWELAKCFDGAAVIPPFVPAETFPDLEDIGIRLTLNGKVVQDGNSNMMLNPIVPMIQHMAANFSLQAGDLIMTGTPAGVGPFETGDQIALELVGQTPFESVVR

SEQ ID NO: 2061 - DNA, 702 bp, Ralstonia eutropha JMP134
  CDS (1)..(702): transl_table=11
atgaccgaattcgtttttgccccgccggcacccgttggcgtgcccgtgcgcggcagcaacgctagcttcccggtgcgccgcgtgtattgcgtcggccgcaactatgccgcccatgcccgcgaaatgggctcggaccccgatcgcgagccgccgttcttcttctgcaagccgtcggacgcggtcagctacgtggcggacggcaccgagggcacattcccgtatccgcccggcaccagcaacgtccactatgaggtggaactggtcgtggcgatcggcaagggcggcaaggacatttcggtcgagcaggcagccagccacgtgttcggctacgccgtaggcctcgatatgacgcgccgcgacctgcagaacgaatcgaagaagaccggccgcccctgggagaccggcaaggcgttcgaccgctcggcgccgatcggcccgatcgtgccggtgtcggccatcggccatccggaaaagggcgaggtcacgctgtccgtcaacggcgccgagaagcagcgcggcgacctgtccgacctgatctggtcggtgccggagatggtgtcgtacctgtcgaagctgttcgaactgcagccgggcgacctgatcttcagcggcacgcccgaaggcgtgggcccggtagtcaagggcgacgtcatgcagtgccatgtcggcggcgtgggcgacctgaccatcaaagtggtctga

SEQ ID NO: 2062 - protein, 233 aa, Ralstonia eutropha JMP134
MTEFVFAPPAPVGVPVRGSNASFPVRRVYCVGRNYAAHAREMGSDPDREPPFFFCKPSDAVSYVADGTEGTFPYPPGTSNVHYEVELVVAIGKGGKDISVEQAASHVFGYAVGLDMTRRDLQNESKKTGRPWETGKAFDRSAPIGPIVPVSAIGHPEKGEVTLSVNGAEKQRGDLSDLIWSVPEMVSYLSKLFELQPGDLIFSGTPEGVGPVVKGDVMQCHVGGVGDLTIKVV

SEQ ID NO: 2063 - DNA, 666 bp, Pseudomonas fluorescens PfO-1
  CDS (1)..(666): transl_table=11
atgagctatcagcaccagtatgtcgacggtacgcggattcattttccgctggggaaagtggtgtgcatcggccgtaactacgccgaacacgccaaggaactggacaacccggtgcctaccgagccgttgctgttcatcaagccgggcagttgcgtggtgccgctggaaggcagtttcagcattccgaccgagcgtggctcggtgcattacgaggcggaaatcgccgtgttgatcggcaaaccgctgtcgaccaaaccgagccgtgaagaagtgctggacgcgatctccggtttcgccccggcgctggacctgaccctgcgcgacaagcaggccgagctcaaatccaagggcctgccgtgggaaatcgccaagtcgttcgacggcgcggcggtgattgcaccgttcgtggtcggcagcactttcgccgacctgaccgacatcggcattcgcctgaccatcaatggcgaagtgcgccaggacggtaacagcagcgccatgctcaacccgatcgtgccgatgatccagcacatggccggctgcttctcgctgcaggccggtgacgtgatcctgaccggcacgccagtgggcgtcggcccgctgaacgttggcgatgagatcgtgctggaactgccgggcgccagtcgttttaccagcagcgttcgctga

SEQ ID NO: 2064 - protein, 221 aa, Pseudomonas fluorescens PfO-1
MSYQHQYVDGTRIHFPLGKVVCIGRNYAEHAKELDNPVPTEPLLFIKPGSCVVPLEGSFSIPTERGSVHYEAEIAVLIGKPLSTKPSREEVLDAISGFAPALDLTLRDKQAELKSKGLPWEIAKSFDGAAVIAPFVVGSTFADLTDIGIRLTINGEVRQDGNSSAMLNPIVPMIQHMAGCFSLQAGDVILTGTPVGVGPLNVGDEIVLELPGASRFTSSVR

SEQ ID NO: 2065 - DNA, 687 bp, Rhodobacter sphaeroides 2.4.1
  CDS (1)..(687): transl_table=11
atgtccgaccatgtctttgccccgcccgccgcgccctccctgcccgttgcggagagccagacgctcttcccggtgcggcgcgtctactgcatcggccggaactatgccgcccatgcggtcgagatgggcggcgatcccgaccgcgagccgccgttcttcttccagaagaaccccgacaatctcgacccgtcgggccgcttcccctacccgcccgaaagcttggacgtccatcacgaggtcgagctcgcggtgatgctgggctcgggcgggacggacattccggtcgaggaggcgatggcccatgtgtggggctatgcgctcgccctcgacatgacccggcgcgacctgcagggcgaggcgaagaaggccggccggccgtgggaggtgggcaaagccttcgaacggtccgccccggtgggtccggtgcatcccgcagcgcggatcggccatcccgaagcggggcggatcgagctccgtgtcaatggcgcgctgcggcaggagggcgatctcaaccagatgatctggaaggtgccggaaatgatctccgtcctgtcgcgccatttcgcgctggccgcgggcgacgtgatcctgacgggcacgccttccggggtcggcgcggtgcagcgcggagacgtgatggaggccagcatcgacggtctcggctcgctgcgcgtcgaggtggtctga

SEQ ID NO: 2066 - protein, 228 aa, Rhodobacter sphaeroides 2.4.1
MSDHVFAPPAAPSLPVAESQTLFPVRRVYCIGRNYAAHAVEMGGDPDREPPFFFQKNPDNLDPSGRFPYPPESLDVHHEVELAVMLGSGGTDIPVEEAMAHVWGYALALDMTRRDLQGEAKKAGRPWEVGKAFERSAPVGPVHPAARIGHPEAGRIELRVNGALRQEGDLNQMIWKVPEMISVLSRHFALAAGDVILTGTPSGVGAVQRGDVMEASIDGLGSLRVEVV

SEQ ID NO: 2067 - DNA, 759 bp, Burkholderia sp. 383
  CDS (1)..(759): transl_table=11
atgccggcccgtgcgccgcacgggcgcggcatccgtcttcccaccgaacgaggccatccgatgtccgcttatgtcatcgacgctgccgagcgtccttccgtcgaagtcgaacagtcgtccgcgcgctttccggtgcgccgcgtcttctgtgtcggccgcaactacgccgaccacgcgcgcgaaatgggcgccgatcccgaccgcgaaccgccgttcttcttcacgaagccggccgacgcgatcgtcccggccagcggcaccgtcgcctatccgccgctgacgaacgaccttcatcacgaaatcgagctggtcgtcgcgatcggcaaggacggccgggcgatcgacccggccgacgcgctgtcgcacgtgtggggctacggcgtcggcatcgacctcacgcgccgcgacctgcaggccgaagcgaagaagctgagccgtccgtgggactgggcgaagggtttcgacgcatcgggccccgtgaccgcgctgcgcgcggcgtccgctaccggccacccggcgacgggccgcatctggctcgcagtgaacggcgacacgcgccagcaaggcgacctggccgacatgatctgggccgtgcccgacgtcatcgcgtatgtgtcgcgctcggtcgagctgaaggccggcgacctgatcttcaccggcacgccggctggcgtcggtgcgctgcagcccggtgaccgcgtcacgggcggcgtcgacggcgtcgcgacgttcgagttcgtcgtgggcgcaaagccgtaa

SEQ ID NO: 2068 - protein, 252 aa, Burkholderia sp. 383
MPARAPHGRGIRLPTERGHPMSAYVIDAAERPSVEVEQSSARFPVRRVFCVGRNYADHAREMGADPDREPPFFFTKPADAIVPASGTVAYPPLTNDLHHEIELVVAIGKDGRAIDPADALSHVWGYGVGIDLTRRDLQAEAKKLSRPWDWAKGFDASGPVTALRAASATGHPATGRIWLAVNGDTRQQGDLADMIWAVPDVIAYVSRSVELKAGDLIFTGTPAGVGALQPGDRVTGGVDGVATFEFVVGAKP

SEQ ID NO: 2069 - DNA, 657 bp, Geobacter metallireducens GS-15
  CDS (1)..(657): transl_table=11
atgacgtttgccaccctggcaggaagcgccacggaataccccatcggcaagatcctctgcattggccgcaactatgcggaacacatcaaggaactggggaacgaaaccccggatgcgccggtcattttcaccaaacccgccacgtcggtcatcggtgatggcgacgccattgtgattcccccttactccagagactgccaccacgaagcggaactggcggtcctcatcgggacagcgggaaaagatatccccgttgaacgcgccctggaacacgtggccggctacggtgtcgccatcgacctgacgctacgggacgtgcaggccgagctcaagaagaaagggctcccctgggacatcgccaaggggttcgacaccgcctgccccctctctccttttgtgcctgccgaccgggtcgccgatccgcaagacctgcggattatcctgaccgtcaacggcgaaacgcgccaggacggctcaacctccctcatgatccacacggtccgcgagatcatcagccatatgtcggggatattcaccctggaaccgggggacgtgatcctcaccggaacccccgccggcgtcagccccattgtttcgggagatcgtctcgtggctgagataccgggtgttgcccggctccaggtctccgttaaataa

SEQ ID NO: 2070 - protein, 218 aa, Geobacter metallireducens GS-15
MTFATLAGSATEYPIGKILCIGRNYAEHIKELGNETPDAPVIFTKPATSVIGDGDAIVIPPYSRDCHHEAELAVLIGTAGKDIPVERALEHVAGYGVAIDLTLRDVQAELKKKGLPWDIAKGFDTACPLSPFVPADRVADPQDLRIILTVNGETRQDGSTSLMIHTVREIISHMSGIFTLEPGDVILTGTPAGVSPIVSGDRLVAEIPGVARLQVSVK

SEQ ID NO: 2071 - DNA, 705 bp, Burkholderia thailandensis E264
  CDS (1)..(705): transl_table=11
atgaccgattacgttttcgcgccgcccgccgttccgtccgtcgaagtcgccggctgcgccgcgcgctttccggtgcgccgcgtgttctgcgtcggccgcaactatgcggaccacgcgcgcgagatgggcgccgatccgaaccgcgagccgccgttcttcttcacgaagccggccgatgcgatcgtgcccgcgagcggcacggtgccgtatccgacgctcacgtccgacctgcatcacgagatcgagctcgtgatcgcgatcggccgaggcgggcgcgcgatcgccgccgacgcggcgctcgatcacgtgtggggctacggcgtcggcgtcgacctgacgcggcgcgacctgcaagcccaggcgaagaaggccggccggccgtgggactgggcgaagggcttcgacgcgtcgggcccgctgacggcgctccatccggccgcatccgtcggtcatccgctgcgcggccggatctggctcgcggtcaacggcgacatgcgccagcaaggcgacctcgccgacatgatctggccgattcccgacgtgatcgcgtatgcgtcgcgcgcggtcgagctgcgcgcgggcgacctgatcttcaccggcacgccggcgggcgtcgccgcgctgcagccgggcgatcgcgtgacgggcggcgtcgacggcgtcgcgtcgttcgagttcgtcgtcggggaaaagccggccgcgtga

SEQ ID NO: 2072 - protein, 234 aa, Burkholderia thailandensis E264
MTDYVFAPPAVPSVEVAGCAARFPVRRVFCVGRNYADHAREMGADPNREPPFFFTKPADAIVPASGTVPYPTLTSDLHHEIELVIAIGRGGRAIAADAALDHVWGYGVGVDLTRRDLQAQAKKAGRPWDWAKGFDASGPLTALHPAASVGHPLRGRIWLAVNGDMRQQGDLADMIWPIPDVIAYASRAVELRAGDLIFTGTPAGVAALQPGDRVTGGVDGVASFEFVVGEKPAA

SEQ ID NO: 2073 - DNA, 771 bp, Silicibacter sp. TM1040
  CDS (1)..(771): transl_table=11
atgcacagcaatgcttggccttcgggggcgaagcctctatctcttttggtgacaaagagaaaaggaccgcccatgcccgccgcgcagcccgactatgtgattgctccgcccccacagcccgccctgccaattgccgagagcaccgccctgtttcccgtgcgcagggtctattgcatcgggcgcaattatgccgcgcacgcggtcgagatgggacatgacccggatcgcgagccgccgttctttttccagaaaacgcccgacagtctcgatgcttcggggcgctttccctacccggtgatgagcgaagacgtccatcacgaagcagagcttttggtggcgctcggcaaaggcggcgagaatatctctgaggatgccgcgcttgatcatgtctggggctatgggctggcgcttgatatgacccgtcgcgatctgcaggggatcgccaaaaaagcgggccggccttgggaaattgggaaatcctttgaacatgcggccccggttgcgccgttaacgccggccacgacgatcgggcatcccgacgcgggtgtgatgacgctcaccgtgaatggaacgccgcgccagcagggggatctcaatcagatgatctggaagatccccgaaatgatcgcgcatctttcgcagtattacaggctggcggcgggggatgtgatcctcacgggtacgcctgcgggtgttggcccggttctgcgcggtgaccagcttgagctcactttcgacggcctgaccccgcttcgggttctggtggagtga

SEQ ID NO: 2074 - protein, 256 aa, Silicibacter sp. TM1040
MHSNAWPSGAKPLSLLVTKRKGPPMPAAQPDYVIAPPPQPALPIAESTALFPVRRVYCIGRNYAAHAVEMGHDPDREPPFFFQKTPDSLDASGRFPYPVMSEDVHHEAELLVALGKGGENISEDAALDHVWGYGLALDMTRRDLQGIAKKAGRPWEIGKSFEHAAPVAPLTPATTIGHPDAGVMTLTVNGTPRQQGDLNQMIWKIPEMIAHLSQYYRLAAGDVILTGTPAGVGPVLRGDQLELTFDGLTPLRVLVE

SEQ ID NO: 2075 - DNA, 666 bp, Pseudomonas aeruginosa UCBPP-PA14
  CDS (1)..(666): transl_table=11
atgagttaccagcatcaatatatcgacggcaccccgatccacttccccctgggcaagctggtctgcgtcgggcgcaactacgccgaacacgccaaggaactgaacaacccggttcccaccgagccgctgctgttcatcaagcccggctcctgcgtggtgccggtgagcggcgggctgagcctgccgcaggagcgcggctcggtacactacgaggcggaaatcgccgtgctgatcggcaagccgctgtcgcgcaagccgaaccgcgaggaggtcctcgacgcgatctccggctatgcgccggcgctggacctgaccttgcgcgaggtccaggcgaaactgaaggaaaagggcctgccctgggagctggcaaagagcttcgatggcgccggcgtgctgtcgccgttcgtgaacgccgaccagttccccgacccgaccgacatcggcatccgcctgaccatcaacggcgaggtgcgccaggacggcaacagccgcgacatgctcaatccgatcgtgccgctgatccagcacatcgccgggcatttctcgctacaggccggcgatgtggtgctgaccggcacgccgtccggggtcgggccgctgaacagcggcgacgagttgctgctcgaattgccgggcgccagccgtttcgagacccgcgtgctctga

SEQ ID NO: 2076 - protein, 221 aa, Pseudomonas aeruginosa UCBPP-PA14
MSYQHQYIDGTPIHFPLGKLVCVGRNYAEHAKELNNPVPTEPLLFIKPGSCVVPVSGGLSLPQERGSVHYEAEIAVLIGKPLSRKPNREEVLDAISGYAPALDLTLREVQAKLKEKGLPWELAKSFDGAGVLSPFVNADQFPDPTDIGIRLTINGEVRQDGNSRDMLNPIVPLIQHIAGHFSLQAGDVVLTGTPSGVGPLNSGDELLLELPGASRFETRVL

SEQ ID NO: 2077 - DNA, 666 bp, Pseudoalteromonas tunicata D2
  CDS (1)..(666): transl_table=11
atggaaaagtttgaatggttaaatgcgggcgaaatagccttggtacctgctaaagcggtttgtattgggcgaaattaccgtgaacatgctgcggaattaaataatgcagtccccgatagcccgatgttattcatcaaaccaagcagtagttttgttgcattcaaagggcaaataccattagcgcagcgtttgggtgagcatcattatgaagctgagcttgcattgttaattggtcaaactattagtgcttcaactgaattagatttgcagcagcaagttataggaattggagttgcgatggatttaaccttaaggaatgtgcaggctgaacttaaaagcaaaggacatccgtgggaaaaagctaaagcttatgataatagttgtattgtaagtccttttattcaaatcactgagcagacagatttcaacaatctcgaatttaacctctctattaataatgaaatacgccagattggacacacttctgagatggttttttcgatagttcaattacttgatgagattcgccaatattttactcttcaacctggtgatatcgtacttaccgggacaccaaaaggagttggtaagcttaactctggtgatcaacttgtcgttacgttgcaaaaaaacacattggcctcaggccaaattttgttggtataa

SEQ ID NO: 2078 - protein, 221 aa, Pseudoalteromonas tunicata D2
MEKFEWLNAGEIALVPAKAVCIGRNYREHAAELNNAVPDSPMLFIKPSSSFVAFKGQIPLAQRLGEHHYEAELALLIGQTISASTELDLQQQVIGIGVAMDLTLRNVQAELKSKGHPWEKAKAYDNSCIVSPFIQITEQTDFNNLEFNLSINNEIRQIGHTSEMVFSIVQLLDEIRQYFTLQPGDIVLTGTPKGVGKLNSGDQLVVTLQKNTLASGQILLV

SEQ ID NO: 2079 - DNA, 663 bp, Oceanospirillum sp. MED92
  CDS (1)..(663): transl_table=11
atgggatatcaacatcgttatcaagatgggtcatcagctggattgccaacagggaaagttatctgtgtagggcgtaactatgcggatcatgcagctgaactgaataatccaatcccgaccgagccgatgttatttatcaagccttctacctgcgttgtggatatggctgagccttttaaggtgcctcaggatcatggtgaggtgcactttgaaacggagatggcgatcctgatcggtaaacagctgacccatgcaagcgaagctgaagcggcggcagccattgttggtgtaggtttggggttagatctaaccttgcgcgaactacaggggcgtcttaaggaaaaaggccatccatgggagaaatcaaaagcctttgatggttcttgtccgctctctgcatttgtaacagcggatcaaataacagacctacaggatgttgagattcggttgtttgtaaatgacgagttacgtcaacaaggtaatagcgctttgatgttgaacagggtgctaccgctcattagtcatactagtgagtttttcacgcttgagcctggtgatgtgattctgacaggaacgcctgcaggtgttggtccagtaaaggcgggtgatcagttgcaggttgaacttgctgatcttattgccatctcgactgaagcgatctaa

SEQ ID NO: 2080 - protein, 220 aa, Oceanospirillum sp. MED92
MGYQHRYQDGSSAGLPTGKVICVGRNYADHAAELNNPIPTEPMLFIKPSTCVVDMAEPFKVPQDHGEVHFETEMAILIGKQLTHASEAEAAAAIVGVGLGLDLTLRELQGRLKEKGHPWEKSKAFDGSCPLSAFVTADQITDLQDVEIRLFVNDELRQQGNSALMLNRVLPLISHTSEFFTLEPGDVILTGTPAGVGPVKAGDQLQVELADLIAISTEAI

SEQ ID NO: 2081 - DNA, 669 bp, marine gamma proteobacterium HTCC2207
  CDS (1)..(669): transl_table=11
atgtcagattacattcatatagtcgatggcgtgtccgcgtcattgcctctgggtaaggttgtctgtgtcggcagaaactatgccgaacatgcaagagagctcaataatcccgttccctcagaaccggtgctgtttattaagccgagcacagccctgactagcctagatggacctgtggcaattcccaccgcctggggcgcctgtcactttgaaaccgagatgacccttttaattggccagcgtctagccaactgtactgagcagcaggcagccgaagccattgtcggcattggcattgcgcttgatttaaccctgcgtgatttacagtctgagctgaaacagaaaagtctgccttgggaaaaagccaagtcatttgatggcgcctgtcccacatctacctttattaaagtgccggttttagaattgcagaatcagcggattcagttgcgtcaaaatggtgagttaaagcaggatggcaatagttccgatatgctcacaccagtgttgcctctgctggcctatataagtcagtttttcactctgcaaccgggtgatattgtactcacgggcacccccgccggggttggacctttggcactgggcgatgagctgcagttgagtttatcgaataaaattgacctctccaccactataatagaaagacattaa

SEQ ID NO: 2082 - protein, 222 aa, marine gamma proteobacterium HTCC2207
MSDYIHIVDGVSASLPLGKVVCVGRNYAEHARELNNPVPSEPVLFIKPSTALTSLDGPVAIPTAWGACHFETEMTLLIGQRLANCTEQQAAEAIVGIGIALDLTLRDLQSELKQKSLPWEKAKSFDGACPTSTFIKVPVLELQNQRIQLRQNGELKQDGNSSDMLTPVLPLLAYISQFFTLQPGDIVLTGTPAGVGPLALGDELQLSLSNKIDLSTTIIERH

SEQ ID NO: 2083 - DNA, 624 bp, Oceanobacter sp. RED65
  CDS (1)..(624): transl_table=11
gtgggcaaggttgtttgtgttgggcgcaattatgctgaacatgcgaaagaattggggaatgaaatacccgctgagccgattttattcatgaaaccggcgacaagtttagtagcgctagagccaagttttactatcccaacgcatcaaggcagtgtgcaccatgaattggaaattgcacttttgatcggtgaaaccgcgaagaatatcgaggcaaagagtgcgtggcgtatggtcagccatgtgggtttagcgttggatttaacattaagagatgtgcagaccaaactaaaagaaaaatcccacccatgggaaatcgcgaaggccttcgatggtgcctgtccgatatctaaatggttaccgttaagtgatattgttaatcgtaacgatatggaaatttctttgtacaagaatggacagctacagcaaaatggtcgttcgacgcaaatgctcaacgacatcccaagactgcttagttacatgagtgaatatttctctttgcagccaggcgatgtcattctcactggcacgcctgctggtgttggtcctttgcatgtggaagacgaattaactttgatgttggatgataagctgcgctgctctgcaaaagtgaaccaagcgcagtaa

SEQ ID NO: 2084 - protein, 207 aa, Oceanobacter sp. RED65
MGKVVCVGRNYAEHAKELGNEIPAEPILFMKPATSLVALEPSFTIPTHQGSVHHELEIALLIGETAKNIEAKSAWRMVSHVGLALDLTLRDVQTKLKEKSHPWEIAKAFDGACPISKWLPLSDIVNRNDMEISLYKNGQLQQNGRSTQMLNDIPRLLSYMSEYFSLQPGDVILTGTPAGVGPLHVEDELTLMLDDKLRCSAKVNQAQ

SEQ ID NO: 2085 - DNA, 672 bp, marine gamma proteobacterium HTCC2143
  CDS (1)..(672): transl_table=11
gtgctgtttatggcggactacaagcatcaatttttgaatgagatcgcgtgtggcaaaacgctgggtaagattgtatgtgtcggtcgaaactatgctgaccacgctaaagagttgaataatccgattcccgaccggccgctgttatttattaagccatcgacggcagcagtcgatatgctgctgccgataaacatccctacagatcgtggctgctgtcatcacgaactggaaatggccgttcttataggcaaacgcagtagcagtgtgtctagcgttgaagcaaaggacgctattgttggagtgggtctgggacttgacctgacattgcgcgatttgcaagatgagttgaaagccaaaggcgagccatgggagcgagcgaaggcctttgatgggtcatgccccttgtcgccatttagcagcgtcggtgatattgatcaacaaaatcttaatattacgctgctgcgcaacggcactgtgcagcaatcaggaaacacccgagacatgttgtttcctgttgctgacttaatagcagatatcagccgcagttttaccctgcttcccggcgatattattttaactggcacacctgcgggcgtagggccattgtaccccggagataccattacagcgcagctgggtgacctagttaccgtgaatactacgattgtgtaa

SEQ ID NO: 2086 - protein, 223 aa, marine gamma proteobacterium HTCC2143
MLFMADYKHQFLNEIACGKTLGKIVCVGRNYADHAKELNNPIPDRPLLFIKPSTAAVDMLLPINIPTDRGCCHHELEMAVLIGKRSSSVSSVEAKDAIVGVGLGLDLTLRDLQDELKAKGEPWERAKAFDGSCPLSPFSSVGDIDQQNLNITLLRNGTVQQSGNTRDMLFPVADLIADISRSFTLLPGDIILTGTPAGVGPLYPGDTITAQLGDLVTVNTTIV

SEQ ID NO: 2087 - DNA, 666 bp, Pseudomonas putida GB-1
  CDS (1)..(666): transl_table=11
atgagttaccagcaccagtacgtagacggcacgcgcattcacttcccgctgggcaaggtggtgtgcatcggccgtaactatgccgagcatgccaaggaactggacaacccgatccccaccgaaccgctgctgttcatcaagccaggcagctgtgtggtgccggccgaaggcggcttcaagatcccggccgagcggggttcggtgcactacgaggccgaaattgccgtgctgctgggcaagccgctgtcggcccacccgagcgaggaagaggtgctggatgccatttccggctacgccccggcgctggacctgaccctgcgcgacgtgcaggccaaactgaaagagaagggcctgccgtgggaactggccaagtgctttgacggggcctgcgtactgccgccgttcgtctcggccgccagtttcgaggatgtcaccgacatcccggtgcgcctgaccgtcaacggcgaagtgcgtcaggacggcaacagcgcgatgatgctgaacccgatcgtgccgatgatccagtacatggcggcgcatttttcgctgcaggcgggggatgtgatcctcaccggtaccccggcgggtgtggggccgttcaatgtcggtgacgagctggtgctggagctgccgggtgtcagccgcttcgaaagccgagtgttctga

SEQ ID NO: 2088 - protein, 221 aa, Pseudomonas putida GB-1
MSYQHQYVDGTRIHFPLGKVVCIGRNYAEHAKELDNPIPTEPLLFIKPGSCVVPAEGGFKIPAERGSVHYEAEIAVLLGKPLSAHPSEEEVLDAISGYAPALDLTLRDVQAKLKEKGLPWELAKCFDGACVLPPFVSAASFEDVTDIPVRLTVNGEVRQDGNSAMMLNPIVPMIQYMAAHFSLQAGDVILTGTPAGVGPFNVGDELVLELPGVSRFESRVF

SEQ ID NO: 2089 - DNA, 758 bp, Arachis hypogaea
  CDS (20)..(691)
gggagttgcttggcggaaaatggcagcagcctgtgagaagcttctgcaactgagcaccacgatcgtcgccgctggcagaaactacgctgcccatgctaaagaattaggcaacgccgttcccaaggagccggtgttgtttctgaagccaacttcctcctacttgccaaatggcggaacaattcaaatcccacacaatgagggatctctgcatcatgaggtcgagctggctgtcgtcatcgccaaaaaagctcgtgatgtcccccaatcatctgccatgcattatgttgctggttatgcacttgcactggatatgactgccagggatctgcaagctactgcaaagtctgcaggtcttccatggactttggcaaaaggccaggacactttcacaccaattagttcaattttgccaaagaatctggtgccaaacccggatgatctagaattgtggttaaaggtagatgaggagattcggcaaaagggctcaaccaaggacatgatctttaagatcccatttataattagtcacataagttctgtcatgacattgtttgaaggagatgtgatactaactggcactcctccaggtgttggccctgtgaaagaaggtcaaacaataaccgccggcattacaggccttgtcgacgtgcaattcaatgttgaaaaaagaaaaaagccttcaagctcttgatatgttgtgcttttgattaccccaggaggtgcttcaattctgcagcaaccagcatggcatccccttg

SEQ ID NO: 2090 - protein, 223 aa, Arachis hypogaea
MAAACEKLLQLSTTIVAAGRNYAAHAKELGNAVPKEPVLFLKPTSSYLPNGGTIQIPHNEGSLHHEVELAVVIAKKARDVPQSSAMHYVAGYALALDMTARDLQATAKSAGLPWTLAKGQDTFTPISSILPKNLVPNPDDLELWLKVDEEIRQKGSTKDMIFKIPFIISHISSVMTLFEGDVILTGTPPGVGPVKEGQTITAGITGLVDVQFNVEKRKKPSSS

SEQ ID NO: 2091 - DNA, 702 bp, Escherichia coli
  CDS (1)..(702): transl_table=11
atgactcaatatgtattcgaaccacaagcgcccgttaccgtaccggttgttggcagtgataaacaattccccgtgcgtcgcgtttactgcgtcgggcgtaactatgccgcccacgcccgcgaaatgggctttgatccggatcgtgaaccacccttcttcttctgcaaaccagcagatgccgttattccggtcgccgctggcgaaacgctggcgctgccatatccggcgcagaccgataactatcattacgaaattgaactggtagtggcgattggtaaaaaaggcagcgatatcccgctggaacacgcccatgaatatgtctggggttatgccacgggtcttgatatgactcggcgtgaccgtcaaatggaaatgcgccagatgggccgcccgtgggaaatcggtaaagcgtttgatctctcagcgcccatcgcgccgctgcacaaagcccgcgatatcggcggtattgataatgcgccaatctggttacaggttaacggcgaagatcatcagcgcagcgatattcgccatctcatctggtcggtgaatgaaaccatcagctatctgtcaggcttctttgagctgcaaccgggcgatctgatcttcaccggtacgccggaaggggttggcccggtagtgaaaggtgatgtgatcacaggcaacgtcgagggcttaacgcctatcgcggtgaagattgtctga

SEQ ID NO: 2092 - protein, 233 aa, Escherichia coli
MTQYVFEPQAPVTVPVVGSDKQFPVRRVYCVGRNYAAHAREMGFDPDREPPFFFCKPADAVIPVAAGETLALPYPAQTDNYHYEIELVVAIGKKGSDIPLEHAHEYVWGYATGLDMTRRDRQMEMRQMGRPWEIGKAFDLSAPIAPLHKARDIGGIDNAPIWLQVNGEDHQRSDIRHLIWSVNETISYLSGFFELQPGDLIFTGTPEGVGPVVKGDVITGNVEGLTPIAVKIV

SEQ ID NO: 2093 - DNA, 672 bp, Arabidopsis thaliana
  CDS (1)..(672)
atggcgacgtcgatgatacagaggatgttcaagcaagggacgaagatcgtctgcgtcggccgtaactacgccgctcacgccaaagaactaggcaacgccgtccccaaggaaccagttatattcttgaagccaacatcatcatacttagaaaatggaggaacaattgagatcccacatcctttggattcacttcaccatgaagtagaactcgctttagtgattggacagaaagctagagatgtacctgaatcaatagccatggattacattggaggatatgcggttgctcttgatatgactgctagggaactccaagcttctgctaaggcatctggtctcccatggacggttgcgaaaggacaagataccttcactcctatcagctctgttctgccaaaggcgatggtgcgtgatcccgataatctagaactttggctcaaggttgatggtgaaacaagacagaagggtttgaccaaagatatgatattcaaggtcccctacctcattagctacataagttctataatgaccctttacgaaggagatgtcatcttgacaggcacaccagaaggtgttggacctgtaaagataggtcagaagataacggccggaatcaccggtctatctgaagttcaattcgatgtggagaggcgtgtaaagcccttgagctaa

SEQ ID NO: 2094 - protein, 223 aa, Arabidopsis thaliana
MATSMIQRMFKQGTKIVCVGRNYAAHAKELGNAVPKEPVIFLKPTSSYLENGGTIEIPHPLDSLHHEVELALVIGQKARDVPESIAMDYIGGYAVALDMTARELQASAKASGLPWTVAKGQDTFTPISSVLPKAMVRDPDNLELWLKVDGETRQKGLTKDMIFKVPYLISYISSIMTLYEGDVILTGTPEGVGPVKIGQKITAGITGLSEVQFDVERRVKPLS

SEQ ID NO: 2095 - DNA, 780 bp, Saccharomyces cerevisiae
  CDS (1)..(780)
atgagctacaattatttgaaggcagctagaaaaattatatgcattgggcgtaattacgcagcgcatatcaaagagctgaacaattcaactccaaaacaaccgttttttttcctaaaaccaacctcgagtattgtgacaccattgtcttcatcattggtcaagaccactagacctgcaaactcgactttcaatggtttaaatgaagacggaactaaccccgggcccatttttatcccacgcggtgtgaaggttcatcacgaaattgagttggcattgattgtgagcaaacatttgtccaatgtcactaagatgaaacccgaagaagtctatgactctattagtggtgtagctctagcattggatcttacagcaagaaatgtccaagatgaagccaaaaagaaggggctaccttggactataagcaagggttttgacaccttcatgccaatctctgctatagtctcccgcgagaagttctcatcctacaaatcaaacttacaggatattttcagagtcaagtgctctgttaacggacagttgagacaagatggtggtactaacctcatgttgcacccactccataaaatactgcaacacatatctaccatgatatctctggaaccgggtgatatcattttgactggtacacctgcaggtgtaggcgagttaaagcctggtgaccgtgttcactgtgagctattgcagaataatgacaatattgtcgacatgaacttcgaatgtgaaaatcggccgggaccatatgaatttagagaaacataa

SEQ ID NO: 2096 - protein, 259 aa, Saccharomyces cerevisiae
MSYNYLKAARKIICIGRNYAAHIKELNNSTPKQPFFFLKPTSSIVTPLSSSLVKTTRPANSTFNGLNEDGTNPGPIFIPRGVKVHHEIELALIVSKHLSNVTKMKPEEVYDSISGVALALDLTARNVQDEAKKKGLPWTISKGFDTFMPISAIVSREKFSSYKSNLQDIFRVKCSVNGQLRQDGGTNLMLHPLHKILQHISTMISLEPGDIILTGTPAGVGELKPGDRVHCELLQNNDNIVDMNFECENRPGPYEFRET

SEQ ID NO: 2097 - DNA, 666 bp, Schizosaccharomyces pombe
  CDS (1)..(666)
atgttgtcacgggccggcaaggttgtttgtattggaagaaactatgctgctcacattcgtgagttgaacaaccccttccccaccaaacctttctttttccttaaacctactagtgccattgttgaacctggccatggaaacttaataattcctcccgatgtatctgctcattatgaagttgaactaggattgataatgaaggatcgcctgcctgccagacgtccagtatcttccaatagctggctcgattcaattggagcctactttgtaggaatcgatatgaccgctagaaacatacaaaatgaagcgaagaaaaaaggtctcccttggtccttcgcgaaaggttatgacacctttttacccgttggccccatcattcctaagcatcttatacctgatccccacaatgtcattctggaattgtcacttaacggcaaggtggtccagaaggacagtacatctctgatgttaaacaagattcctaaaatattctcgtcaatcactgaggccatgtccttgaatcctggtgatttggtgctaacaggtactccaaagggcgttggtcctgtggtaccgggagatattttgtctgctcggttgcttactgcgcaggagcaggaaataattcctagtaaatttgaaatcaaagcagagaaatgtgattaa

SEQ ID NO: 2098 - protein, 221 aa, Schizosaccharomyces pombe
MLSRAGKVVCIGRNYAAHIRELNNPFPTKPFFFLKPTSAIVEPGHGNLIIPPDVSAHYEVELGLIMKDRLPARRPVSSNSWLDSIGAYFVGIDMTARNIQNEAKKKGLPWSFAKGYDTFLPVGPIIPKHLIPDPHNVILELSLNGKVVQKDSTSLMLNKIPKIFSSITEAMSLNPGDLVLTGTPKGVGPVVPGDILSARLLTAQEQEIIPSKFEIKAEKCD

SEQ ID NO: 2099 - DNA, 660 bp, Brassica napus
  CDS (1)..(660)
atggcgacgtcgaagatagagaggcagttcaagcaaggcaccaagatcgtcggcgtcagtcgcaactacgccgctcatgtcaacgcccttcccaaggaaccagttatattcttaaagccaacttcatcatacttggagaacggaggaacgattgagatcccacatcctctggattcactttatcatgaggtggagcttgctgtagtgatcgcaaagaaggctagagatgtacccgagtcaaccgccatggaatacgttggaggatatgcggttgctcttgatatgtccgctagggaaatccaagcttccgccaaggcatctggtctcccttggactcttggcaaaggacaggatactttcacaccaataggctctgttctgccaaaggcgatggtgcacgatcccgataatctggaactttggctgaaggttgatggtgaaacaagacaaaagggtttaacaaaagatatgatcttcaaggtcccgtaccttatcagctacataagttctttcatgactctctacgaaggagatgtcatcttgacaggtacaccagaaggtgttggacctgtaaagataggtcagaagataaccgcagggatcactggtctatctgaagttcagttcgatgttgataggcgtgtaaaacctctgagctaa

SEQ ID NO: 2100 - protein, 219 aa, Brassica napus
MATSKIERQFKQGTKIVGVSRNYAAHVNALPKEPVIFLKPTSSYLENGGTIEIPHPLDSLYHEVELAVVIAKKARDVPESTAMEYVGGYAVALDMSAREIQASAKASGLPWTLGKGQDTFTPIGSVLPKAMVHDPDNLELWLKVDGETRQKGLTKDMIFKVPYLISYISSFMTLYEGDVILTGTPEGVGPVKIGQKITAGITGLSEVQFDVDRRVKPLS

SEQ ID NO: 2101 - DNA, 687 bp, Hordeum vulgare
  CDS (1)..(687)
atggcagcagcggcggcgcagaggctccttgcggcgagcacgaagatcgtcggggccgggcgcaactacatctcccatgccaaagatctcggcaaccctgtcctcaaggaacccgtcctgttcctgaagcccacgtcgtcgtttctccacgctggcccgaccgccggccccatcgaggtgcccgagccgctcgagtcgctgcaccacgaggtcgagctcgccgtcgtcatctcccggcgcgcgcgcgatgtccccgaggcctccgccatggatttcgtcggaggttatgcacttgctttggacatgtcatcaaacgatctgcaatcagcttctaagtctgcaggtcttccttggacattgggtaaagtacaggacacctttactccaattagtgcggtggttccgaaatcagcgatcactaatccctatgatctagaactgtggctaaaggtagatggtgaacttaggcagaagggacttacaagtgatatgatattcaagattccttttctaatcagctatatcagttccatcatgacattaatggagggtgatgtgatattaactggtactccccccgatggtgtaggtcctgtccgagtaggacagaagattagtgctggtataactgacctcattgatgtagagttcgatgttcagagacgcaaacgttcattttctaactga

SEQ ID NO: 2102 - protein, 228 aa, Hordeum vulgare
MAAAAAQRLLAASTKIVGAGRNYISHAKDLGNPVLKEPVLFLKPTSSFLHAGPTAGPIEVPEPLESLHHEVELAVVISRRARDVPEASAMDFVGGYALALDMSSNDLQSASKSAGLPWTLGKVQDTFTPISAVVPKSAITNPYDLELWLKVDGELRQKGLTSDMIFKIPFLISYISSIMTLMEGDVILTGTPPDGVGPVRVGQKISAGITDLIDVEFDVQRRKRSFSN

SEQ ID NO: 2103 - DNA, 678 bp, Brassica napus
  CDS (1)..(678)
atggcgacttcgatgattcagaggatgttcaagcaaggcacgaagatcgtcggcgttggtctcaattacgcttcacacgccaaagagcttggcaacgcactcccaaaggacccgattgtgttcttaaagccaacctcttcctacttggaaaacggtggaacgattgagatcccacatcctctggactcacttcaccatgaggttgaactcgctgtagtgatcggacacaaggctagagatgtccctgaacgtttagccatggattacatcggaggatatgcgattgctcttgatatgactgctaaggaacaccacgtttctgccatggcatctggtctgccgtgtacacttgctaaagcacaggataccttcactcccatcagctctgttctaccaaaggcaatggtggttgatcccaataacctggaactctggcttaaggttgatgatgagataagacaaaagggttggacaaaggatatgatctacaaggtcccatacctcatcagctacataagttctgtaatgacccttttcaaaggagatgtcatcttgacaggtacaccagaagggataggacctgtaaagattggtcagaagataaccgctggaatcactggtctttctgaagttcagttcaatgtcggtaggcgtgtaaaaccattgttgaactcctag

SEQ ID NO: 2104 - protein, 225 aa, Brassica napus
MATSMIQRMFKQGTKIVGVGLNYASHAKELGNALPKDPIVFLKPTSSYLENGGTIEIPHPLDSLHHEVELAVVIGHKARDVPERLAMDYIGGYAIALDMTAKEHHVSAMASGLPCTLAKAQDTFTPISSVLPKAMVVDPNNLELWLKVDDEIRQKGWTKDMIYKVPYLISYISSVMTLFKGDVILTGTPEGIGPVKIGQKITAGITGLSEVQFNVGRRVKPLLNS

SEQ ID NO: 2105 - DNA, 678 bp, Brassica napus
  CDS (1)..(678)
atggcgacttcgatgattcagaggatgttcaagcaaggcacgaagatcgtcggcgttggtctcaattacgcttcacacgccaaagagcttggcaacgcactcccaaaggacccgattgtgttcttaaagccaacctcttcctacttggaaaacggtggaacgattgagatcccacatcctctggactcacttcaccatgaggttgaactcgctgtagtgatcggacacaaggctagagatgtccctgaacgtttagccatggattacatcggaggatatgcgattgctcttgatatgactgctaaggaacaccacgtttctgccatggcatctggtctgccgtgtacacttgctaaagcacaggataccttcactcccatcagctctgttctaccaaaggcaatggtggttgatcccaataacctggaactctggcttaaggttgatgatgagataagacaaaagggttggacaaaggatatgatctacaaggtcccgtacctcatcagctacataagttctgtaatgacccttttcaaaggagatgtcatcttgacaggtacaccagaaggtataggacctgttaagattggtcagaagataaccgctggaatcactggtctttctgaagttcagtttagtgtcggtaggcgtgtaagaccattgttgagctcctag

SEQ ID NO: 2106 - protein, 225 aa, Brassica napus
MATSMIQRMFKQGTKIVGVGLNYASHAKELGNALPKDPIVFLKPTSSYLENGGTIEIPHPLDSLHHEVELAVVIGHKARDVPERLAMDYIGGYAIALDMTAKEHHVSAMASGLPCTLAKAQDTFTPISSVLPKAMVVDPNNLELWLKVDDEIRQKGWTKDMIYKVPYLISYISSVMTLFKGDVILTGTPEGIGPVKIGQKITAGITGLSEVQFSVGRRVRPLLSS

SEQ ID NO: 2107 - DNA, 675 bp, Glycine max
  CDS (1)..(675)
atggcagtggcaggttgtcagaagcttctggaactgagcaccaagatcgtcgctgttggcagaaactacgctgctcacgccaaggaattaggcaacgccgttcccaaggagccggtgttgtttctgaaaccgacgtcgtcttacttgaaaaacggcggaaccatccaaatcccacacaacgagggctctctgcatcacgaggttgagctcgctgtggtcatcgccaagaaagcacgtgacgtctccgaatcctctgcgatggattatgtcgccggttatgcactggctctggatatgactgctagggaccttcaagctgctgctaagtctgcaggtcttccatggagtttggcaaaaggccaggacactttcaccccaattagttctattttgccaaagactgcagtgccaaatcctgatgatctagaattatggttaaaggtagatgaggaaatacggcaaaagggctcaaccaaggacatgatctttaagatcccatttctaattagctacattagctctgtcatgacattgtttgaaggggatgtcatactaactggtactcccccgggtgttggccctgtcaaagagggtcaaacaattactgctggcgttacaggccttgtggacgtacagtttaatgttgaaaaaagagctaggcctgttctttcttga

SEQ ID NO: 2108 - protein, 224 aa, Glycine max
MAVAGCQKLLELSTKIVAVGRNYAAHAKELGNAVPKEPVLFLKPTSSYLKNGGTIQIPHNEGSLHHEVELAVVIAKKARDVSESSAMDYVAGYALALDMTARDLQAAAKSAGLPWSLAKGQDTFTPISSILPKTAVPNPDDLELWLKVDEEIRQKGSTKDMIFKIPFLISYISSVMTLFEGDVILTGTPPGVGPVKEGQTITAGVTGLVDVQFNVEKRARPVLS

SEQ ID NO: 2109 - DNA, 675 bp, Glycine max
  CDS (1)..(675)
atggcagcggcaggttgtcagaagcttctggaattgagcacgaagatcgtcgctgttggcagaaactacgctgctcatgccaaagaactaggcaacgccgttcccaaggagccggtgttgtttctgaaaccgacgtcgtcttacttgagtaacggcggaaccattcaaatcccacacaacgagggctctctgcatcacgaggttgagctcgctgtggtcatctccaagaaagcccgtgacgtctccgaatcctctgccatggattacgtcgccggttatgcactggctctggatatgactgctagggaccttcaagctgctgctaagtctgcaggtcttccatggagtttggcaaaaggccaggacactttcacccctattagctctattttgccaaagactacagtgccgaatcccgatgatctagaattatggttaaaggttgacgaggaaattcggcaaaagggctcaaccaaggacatgatatttaagatcccatttctgattagctacgtaagctctgtcatgacattgtttgaaggagatgtcatactaactggtactcccccgggtgttggccctgtgaaagagggtcaaacaattactgctggtattacaggccttgtggacgtacagtttaatgttgaaaaaagagctaggcctgttctttcttga

SEQ ID NO: 2110 - protein, 224 aa, Glycine max
MAAAGCQKLLELSTKIVAVGRNYAAHAKELGNAVPKEPVLFLKPTSSYLSNGGTIQIPHNEGSLHHEVELAVVISKKARDVSESSAMDYVAGYALALDMTARDLQAAAKSAGLPWSLAKGQDTFTPISSILPKTTVPNPDDLELWLKVDEEIRQKGSTKDMIFKIPFLISYVSSVMTLFEGDVILTGTPPGVGPVKEGQTITAGITGLVDVQFNVEKRARPVLS

SEQ ID NO: 2111 - DNA, 675 bp, Glycine max
  CDS (1)..(675)
atggcagcggcaggttgtcagaagcttctggaattgagcacgaagatcgtcgctgttggcagaaactacgctgctcatgccaaagaactaggcaacgccgttcccaaggagccggtgttgtttctgaaaccgacgtcgtcttacttgagtaacggcggaaccattcaaatcccacacaacgagggctctctgcatcacgaggttgagctcgctgtggtcatctccaagaaagcccgtgacgtctccgaatcctctgccatggattacgtcgccggttatgcactggctctggatatgactgctagggaccttcaagctgctgctaagtctgcaggtcttccatggagtttggcaaaaggccaggacactttcacccctattagctctattttgccaaagactacagtgccgaatcccgatgatctagaattatggttaaaggttgacgaggaaattcggcaaaagggctcaaccaaggacatgatatttaagatcccatttctaattagctacattagctctgtcatgacattgtttgaaggggatgtcatactaactggtactcccccgggtgttggccctgtcaaagagggtcaaacaattactgctggcgttacaggccttgtggacgtacagtttaatgttgaaaaaagagctaggcctgttctttcttga

SEQ ID NO: 2112 - protein, 224 aa, Glycine max
MAAAGCQKLLELSTKIVAVGRNYAAHAKELGNAVPKEPVLFLKPTSSYLSNGGTIQIPHNEGSLHHEVELAVVISKKARDVSESSAMDYVAGYALALDMTARDLQAAAKSAGLPWSLAKGQDTFTPISSILPKTTVPNPDDLELWLKVDEEIRQKGSTKDMIFKIPFLISYISSVMTLFEGDVILTGTPPGVGPVKEGQTITAGVTGLVDVQFNVEKRARPVLS

SEQ ID NO: 2113 - DNA, 684 bp, Zea mays
  CDS (1)..(684)
atggcggctgcggcggcgcagaagctcctcgaggcgagcacgaagatcatcggcgtcgggcgcaactacatcgcccacgccgaggagctcggcaacccgatccccaaggagcccgtactattcctgaagccgacctcgtcgttcctccacgctggcgtggccaccgccgccgtcgagatcccggagccgctcgaatcgctacaccacgaagtcgagctcgccgtcgtcatctcccggcgtgggcgtgacattcctgaagcgtccgccatggacttcgtcggaggctatgcacttgctttggacatgacagcaaggggccttcaatctgttgctaagtctgcaggccttccatggactttggctaaagggcaagacaccttcactccaattagtgcagtagttccaaaatcatctgtcactaatcccgacgatctcgagctatggctaaaggtagatgatgaactaaggcagaaaggatcgacaagtgacatgatattcaagattccttttctgatcagctatatcagctccatcatgacattaatggagggtgatgtgatactaacaggtactcctgagggtgtgggtcctgtgcgagtaggtcagaagatcaaagctggtataactgacctaattgatgtcgagttcgatgttcagaggcgcaaccggtcattttccacatga

SEQ ID NO: 2114 - protein, 227 aa, Zea mays
MAAAAAQKLLEASTKIIGVGRNYIAHAEELGNPIPKEPVLFLKPTSSFLHAGVATAAVEIPEPLESLHHEVELAVVISRRGRDIPEASAMDFVGGYALALDMTARGLQSVAKSAGLPWTLAKGQDTFTPISAVVPKSSVTNPDDLELWLKVDDELRQKGSTSDMIFKIPFLISYISSIMTLMEGDVILTGTPEGVGPVRVGQKIKAGITDLIDVEFDVQRRNRSFST

SEQ ID NO: 2115 - DNA, 684 bp, Zea mays
  CDS (1)..(684)
atggcggctgcggcggcgcagaggctcctcgcggcgagcacgaaaatcatcggcgttgggcgcaactacatagcccacgccaaggagctcggcaatccggtccccaaggagcccgtcctgttcctgaagccgacctcgtcgtttctccacgctggtgtggccaccgccgccgtcgagatcccggagccgctcgagtcgctacaccacgaggtcgagctcgccgtcgtcatctcccggcgtgggcgcgacgttcccgaggcgtccgccatggactttgttggaggttatgcacttgctttggacatgacagcaagggaccttcagtctgttgctaagtctgcaggccttccatggactttggctaaaggacaagacaccttcaccccaattagtgcagtagttccaaaatcagctgtcactaatcccgatgatctcgagctctggctgaaggtagatgatgaactaaggcagaaaggaccgacaagcgacatgctattcaagattccttttctgataagctatatcagttccatcatgacattaatggagggtgatgtgatactaacaggtactcctgagggtgtgggtcctgtccgagtaggtcagaagattacagctggtataactgacctaattgatgttgagttcgatgttcagaggcgcaatcggtcattttccacatga

SEQ ID NO: 2116 - protein, 227 aa, Zea mays
MAAAAAQRLLAASTKIIGVGRNYIAHAKELGNPVPKEPVLFLKPTSSFLHAGVATAAVEIPEPLESLHHEVELAVVISRRGRDVPEASAMDFVGGYALALDMTARDLQSVAKSAGLPWTLAKGQDTFTPISAVVPKSAVTNPDDLELWLKVDDELRQKGPTSDMLFKIPFLISYISSIMTLMEGDVILTGTPEGVGPVRVGQKITAGITDLIDVEFDVQRRNRSFST

SEQ ID NO: 2117 - DNA, 696 bp, Zea mays
  CDS (1)..(696)
atgccggcggccatggcggctgcggcggcgcagaggctcctcgcggcgagcacgaaaatcatcggcgttgggcgcaactacatagcccacgccaaggagctcggcaatccggtccccaaggagcccgtcctgttcctgaagccgacctcgtcgtttctccacgctggtgtggccaccgccgccgtcgagatcccggagccgctcgagtcgctacaccacgaggtcgagctcgccgtcgtcatctcccggcgtgggcgcgacgttcccgaggcgtccgccatggactttgttggaggttatgcacttgctttggacatgacagcaagggaccttcagtctgttgctaagtctgcaggccttccatggactttggctaaaggacaagacaccttcaccccaattagtgcagtagttccaaaatcagctgtcactaatcccgatgatctcgagctctggctgaaggtagatgatgaactaaggcagaaaggaccgacaagcgacatgctattcaagattccttttctgataagctatatcagttccatcatgacattaatggagggtgatgtgatactaacaggtactcctgagggtgtgggtcctgtccgagtaggtcagaagattacagctggtataactgacctaattgatgttgagttcgatgttcagaggcgcaatcggtcattttccacatga

SEQ ID NO: 2118 - protein, 231 aa, Zea mays
MPAAMAAAAAQRLLAASTKIIGVGRNYIAHAKELGNPVPKEPVLFLKPTSSFLHAGVATAAVEIPEPLESLHHEVELAVVISRRGRDVPEASAMDFVGGYALALDMTARDLQSVAKSAGLPWTLAKGQDTFTPISAVVPKSAVTNPDDLELWLKVDDELRQKGPTSDMLFKIPFLISYISSIMTLMEGDVILTGTPEGVGPVRVGQKITAGITDLIDVEFDVQRRNRSFST

SEQ ID NO: 2119 - DNA, 696 bp, Zea mays
  CDS (1)..(696)
atgccggcggccatggcggctgcggcggcgcagaggctcctcgcggcgagcacgaaaatcatcggcgttgggcgcaactacatagcccacgccaaggagctcggcaatccggtccccaaggagcccgtcctgttcctgaagccgacctcgtcgtttctccacgctggtgtggccaccgccgccgtcgagatcccggagccgctcgagtcgctacaccacgaggtcgagctcgccgtcgtcatctcccggcgcgggcgcgacgttcccgaggcgtccgccatggactttgttggaggttatgcacttgctttggacatgacagcaagggaccttcagtctgttgctaagtctgcaggccttccatggactttggctaaaggacaagacaccttcaccccaattagtgcagtagttccaaaatcagctgtcactaatcccgatgatctcgagctctggctgaaggtagatgatgaactaaggcagaaaggaccgacaagcgacatgctattcaagattccttttctgataagctatatcagttccatcatgacattaatggagggtgatgtgatactaacaggtactcctgagggtgtgggtcctgtccgagtaggtcagaagattacagctggtataactgacctaattgatgttgagttcgatgttcagaggcgcaatcggtcatttttcacatga

SEQ ID NO: 2120 - protein, 231 aa, Zea mays
MPAAMAAAAAQRLLAASTKIIGVGRNYIAHAKELGNPVPKEPVLFLKPTSSFLHAGVATAAVEIPEPLESLHHEVELAVVISRRGRDVPEASAMDFVGGYALALDMTARDLQSVAKSAGLPWTLAKGQDTFTPISAVVPKSAVTNPDDLELWLKVDDELRQKGPTSDMLFKIPFLISYISSIMTLMEGDVILTGTPEGVGPVRVGQKITAGITDLIDVEFDVQRRNRSFFT

SEQ ID NO: 2121 - DNA, 25 bp, Artificial sequence
  primer
atgtatcaacatcacaactggcaag

SEQ ID NO: 2122 - DNA, 25 bp, Artificial sequence
  primer
ttacaaaacgcgagttgtcaaagaa

SEQ ID NO: 2123 - protein, 253 aa, Artificial sequence
  consensus sequence
  Variant (2)..(2): Xaa in position 2 is any amino acid
  Variant (3)..(27): Xaa in position 3 to 27 is any or no amino acid
  Variant (30)..(31): Xaa in position 30 to 31 is any amino acid
  Variant (33)..(33): Xaa in position 33 is any amino acid
  Variant (34)..(34): Xaa in position 34 is any or no amino acid
  Variant (36)..(41): Xaa in position 36 to 41 is any amino acid
  Variant (42)..(46): Xaa in position 42 to 46 is any or no amino acid
  Variant (48)..(49): Xaa in position 48 to 49 is any amino acid
  Variant (50)..(57): Xaa in position 50 to 57 is any or no amino acid
  Variant (59)..(59): Xaa in position 59 is any amino acid
  Variant (62)..(80): Xaa in position 62 to 80 is any amino acid
  Variant (81)..(106): Xaa in position 81 to 106 is any or no amino acid
  Variant (108)..(108): Xaa in position 108 is any amino acid
  Variant (110)..(110): Xaa in position 110 is any amino acid
  Variant (113)..(133): Xaa in position 113 to 133 is any amino acid
  Variant (134)..(138): Xaa in position 134 to 138 is any or no amino acid
  Variant (140)..(144): Xaa in position 140 to 144 is any amino acid
  Variant (146)..(146): Xaa in position 146 is any amino acid
  Variant (148)..(148): Xaa in position 148 is any amino acid
  Variant (150)..(151): Xaa in position 150 to 151 is any amino acid
  Variant (152)..(153): Xaa in position 152 to 153 is any or no amino acid
  Variant (155)..(156): Xaa in position 155 to 156 is any amino acid
  Variant (157)..(160): Xaa in position 157 to 160 is any or no amino acid
  Variant (162)..(162): Xaa in position 162 is any amino acid
  Variant (165)..(167): Xaa in position 165 to 167 is any amino acid
  Variant (169)..(170): Xaa in position 169 to 170 is any amino acid
  Variant (172)..(174): Xaa in position 172 to 174 is any amino acid
  Variant (176)..(199): Xaa in position 176 to 199 is any amino acid
  Variant (200)..(207): Xaa in position 200 to 207 is any or no amino acid
  Variant (209)..(214): Xaa in position 209 to 214 is any amino acid
  Variant (216)..(226): Xaa in position 216 to 226 is any amino acid
  Variant (228)..(231): Xaa in position 228 to 231 is any amino acid
  Variant (233)..(234): Xaa in position 233 to 234 is any amino acid
  Variant (237)..(239): Xaa in position 237 to 239 is any amino acid
  Variant (244)..(244): Xaa in position 244 is any amino acid
  Variant (245)..(245): Xaa in position 245 is any or no amino acid
  Variant (249)..(250): Xaa in position 249 to 250 is any amino acid
  Variant (251)..(252): Xaa in position 251 to 252 is any or no amino acid
GXXXXXXXXXXXXXXXXXXXXXXXXXXNYXXHXXEXXXXXXXXXXXPXXXXXXXXXXFXKPXXXXXXXXXXXXXXXXXXXXXXXXXXXXXXXXXXXXXXXXXXXXXHXEXELXXXXXXXXXXXXXXXXXXXXXXXXXXGXXXXXDXTXRXXXXQXXXXXXGXPWXXXKXXDXXXPXXXXXXXXXXXXXXXXXXXXXXXXXXXXXXXXQXXXXXXMXXXXXXXXXXXSXXXXLXXGDXXXTGTPXXGVGXXXXG

SEQ ID NO: 2124 - protein, 16 aa, Artificial sequence
  protein pattern
  Variant (2)..(2): Xaa in position 2 is any amino acid
  Variant (5)..(6): Xaa in position 5 to 6 is any amino acid
  Variant (8)..(8): Xaa in position 8 is Ala or Ile
  Variant (9)..(9): Xaa in position 9 is any amino acid
  Variant (11)..(14): Xaa in position 11 to 14 is any amino acid
  Variant (15)..(15): Xaa in position 15 is any or no amino acid
GXNYXXHXXEXXXXXP

SEQ ID NO: 2125 - protein, 13 aa, Artificial sequence
  protein pattern
  Variant (3)..(3): Xaa in position 3 is Ile, Leu or Val
  Variant (4)..(4): Xaa in position 4 is Ile or Val
  Variant (5)..(5): Xaa in position 5 is Phe, Leu or Met
  Variant (10)..(10): Xaa in position 10 is any amino acid
  Variant (13)..(13): Xaa in position 13 is Ala, Gly or Ser
GDXXXTGTPXGVX

SEQ ID NO: 2126 - protein, 20 aa, Artificial sequence
  protein pattern
  Variant (2)..(3): Xaa in position 2 to 3 is any amino acid
  Variant (4)..(6): Xaa in position 4 to 6 is any or no amino acid
  Variant (8)..(8): Xaa in position 8 is any amino acid
  Variant (9)..(9): Xaa in position 9 is Ala, Gly, Ser, Thr or Val
  Variant (10)..(10): Xaa in position 10 is any amino acid
  Variant (11)..(11): Xaa in position 11 is Ala, Gly, Ser or Thr
  Variant (12)..(12): Xaa in position 12 is any amino acid
  Variant (14)..(14): Xaa in position 14 is Phe, Leu, Met or Val
  Variant (15)..(15): Xaa in position 15 is Ser or Thr
  Variant (16)..(16): Xaa in position 16 is any amino acid
  Variant (17)..(17): Xaa in position 17 is Asn or Arg
  Variant (18)..(19): Xaa in position 18 to 19 is any amino acid
AXXXXXGXXXXXDXXXXXXQ

SEQ ID NO: 2127 - DNA, 192 bp, Escherichia coli
  CDS (1)..(192)
atgcctgagactactaagctgtttaattgtggcgataataagataaaagaaattcaatacttcccaaatcatctggagaaagcacgtatggagtgtgatattgaggttgtctctgcgatatatagcaataaagaattactttttaaagaatgtaattcttttgaagagacatttttatatcatggactttaa

SEQ ID NO: 2128 - protein, 63 aa, Escherichia coli
MPETTKLFNCGDNKIKEIQYFPNHLEKARMECDIEVVSAIYSNKELLFKECNSFEETFLYHGL

SEQ ID NO: 2129 - DNA, 1140 bp, Escherichia coli O157:H7 EDL933
  CDS (1)..(1140): transl_table=11
atgtttccattaaatgatctgtcgttaaaaactcagtcggttcaattaaataaaatcacatcgaatactgagtctacgataaaacaacacgagttagtatctgatgatgcaatcataaatgaattatcaagtgagttagtcagttgtcttggaaatgataagtttacaccagttagtgaagactgcaacttactgaatatgctgtctgaatttaagttattgagagagcaatgtttcaggtggggtaattatactctattgtttgaaaattatgagtcttatgataagacggggtctatcacgatagaaaaaaatcagggggaggggactttacccattcggcataaattagagtttatatcgactaatattgcagagttgctggacaagttaacgaaaattacagatgccagactttgcaaaggcttcagtgactgggctagttcagtcaaagaaggcggatcgaatgacctcaaagaaaatgtagatagagcgttggtgagaatgtttaaatgtgttaagcttcacagtaatgaacttgacttatcatacctatttttgggttctgtgccgcctcttccagattggattgaaatgcttagccttgtttataatgaacttgattcaatacaggttcccgaatcatgcaaagaattagaactcgatttcaataaccttacagaatttccacaagtacctgatggaattaccctgatctccgtaaataataacctgatatcgcatattgactcatttccgccaaaggctaagaaaatttttattagtcacaataagctatcggaaacaccagcaataccagacaccgctaaggtttttgattgtggctataataagatacaagaaattcgatacttccccaaaaatctgaaagaagcgcgtattggatataataatattgaggttgttcctgcgatacctggcaatttaaaaatactttttatggaatgtaatcctattaaagaggcatttttaatgccatggactctgacagggatctgctatgaaatatcgcagcgaaaatatattgttacgaatccagccgattatgataaatattccgatatggttaaaaagcatgtaatagatggtgaggaactcataattaaatattttatgtaa

SEQ ID NO: 2130 - protein, 379 aa, Escherichia coli O157:H7 EDL933
MFPLNDLSLKTQSVQLNKITSNTESTIKQHELVSDDAIINELSSELVSCLGNDKFTPVSEDCNLLNMLSEFKLLREQCFRWGNYTLLFENYESYDKTGSITIEKNQGEGTLPIRHKLEFISTNIAELLDKLTKITDARLCKGFSDWASSVKEGGSNDLKENVDRALVRMFKCVKLHSNELDLSYLFLGSVPPLPDWIEMLSLVYNELDSIQVPESCKELELDFNNLTEFPQVPDGITLISVNNNLISHIDSFPPKAKKIFISHNKLSETPAIPDTAKVFDCGYNKIQEIRYFPKNLKEARIGYNNIEVVPAIPGNLKILFMECNPIKEAFLMPWTLTGICYEISQRKYIVTNPADYDKYSDMVKKHVIDGEELIIKYFM

SEQ ID NO: 2131 - DNA, 1140 bp, Escherichia coli O157
  CDS (1)..(1140): transl_table=11
atgtttccattaaatgatctgtcgttaaaaactcagtcggttcaattaaataaaatcacatcgaatactgagtctacgataaaacaacacgagttagtatctgatgatgcaatcataaatgaattatcaagtgagttagtcagttgtcttggaaatgataagtttacaccagttagtgaagacagcaacttactgaatatgctgtctgaatttaagttattgagagagcaatgtttcaggtggggtaattatactctattgtttgaaaattatggggcttatgataagacgggatctatcacgatagaaaaaagtcagggggaggggactttacccattcggcataaattagagtttatatcgaccaatattgcagagttgctggacaagttaaccaaaattacagatgccaggctttgcaaaggtttcagtgactgggctagttcagtcaaagaaggcgcatcgaatgacttgaaagaaaatgtggatagagcattggtgagaatgtttaaatgtgttaagcttcacagtaatgaacttaacttatcaagcctttctttgggttctgtgccgcctcttcctgagtggattgaaatgcttagccttgtttataatgaacttgattcaatacaggtgcccgaatcgtgcaaagaattagaactcgatttcaataaccttacagaatttccacaagtacctgatggaattaccctgatctccgtaaataataacctgatatcgtatattgactcatttccgccaaaggctaagaaaatttttatttgtcacaataagctatcggaaataccagcactaccagacaccgctaaggtttttgattgtagtgagaataatattaaagaaattagatggttccccaaaaatttgaaagaagcgtatattgaatataataagattgaggttattcctgcgatacctggcaatttaaaattactttgtatgaaatgtaatcctattaaagaggcatttttaatgccatggacccttacagggattcgctatgaaatatcgcagcgaaaatatattgttatgaatcccgccgattatgataaatattccgatatggttaaaaagcatgtaatagatggtgaggaattcataattaaatattatatgtaa

SEQ ID NO: 2132 - protein, 379 aa, Escherichia coli O157
MFPLNDLSLKTQSVQLNKITSNTESTIKQHELVSDDAIINELSSELVSCLGNDKFTPVSEDSNLLNMLSEFKLLREQCFRWGNYTLLFENYGAYDKTGSITIEKSQGEGTLPIRHKLEFISTNIAELLDKLTKITDARLCKGFSDWASSVKEGASNDLKENVDRALVRMFKCVKLHSNELNLSSLSLGSVPPLPEWIEMLSLVYNELDSIQVPESCKELELDFNNLTEFPQVPDGITLISVNNNLISYIDSFPPKAKKIFICHNKLSEIPALPDTAKVFDCSENNIKEIRWFPKNLKEAYIEYNKIEVIPAIPGNLKLLCMKCNPIKEAFLMPWTLTGIRYEISQRKYIVMNPADYDKYSDMVKKHVIDGEEFIIKYYM

SEQ ID NO: 2133 - DNA, 24 bp, Artificial sequence
  primer
atgcctgagactactaagctgttt

SEQ ID NO: 2134 - DNA, 28 bp, Artificial sequence
  primer
ttaaagtccatgatataaaaatgtctct

SEQ ID NO: 2135 - DNA, 1119 bp, Escherichia coli
  CDS (1)..(1119)
atgggaaaaagcatagtcgttgtttctgcggtcaattttaccactggcggtccatttaccattttgaaaaaatttttggcagcaactaataataaagaaaatgtcagttttatcgcattagtccattctgctaaagagttaaaagaaagttatccatgggttaaattcattgagtttcctgaggttaaagggtcgtggctaaaacgtttgcactttgaatatgtagtttgtaaaaaactttcaaaagagctgaatgctacgcattggatttgtctgcatgatattacggccaatgtcgtcactaaaaaaagatatgtgtattgtcataaccctgcacctttttataaaggaattttattccgtgaaattcttatggagcctagctttttcttatttaaaatgctatacgggctgatatataaaataaacattaaaaaaaatactgcagtgtttgttcaacaattctggatgaaagaaaaatttatcaagaaatattctataaataacatcattgtcagtcggccagaaattaaattatctgataaaagccaacttactgatgatgattctcaatttaagaataacccttctgagttgacaatattttaccctgctgttccacgagtatttaaaaattacgagcttattattagtgcagcaaggaaattgaaagaacaatccaatattaaatttctgcttactatcagtggtacagaaaatgcgtatgcaaaatatattatcagtcttgcagaaggactggataatgttcatttcctcgggtacttggataaagaaaaaatcgatcattgttataatatttcagatatagtttgttttccctctaggttagaaacatggggattgccgttgtctgaagctaaagagcgaggtaagtgggtattagcatcagatttcccatttactagagaaactcttggtagttatgaaaagaaagctttttttgattctaataacgatgacatgttagttaaacttattattgacttcaaaaaaggtaacctcaaaaaagatatctctgatgcaaatttcatttatcgtaatgaaaatgtattagttgggtttgatgaactagttaattttattactgaagaacattaa

SEQ ID NO: 2136 - protein, 372 aa, Escherichia coli
MGKSIVVVSAVNFTTGGPFTILKKFLAATNNKENVSFIALVHSAKELKESYPWVKFIEFPEVKGSWLKRLHFEYVVCKKLSKELNATHWICLHDITANVVTKKRYVYCHNPAPFYKGILFREILMEPSFFLFKMLYGLIYKINIKKNTAVFVQQFWMKEKFIKKYSINNIIVSRPEIKLSDKSQLTDDDSQFKNNPSELTIFYPAVPRVFKNYELIISAARKLKEQSNIKFLLTISGTENAYAKYIISLAEGLDNVHFLGYLDKEKIDHCYNISDIVCFPSRLETWGLPLSEAKERGKWVLASDFPFTRETLGSYEKKAFFDSNNDDMLVKLIIDFKKGNLKKDISDANFIYRNENVLVGFDELVNFITEEH

SEQ ID NO: 2137 - DNA, 1017 bp, Rickettsia prowazekii str. Madrid E
  CDS (1)..(1017): transl_table=11
atggatcaggaaaagtcgaaaatagtccaaagctttatattttatagtcctggtattcactcaggtggtggactagttttattaaaagagattttaaacgttaaagattttgttaataattgtaagtatatttatctagatgaaagagtaagaagtaaattaaatttctctcatttctttaaaaatattatttttataaaatcacgattattaggagaatggaaattaagaaaaaattgtgaaatgagtgatactgttttatgctttcatggattaccaccattatttcctataaaaagtaaggtaattgtatttttacaaaatagacttttattagaaccgttgaaaaataatcactactcaattttaatattaataaaaaagatttggttacgtttaggtttaaaatttaataatataagatatatagtacaaactgagtctatgctaagaattgctaaagagtttttagatcaagatattgatattgcagtactacctttttcacctaaaactattcaaaaaaatttaaatcatactaaaaaatatgattttttttatcctgcaagtggtgaggctcataaaaatcattttaatttacttaaagcatggaaaattttagctggtataggtataaaaccttctcttgctttaactataaatactgaattataccctgagcttttagagcaaatacaaacataccaattagatatagttaatttaggcgaaatatcttataacgaagtattagacttatatacacaagtttcagtagtaatttatccatcaaaatcagaatcactcggtttacctttaattgaggctacagtatataaaatacctattattgcatcagaacttgattatgttagggatgtatcaaaccctatagagacatttgatccaaattctcccatctcaattgtaagagcagtaagaagatttctaaataataatgagagtttaatagtgctaaattcagcagcagaatttttagaggttatttgtaaataa

SEQ ID NO: 2138 - protein, 338 aa, Rickettsia prowazekii str. Madrid E
MDQEKSKIVQSFIFYSPGIHSGGGLVLLKEILNVKDFVNNCKYIYLDERVRSKLNFSHFFKNIIFIKSRLLGEWKLRKNCEMSDTVLCFHGLPPLFPIKSKVIVFLQNRLLLEPLKNNHYSILILIKKIWLRLGLKFNNIRYIVQTESMLRIAKEFLDQDIDIAVLPFSPKTIQKNLNHTKKYDFFYPASGEAHKNHFNLLKAWKILAGIGIKPSLALTINTELYPELLEQIQTYQLDIVNLGEISYNEVLDLYTQVSVVIYPSKSESLGLPLIEATVYKIPIIASELDYVRDVSNPIETFDPNSPISIVRAVRRFLNNNESLIVLNSAAEFLEVICK

SEQ ID NO: 2139 - DNA, 1113 bp, Clostridium acetobutylicum ATCC 824
  CDS (1)..(1113): transl_table=11
atgacacaaaatttaagagtaataattgatgcgcgtatggttaataagcatctacatgggattgctcgatatacttatgaaataataaaacatatgtcatatgaagataatgtggagatgatactgctcgtgaatgatttagaagaagcaagtaaaatctttggtcaatttaataacataaaatttaaaaggatgagatctaagtttttatctatttttgaacaaattgaattgcctatgattgttaataagtataaaaatatggctatatttcattcgccttcttttgttgcaagcccgtttataaagtgtaagatgattatgacaatacatgatttgaatcatctaaaatttcctcaatattatacaccttttcataagtattattacaaatacatagtaaagaaatgtgcgttgaaaagtaaaaaaatattaactgtttctgaattttctaaggaggaaatttttaagtggataaagtgtgatagggataaaattaaagtcacgtataatggaattgatcctaaatttcatgtgataagtgatgcagagaaattaaaaaaaataaaagaaaaatataagttgccagatagatttattttatatatcggtaacttaaagccacataaaaatgttgaaacattagtaaaagctatgagatttattgacggcaaagttaaattggtaattaacggaacaataaataaatctataagtgagattttagacaaatttaatttgctcgagaaagttaaatttataggttatgttaatgaggatgaattaccactactgtataatttggctagcgtttttgtgtttccatcattatatgaaggatttgggctaccaccattagaggctgctgtgtgtggatgtaaagttattatctctgatatatcgtcattgagtgaaattatgagtgattatggagttaaggtgaatcctctagattcaaaaggaatggcaagagagattaaaaaaatattagaaaatagtagtatagatatttgtaataaagaaaaagaaacttttgttcaaaaatatagttggaataaaactagtagtaagacattagaaatttacaaagaaataaataaagaatttttgtga

SEQ ID NO: 2140 - protein, 370 aa, Clostridium acetobutylicum ATCC 824
MTQNLRVIIDARMVNKHLHGIARYTYEIIKHMSYEDNVEMILLVNDLEEASKIFGQFNNIKFKRMRSKFLSIFEQIELPMIVNKYKNMAIFHSPSFVASPFIKCKMIMTIHDLNHLKFPQYYTPFHKYYYKYIVKKCALKSKKILTVSEFSKEEIFKWIKCDRDKIKVTYNGIDPKFHVISDAEKLKKIKEKYKLPDRFILYIGNLKPHKNVETLVKAMRFIDGKVKLVINGTINKSISEILDKFNLLEKVKFIGYVNEDELPLLYNLASVFVFPSLYEGFGLPPLEAAVCGCKVIISDISSLSEIMSDYGVKVNPLDSKGMAREIKKILENSSIDICNKEKETFVQKYSWNKTSSKTLEIYKEINKEFL

SEQ ID NO: 2141 - DNA, 1056 bp, Methanosarcina acetivorans C2A
  CDS (1)..(1056): transl_table=11
atggaaatagattatataaacggcctgaaaacagatgagatattcgggatgtcaaaatatcaaagtgagattcataagaggttagaaaatgtaaaattaaatcggatagaatatcctaatatatcaaaagtaactggaattaataaaattgtagaatattctgtatatccatttattgtaaaaaaaaaagtaattaagaataatattaagcatgtgacccgtcaagatctagcatttctcctagtattgatgaaattaaaaagaaccatcgttacttgccacgacatcataccgatatcatattataagacccagagccctgtttggaaacttaatggaaaaggattaaggaaagcagaaaaaataataactgtatcagaattctccaaaaaggaaattggtaaatatataaaatatccggaagaaaatattgagatcatacatcccgcagtggatcataatttgtactatcgaaatagaaacaaaatgattttaaaaaaatatgggataaaggataacgagaaagtaattctctatgttggagccgaagagccgagaaaaaacgttcaatttataataaactcattcagcaacttaaagaaaagaattccagaagtaaaattattaaaagttgggatgccaaattatcctggagtaagaagaaaactcattcaacaaatagagtctttaaacctgcagaaagacattatctttgcagggtatgtatcggaactcgcattggcagaaatatacaatgctgtagacttgttcgtatttccatctttgtatgagggattcggaatacctcctttagaagcaatggcttgcggaacccccgtcataacctcaaacacatcctcactacctgaagttgtgggagatgctgcaattcagataaacccttatgatgttgagaaatttgctgaagagatgtatgaagtactgaccaatgagagactcaaagaagaaatgatcagaaaaggactggaaaggtcgaaaatgtttagctgggagaattcagcaaaaaaaacattgaaagtttacagagaaatgtaa

SEQ ID NO: 2142 - protein, 351 aa, Methanosarcina acetivorans C2A
MEIDYINGLKTDEIFGMSKYQSEIHKRLENVKLNRIEYPNISKVTGINKIVEYSVYPFIVKKKVIKNNIKHVTRQDLAFLLVLMKLKRTIVTCHDIIPISYYKTQSPVWKLNGKGLRKAEKIITVSEFSKKEIGKYIKYPEENIEIIHPAVDHNLYYRNRNKMILKKYGIKDNEKVILYVGAEEPRKNVQFIINSFSNLKKRIPEVKLLKVGMPNYPGVRRKLIQQIESLNLQKDIIFAGYVSELALAEIYNAVDLFVFPSLYEGFGIPPLEAMACGTPVITSNTSSLPEVVGDAAIQINPYDVEKFAEEMYEVLTNERLKEEMIRKGLERSKMFSWENSAKKTLKVYREM

SEQ ID NO: 2143 - DNA, 1122 bp, Bacteroides thetaiotaomicron VPI-5482
  CDS (1)..(1122): transl_table=11
atgggaaacaatgcaaaactcatagtcgtgtctgctgtcggattgcgtcagggaggtactttgactattctgaaagagtgcctgcaatatctttctacctgtgtacgtgaggggcatgtacgtgtgatagccattgtacacgacagaaggctcgcggagttcaacggcattgagtatattgaattgccggatgtcatcaaaagttggactcgccggttatggtgcgaatatataaccatgcaccgcatttctcaacgattacccgggattgatttatggctttcactgcatgacaccacccctcgtgtgatagccaaacgacaggcggtctattgccagacttcttttcctttttataagcggacgtggcgtgatttttatttcaactataagatagccctattttcactgttcacccgttatgcttacaggattaatgttcaccgtaatcagtatatgatagtacagcagtcatggctaagggagggacttagcaggatgttaggcgtgggcaaagagaaatttatcgtagcaccgccccgacgtatggcagtcaaagtggaaacggagagcgtgaatttgccttgtttcacattcctatatgcttccgcaccggactgtcacaagaatttcgaggtattatgtcaggccgccaggcttttggagaaggaaaaaggaaaaggctgttttaaagtggtggtcacgctgtccggaaaagaaaaccgttatacccgctggctttataaaaactggcacgatgtgaactcaatcgagtttgccggatatatgaataaggaaaagttatatggttactatcaggccgcacattgtttggtacatgcttccaaagtagaaacctggggcttgccgatttccgaattcggtgaaacgggcaaacccatgttacttgcagatcttccttatgctcatgctacagcttcgggctttcatgccgtaggctacttcaatgaacacaaaccggaagaattgaaaagacttatgaaagaaatgctggagggggatcataggtctctatcatcccaaccttcgactgccataaagggactctatgtgtgttcatggcgggaactgtttgaaaaattactgcctgcttccatttga

SEQ ID NO: 2144 - protein, 373 aa, Bacteroides thetaiotaomicron VPI-5482
MGNNAKLIVVSAVGLRQGGTLTILKECLQYLSTCVREGHVRVIAIVHDRRLAEFNGIEYIELPDVIKSWTRRLWCEYITMHRISQRLPGIDLWLSLHDTTPRVIAKRQAVYCQTSFPFYKRTWRDFYFNYKIALFSLFTRYAYRINVHRNQYMIVQQSWLREGLSRMLGVGKEKFIVAPPRRMAVKVETESVNLPCFTFLYASAPDCHKNFEVLCQAARLLEKEKGKGCFKVVVTLSGKENRYTRWLYKNWHDVNSIEFAGYMNKEKLYGYYQAAHCLVHASKVETWGLPISEFGETGKPMLLADLPYAHATASGFHAVGYFNEHKPEELKRLMKEMLEGDHRSLSSQPSTAIKGLYVCSWRELFEKLLPASI

SEQ ID NO: 2145 - DNA, 1113 bp, Bacteroides thetaiotaomicron VPI-5482
  CDS (1)..(1113): transl_table=11
atgagtagcaagcgaaagacgattgttgtctcagcggttagtttacgtaagggaggtacattaacgatattgcaagattgcttatgttatctttctgctttggcagccgacggcaattatcgggttattgcattggtacataaaagagaattggctgactatccgcacattgaatatattgaaatgccggacgttatcaaagggtggggacgacgtttgtggtgtgaatatgtgacaatgtataaattgtcacaaaaaataatgcctgtatatttatggctgtctcttcatgatgcgactccaagggtggtggctgaacgtcgggttgtctattgccagacttctttccctttttataaatggagttggagggattttctgtttgactataagattgttctatttgctttatttacccgttggatttatcggatcaatgtgcatcggaatacttacctgattgtacaacaggaatggttacgttccggattgagccggatgttgggggtaaaaaaagaaaagttcatagtagctcctccggaacgtaaagagaatgatgtgattgcagaaatagtagaactttcctgttttacattcttttatgctgccacaccagattgccataagaattttgagctgctatgcgacgctgcttctctgttggaacaagagcttggaaaaggaaggttcaaagtggtcttgactattagcggacaagaaaataaatatgcacagtggttatataaaaagttcggttcggtaagttcgatagagttcgcaggattcatgagcagagaaaaactttttggttattatcatgcagttgattgccttgtgtttccgtcaaaggtggaaacatggggattacccgtatctgaatttatggcaacgggtaagccgatgcttctagccgaccttccgtatgctcacgagactgccgctggaagtatgcaaactgcattttttaaattgtcggacccggttcaattaatgaatctgatgaaacggttatgtgaagatgactttacttttctaacgagtatcggtacttctgataaacgtttctcattcgcttcatcctggcgggaattattcgattctatattaaattaa

SEQ ID NO: 2146 - protein, 370 aa, Bacteroides thetaiotaomicron VPI-5482
MSSKRKTIVVSAVSLRKGGTLTILQDCLCYLSALAADGNYRVIALVHKRELADYPHIEYIEMPDVIKGWGRRLWCEYVTMYKLSQKIMPVYLWLSLHDATPRVVAERRVVYCQTSFPFYKWSWRDFLFDYKIVLFALFTRWIYRINVHRNTYLIVQQEWLRSGLSRMLGVKKEKFIVAPPERKENDVIAEIVELSCFTFFYAATPDCHKNFELLCDAASLLEQELGKGRFKVVLTISGQENKYAQWLYKKFGSVSSIEFAGFMSREKLFGYYHAVDCLVFPSKVETWGLPVSEFMATGKPMLLADLPYAHETAAGSMQTAFFKLSDPVQLMNLMKRLCEDDFTFLTSIGTSDKRFSFASSWRELFDSILN

SEQ ID NO: 2147 - DNA, 1014 bp, Staphylococcus haemolyticus JCSC1435
  CDS (1)..(1014): transl_table=11
ttggattatgtaggaaaagttggaggagctagttcgatttcaagacaattttatgaagatgttaaaaatgatgagaataatcaatggatttttttaacaaataaagagtatgtatcacaaaaaagtaatattaaaagaattttagtaaacaatgcaaataaaactttcttacatagattttattttgaaacttttaaaatacctaatattataaataatattaagccagatctagttttatcattacaaaatcttggagttaaacctaagcaaaatcaaattttatatattcatcaagcgctcccatttcaaaataagttatgggagttaagtaataatcctataagcttggttaaaatgctattaatgaaatacaaattgattaaagatataaaaaaatctaatcacataattgtgcaaaccaattatatgaaaaaattaattgaaaaatataataacaatataattgttaacttgccaaattttaattttgccagcccgcaaacacataaagatacaaaagactttttatatcccacaaatgcacaaaaatataaaggtttaaattatatcgttgatttcgctagaatattgaaaaaaaataaacaaaatgtgtatataaatttaactttgataggtaatgaaaataaatatattgaaaatataagaaaaattattaataaagagcaattagctataagattcattggaagacaaaatagtgatgaaatgaatgaactttataaactaaataatttactttttacctcccaagtagaaagtttgggcttacctttaattgaagcagctcattacggatgtaaaatatttgcatatgaaactgatgttactaaagaagtgcttaaaaattataaattcaaagtttttttcaataaatcaaatattgaaagtaaatataaagaatttttaagtttccctccaactactataggggaaaatataaatggtttaaacataaatggaattttgcgaacaaatcacataatcaaatag

SEQ ID NO: 2148 - protein, 337 aa, Staphylococcus haemolyticus JCSC1435
MDYVGKVGGASSISRQFYEDVKNDENNQWIFLTNKEYVSQKSNIKRILVNNANKTFLHRFYFETFKIPNIINNIKPDLVLSLQNLGVKPKQNQILYIHQALPFQNKLWELSNNPISLVKMLLMKYKLIKDIKKSNHIIVQTNYMKKLIEKYNNNIIVNLPNFNFASPQTHKDTKDFLYPTNAQKYKGLNYIVDFARILKKNKQNVYINLTLIGNENKYIENIRKIINKEQLAIRFIGRQNSDEMNELYKLNNLLFTSQVESLGLPLIEAAHYGCKIFAYETDVTKEVLKNYKFKVFFNKSNIESKYKEFLSFPPTTIGENINGLNINGILRTNHIIK

SEQ ID NO: 2149 - DNA, 1155 bp, Candidatus Pelagibacter ubique HTCC1062
  CDS (1)..(1155): transl_table=11
atgtcttcagaattaaaagtactgcaagtaattcctaaacttggatatgggggtgcagaaacaggctgttacgatcttgcacactatttaccagaaaataattgtggttcttatatagtaactagtggaggagagttattaaaatttattgataaaaaaaaagtaaaagtaataaaacttcccgtccatagtaaaaatccatttttaatgctctttaattcaatagctttgatttttattattttactaaataatatatctattgttcatgcaagaagtcgtgctccagcttggtcttgtttgtttgcaacaaaaattacaagaagaaagtttgttacaacttttcatggtacttataattttaaaaactcaattaaaaaattctataattcagtaatggttagatcagatttaataatagcaggatcaaattttattttttcacatattaatcaaaattatccaaaatttttagatttaaaaaaaaaattcttagtaatttttaggggaattaatgtcgattattttgaattatcaacaattttagacagtgaagaaaacagacttatttcagattgggaagttgatagaaataaaaaaacgatcctaatgccaggtcggttaactgcttggaaaggtcaggagacatttattgaggcattaaatcttgttaataaagaactgggctatgagtcttttaatgcagttattttgggtagcgatcaagaaagagacatttataccaaaaaaattaaaagattggctgagcaatataggctaactagtcagttaaaatttatagaacattgtaaaaatatgccgttagcctacaaaatatcagacattgttgtttcagcctcagtagaacctgaagcttttggaagggtagcagttgaagcccaatcaatggaaaaaccaataattgcaagtgatattgggggatctaatgaaactattatcgataacgtgacaggttttttatttcagtctggcaatgcagaagctttgagtaaaaaaataatagaagtcttacaattagacgaatctagattgaaatctattggtatagaaggtagaaaaaatataattaaaaaatttaatgttgaaaaaatgtgtttttctacatattcagaatacaaaaaattattgaattaa

SEQ ID NO: 2150 - protein, 384 aa, Candidatus Pelagibacter ubique HTCC1062
MSSELKVLQVIPKLGYGGAETGCYDLAHYLPENNCGSYIVTSGGELLKFIDKKKVKVIKLPVHSKNPFLMLFNSIALIFIILLNNISIVHARSRAPAWSCLFATKITRRKFVTTFHGTYNFKNSIKKFYNSVMVRSDLIIAGSNFIFSHINQNYPKFLDLKKKFLVIFRGINVDYFELSTILDSEENRLISDWEVDRNKKTILMPGRLTAWKGQETFIEALNLVNKELGYESFNAVILGSDQERDIYTKKIKRLAEQYRLTSQLKFIEHCKNMPLAYKISDIVVSASVEPEAFGRVAVEAQSMEKPIIASDIGGSNETIIDNVTGFLFQSGNAEALSKKIIEVLQLDESRLKSIGIEGRKNIIKKFNVEKMCFSTYSEYKKLLN

SEQ ID NO: 2151 - DNA, 1134 bp, Candidatus Pelagibacter ubique HTCC1062
  CDS (1)..(1134): transl_table=11
atgattaaaattctttattttttagaccatccaattcaatatcaaaatccatttttagacagaatatcactttcttcaaaaattaatttaaacgttatttatctatcagacttttctctaaaaccttatttcgacgaaggtttgaataaaactattaaattcgatgatattgaaaactttagtcacaaacatcaatttatatttaaagataaaaataaaagtaaaataaaatttttaattaggctcactaagatattgtttaaagaaaaacctaagtatttttgggtacatggatattctaatttttactcaatgtcatcaataattattgctcgtttgttaagtatcaaagttttgttaagaggtgaaagtagtaatttttttaaaaacaatttaaaatctaaaattagtatttttttattttttaaaataattgatccactaattacaaactatctagcaattggtaaaaaaaataaagaattctatcttaataatacaaaaaaaaatattcttaaacttccttacattgttggaaatttatctaaaaaaaaaataataaaaaaagaggatttaatgaatttaagaaaaaaaattcaaattaaacaaaactcttttataatattttataatgcaaaaatcatagatagaaaaaatccagagttattaattaagtcttttttaaaaatagagaaagcttgcaaaatcccagtgactttaattattgcgggagatggtaatattaaagatagattaattaatagatataaaaactttagaaatataaaatttgttggctttataaatcagaacttgttatgtcaattttatgctttatcagatttatttgttttgccatctaaatatgatgcttggggacttgtagtaaatgaagcaatgagtttttcaaaacctgttataacctcaaggaatgttatttcatcatacgatcttgtaaaacaaaacgtaaatggagttgcttttaataataaatttcatttagaacaatccataattaatattattaacaataaagatataagatataggtattcaaaaaactcaaagataattataaaaaattggagtatagaaacagctaataaatacttccataaaatatttgtaaaataa

SEQ ID NO: 2152 - protein, 377 aa, Candidatus Pelagibacter ubique HTCC1062
MIKILYFLDHPIQYQNPFLDRISLSSKINLNVIYLSDFSLKPYFDEGLNKTIKFDDIENFSHKHQFIFKDKNKSKIKFLIRLTKILFKEKPKYFWVHGYSNFYSMSSIIIARLLSIKVLLRGESSNFFKNNLKSKISIFLFFKIIDPLITNYLAIGKKNKEFYLNNTKKNILKLPYIVGNLSKKKIIKKEDLMNLRKKIQIKQNSFIIFYNAKIIDRKNPELLIKSFLKIEKACKIPVTLIIAGDGNIKDRLINRYKNFRNIKFVGFINQNLLCQFYALSDLFVLPSKYDAWGLVVNEAMSFSKPVITSRNVISSYDLVKQNVNGVAFNNKFHLEQSIINIINNKDIRYRYSKNSKIIIKNWSIETANKYFHKIFVK

SEQ ID NO: 2153 - DNA, 1134 bp, Rhodoferax ferrireducens DSM 15236
  CDS (1)..(1134): transl_table=11
ttggaaaggaatataggcatgccacgtatcgttgtttccgcagtaaatttcactgagggcgggccgctcacggtgctgcgtgagtgcctcgcatccgcggcggctgtgctccccgctgagttcgagatcatagccatagtaaatcgtgctgatctgatcaatgaaccgcgggttcgtttgatttcaattccgagttcaaagaaatcctggtttcataggctttactgggaatggtgcgggttcagtcgtatttcccacgaactaaagcccacgttgtggctatcgctgcacgacatcacgccgcgcgtgtcagctgctcgccaagcagtgtattgtcataatccttcgcccttttatcgcatcggtctacgtgaggctttgatggagccaacgttcctcatgttcaaccagttctacgctttgctgtaccgactcttcatccgtcgcaaccactgcgttatcgtgcagcaagactggcttcgcgccgagtttataaaacggatggggcagctccctgtggtcgtcgctcacccctcctttcgggctgccgagcgtcccagcgctccgaagcgtggaccggcattcgtctttatctatccagctctgccacgggtatttaagaacatcgagactttgtgcaaagcggcacagctattggtttcccggggggtcggcggcttcgaggtacggctgactcttgacggcagcgaaaatcgatacgctcgctggcttcgaaatcggtttggcgatacggcgcacgtccgatttataggccgacagactaaagatgagatggacgcccactatggtgaggcctccgcagtcgtgtttccgagcaagctggagacttgggggttgcccattaccgaaggcaaggcacaacggcggccgcttctcgtggccgatctcccatatgcacgggaaaccgttgggacctacgatctcgtgagctttttcccggccgaatcttctgaggcgcttgctgatctcatgcagtcgatgatcgagcaaacgtggcgaccgaccggcaacgaccatcctgaccccgcggctccgtttgcacccaattgggctagcctgtggggcatcctcattagcgggctgccgtctgcagcacagaactccggtgattga

SEQ ID NO: 2154 - protein, 377 aa, Rhodoferax ferrireducens DSM 15236
MERNIGMPRIVVSAVNFTEGGPLTVLRECLASAAAVLPAEFEIIAIVNRADLINEPRVRLISIPSSKKSWFHRLYWEWCGFSRISHELKPTLWLSLHDITPRVSAARQAVYCHNPSPFYRIGLREALMEPTFLMFNQFYALLYRLFIRRNHCVIVQQDWLRAEFIKRMGQLPVVVAHPSFRAAERPSAPKRGPAFVFIYPALPRVFKNIETLCKAAQLLVSRGVGGFEVRLTLDGSENRYARWLRNRFGDTAHVRFIGRQTKDEMDAHYGEASAVVFPSKLETWGLPITEGKAQRRPLLVADLPYARETVGTYDLVSFFPAESSEALADLMQSMIEQTWRPTGNDHPDPAAPFAPNWASLWGILISGLPSAAQNSGD

SEQ ID NO: 2155 - DNA, 1080 bp, Lactobacillus rhamnosus
  CDS (1)..(1080): transl_table=11
atgcattatgtcatcgtcgattttgtagtaaggcaaaattctggagggatattatcaatattacaagatgtcaataaatttgcgcttgaacatacagaagaccgttttacgtttatagttgggacagatggtctgatcactacttcgccaaacataaaggttattttgcgccctgatttgcagcgtaactacataaaaagaatttttttcgatttctggagaggtgctggtgtcattaattctttaaaaccggatgtggttatttctctacagaataccgccgttcttggagttaatgctcctgaaatgttatatgtgcaccaacctctcccgttcgaaacaaattataaatttagcttctttaaaagctcggagaggaaaatggctttttaccaaagtttagtgggcagtgttatcaaattgaacttaaggagttttcataagggggcaatcacggtacaaactcactggatgttggaagaagtacagaagtacgctaaaacaccaatttttgtaacgcgaccatctattgataaaaatgatttcaaaggtcagattttaggaagtaaaggaagcaatttcttttttccgagtactgcaatggtttataagaaccatcgaaatctagttgacgcctatgaaatgctttctgacgaagtaaggcgtgaacatcacttaatatttacgatctctagaaaggaatacggtcgtttgtacgggcaagtacctgatgattcgaatattaagtttctaggaaggattcctcgggctaaggtaatcgaaattttaaatcatagtatattagtctttccttcaaaaattgaaactctcgggttaccgcttattgaagcaatgatattgcaaagacagattgttgctgcaaatatcagcccggtcactgaagtaactagtgagtacgattcgattagttactttgatcctgatgatgtgaagtctatttacaactctctattggccggaataagaatgaatccttctaggagaagctttaaagagacaaatgacaatggttggcaggcattcttttctaatgtagaggcattgaatcatgcaaaatag

SEQ ID NO: 2156 - protein, 359 aa, Lactobacillus rhamnosus
MHYVIVDFVVRQNSGGILSILQDVNKFALEHTEDRFTFIVGTDGLITTSPNIKVILRPDLQRNYIKRIFFDFWRGAGVINSLKPDVVISLQNTAVLGVNAPEMLYVHQPLPFETNYKFSFFKSSERKMAFYQSLVGSVIKLNLRSFHKGAITVQTHWMLEEVQKYAKTPIFVTRPSIDKNDFKGQILGSKGSNFFFPSTAMVYKNHRNLVDAYEMLSDEVRREHHLIFTISRKEYGRLYGQVPDDSNIKFLGRIPRAKVIEILNHSILVFPSKIETLGLPLIEAMILQRQIVAANISPVTEVTSEYDSISYFDPDDVKSIYNSLLAGIRMNPSRRSFKETNDNGWQAFFSNVEALNHAK

SEQ ID NO: 2157 - DNA, 1080 bp, Lactobacillus rhamnosus
  CDS (1)..(1080): transl_table=11
atgcattatgtcatcgtcgattttgtagtaaggcaaaattctggagggatattatcaatattacaagatgtcaataaatttgcgcttgaacatacagaagaccgttttacgtttatagttgggacagatggtctgatcaatacttcgccaaacataaaggttattttgcgacctgatttgcagcgtaactacataaaaagaatttttttcgatttctggagaggtgctggtgtcattaattctttgaaaccggatgtggttatttctctacagaataccgccgttcttggagttaatgctcctgaaatgttatatgtgcaccaacctcttccgttcgaaacaaattataaatttagcttctttaaaaactcggagaggaaaatggctttttaccaaagtttagtgggtagtgttatcaaatcgaacttaaggagttttcataagggggcaatcacggtacaaactcactggatgttggaagaagtacagaagtacgctaaaacaccaatttttgtaacgcgaccatctattgataaaaatgatttcagaggtcagattttaggaagtaaaggaagcaatttcttttttccgagtactgcaatgatttataagaaccatcgaaatctagttgacgcctatgaaatgctttctaacgaagtaaggcatgaacatcacttaatatttacgatctctagaaaggaatacggtcgtttgtacgggcaagtacctgatgattcgaatattaagtttctcggaagaattcctcgggctaaggtaatcgaaattttaaatcatagtatattagtctttccttcaaaaattgaaactctcgggttaccgcttattgaagcgatgatattgcaaagacagattgttgctgcaaatatcagcccggtcactgaagtaactagtgagtacgattcgattagttacttcgatcctgatgatgtgaagtctatttacaactctctattggccggaataagaatgaatccttctaggagaggctttaaagagacaaatgacaatggttggcaggcattcttttctaatgtagaggcattgaatcatgcaaaatag

SEQ ID NO: 2158 - protein, 359 aa, Lactobacillus rhamnosus
MHYVIVDFVVRQNSGGILSILQDVNKFALEHTEDRFTFIVGTDGLINTSPNIKVILRPDLQRNYIKRIFFDFWRGAGVINSLKPDVVISLQNTAVLGVNAPEMLYVHQPLPFETNYKFSFFKNSERKMAFYQSLVGSVIKSNLRSFHKGAITVQTHWMLEEVQKYAKTPIFVTRPSIDKNDFRGQILGSKGSNFFFPSTAMIYKNHRNLVDAYEMLSNEVRHEHHLIFTISRKEYGRLYGQVPDDSNIKFLGRIPRAKVIEILNHSILVFPSKIETLGLPLIEAMILQRQIVAANISPVTEVTSEYDSISYFDPDDVKSIYNSLLAGIRMNPSRRGFKETNDNGWQAFFSNVEALNHAK

SEQ ID NO: 2159 - DNA, 1080 bp, Lactobacillus rhamnosus
  CDS (1)..(1080): transl_table=11
atgcattatgtcatcgtcgattttgtagtaaggcaaaattctggagggatattatcaatattacaagatgtcaataaatttgcgcttgaacatacagaagaccgttttacgtttatagttgggacagatggtctgatcaatacttcgccaaacataaaggttattttgcgacctgatttgcagcgtaactacataaaaagaatttttttcgatttctggagaggtgctggtgtcattaattctttgaaaccggatgtggttatttctctacagaataccgccgttcttggagttaatgctcctgaaatgttatatgtgcaccaacctcttccgttcgaaacaaattataaatttagcttctttaaaaactcggagaggaaaatggctttttaccaaagtttagtgggtagtgttatcaaattgaacttaaggagttttcataagggggcaatcacggtacaaactcactggatgttggaagaagtacagaagtacgctaaaacaccaatttttgtaacgcgaccatctattgataaaaatgatttcagaggtcagattttaggaagtaaaggaagcaatttcttttttccgagtactgcaatgatttataagaaccatcgaaatctagttgacgcctatgaaatgctttctaacgaagtaaggcatgaacatcacttaatatttacgatctctagaaaggaatacggtcgtttgtacgggcaagtacctgatgattcgaatattaagtttctcggaagaattcctcgggctaaggtaatcgaaattttaaatcatagtatattagtctttccttcaaaaattgaaactctcgggttaccgcttattgaagcgatgatattgcaaagacagattgttgctgcaaatatcagcccggtcactgaagtaactagtgagtacgattcgattagttacttcgatcctgatgatgtgaagtctatttacaactctctattggccggaataagaatgaatccttctaggagaggctttaaagagacaaatgacaatggttggcaggcattcttttctaatgtagaggcattgaatcatgcaaaatag

SEQ ID NO: 2160 - protein, 359 aa, Lactobacillus rhamnosus
MHYVIVDFVVRQNSGGILSILQDVNKFALEHTEDRFTFIVGTDGLINTSPNIKVILRPDLQRNYIKRIFFDFWRGAGVINSLKPDVVISLQNTAVLGVNAPEMLYVHQPLPFETNYKFSFFKNSERKMAFYQSLVGSVIKLNLRSFHKGAITVQTHWMLEEVQKYAKTPIFVTRPSIDKNDFRGQILGSKGSNFFFPSTAMIYKNHRNLVDAYEMLSNEVRHEHHLIFTISRKEYGRLYGQVPDDSNIKFLGRIPRAKVIEILNHSILVFPSKIETLGLPLIEAMILQRQIVAANISPVTEVTSEYDSISYFDPDDVKSIYNSLLAGIRMNPSRRGFKETNDNGWQAFFSNVEALNHAK

SEQ ID NO: 2161 - DNA, 1104 bp, Escherichia coli
  CDS (1)..(1104): transl_table=11
atgtttgatctgtccaaaaattatattattgtaagtgcgacggcgctggcttccggaggtgcattaactatattaaagcaatttataaaacatgcatcacaaaattcaaatgactatattatgtttgtatctgcgggattggagttgccggtctgtgataacatcatttacatagaaaacacaccaaaaggatggttgaaaagaatatattgggattggttcggttgtcggaagtttatctcggaacataagattaacgttaagaaagtaatttctctacaaaattccagtttgaatgttccttacgaacagattatttacttgcaccagccaattccttttagtaaagttgattcttttttaaaaaatatcacatccgataacgtaaagctttttttatataaaaagttttattcctattttatatttaaatatgtgaatgccaatacaaccatcgtagtgcaaacgaattggatgaaaaaaggagtgctggagcaatgtgataaaattagtaccgaaagggtccttgttataaaacctgatatcaaagcatttaataatactaattttgatgtagatatggatgtatctgcaaaaacactcttatatccagcgacaccacttacctataaaaatcatttggtcattctgaaggcgttggttattttaaagaaaaagtattttatagatgatctgaaattccaagtgacttttgaaaagaataggtacaaaaattttgataagtttgtgcaattaaataacttaagcaaaaacgttgattatctcggcgttctttcatactcgaacttgcaaaaaaaatatatggcggcatctttaatcgtttttcctagctatatcgaatcatatgggttaccactcatcgaagctgctagtttaggaaaaaaaatcattagtagtgatcttccttatgcccgggatgttttaaaggattatagcggcgtagattttgtaatttacaataatgaagatggctgggctaaggcgttgtttaatgttttaaatggcaattcgaagctcaattttaggccttatgaaaaagatagtcgttcatcttggccacagttcttctctattttgaaataa

SEQ ID NO: 2162 - protein, 367 aa, Escherichia coli
MFDLSKNYIIVSATALASGGALTILKQFIKHASQNSNDYIMFVSAGLELPVCDNIIYIENTPKGWLKRIYWDWFGCRKFISEHKINVKKVISLQNSSLNVPYEQIIYLHQPIPFSKVDSFLKNITSDNVKLFLYKKFYSYFIFKYVNANTTIVVQTNWMKKGVLEQCDKISTERVLVIKPDIKAFNNTNFDVDMDVSAKTLLYPATPLTYKNHLVILKALVILKKKYFIDDLKFQVTFEKNRYKNFDKFVQLNNLSKNVDYLGVLSYSNLQKKYMAASLIVFPSYIESYGLPLIEAASLGKKIISSDLPYARDVLKDYSGVDFVIYNNEDGWAKALFNVLNGNSKLNFRPYEKDSRSSWPQFFSILK

SEQ ID NO: 2163 - DNA, 1080 bp, Escherichia coli
  CDS (1)..(1080): transl_table=11
atgaaaattattatatatgcgacagcagcagttgatggtggcgctctttcgcttttaaatgatttgctggaatatgcgaatgatgatattgataatgaatatactgtttgcgttaatgaaaaattaaataacgaagtgtctgtttacaataatttgacatttttatttgttgatactaaagcttggcataaaagggtttattttgactttatagggtttaaaaaaaactttgataataaagattattgcttggtaataaatttgcaaaatataccagttcggacacaattaaaacaaatattgtacttgcatcagcctttgcctttttcggatattaagttaaatattttggagaagcgtaatagaaaattgatattctataaatacttatatggattaataataaaatttaattcatgttttattgatcattgcttagtgcaaactgagtggatgagaaaagctgttattgataaactaaacctgtctgagaaaaaaataagtataattagaccagtaatagatattgatttgaacaaaattttaaaaaatgaaaatgaaaatgaaaatacattcatctatcccgcagcatcttatagttataaaaatcatataatattggttgaatcattaaatatgattggtgtggattttttgtttcagaataagataactgttatatttacattagatcgtgatgaaaattcgaagttgtttgatcggataaaaaaatataatcttcaagagattattaaatttacaggaaatatcccaagatatgatgttttaaattacatttataatgctaaagccttactgtttccatcaagactagaaacatttggtataccattgatagaagctgtaaaatttaattctaacataattgtaagtgatctaccttatgcgcacgacgtattggatggttatgaaaatgtcaaatactgtaatcctgattctccagaggattggtctgaagcaatcaaatttgctatcaatctaaaagagaataaattaaatcagggctttgaattaaattcagggtggagagagttgagttcgattatttcaactctttaa

SEQ ID NO: 2164 - protein, 359 aa, Escherichia coli
MKIIIYATAAVDGGALSLLNDLLEYANDDIDNEYTVCVNEKLNNEVSVYNNLTFLFVDTKAWHKRVYFDFIGFKKNFDNKDYCLVINLQNIPVRTQLKQILYLHQPLPFSDIKLNILEKRNRKLIFYKYLYGLIIKFNSCFIDHCLVQTEWMRKAVIDKLNLSEKKISIIRPVIDIDLNKILKNENENENTFIYPAASYSYKNHIILVESLNMIGVDFLFQNKITVIFTLDRDENSKLFDRIKKYNLQEIIKFTGNIPRYDVLNYIYNAKALLFPSRLETFGIPLIEAVKFNSNIIVSDLPYAHDVLDGYENVKYCNPDSPEDWSEAIKFAINLKENKLNQGFELNSGWRELSSIISTL

SEQ ID NO: 2165 - DNA, 1035 bp, Shigella boydii
  CDS (1)..(1035): transl_table=11
gtgtcaaatttaaaaaaatataagtttataatttttattcctgatagcattaatttgcctaaagcagttaatatcagatatatccctgtgcctaaaaaaaattggctatctaggatatattgggatagttatggcttaagaaaatatattcgagtaaatcggcttcaatatcaggcggtcatttctcttcagaatacatctgtaaatgtagaaggaaaacagataatatatcttcaccaatctataccatttatagattttgatattccactgacaagtttatttaatttaaaattatggctatacaagcgattttattcttattttatatttttatttgttaacaagaatacttcttttattgtccaagccaaatggctgaaagagctcctttctgataagtatcatatcgatgcaaaaaaaatatctatcataaagcccaaagcaagatatgttcctctagcaactaactctattcataatgtagccaacttatctaagcaattctgtaatattatttatccagcaacaccaatattttataaaaatcattgtgttattattgatgctcttaggattttaagagaacagcgcaatattgataacttatgttttaatgtcaccttttcaaaaggtgagtatgctaagtttgacgatttggttaggcgttataacttgggtaagaatattcgctatttgggatatttgacccgagatgaattatatcaacattatgataatagcgcttttatggtctaccccagttatgtggaaacctgtgggcttccgttgctggaggctgcttctaagcagttgccaataatcgctagtgatctgccttatgcatgtgaaatgcttgaggcttatactggcgtcgtttatgttaagttcaatgtctctaccgaatgggctcgagaaattgatacgatggcccgagctggtgaaactcgaattattccgccgttattaaaagcggagaatgattctgattggaataagttagataatattattgaaggaaaagatgatgtttaa

SEQ ID NO: 2166 - protein, 344 aa, Shigella boydii
MSNLKKYKFIIFIPDSINLPKAVNIRYIPVPKKNWLSRIYWDSYGLRKYIRVNRLQYQAVISLQNTSVNVEGKQIIYLHQSIPFIDFDIPLTSLFNLKLWLYKRFYSYFIFLFVNKNTSFIVQAKWLKELLSDKYHIDAKKISIIKPKARYVPLATNSIHNVANLSKQFCNIIYPATPIFYKNHCVIIDALRILREQRNIDNLCFNVTFSKGEYAKFDDLVRRYNLGKNIRYLGYLTRDELYQHYDNSAFMVYPSYVETCGLPLLEAASKQLPIIASDLPYACEMLEAYTGVVYVKFNVSTEWAREIDTMARAGETRIIPPLLKAENDSDWNKLDNIIEGKDDV

SEQ ID NO: 2167 - DNA, 25 bp, Artificial sequence
  primer
atgggaaaaagcatagtcgttgttt

SEQ ID NO: 2168 - DNA, 28 bp, Artificial sequence
  primer
ttaatgttcttcagtaataaaattaact

SEQ ID NO: 2169 - protein, 187 aa, Artificial sequence
  consensus sequence
  Variant (2)..(83): Xaa in position 2 to 83 is any amino acid
  Variant (84)..(98): Xaa in position 84 to 98 is any or no amino acid
  Variant (101)..(143): Xaa in position 101 to 143 is any amino acid
  Variant (144)..(152): Xaa in position 144 to 152 is any or no amino acid
  Variant (154)..(171): Xaa in position 154 to 171 is any amino acid
  Variant (172)..(172): Xaa in position 172 is any or no amino acid
  Variant (175)..(176): Xaa in position 175 to 176 is any amino acid
  Variant (177)..(177): Xaa in position 177 is any or no amino acid
  Variant (179)..(180): Xaa in position 179 to 180 is any amino acid
  Variant (184)..(185): Xaa in position 184 to 185 is any amino acid
FXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKNXXXXXXXXXXXXXXXXXXXXXXXXXXXXXXXXXXXXXXXXXXXXXXXXXXXXGXXXXXXXXXXXXXXXXXXXPSXXXEXXGLPXXEA

SEQ ID NO: 2170 - protein, 24 aa, Artificial sequence
  protein pattern
  Variant (2)..(3): Xaa in position 2 to 3 is any amino acid
  Variant (4)..(4): Xaa in position 4 is Asp or Glu
  Variant (5)..(5): Xaa in position 5 is Ala, Gly, Ser or Thr
  Variant (6)..(6): Xaa in position 6 is any amino acid
  Variant (9)..(9): Xaa in position 9 is Pro or Val
  Variant (10)..(10): Xaa in position 10 is Ile, Leu, Pro or Val
  Variant (11)..(11): Xaa in position 11 is any amino acid
  Variant (13)..(19): Xaa in position 13 to 19 is any amino acid
  Variant (20)..(20): Xaa in position 20 is Ile, Leu, Met or Val
  Variant (21)..(21): Xaa in position 21 is Phe, Ile, Leu or Val
  Variant (22)..(23): Xaa in position 22 to 23 is any amino acid
  Variant (24)..(24): Xaa in position 24 is Asp, Glu, Asn or Arg
SXXXXXGLXXXEXXXXXXXXXXXX

SEQ ID NO: 2171 - DNA, 939 bp, Escherichia coli K12
  CDS (1)..(939): transl_table=11
atgtctgaattaaaaatttcccctgaattattacaaatttccccggaagtgcaggacgctttaaaaaacaaaaaaccggttgtggcgctggaatcgaccattatttctcacgggatgccgttcccacaaaatgcccagaccgcaattgaagttgaagaaactattcgtaaacagggcgctgtacctgccacgatcgccattattggcggcgtgatgaaagtggggttaagcaaagaagaaattgaattactgggtcgtgaagggcataacgtgaccaaagttagtcgtcgcgatttaccttttgttgttgccgccggaaaaaatggcgcaaccactgtggcttcaacgatgattattgcggcgcttgccggaattaaagtatttgccaccgggggaattggtggtgtgcatcgcggggcggaacataccttcgatatttctgccgatttgcaagaactggcaaatactaatgtcaccgttgtttgtgccggggcgaaatctattctcgatttaggattaaccactgagtatttagaaaccttcggtgtgccgttaattggctatcagactaaagcgctgcctgcgtttttctgccgcaccagcccgtttgacgtcagcattcgtctcgacagcgccagcgaaattgcccgtgcaatggtggtgaaatggcaaagcggtctgaacggtggcctcgtggtagcgaacccgatcccggaacagtttgctatgccggaacacactatcaatgcggcgatcgatcaggcggtagctgaagctgaagctcagggagtcattggtaaagaaagtacgccattcctgctggcgcgcgttgctgaactgaccggcggtgacagcctgaaatccaacatccagctggtgttcaacaacgccattctggcgagcgaaattgccaaagaatatcagcgtctcgcgggttaa

SEQ ID NO: 2172 - protein, 312 aa, Escherichia coli K12
MSELKISPELLQISPEVQDALKNKKPVVALESTIISHGMPFPQNAQTAIEVEETIRKQGAVPATIAIIGGVMKVGLSKEEIELLGREGHNVTKVSRRDLPFVVAAGKNGATTVASTMIIAALAGIKVFATGGIGGVHRGAEHTFDISADLQELANTNVTVVCAGAKSILDLGLTTEYLETFGVPLIGYQTKALPAFFCRTSPFDVSIRLDSASEIARAMVVKWQSGLNGGLVVANPIPEQFAMPEHTINAAIDQAVAEAEAQGVIGKESTPFLLARVAELTGGDSLKSNIQLVFNNAILASEIAKEYQRLAG

SEQ ID NO: 2173 - DNA, 1360 bp, Glycine max
  CDS (42)..(1061)
gaggtgcgagaagacgacagaagggggagtaagcaggcggcatggcattctcagcggtctggcgactagcgaatcttgggcgacacttggatttgagtgaatcagtgaacaaggctgcgccagttgggtcaatcaagttgaaggtagcttcagaggtttctgaagcattatcactgggtcgtgctgttgttgctcttgaatctaccattatttcgcatgggatgccatatccccaaaatttggaaactgcaaaagaggtggaacgtattgtaagagagaacggtgcagttcctgcaaccattgcaattttagatggcacgccttgtgtaggcctaagtgtagaagaacttgaaaggctagctattttgggaaccagagctcagaagacagctcgaagggacatcgcacatgttgtagcttgcggtggaaatggtgcaactactgtttctgcaacaatgctttttgcttcaatggttcatattcccgtttttgttactggggggattgggggagtgcacagacattcggaacagactatggacatatcttctgatctcactgagctaggcagaacaccagtaacagttgtatgtgctggtgtaaaatcaatattagatattcccaggacgcttgaatatctggaaacactaggagtttgtgtagctgcttacaagactaatgagtttcctgcatttttcacggaatcaagtggctgcaaggtctcatgtcgggtagatacccctgaagactgtgcttccttaatagaagcaagcatcaaactcaagcttggaactggaattttgatagcagttcctattcctcaagaacactcaacttctggacacataattgaatctgccattcagaaagccattaaagaagctagggaaaagaatataacaggaaatgctgagactcctttcttgcttgctagagtaaatgacctgactggaggtgcttcacttgctgcaaacattgctcttgtgaagaataatgctcttgttggagctaaagttgctgtagcccttgctcaattaagagaaaattgtcaaagatcttagaagttggaagatggcctccacaaccagtctgatccaactacaattgggagcaggaacctagaaacttgatcactctgctagtgcttcacttcttgacgttttgtgttgtattatccccccggttttccttgtgaagtggatatttttttttgctgttgttgttcgttatgcatttcaaaattgcagaagtggttagtgaacttgacaaaacatatatgttgtgagagggatactgctggacaggaaagatttaaaattctaattcaatctttccaagctaaattaaggacgcaaaaaaa

SEQ ID NO: 2174 - protein, 339 aa, Glycine max
MAFSAVWRLANLGRHLDLSESVNKAAPVGSIKLKVASEVSEALSLGRAVVALESTIISHGMPYPQNLETAKEVERIVRENGAVPATIAILDGTPCVGLSVEELERLAILGTRAQKTARRDIAHVVACGGNGATTVSATMLFASMVHIPVFVTGGIGGVHRHSEQTMDISSDLTELGRTPVTVVCAGVKSILDIPRTLEYLETLGVCVAAYKTNEFPAFFTESSGCKVSCRVDTPEDCASLIEASIKLKLGTGILIAVPIPQEHSTSGHIIESAIQKAIKEAREKNITGNAETPFLLARVNDLTGGASLAANIALVKNNALVGAKVAVALAQLRENCQRS

SEQ ID NO: 2175 - DNA, 1197 bp, Glycine max
  CDS (26)..(1024)
gttatttagagagattcagagagaaatggcttcatattcttcgtcctctctttctagaatctcaactctccagaatcatatctcccctcttgaagccaacaacaagctacggagtctggtcaagatatctccacaagtgtctgaagccatagccagtggacgtgctgtggtcgctcttgagtcaaccattatctcacatgggatgccttaccctcaaaacctgcaaacagcaaaagaggtggagtcaattgtgagagagaatggagcagtccctgcaacaatagctatattaaacggagtaccttgcataggtctgaacgaagaagaactagaacgtcttgcatctctgggcaaaagtgtccaaaagactgcaggcagggacataccacatgttgtggcgacaagaggagatggtgcaactacagtctctgcaacgttgttttttgcttcaatggttggcatccaagtctttgtaaccggcgggataggaggtgtgcatagacatgccaaccatactatggacatatcatctgatcttactgcactaggaaggactcctatagctgtgatatcagcaggcgttaaatcaatacttgatatcccaaagactcttgaatatttggaaactcaagaagtgtatgttgctgcatacaagagcgatgagtttccagcatttttcacagagaaaagcggctgtaaggcaccttcccgagttgatagccctgaagactgtgctcgagtaatagatgcaaacatgaagttaaaccgtaaggcggggattctattcgctgttccaatcccaaaacagcattcagctgccggaaatcttatcgaatcagcaacacagcgtgctcttacagaagcaagggaacaaaacgttactggaaatgccgaaactccattcttactctcacgtgtaaatgagttaactgaaggcacctcacttgcagcaaatattgcgcttgtgaaaaacaatgcccttatcggttctcaaattgcagtagcgctttctcagctggtatgagcttccttatcaacctcagactcaggctcaggttcatgattcaggactggtcaaagatcttttagattggtagtaatctagtgttttaatgttgcttatgaaatattgtttcttgcccaaaaaaaaactcttttttaacaaactttcacatattatatgaatatttttatatc

SEQ ID NO: 2176 - protein, 332 aa, Glycine max
MASYSSSSLSRISTLQNHISPLEANNKLRSLVKISPQVSEAIASGRAVVALESTIISHGMPYPQNLQTAKEVESIVRENGAVPATIAILNGVPCIGLNEEELERLASLGKSVQKTAGRDIPHVVATRGDGATTVSATLFFASMVGIQVFVTGGIGGVHRHANHTMDISSDLTALGRTPIAVISAGVKSILDIPKTLEYLETQEVYVAAYKSDEFPAFFTEKSGCKAPSRVDSPEDCARVIDANMKLNRKAGILFAVPIPKQHSAAGNLIESATQRALTEAREQNVTGNAETPFLLSRVNELTEGTSLAANIALVKNNALIGSQIAVALSQLV

SEQ ID NO: 2177 - DNA, 915 bp, Oryza sativa (japonica cultivar-group)
  CDS (1)..(915)
atgtcgccgtcgtcgtcgtcgtcgagcacggggccgatgggggtggcggtgtcgccggaggtggaagcggcgctggcgcgcggcggcgcggtcgtcgccctcgagtccaccatcatctgccacggtatgccctacccgaagaatctccagaccgccatggaggtggaggccgtcgtgagggagaacggggcggttcctgccaccatagccattctgaacggcgtgccacatgttggccttagcggcgagcaattgaagagcttggctgtaagtggaagacagtttcagaagacggctagaagggatattgcacatgttgtggcctctggtggtaatggtgcaacaacagtttctgccactatgtttttcgctcataaggttggcataccaattttcgtaactggagggattggaggtgttcatagaaatggtgaacagaccatggacatctcctcagacttaactgaacttggaaagactcctgtcactgttatttcagctggtgtgaaatctattttggacataccacggacacttgagtacttggaaactcaaggagtaacggttgctgcttacaaaaccaatgaatttcctgctttctttacagaagtcagcggatgtaaggtgccatgtcgcgttgattctcccgaagagtgtgccaagataatatatgcaaacaagaatttacatctaggatctgggattttgattgctgtgccgattcccaaggaacatgcagcttcaggaaatgctatagagtctgcaatacagaaagccctcaaggaagcagaggataaaaatataataggcaacgcgatcactcccttcatgcttgacagagtgaaagtactaactggacgatcttcgctagaagccaattgcgcttgtaaagaacaatgctcttgttggtgctaa

SEQ ID NO: 2178 - protein, 304 aa, Oryza sativa (japonica cultivar-group)
MSPSSSSSSTGPMGVAVSPEVEAALARGGAVVALESTIICHGMPYPKNLQTAMEVEAVVRENGAVPATIAILNGVPHVGLSGEQLKSLAVSGRQFQKTARRDIAHVVASGGNGATTVSATMFFAHKVGIPIFVTGGIGGVHRNGEQTMDISSDLTELGKTPVTVISAGVKSILDIPRTLEYLETQGVTVAAYKTNEFPAFFTEVSGCKVPCRVDSPEECAKIIYANKNLHLGSGILIAVPIPKEHAASGNAIESAIQKALKEAEDKNIIGNAITPFMLDRVKVLTGRSSLEANCACKEQCSCWC

SEQ ID NO: 2179 - DNA, 918 bp, Mesorhizobium loti MAFF303099
  CDS (1)..(918): transl_table=11
atgagccccgaaaccgcacgccccttcatcgacatccacgcacccgtggcgcaagccctggccgccgggcgccctgtcgtggcgctggaaagcaccatcatcacccatggcatgccctacccggacaatggcgccatggcggccaatgtcgagaagatcatcagcgacggcggcgccgtgccggcgacgatcgccgtgatcggtggacgcatcaagatcggcctttccgacggcgagcgcgaatcgctggccatgaccggtgacgccatgaagctgtcgcgcgccgacctcggcttcgccgtcgcgcaaggacgcaccggcggcacgaccgtcgccgccacgatgatcgcggctgaaatggtcggaataaaggtgttcgccaccggcggcattggcggcgtgcacaagggcgccgagaagagttttgacatctcggccgatctcgacgaattggcgcgcacaccggtcatcgtcgtctcggccggcgccaaggcgatcctcgacatcgaaaagacgctggaagtgctggagacgcgcggcgtgcccgtggtcggccatggctgtgagacgatgccggccttctggtcgcgacagtcgccgttccgcgcgcctctgacactttataagcccgaagagatcgcgcatttcttccggacgcgggtcgcgctggggctcggcggcggcgtgctggtcgccaatccggtgccggaaaaccacgaaatcccggctgaggagatggccggctacatcgaagccgcgcaaaaggccgccgaggcgctcaacgtgaccggcaaggcggtgacgccgttcctgctgggaaaaatcctggagttgaccggcggccgcagcctcaagactaatatcgcgctggtcgaaaacaatgcgcggctggcggccgagatagccaaggccctgtag

SEQ ID NO: 2180 - protein, 305 aa, Mesorhizobium loti MAFF303099
MSPETARPFIDIHAPVAQALAAGRPVVALESTIITHGMPYPDNGAMAANVEKIISDGGAVPATIAVIGGRIKIGLSDGERESLAMTGDAMKLSRADLGFAVAQGRTGGTTVAATMIAAEMVGIKVFATGGIGGVHKGAEKSFDISADLDELARTPVIVVSAGAKAILDIEKTLEVLETRGVPVVGHGCETMPAFWSRQSPFRAPLTLYKPEEIAHFFRTRVALGLGGGVLVANPVPENHEIPAEEMAGYIEAAQKAAEALNVTGKAVTPFLLGKILELTGGRSLKTNIALVENNARLAAEIAKAL

SEQ ID NO: 2181 - DNA, 858 bp, Thermotoga maritima MSB8
  CDS (1)..(858): transl_table=11
gtgatcatagaaagcaggatagaaaaaggaaagcccgttgtagggatggaaaccacagtgtttgttcatggactgcccagaaaggaagccatagagttgttcagaagggcgaaagagatatccagagaaaaagggttccagcttgcggttataggcatcctgaagggaaagatcgtcgctggcatgagtgaagaagaactcgaggcgatgatgagagaaggtgccgataaggtaggtacgcgagaaattcccattgtggtggctgagggaaaaaacgctgcgactactgtgagtgccaccatctttctctccagacgaatcggaatagaggtcgttgtaaccggaggaactgggggtgttcatcccggacgtgtggacgtttctcaggatctcaccgagatgtcttcttcgcgcgcagttctcgtatccagcgggataaagtccattcttgatgtggaagcaactttcgagatgcttgaaactttagagattcctctggttggtttcagaacgaacgagttcccgttgtttttctcgaggaaaagcggccgaagggttccaaggatagaaaatgtagaggaagtcttgaaaatctacgaatccatgaaagaaatggaacttgagaaaaccctcatggtgctgaatcctgtgccggaggagtacgaaataccgcacgatgaaatagaacgtcttcttgaaaagatcgagctggaggttgaaggaaaagaagtgactccttttcttctcaaaaagctcgtggagatgacgaatggaagaactctgaaggcgaatcttgctcttctcgaagaaaacgtgaaactcgcgggagagattgcggtaaaactcaaacgctcgtga

SEQ ID NO: 2182 - protein, 285 aa, Thermotoga maritima MSB8
MIIESRIEKGKPVVGMETTVFVHGLPRKEAIELFRRAKEISREKGFQLAVIGILKGKIVAGMSEEELEAMMREGADKVGTREIPIVVAEGKNAATTVSATIFLSRRIGIEVVVTGGTGGVHPGRVDVSQDLTEMSSSRAVLVSSGIKSILDVEATFEMLETLEIPLVGFRTNEFPLFFSRKSGRRVPRIENVEEVLKIYESMKEMELEKTLMVLNPVPEEYEIPHDEIERLLEKIELEVEGKEVTPFLLKKLVEMTNGRTLKANLALLEENVKLAGEIAVKLKRS

SEQ ID NO: 2183 - DNA, 942 bp, Deinococcus radiodurans R1
  CDS (1)..(942): transl_table=11
atgaccagcaaacccagcaatgaccgcctccattcttacctcgaccttcagcccgaagtcgccgccgcgctctcgcagggccgcccggtggtggcgctcgaaagcaccatcatcagccacgggatgccctacccgcaaaacgtggagatggcgcggggcgtggagcaaatcgtgcgcgacaacggcgccgtgcccgcgactatcgctgtgctcggcgggcggctcaaggtggggctgagtgccgacgagttggagctgctcgccaccgacaaggcggtgcagaaaatcagcacccgcgacctgccggtgacggtggcgctcgggggccacggggcgacgacggtggcctccaccatgcggattgccgcgctcgccgggattcgcgtctttgcaacgggtggcaccggcggcgtgcaccggggcgcgggcgagacgatggacatcagcgccgacctgctcgaactcgcccgcaccgacgtgtgcgtggtgagcgccggggtcaagagcattctggacattggcctgacgctggaagtgctggaaacgcagggcgtgcccgccatcaccctcggcgccgatgagtttcctgccttctactcgcgccgcagcggcttcagctcgccgctcacggtccagacccccgccgaggccgcccgcgtgctgaaggtgaagtgggacctgggcctgaccggcggcgtcctgctcgccaatccggtgcccgaaaccgccgagattcccgccgaggagatggaaacccacatcacgcgggcgctggcggacatggccgcgcttgggctgagcggcaaggacaccacgccgtacctgctgggccgcatcgtggaactcaccgggggccgcagcctggagacgaacatcgctctagtccgccacaacgcggcggcggcggcgcaggtcgcggcggagtacgcgcggctgggctga

SEQ ID NO: 2184 - protein, 313 aa, Deinococcus radiodurans R1
MTSKPSNDRLHSYLDLQPEVAAALSQGRPVVALESTIISHGMPYPQNVEMARGVEQIVRDNGAVPATIAVLGGRLKVGLSADELELLATDKAVQKISTRDLPVTVALGGHGATTVASTMRIAALAGIRVFATGGTGGVHRGAGETMDISADLLELARTDVCVVSAGVKSILDIGLTLEVLETQGVPAITLGADEFPAFYSRRSGFSSPLTVQTPAEAARVLKVKWDLGLTGGVLLANPVPETAEIPAEEMETHITRALADMAALGLSGKDTTPYLLGRIVELTGGRSLETNIALVRHNAAAAAQVAAEYARLG

SEQ ID NO: 2185 - DNA, 1002 bp, Agrobacterium tumefaciens str. C58
  CDS (1)..(1002): transl_table=11
gtgtcgaagccatgttggggcttgttccccaggccgaaatgctggcatgaagcgcttttaaaaactggaacagatgaaatgacccgccccatctccccgctcctgcccatcgtctattctcaggaagtcgccgccgccaagcagcgcggtgcgccgatcgtcgcgctcgaatcgaccatcatcacccacggcatgccctatccaggcaatatcgagatggcggaaagcgtcgagcagatcatccgtgatcagggtgcggttccggccaccatcgccgtcattcacggcacgctgcatatcggccttgagaaagaccagctcgaggcgctcgcccagaccaccgacgccatgaaggtgtcgcgcgccgatatcgccttcgcgatcgccgagcgccgcacgggtgccaccacggtcgccgccacgatgatcgccgccgcccgcgccggcatccgcgttttcgccactggtggcatcggcggcgtgcacaagggcgcggaagaaaccttcgacatctccgccgacctgaccgagcttgccaagaccggcgtgatcgtcgtctgcgccggcgccaaggcgatcctcgacattccaaagacactcgaggttctcgaaaccaacggcgtgcctgtcgttaccttcggctccgaagaattcccggctttctggtcgcgctcctccggcctggccagcccactctcgctcaacagcccggcggcaatcgccaatttccaggcgacccgcgaacagctcgggatcgatggcggcatgctggtggccaaccccgtgccggaagaagacgaaattccgcgcgaggagatggagatctacatcaaccgcgccatctcccatgcagaacgcgacgaagtcaccggcaaggcggtcacgccttacctgctcggcgatattttccgcctgacggatggcaggagcctcgagaccaacatcgcactggtacgcaacaatgcgcagctggctgcggaaatcgccgtggcgttgagctga

SEQ ID NO: 2186 - protein, 333 aa, Agrobacterium tumefaciens str. C58
MSKPCWGLFPRPKCWHEALLKTGTDEMTRPISPLLPIVYSQEVAAAKQRGAPIVALESTIITHGMPYPGNIEMAESVEQIIRDQGAVPATIAVIHGTLHIGLEKDQLEALAQTTDAMKVSRADIAFAIAERRTGATTVAATMIAAARAGIRVFATGGIGGVHKGAEETFDISADLTELAKTGVIVVCAGAKAILDIPKTLEVLETNGVPVVTFGSEEFPAFWSRSSGLASPLSLNSPAAIANFQATREQLGIDGGMLVANPVPEEDEIPREEMEIYINRAISHAERDEVTGKAVTPYLLGDIFRLTDGRSLETNIALVRNNAQLAAEIAVALS

SEQ ID NO: 2187 - DNA, 924 bp, Staphylococcus aureus subsp. aureus Mu50
  CDS (1)..(924): transl_table=11
atggcaaatttacaaaagtatattgagtattctcgagaagttcagcaagcacgggagaacaatcaaccgattgtagcattagaatcaacaattatttcgcatggtatgccgtacccacaaaatgttgaaatggcaacaacagtagagcaaattatcaggaataatggtgccattccagcaaccatagccattatagatggcaaaattaaaattggtttagaaagcgaagatttagaaatactggcaactagtaaagacgttgctaaagtatctagaagggatttagcagaagttgttgcgatgaagtgtgttggtgctactactgtagcgacgacgatgatatgtgctgcaatggctggtattcaattttttgttacaggaggtattgggggcgtccataaaggtgcagaacatacgatggacatttcagcagacttagaagaactgtctaaaacaaatgtcactgttatctgtgcaggtgccaaatcaattttagacttacctaagacgatggagtatttagaaacaaaaggcgttccagttattggatatcaaacgaatgaattgccagcattcttcactcgcgaaagcggtgttaagttaacaagttcggttgaaacgccagaacgacttgctgacattcatttaacaaaacagcagttaaatcttgaaggtggcattgttgttgctaatccaattccatatgagcatgccttatcaaaagcatatattgaggcaatcataaatgaagctgttgttgaagcggaaaatcaaggtattaaaggtaaggacgccacaccgttcttgttagggaaaattgtagaaaaaacgaatggtaaaagtttagcagcaaatataaaacttgttgaaaacaatgcggcgttgggtgctaaaattgctgtcgctgttaataaattattgtag

SEQ ID NO: 2188 - protein, 307 aa, Staphylococcus aureus subsp. aureus Mu50
MANLQKYIEYSREVQQARENNQPIVALESTIISHGMPYPQNVEMATTVEQIIRNNGAIPATIAIIDGKIKIGLESEDLEILATSKDVAKVSRRDLAEVVAMKCVGATTVATTMICAAMAGIQFFVTGGIGGVHKGAEHTMDISADLEELSKTNVTVICAGAKSILDLPKTMEYLETKGVPVIGYQTNELPAFFTRESGVKLTSSVETPERLADIHLTKQQLNLEGGIVVANPIPYEHALSKAYIEAIINEAVVEAENQGIKGKDATPFLLGKIVEKTNGKSLAANIKLVENNAALGAKIAVAVNKLL

SEQ ID NO: 2189 - DNA, 933 bp, Sinorhizobium meliloti 1021
  CDS (1)..(933): transl_table=11
atgaccaaaccctcctccccgtccctgccgatggaatattcagatgaagtcgcagccgccaagcaacgaggtgcgccgatcgtcgcgctggaatccacgatcatcacgcatggcatgccctatcccggcaacctcgacatggcccgcagcgtcgaggcgatcatccgtgaacagggtgccgtgcccgcaaccatcgccgtgatccacggggtcctgcatatcggtctggacgatgccaaactggaggctttgtcgaaaacgcagggcgccatgaaactgtcgcgcgccgatctcgcctttgcgatcgccgaacgccgcaccggcgccacgaccgttgccgcaacgatgatcgccgccgcccgcgccggcatccgggttttcgcgaccggcggcatcggcggcgttcaccgcggggcggaacagagcttcgacatatcggcggatctcgacgaactcgcacgtaccggcgtcatcgtcgtctgcgccggcgccaaggccattctggacattcccaagacgctcgaagtgctcgaatcgcgcggtgttcctgtcgtgacctatgacagcgagaacttccccgccttctggtcgcgcgaatccggcctcaagagcccgctgatgctgaacagcccggcggcgatcgccagtttccagcggacgcgcgaactgctcggaatcgacggcggaatgcttgtcgccaatccggtgccggtagaaagcgaaatcccgcgcgaggagatggagatctacatcacccgcgcgctggacaatgcggcgagcgaggggatttccggcaaggcggtcaccccgtatctgctcgacaacctcttccgtttgacggacgggcgcagcctcgaaaccaatatcgcgctggtcgagaacaatgcacgccttgccgccgggatcgccgtcgctctcgctgctaacgattga

SEQ ID NO: 2190 - protein, 310 aa, Sinorhizobium meliloti 1021
MTKPSSPSLPMEYSDEVAAAKQRGAPIVALESTIITHGMPYPGNLDMARSVEAIIREQGAVPATIAVIHGVLHIGLDDAKLEALSKTQGAMKLSRADLAFAIAERRTGATTVAATMIAAARAGIRVFATGGIGGVHRGAEQSFDISADLDELARTGVIVVCAGAKAILDIPKTLEVLESRGVPVVTYDSENFPAFWSRESGLKSPLMLNSPAAIASFQRTRELLGIDGGMLVANPVPVESEIPREEMEIYITRALDNAASEGISGKAVTPYLLDNLFRLTDGRSLETNIALVENNARLAAGIAVALAAND

SEQ ID NO: 2191 - DNA, 912 bp, Listeria monocytogenes EGD-e
  CDS (1)..(912): transl_table=11
atgaaaaattatctatcattatccgaagaagtaaaacaagcaaaagcagaaggaaaagcaattgttgcgctagaatctactattatctctcacggtatgccatacccgcaaaatgttgaaatggcgcgtgatgtggaacaaattattcgtgataacggtgccgtaccagcaacaatcgctttaatcgacggaaaaattaaaatcggtctttctgatgaagaactagaactatttgctaaaagtagcaatgtagcaaaagtttctcgtcgtgatatcggttaccttattgcaacaaaacaacttggagcaacaactgtagcagctacaatgatttgtgctgaactcgcagaaattggaatcttcgtaactggcggaattggtggtgttcaccgtggtgccgaaacaacaatggacgtttcagctgacttagaagaattagcgaaaacaaatgttgctgtcgtttgtgccggagcaaaatcaatcctagacctaaacttaacaatggaatacctagaaacaaaaggggttccagttattggttaccaaaccgatgtattgccagcattttacacacgttcaagtgatgtagaattaacattgcgtgcagacactccggaagttatcgcagaatcgcttaaagcgaaatgggaccttcaaatcgaaggcggcgcagtaattactaacccaatcccagaagaattcgctatggacgaaaaagtaattaacgatgtaatccaaacagcgcttaaagaagcagaagaaaaccatatccacggaaaagacgttactccattcctacttggaaaagtaaaagaactaacagatggtaagagccttgaagcaaacatcgaacttgtaaaacacaatgctttaatcggtacacaaatcgccgtagcataccaaaacatctaa

SEQ ID NO: 2192 - protein, 303 aa, Listeria monocytogenes EGD-e
MKNYLSLSEEVKQAKAEGKAIVALESTIISHGMPYPQNVEMARDVEQIIRDNGAVPATIALIDGKIKIGLSDEELELFAKSSNVAKVSRRDIGYLIATKQLGATTVAATMICAELAEIGIFVTGGIGGVHRGAETTMDVSADLEELAKTNVAVVCAGAKSILDLNLTMEYLETKGVPVIGYQTDVLPAFYTRSSDVELTLRADTPEVIAESLKAKWDLQIEGGAVITNPIPEEFAMDEKVINDVIQTALKEAEENHIHGKDVTPFLLGKVKELTDGKSLEANIELVKHNALIGTQIAVAYQNI

SEQ ID NO: 2193 - DNA, 912 bp, Listeria innocua Clip11262
  CDS (1)..(912): transl_table=11
atgaaaaattatctatcattatccgaagaagtaaaacaagcaaaagcagaaggaaaagctatcgtagccttagaatccacaatcatctctcacggcatgccttacccacaaaatgttgaaatggctcgtgacgtagaacaaattatccgtgataacggcgcggtacctgcaacaatcgctttaatcgacggtaaaattaaaatcggtctttctgatgaagaactagaactatttgcaaaaagcagcaatgtagcaaaagtttctcgtcgtgatattggctaccttattgctacaaaacaactaggagcaacaacagtagctgcaacgatgatctgtgctgaattagcagaaatcggtatctttgtaactggtggaatcggcggagttcaccgcggtgccgaaacaacaatggacgtttctgctgatttagaagagttagcgaaaacaaatgtagcagtagtatgtgctggagcaaaatctatcttagacttaaacttaacaatggaatacttagaaacaaaaggcgttccagtaattggttaccaaacagacgtacttccagcattctatactcgttcaagcgatgtagaattaacattacgtgcagatgctccagaagttatcgctgagtcccttaaagcaaaatgggatctaaaaattgaaggtggcgctgtaatcacaaacccaatcccagaagaatttgcaatggatgaaaaagtaattaacgatgttatccaaactgcacttaaagaagcagaagaaaaccacatccacggaaaagacgttacaccattccttcttggcaaagtaaaagaactaacagacggtaagagcttagaagcaaatatcgaactagtaaaacacaacgcactaatcggtactcaaatcgccgtagcttatcaaaatatctaa

SEQ ID NO: 2194 - protein, 303 aa, Listeria innocua Clip11262
MKNYLSLSEEVKQAKAEGKAIVALESTIISHGMPYPQNVEMARDVEQIIRDNGAVPATIALIDGKIKIGLSDEELELFAKSSNVAKVSRRDIGYLIATKQLGATTVAATMICAELAEIGIFVTGGIGGVHRGAETTMDVSADLEELAKTNVAVVCAGAKSILDLNLTMEYLETKGVPVIGYQTDVLPAFYTRSSDVELTLRADAPEVIAESLKAKWDLKIEGGAVITNPIPEEFAMDEKVINDVIQTALKEAEENHIHGKDVTPFLLGKVKELTDGKSLEANIELVKHNALIGTQIAVAYQNI

SEQ ID NO: 2195 - DNA, 924 bp, Agrobacterium tumefaciens str. C58
  CDS (1)..(924): transl_table=11
atgacccgccccatctccccgctcctgcccatcgtctattctcaggaagtcgccgccgccaagcagcgcggtgcgccgatcgtcgcgctcgaatcgaccatcatcacccacggcatgccctatccaggcaatatcgagatggcggaaagcgtcgagcagatcatccgtgatcagggtgcggttccggccaccatcgccgtcattcacggcacgctgcatatcggccttgagaaagaccagctcgaggcgctcgcccagaccaccgacgccatgaaggtgtcgcgcgccgatatcgccttcgcgatcgccgagcgccgcacgggtgccaccacggtcgccgccacgatgatcgccgccgcccgcgccggcatccgcgttttcgccactggtggcatcggcggcgtgcacaagggcgcggaagaaaccttcgacatctccgccgacctgaccgagcttgccaagaccggcgtgatcgtcgtctgcgccggcgccaaggcgatcctcgacattccaaagacactcgaggttctcgaaaccaacggcgtgcctgtcgttaccttcggctccgaagaattcccggctttctggtcgcgctcctccggcctggccagcccactctcgctcaacagcccggcggcaatcgccaatttccaggcgacccgcgaacagctcgggatcgatggcggcatgctggtggccaaccccgtgccggaagaagacgaaattccgcgcgaggagatggagatctacatcaaccgcgccatctcccatgcagaacgcgacgaagtcaccggcaaggcggtcacgccttacctgctcggcgatattttccgcctgacggatggcaggagcctcgagaccaacatcgcactggtacgcaacaatgcgcagctggctgcggaaatcgccgtggcgttgagctga

SEQ ID NO: 2196 - protein, 307 aa, Agrobacterium tumefaciens str. C58
MTRPISPLLPIVYSQEVAAAKQRGAPIVALESTIITHGMPYPGNIEMAESVEQIIRDQGAVPATIAVIHGTLHIGLEKDQLEALAQTTDAMKVSRADIAFAIAERRTGATTVAATMIAAARAGIRVFATGGIGGVHKGAEETFDISADLTELAKTGVIVVCAGAKAILDIPKTLEVLETNGVPVVTFGSEEFPAFWSRSSGLASPLSLNSPAAIANFQATREQLGIDGGMLVANPVPEEDEIPREEMEIYINRAISHAERDEVTGKAVTPYLLGDIFRLTDGRSLETNIALVRNNAQLAAEIAVALS

SEQ ID NO: 2197 - DNA, 993 bp, Arabidopsis thaliana
  CDS (1)..(993)
atggcttcttctttagctcaatctagaatctcgaatctccagaatcatctttcacctcttgaagcaaacaacaagctcaggagtctggtcaagatttctccccaagtatctgaagccttgtctaatggacgtgctgttgtcgctcttgagtcaaccattatctcccatgggatgccttaccctcaaaatctgcaaacagcaaaagaggtggagtcaattgtgagagaaaatggagcaatccctgcaacaattgctatccttaatggagtaccttgcataggtctgagcgaggaagaactagaacgtcttgcatctctcggaaaaagtgtccaaaagacagcgggaagggacatagcaaatgttgtggctacaagaggaaacggtgcaactacagtctctgcaacgttgtttttcgcttcaatggttggcatccaagtttttgtgacgggcgggataggtggtgtccatagacatgccaaccattcgatggacatatcatctgatcttactgcacttgggaggactccaatagcagtgatatcagcaggcgttaaatcaatacttgatattccaaagactcttgaatatttggaaactcaagaagtgtatgttgctgcatacaagagcgatgagtttccagcatttttcacagaaaaaagtggctgtaaggcaccttcccgtgtaaatagccctgaagactgtgctagagtaatagatgcaaacatgaagctaaaccgtcaggcggggattctatttgccattccaattccgaaacaccattcagccgctggaaatcttatcgaatcagcaacacagcgtgctcttacagaagcaagggaacaaaacgttactggaaatgcagaaactccattcttacttgcacgggtaaatgagttaaccggaggcacatcacttgcagcaaacattgcgcttgtgaaaaacaatgcccttatcggttctcagattgcagtagccctttctcagctgatgtga

SEQ ID NO: 2198 - protein, 330 aa, Arabidopsis thaliana
MASSLAQSRISNLQNHLSPLEANNKLRSLVKISPQVSEALSNGRAVVALESTIISHGMPYPQNLQTAKEVESIVRENGAIPATIAILNGVPCIGLSEEELERLASLGKSVQKTAGRDIANVVATRGNGATTVSATLFFASMVGIQVFVTGGIGGVHRHANHSMDISSDLTALGRTPIAVISAGVKSILDIPKTLEYLETQEVYVAAYKSDEFPAFFTEKSGCKAPSRVNSPEDCARVIDANMKLNRQAGILFAIPIPKHHSAAGNLIESATQRALTEAREQNVTGNAETPFLLARVNELTGGTSLAANIALVKNNALIGSQIAVALSQLM

SEQ ID NO: 2199 - DNA, 2244 bp, Schizosaccharomyces pombe 972h-
  CDS (1)..(2244)
atgctcatcgttatgaatagaggttgtcggttagtttcacgtattccattggggttcagaaggctgaagagaaatccaaaccctggattgaggaatatactttgcagaagatatagtccgctggccttatccaaggaagtgacagaagcccttaaaaacaacgtaccagtcgttgccttagaatcaactatcatcactcatggaatgccttatcctcaaaatgaagaattggcaattcaagtggaaagcaaggtacgcagcatgggtgcggttcctgcgacaattgctctattaaatggacaatgtactatagggcttgaacaatttcagttaagcgaacttgctaaatcaggtgaaacagcatataaagtgtctcgtagagatttatcttatgttgcttcccagagactcaatggtggaaccacagttgctgcaactatgatcttggctagagcagctggcattgacgtattcgcaacgggcggtataggtggtgttcatcgtggggcagaaaattccatggatatttctgcggatttaatagaattaggtcgcacaagggttgccgtcgtcagtgctggtgtcaagagtatactcgatattggacgcacacttgaagtattagaaactcagggtgttcctgttgtcactttaggccctccaaaatcggctttccctgcatttttttcaagagaatccaagttccagagccctctttctctagaaactccgcagttaattgctaacatgctctttagtaatatacagcttggccaggaatgtggtactcttgtggccattcccacccctcaccattgttctattgattacgaaaaaatggaggctttgattgaaacttgtttgcaaaggagtgtacaacttggcataactggtaaaaatgtaactccatggcttttaggagaacttctaagagaatcaaaagggaaaagtttaaatactaatattgatttggtcttaaacaatgccgaaaaggcttcccttattgcaaaagaactagctgttttaaaagaaaaaagctcttttttccctaccaacaccggaaatacatttgaaacgaagccggttaaacaagactttttctatggtaaagtgagtgacaaaggggtttcgtcgagcaaaaaaaaaattacagaaacaacgtccaaacctgcagaagttgtatgtgttggtagtgtgtctattgactcagttttgaaattggataatcctttaacatctaaattccttggcacatctcatccttgtcactctgaacaggcttttggcggtgttgctcataacatggctttggcttcttctttaatgggcgcttctacgaagttggtttcatgtgttggaacaaaatccgtacccacttcctctattaaagagtatcttaccaagtcttctttgcagcataccattgttgagaaaagtaactttacctcttgctcatacacagctatcaacgattgtaatggcaatttattattagctggagctgacatggccatcatggaaaaccttagttattcagaaatcaaggatgatcttaatgacgctaagtacatttgttttgatggtaatatttcaccgtcattgatgctagatataaccacatctaaatcgagtaagcaacgagtcgtttttgaaccaaccagtggtcccaaaacattaaagatactaaaagtcttatctgttgcctcaattgattttataacaccgaacaagtttgaactcgatgtattatttcaagctatgaaagacggaaatttcttcgagaatgagtcatggtggcagaagttaaacagctttggtatcacctcctctttctataatgagattgagcgttttacgaaaagtacaggaatagaagaaattacagaaaacggaatcttacaaaagtgttttcatttacttcccttcataaagaatattattgttaagttaggacctaatggtgctcttttaataagctctgagaaacttcaaggagtgaattcaaactcagccagcctttttacccccggaaatgtgactgtaaagtattaccctgttccaaaagttatagcaacccctgtaaatgctagcggaactggtgatacttttatcggtactttcactgctttgctttcgaaaggctggggtatggacgatgctattgatactgctcaaaaagctgcgggcctcactttgcagtgtaatttttcagtaaatcctgaaataaagactcttttaaaatag

SEQ ID NO: 2200 - protein, 747 aa, Schizosaccharomyces pombe 972h-
MLIVMNRGCRLVSRIPLGFRRLKRNPNPGLRNILCRRYSPLALSKEVTEALKNNVPVVALESTIITHGMPYPQNEELAIQVESKVRSMGAVPATIALLNGQCTIGLEQFQLSELAKSGETAYKVSRRDLSYVASQRLNGGTTVAATMILARAAGIDVFATGGIGGVHRGAENSMDISADLIELGRTRVAVVSAGVKSILDIGRTLEVLETQGVPVVTLGPPKSAFPAFFSRESKFQSPLSLETPQLIANMLFSNIQLGQECGTLVAIPTPHHCSIDYEKMEALIETCLQRSVQLGITGKNVTPWLLGELLRESKGKSLNTNIDLVLNNAEKASLIAKELAVLKEKSSFFPTNTGNTFETKPVKQDFFYGKVSDKGVSSSKKKITETTSKPAEVVCVGSVSIDSVLKLDNPLTSKFLGTSHPCHSEQAFGGVAHNMALASSLMGASTKLVSCVGTKSVPTSSIKEYLTKSSLQHTIVEKSNFTSCSYTAINDCNGNLLLAGADMAIMENLSYSEIKDDLNDAKYICFDGNISPSLMLDITTSKSSKQRVVFEPTSGPKTLKILKVLSVASIDFITPNKFELDVLFQAMKDGNFFENESWWQKLNSFGITSSFYNEIERFTKSTGIEEITENGILQKCFHLLPFIKNIIVKLGPNGALLISSEKLQGVNSNSASLFTPGNVTVKYYPVPKVIATPVNASGTGDTFIGTFTALLSKGWGMDDAIDTAQKAAGLTLQCNFSVNPEIKTLLK

SEQ ID NO: 2201 - DNA, 924 bp, Thermoanaerobacter tengcongensis MB4
  CDS (1)..(924): transl_table=11
atgaatagatttatcgatttgtcagaagaagtaaaaagtgccttagaggaaagaaggccagttgtggctttagaatctacgataatatcccacggtatgccctacccacaaaatattgaaactgccagagccttagaagaaattgtaagggaaaatggcgctgtacctgctacaattgcaattataggaggaaaaataaaaataggtctaaatgaagaggaactggagtttatgggtacatcaaaagaaatattaaaagccagcaaaagagatttgcctgtggtcttagcaaaagggttaaacgctgctactactgtttctgccacgatgatttgtgcaaaccttgcaggtataaaggtatttgtgacaggaggaataggaggagtacacagaggggcagaagagactttcgatatatctgccgatttgcaagaacttgcaaatacaaatgtagcagttgtatgtgcaggagcaaaagctatacttgatttacctcgtactttagaatatcttgaaacctttggtgttcctgtaattggatttagaacagaggaatttcctgctttttacacaagagagagcgggctcaaagtggactacagagtggaagatgaagtagaagccgcaaaggttataaaaactaaatgggatttgggacttaaaggagggattttaatagccaatcccattcctgaagaatatgccctagacagagcttatattgaaaaagccatagaagaggctatttttgaagcagacagacgaggaataaggggtaaagcccttacgccatttttgttggaaaagataaaggacctgacagagggtaaaagtttaaaagcaaatattgaacttgttaagaataatgccagagttggagccaaaattgctgtacaattgaataaactgtataaagaggcgtag

SEQ ID NO: 2202 - protein, 307 aa, Thermoanaerobacter tengcongensis MB4
MNRFIDLSEEVKSALEERRPVVALESTIISHGMPYPQNIETARALEEIVRENGAVPATIAIIGGKIKIGLNEEELEFMGTSKEILKASKRDLPVVLAKGLNAATTVSATMICANLAGIKVFVTGGIGGVHRGAEETFDISADLQELANTNVAVVCAGAKAILDLPRTLEYLETFGVPVIGFRTEEFPAFYTRESGLKVDYRVEDEVEAAKVIKTKWDLGLKGGILIANPIPEEYALDRAYIEKAIEEAIFEADRRGIRGKALTPFLLEKIKDLTEGKSLKANIELVKNNARVGAKIAVQLNKLYKEA

SEQ ID NO: 2203 - DNA, 906 bp, Streptomyces coelicolor A3(2)
  CDS (1)..(906): transl_table=11
atgctggtgctgtcggaagaggtgcgggaggcgatggacgcgcgtcgccccgtggtggccctggagtccacgatcatcgcgcacggcttgccccgcccgcgcaatctgctggtggcgcgggagctggaggaggcggtgcggcaggagggtgccgtaccggcgacgatcgccgtgctggacggccggccgcatgtcggcctggacaaggagcagctggaacgggtcgccggcgaggacggcatccgcaagctgggacaccgggacctgccgctcgcggtggcctccggcgcgagcggggcgaccaccgtgtcggcgaccgccctgctggcggacctcgcgggcgtacgggtgttcgccacgggagggctgggcggcgtccaccgggagtggacggtgacgcaggacgagtcggccgacctgggtctgctggcccgcacccggatcaccgtggtctgcgcgggcgtgaagtcgatcctggacgtgccggcgacgctgcagcggctggagacgctgggggtcgccgtggccggttacgggacggaccgcttccccggcttctacctgtccgactcggggcatccggtggactggacgctggacgacccggggcaggtggcagcggtcatgcgggcgcaggacgcgctggacgggccgcggtccgcgctcgtggtcgccaaccccgttcccgagcaggagcagctcgatcccggactccacgcgcgcgtgctcgcggacgcgctgcacgcctgcgaggcggagggtgtcacgggccaggcggtcacgccgttcctcctcgaacgcctggtgcggctcaccgacggcgcctcgctgagcgccaacctggcggcggtgcgggggaacgtgcggctggcggcccggatcgcggcggcctggaccggggcatga

SEQ ID NO: 2204 - protein, 301 aa, Streptomyces coelicolor A3(2)
MLVLSEEVREAMDARRPVVALESTIIAHGLPRPRNLLVARELEEAVRQEGAVPATIAVLDGRPHVGLDKEQLERVAGEDGIRKLGHRDLPLAVASGASGATTVSATALLADLAGVRVFATGGLGGVHREWTVTQDESADLGLLARTRITVVCAGVKSILDVPATLQRLETLGVAVAGYGTDRFPGFYLSDSGHPVDWTLDDPGQVAAVMRAQDALDGPRSALVVANPVPEQEQLDPGLHARVLADALHACEAEGVTGQAVTPFLLERLVRLTDGASLSANLAAVRGNVRLAARIAAAWTGA

SEQ ID NO: 2205 - DNA, 939 bp, Shigella flexneri 2a str. 301
  CDS (1)..(939): transl_table=11
atgtctgaattaaaaatttcccctgaattattacaaatttctccggaagtgcaggacgctttaaaaaacaaaaaaccggttgtggcgctggaatcgaccattatttctcacgggatgccgttcccacaaaatgcccagaccgcaattgaagtagaagaaactattcgtaaacagggcgcagtacctgccactatcgccattattggcggcgtgatgaaagtgggtttaagcaaagaaaaaattgaattactgggtcgtgaagggcataacgtgaccaaagttagtcgtcgcgatttaccttttgttgttgccgccggaaaaaatggcgcaaccactgtggcttcaacgatgattattgcggcgcttgccggaattaaagtatttgccaccgggggaattggtggtgtgcatcgcggggcggaacataccttcgatatttctgccgatttgcaagaactggcaaatactaatgtcaccgttgtttgtgccggggcgaaatctattctcgatttaggattaaccactgagtatttagaaaccttcggtgtgccgttaattggctatcagactaaagcgctgcctgcgtttttctgccgtaccagctcgtttgacgtcagcattcgtctcgacagcgccagtgaaattgcccgtgcaatggcggtgaaatggcaaagcgggctgaacggtggcctcgtggtagcgaacccgatcccggaacagtttgcgatgccggaggaatctatcaatgcagccatagatcaagccgtcgccgaagccgaagagcagggcgttattggtaaagaaagtacaccgttcctgctggcgcgcgttgctgagctgaccagcggtgacagcctgaaatccaatatccagctggtgttcaacaacgccattctggcgagtgaaattgccaaagaataccagcgtctcgcgggttaa

SEQ ID NO: 2206 - protein, 312 aa, Shigella flexneri 2a str. 301
MSELKISPELLQISPEVQDALKNKKPVVALESTIISHGMPFPQNAQTAIEVEETIRKQGAVPATIAIIGGVMKVGLSKEKIELLGREGHNVTKVSRRDLPFVVAAGKNGATTVASTMIIAALAGIKVFATGGIGGVHRGAEHTFDISADLQELANTNVTVVCAGAKSILDLGLTTEYLETFGVPLIGYQTKALPAFFCRTSSFDVSIRLDSASEIARAMAVKWQSGLNGGLVVANPIPEQFAMPEESINAAIDQAVAEAEEQGVIGKESTPFLLARVAELTSGDSLKSNIQLVFNNAILASEIAKEYQRLAG

SEQ ID NO: 2207 - DNA, 906 bp, Streptomyces avermitilis MA-4680
  CDS (1)..(906): transl_table=11
gtgctggtggtgtccgaagaggtacgggaggcgctcgccgcgcaccggccggtggtggctctggagtccacgatcatcgcgcacgggctgccgcgtccgcgcaatctccaggtcgctctggagctggaggacgtcgtacggcaggagggtgccgtgcccgcgacgatcgccgtgctcgacgggcatccccgtgtcggcctggacaaggaacagctggagcgggtcgccaacgaggacgggatccgcaagctggggcatcgcgatctgccgctcgcggtggcggcgggcgcgagcggcgcgaccacggtgtcggcgactgctctgctggcggccctcgcgggcgtacgggtgttcgcgacgggcggtctcggcggggtgcaccgcgagtggacggtgacgcaggacgagtcggccgacctgggactgctggcacgcacccggatcacggtggtgtgcgcgggcgtgaagtccatcctggacgtgcccgcgacgctgcagcggctggagaccctgggagtcgcggtggccgggtacggcacggcgcgctttcccggcttctatctgtccgactccgggtatccggtggactggacgcttcggtcgccgcggcaggtcgcggatgtcatgcgcgcgcaggacgcgctcgacggcccggagtcggcgctcatcgtcgcccatcccgtccccgaggacgaacagctcgatcccgagctccacgcgcgcgtactcgccgacgcgctgcacgcgtgcgaggcggagggcgtcacgggccaggcggtcaccccgttcctcctcgactacctggtacgccacaccgagggtgcctcgctgagcgccaacctggcggcggtacggggcaacgtacgcctcgcggggcggatcgcggcggcctgggccggggcatga

SEQ ID NO: 2208 - protein, 301 aa, Streptomyces avermitilis MA-4680
MLVVSEEVREALAAHRPVVALESTIIAHGLPRPRNLQVALELEDVVRQEGAVPATIAVLDGHPRVGLDKEQLERVANEDGIRKLGHRDLPLAVAAGASGATTVSATALLAALAGVRVFATGGLGGVHREWTVTQDESADLGLLARTRITVVCAGVKSILDVPATLQRLETLGVAVAGYGTARFPGFYLSDSGYPVDWTLRSPRQVADVMRAQDALDGPESALIVAHPVPEDEQLDPELHARVLADALHACEAEGVTGQAVTPFLLDYLVRHTEGASLSANLAAVRGNVRLAGRIAAAWAGA

SEQ ID NO: 2209 - DNA, 957 bp, Photorhabdus luminescens subsp. laumondii TTO1
  CDS (1)..(957): transl_table=11
atgaatatcagcaataaggttccatttaaattcagccttgaggtaaaagaagcacttgaatcaggaaagcctgttgttgctctggaatctaatgtgattactcatggtttggattatcctgataatgtcacaacagctaagaatgttgagcaggctgttcgtgaaagtggggcaatacccgcaacgataggaatagataagggggaatttttgattggaatgtcagatgagcaaattgaaaaatttgcgacagcatctcacgttccaaaggtcacgagtcgagatattccggtcgtgttagcgagtggcggtatgggggcgaccactgtggcatcgtcaatacttgcagcagaaatagcgggtattaaattcttctgttctgcgggtattggtggggtacatcgaggggcagagacgagtatggatatatcggcagacttgactcagttaacgcgttcccgagttgctgtcgtatgtgctggtgcaaaaaatatcctcgatattggattaacattggagtttttggagacatggaatgtgccagtcatctcctatcagtcggatgattttcctgcattctattgccgttccagcggattcaaaagcccacagcgccttgatgaacttgccgtcattgccaaagctattgagataaattggatgctgccaggaggaaaaggggtattaattacgacgccaactaagcctgaggatgctctggataatcaaaagattgatataattatacaggaagctgtattagaggctaagaagaaaaatattgttggcaactcgttgacaaagtatttgatgagaatggtggatcgagaaaccgatggaatttctgcgaaagccaatatggctgtattagttaataccgcagaagttgctggaaagttagcggtagccgcttgcttgcaatcatcgaccttttttgctcgcattaagagccaatga

SEQ ID NO: 2210 - protein, 318 aa, Photorhabdus luminescens subsp. laumondii TTO1
MNISNKVPFKFSLEVKEALESGKPVVALESNVITHGLDYPDNVTTAKNVEQAVRESGAIPATIGIDKGEFLIGMSDEQIEKFATASHVPKVTSRDIPVVLASGGMGATTVASSILAAEIAGIKFFCSAGIGGVHRGAETSMDISADLTQLTRSRVAVVCAGAKNILDIGLTLEFLETWNVPVISYQSDDFPAFYCRSSGFKSPQRLDELAVIAKAIEINWMLPGGKGVLITTPTKPEDALDNQKIDIIIQEAVLEAKKKNIVGNSLTKYLMRMVDRETDGISAKANMAVLVNTAEVAGKLAVAACLQSSTFFARIKSQ

SEQ ID NO: 2211 - DNA, 939 bp, Photorhabdus luminescens subsp. laumondii TTO1
  CDS (1)..(939): transl_table=11
atgaaaaatcatgctattagcaataaatatttggatatttccccagaagttacagaggctttagagaataaccgaccggttgtggcgttagaatcgaccattattgctcatggaatgccttatccgcaaaatgtaaagactgcgctacaagttgagcagaaaatcagggaaaatggtgctgttcctgcaacaattgctgttatcaatgggatgatgaaagcaggtctgtcgcatgaagaaatagcgtttttggctagaaaaggtgatgaaataactaaagtcagccgtcgtgatttaccctttgttatcgcggctggaaaaaatggcgcgacgacggttgcttctaccatgattattgcggcaatggccgggattagaatcttcgctaccggcggtattggcggtgtgcaccgtggggcggaacagacttttgatatttctgccgatttacaggaattagcgaaaaccagtgttgcggtagtctgtgctggtgctaaatccattttggatcttggcttgacaacagaatatcttgaaactcacggtgtgccactgattggttatcagactcacgctttaccggcgtttttctgtcgtaccagtccattctccgtcaatattcgtctggattccccagaacagatagctcaggcgatggcagtaaaatgggatactggattacagggcggtttggtagttgctaatccgattcctgagccatacgccatgccggaagcggagatcagtgctgctatcgaacaagcagtacgcgaatccatagaacagagagtaaatggaaaagcgtgtacgccgtttttgttagcaagagtctctgagttaaccgggggcaatagcctatcttccaatattcagttagtgctcaataacgctgaactggcagcgaaaattgcttgttgttattgggagcgccacatgtga

SEQ ID NO: 2212 - protein, 312 aa, Photorhabdus luminescens subsp. laumondii TTO1
MKNHAISNKYLDISPEVTEALENNRPVVALESTIIAHGMPYPQNVKTALQVEQKIRENGAVPATIAVINGMMKAGLSHEEIAFLARKGDEITKVSRRDLPFVIAAGKNGATTVASTMIIAAMAGIRIFATGGIGGVHRGAEQTFDISADLQELAKTSVAVVCAGAKSILDLGLTTEYLETHGVPLIGYQTHALPAFFCRTSPFSVNIRLDSPEQIAQAMAVKWDTGLQGGLVVANPIPEPYAMPEAEISAAIEQAVRESIEQRVNGKACTPFLLARVSELTGGNSLSSNIQLVLNNAELAAKIACCYWERHM

SEQ ID NO: 2213 - DNA, 4314 bp, Magnaporthe grisea 70-15
  CDS (1)..(4314)
atggccaaccggattctcggcacggctcgtttccaccaagaaaacactcgcctgcttcggtttgggttcatgggaagcaagctgtatgcactctcccgaccccagtcgcttggtacatttgctcaatcaaaggaccaagtctgtctaggtccgccaatcgagcttggcatcgctttacagagacatgtgggctacatcacgaacacgactggcggctgcaaccagatgctgcacagcggtctgggtgggatcctcaagatctccgacgaggttcgggatgcattggaatcgaaccggcccgtggtggccttagagtctacgatatacacccatggagcagttgcacgtagcgagctcgggctagaggatatcgtccgccaaaacggaggcactcctgccgtcattggagtcttggctggcgtgcctacagtcggcctgacagatgccgaggtagaacgcatgatatcagagggcgccaacaaagtctcccggcgagatcttgcatacctggctgggttgggcatgactgggcgacagattcacggaggaactaccattgctgggacaatgcttctcgcaaggctggcgggtattaaggtcttcggcactggtggtctcggcggagtccaccgtggctgggagtcgacaatggacatctcggccgacctgaccgagctaggtagaacgcgcgtggcggtgatttgcagcggcagcaaaggcttccttgacatccctacaactctcgagtacctggaaacgcagggcgtgctcgtctccacctttgccgaaggccgcaccggaaaggttgactttccggctttctgggcgcgggagagcggcatcaagagcccgtctgtcatcaacacggaggcggaagcggcagccattatcctcgcgcaggaggaactgggcatagagaccggaattttgtttgcaagccccatccctgaacagcatcaaattccgcgagaggagatggatgccgtgatcaagcaggcagtctcggacgctgcagagcagggctttacgggatcccaaaacacccccttcatactcggccagatccggaaactgacggatggccgaagtgtgcctgcgaatgtggccttgattaagtcaaacgtcgaaagggccacgaaaatctctgttgagctgtcgaagctctcagggggttcttcagcgactaaaatctttcccacaagcaacactgtaaaaactcaagtagatccaaaagccggtcaaaaaactgccgaaaaggtagagacgcattccaaagttgacgtgttagtggctggatcaatcgccctcgatctgagctgtgattttgttcctggttcagcatcccagacctcgcctgcaatgcagacatcaaatccctcgattgtcacacagacagttggaggcgtcggacacaacgttgctctggctgctcatcgagttgatcgcaatgtgaaggtgcggttgtgtagcttggttggagacgacttcgccggagcaactgttctttcaaagctagaatcctctgggatggacacatcgtgcatccgacaactgggaccagaatacccctcggcacgcacggcacaatatgtggcagtcaacggcgccgacaaaaaccttgttctcgccatggccgacatgggaatacttactagccattcattccaaaagtactgggactcggctatcgctgcttcacgtccctcatggctggttgtagacggtaactggagtgagaccgatatccatgagggatggatacgatctgggcgccaacatggagccaagatcgcctttgagccggtgtccgtggcgaagtctgcccggctgttccctcgattgagctccgcggcgagaagcaaccacgacgggctactgcatccgtcccctctcgtggatctagctacacccaacatccatgaactggcagccatgtataacgcggccaaggagcatggctactttgacgacctcagttggttcagtatgatcgatgccctgggcatgaggggagcacgcgatcgcttcgtccgtctcacatcaactgctcttacagacactggagtaccacaacagataattcacctccttccctatataccctccctcctaactaagctcggcgacaagggcgtgcttctgtccatgcttctttcacccgacgacgcccgagttcgatcgatcgaggcagatccttatatcctagtcagggctacgggagaccaccctcatgttggcgccgtgtacatgcgcctgttcccggccgccgaggacgtgcaagacgtggtttcagtgaacggagtcggcgataccttctgcggaacactaattgcgggactggctcgcggagcaaaggtggaaaatctcattgatgtcgcccagaaggctgccgtattgacgctgagaagtcaccagtcggtgagcgacgaggccgcattggcccatactcaagtacgtagacacattcctgttctttcgcaaagtgacagcggcgagccattatacctaacagacgagatgggtcccaaaaaccgcaacaatttcgaatcctccgacgatgatgacttctcaaacgacgagtttgccagcttcgatgacgacaacggcgggtcagaggtgaactttcaggttcgcgataaggactcggacgaggaggagctcgagcgccttgtcctcggcgacactaccactttcagatcacgtctgtttgaagacgacgactttcttcccgctcagaccggctccaaggacttgcaattggcgcaggatcagtcgttaaaagccactggcaatgaagccattgacgactcggccctgttcttctttgctactgagaaggagcctgtcacagggagccaacagctcgcgatcactccttctggcaataagtcgagtgacccgacagccggaaacgatgtgccggcgtgggaggacagcgacgacgaaaagctgtccatttcgcttgctggtgccagcaggctgcggaagctgcgtttgacggaaggggaggatattgtgagtggcgcggagtactccaggaggctgcgccagcagtatctccggttgaacccgcagccctcgtgggtgaaggatgcagccgcaagggagccaaagcggcgacgtaggtcgtcagcatcctcgggctccgacagcggtagcggctcggatgatgaagatttcggcactgccatgcctctggaggagtttctacgggacgtcagcgctcttacggacggcggctcgcggaagaggaggaagttgcgaccagagactatcaacatccaaaagacgcgcgacataccagacgtccacaaggggcccgtcgagtccctctctttccacccgcaacaccccgttctcctatcatccagcacatcctcaatgcttcatcttcatcacatatcgccagctgcgcaccctactccgaacccactcctaacgtcggtacaggtgcaaaacactccaatcaggaaggccgagtttctttcaccttcgggcgagcaaatcgtctttgcaggtagacggcgtttctttcattcttggaacatatcgacaggacaggtgaccaaggtcagcaggatacatggccatcgcctagaacagaagtcggtggagcgcttcaagttgagcccgtgtgggcgctacatggctatagtaggaacggacaagaaagggggtggcttgctcaatattatgcgtgtcggcaccatgcaatggattgctcaagcgcggatggatggacgtcatggaattgcagacttttgctggtggaggacaggcgagggcatgactatattggggagagacggccaagttggagagtggaacctcgaggcgaagaggttcgtcggtatctggagggattctggttctacaggtggaacggtacttgctctcggtggccgggatgggccaagtgagctgggagaggaccgctgggtggccgtcggctccaacgtcggtatcctgcaggtatatgacagagacgacctcgttctgagacctggagtcggccaggaggatgaggtgacggtcaaggagaccccagagccgacccgcgcatttgagtcgttgacaacggcgatatctgtggtcactttttctcccgacgcccagctgctggctttcggcagtatccacaagaaggatgcgctcagactggcacacatcccgagctgcacgctgtaccgcaactggcctacatcagagacgccgtttggcaggatcacggcggtggcgtttgggatgcagagcgatctgattgccgttggaaacgacaaaggaaagatccgcctatgggagatcaggagctag

SEQ ID NO: 2214 - protein, 1437 aa, Magnaporthe grisea 70-15
MANRILGTARFHQENTRLLRFGFMGSKLYALSRPQSLGTFAQSKDQVCLGPPIELGIALQRHVGYITNTTGGCNQMLHSGLGGILKISDEVRDALESNRPVVALESTIYTHGAVARSELGLEDIVRQNGGTPAVIGVLAGVPTVGLTDAEVERMISEGANKVSRRDLAYLAGLGMTGRQIHGGTTIAGTMLLARLAGIKVFGTGGLGGVHRGWESTMDISADLTELGRTRVAVICSGSKGFLDIPTTLEYLETQGVLVSTFAEGRTGKVDFPAFWARESGIKSPSVINTEAEAAAIILAQEELGIETGILFASPIPEQHQIPREEMDAVIKQAVSDAAEQGFTGSQNTPFILGQIRKLTDGRSVPANVALIKSNVERATKISVELSKLSGGSSATKIFPTSNTVKTQVDPKAGQKTAEKVETHSKVDVLVAGSIALDLSCDFVPGSASQTSPAMQTSNPSIVTQTVGGVGHNVALAAHRVDRNVKVRLCSLVGDDFAGATVLSKLESSGMDTSCIRQLGPEYPSARTAQYVAVNGADKNLVLAMADMGILTSHSFQKYWDSAIAASRPSWLVVDGNWSETDIHEGWIRSGRQHGAKIAFEPVSVAKSARLFPRLSSAARSNHDGLLHPSPLVDLATPNIHELAAMYNAAKEHGYFDDLSWFSMIDALGMRGARDRFVRLTSTALTDTGVPQQIIHLLPYIPSLLTKLGDKGVLLSMLLSPDDARVRSIEADPYILVRATGDHPHVGAVYMRLFPAAEDVQDVVSVNGVGDTFCGTLIAGLARGAKVENLIDVAQKAAVLTLRSHQSVSDEAALAHTQVRRHIPVLSQSDSGEPLYLTDEMGPKNRNNFESSDDDDFSNDEFASFDDDNGGSEVNFQVRDKDSDEEELERLVLGDTTTFRSRLFEDDDFLPAQTGSKDLQLAQDQSLKATGNEAIDDSALFFFATEKEPVTGSQQLAITPSGNKSSDPTAGNDVPAWEDSDDEKLSISLAGASRLRKLRLTEGEDIVSGAEYSRRLRQQYLRLNPQPSWVKDAAAREPKRRRRSSASSGSDSGSGSDDEDFGTAMPLEEFLRDVSALTDGGSRKRRKLRPETINIQKTRDIPDVHKGPVESLSFHPQHPVLLSSSTSSMLHLHHISPAAHPTPNPLLTSVQVQNTPIRKAEFLSPSGEQIVFAGRRRFFHSWNISTGQVTKVSRIHGHRLEQKSVERFKLSPCGRYMAIVGTDKKGGGLLNIMRVGTMQWIAQARMDGRHGIADFCWWRTGEGMTILGRDGQVGEWNLEAKRFVGIWRDSGSTGGTVLALGGRDGPSELGEDRWVAVGSNVGILQVYDRDDLVLRPGVGQEDEVTVKETPEPTRAFESLTTAISVVTFSPDAQLLAFGSIHKKDALRLAHIPSCTLYRNWPTSETPFGRITAVAFGMQSDLIAVGNDKGKIRLWEIRS

SEQ ID NO: 2215 - DNA, 2337 bp, Gibberella zeae PH-1
  CDS (1)..(2337)
atgcggttgtcaagcctcatctctcggcatggctccgtcctgcgccgctgctccggagccagagctcggccgatctgttctcatcctcaacgtcgactcatgagctcttccttggctggcgtgaaggagctcctcaaagtctcggatgagattgccgacggtgtttccactaacaagcccattgttgctctcgagtcaaccatctacactcacggagctctgggcaatgagcttgctcggcaacattccgaccttgttcgcagcaatggaggaattcccgctattattgccattgttgacggtgtgcctactgttggtgccacagcctctgatattcttcgcatgattgagagcggaagcgctgttaaagcatccaggcgagatattgcctatattgcaggaatgggcttgactggacagaagattcatggtggaactaccatctctggcaccatgctactggcaagactagcaggtatccgtgtctttggaactggtggcttgggtggtgttcaccgtggtggccatgactctatggacgtttctgctgatctgactgagctcggacgaacccgagttgctgtcgtcagcagtggctgcaagggttttcttgatattcccaggaccctcgagtttcttgagacacagggtgctcacgtctcaacgtttgccgatggtcgatccggaaagattgagttccctgctttctgggctcgggacagtggcattaagagtccttctgtcgtccacaccgaaaaggaggctgctgctatcatcctcgcgcaggagaggctcggtatcgaatcaggcttgctcttcgcaaaccccattcccgaggagtttggcatccctgcccctgagatgcagtcttacatcgagcaggctgtcaaggaggccaacgataagggcttcactggaagcgccaacaccccctatatcctgggcaggctcaaagagctcacgggagaaaaggccgtcatcgccaacaaggcgctggtaacctccaacatcacccgggctaccaacatcgctgtcgaactctcacggttgttgtcttctggttccgaaccagtcaagacttttaattcatttcctgccgccccatctgctgctccatctgagctcaagggacccgaagtaacgtccgagagcaaggctgatattcttgttgctggctccgtagctattgatctcagctgtgactatgcacccaagtcgggtgaatcttcgcctgccctccatacctccaacccatccagtatcagccagtccattggcggtgtcggccataatgtagcactcgctgcccactctgttagcaaacatgctcgagtgcgcctttgcagcatggttggcgatgatgttgctggcaaaactgttctgaatggactccaagcctctggtttggacactacctacatccgaacacttggcaatgagtatcacggttcgaacagaacggctcagtatgtcgccgtgaatgatgccgacaagaacttggtcatggcaatggccgatatgggcatatttacacatcactcattccccgagtattggaaatccgccgtgcgaggaaccaagcccaagtggttggtagtggacggcaactggagtgagagagatattcgagcgtggctcaaggctggccaagatgaaggctgcaaggtcgcctttgagccagtctcgacagcaaagtctatgaatcttttctgtccccagaagggtcaccccaaacttcgagtcttccccaagcctactgtgcatattgcatcccccaacagtttcgagttggaatctatgtactctgcagctcgtgataacggctacttggaagcgcctgagtggtttgacatcattgacgcctttggcatgcgaggcgcccgagagcgctttgtccacatcacctcagctgagctgactgatgctggtgttccagtgcagtctgtccaactacttccctacatccctactattgtgacaaagcttggccctcagggcgttcttttgactaccatccttggaagagacgatcctcgactgacagatcctgactcggaagaatacattgtcgcacggtcaatgagccacccgacagttggtggactttacatgcgactgttttccgctgctgaaaaggtccaaaacatcgtttctgttaacggtgttggcgatacttttttcggcgtcttgatctctggtttggcgcaggggggtaaagttgagaaccttatcgacgttgctcaagcaggctcatgtttgactttgaagtctcacgagtctgttagtcccgacttgcgccagctggaatctgtcttggcacaggccgcagctcaatag

SEQ ID NO: 2216 - protein, 778 aa, Gibberella zeae PH-1
MRLSSLISRHGSVLRRCSGARARPICSHPQRRLMSSSLAGVKELLKVSDEIADGVSTNKPIVALESTIYTHGALGNELARQHSDLVRSNGGIPAIIAIVDGVPTVGATASDILRMIESGSAVKASRRDIAYIAGMGLTGQKIHGGTTISGTMLLARLAGIRVFGTGGLGGVHRGGHDSMDVSADLTELGRTRVAVVSSGCKGFLDIPRTLEFLETQGAHVSTFADGRSGKIEFPAFWARDSGIKSPSVVHTEKEAAAIILAQERLGIESGLLFANPIPEEFGIPAPEMQSYIEQAVKEANDKGFTGSANTPYILGRLKELTGEKAVIANKALVTSNITRATNIAVELSRLLSSGSEPVKTFNSFPAAPSAAPSELKGPEVTSESKADILVAGSVAIDLSCDYAPKSGESSPALHTSNPSSISQSIGGVGHNVALAAHSVSKHARVRLCSMVGDDVAGKTVLNGLQASGLDTTYIRTLGNEYHGSNRTAQYVAVNDADKNLVMAMADMGIFTHHSFPEYWKSAVRGTKPKWLVVDGNWSERDIRAWLKAGQDEGCKVAFEPVSTAKSMNLFCPQKGHPKLRVFPKPTVHIASPNSFELESMYSAARDNGYLEAPEWFDIIDAFGMRGARERFVHITSAELTDAGVPVQSVQLLPYIPTIVTKLGPQGVLLTTILGRDDPRLTDPDSEEYIVARSMSHPTVGGLYMRLFSAAEKVQNIVSVNGVGDTFFGVLISGLAQGGKVENLIDVAQAGSCLTLKSHESVSPDLRQLESVLAQAAAQ

SEQ ID NO: 2217 - DNA, 2217 bp, Kluyveromyces lactis NRRL Y-1140
  CDS (1)..(2217)
atgctacgaacttcagtgaggtctcatgtacaaaggataggtcatcgaaggctgcatttgtctgtctctgatgaaatacgggaggcattgaatgccaaaatgcccgtagtggcattggaatccaccataatatcacatggattaccgtacccggaaaatatagagatggccttgaaggtggagcaagaaatcaggaacaacggagccatacctgcaacaacagctttcattaatggtatccctaaagttggattaaagacgagagaaatcgaacaattagcagagtatgctaggaagggtctggtaaataaagtttctcgacgtgatatatcttatactattgctcaaaaactttatggaggcactacaatatcgagtacgatgatcttgtcccacaaggcaggtattgaagtatttgctacagggggactaggtggcgttcataaaggcggtgaactaactcttgatgttagtgctgatttagaagaattaggaagaactcctgtatccgtggtgtgtgcaggcccaaaggcaatattggatatccctagaactatggaatatttagagactaaaggatgcatggtagctacaatggggcccccggggacgaatgttccaggtttctatactagagattcaggagtgaaatctccttataattttaactcttatctggaagctgcacaaattatacgagatggtaatgaatttgggttaaattcgggctacttattctgttgccctcctccaagagaagtggctttggatgataacttcattaacgatataatagaacaagcatgccaaaatgcagcagcagcaggtattagtggtaaagagttaacaccttttttactcagggagatagcttcaaagacttcaggagcgtctgttaaatgtaatatttcatttgtactgaacaactgtaaaattgcagcaaatatagcggcttctctatctaaactaaagcaaaacattattccaagatatgagcctaaaaatcaacggggaactatgacaagccaggaaacttcaggcaatgaaaaggagacaaaggttctatctgcggtaattggctctgtcgctcttgatactcagtgcactttcaattcttcacatatataccaaggtgattctaatcctgggaaagcgtcaacctctattggaggagttggacacaacgttgcgttaagtgcaaactacagtaatcgaagctctcaacatcaaaccacactaatcagtgctgtcggcaaagacattgctggaaagcatatattgtcggggctaggaatgtctgcggatggtatttacatcaacgaatcggaaaggacagcacagtatatctcaatccactctagggatggggagctatacatcgctggttctgatatggatatcgtaactcagctaccgataaaacatataacaaataaattgaagtcattgaaacctaatgttgttttggtagatgccaatgtatctgtagaagttttagaacatctgattacgttacgagaaaaaatgggattcaagttgattttcgagccgacttctgaatgtaaagcacagaaaatcgcccaagcaaagaatttaaaagtctatcccaaccatggatttgatttgatcactccaacggttacggaacttaaaggaatatatgaagccttggacaaaaacaacaaatttgatttagataattggtttccagtgttagactcgttcaagatcgatagaaatttatcagtgaataagaaggcatccacaggagaactaaaatatctattggacaatggaatatttcaaactgcgtcattcttactaccttacttcccaaggatggtgattaaacatggttcaaagggtatttacatattttctatggagaaagatactgatccagcaacgcttgagttaatatcaaaatatagtgattattcaatgtattgtaccggagaacatgttggcggtcaacaacaaggcgttcttgtagagcatcatgcggttccagctggaaatacaactgtaactagtgtcactggcgctggtgatactttagttggtattttgctaaatgagatctccatagatccagagtttttggaactgaaggatccagccaggagaaaacaccgattagacagagcccaatatggagcaagaattactctagaagataaagaaactatcagcaagaatttaaaagagttgccttga

SEQ ID NO: 2218 - protein, 738 aa, Kluyveromyces lactis NRRL Y-1140
MLRTSVRSHVQRIGHRRLHLSVSDEIREALNAKMPVVALESTIISHGLPYPENIEMALKVEQEIRNNGAIPATTAFINGIPKVGLKTREIEQLAEYARKGLVNKVSRRDISYTIAQKLYGGTTISSTMILSHKAGIEVFATGGLGGVHKGGELTLDVSADLEELGRTPVSVVCAGPKAILDIPRTMEYLETKGCMVATMGPPGTNVPGFYTRDSGVKSPYNFNSYLEAAQIIRDGNEFGLNSGYLFCCPPPREVALDDNFINDIIEQACQNAAAAGISGKELTPFLLREIASKTSGASVKCNISFVLNNCKIAANIAASLSKLKQNIIPRYEPKNQRGTMTSQETSGNEKETKVLSAVIGSVALDTQCTFNSSHIYQGDSNPGKASTSIGGVGHNVALSANYSNRSSQHQTTLISAVGKDIAGKHILSGLGMSADGIYINESERTAQYISIHSRDGELYIAGSDMDIVTQLPIKHITNKLKSLKPNVVLVDANVSVEVLEHLITLREKMGFKLIFEPTSECKAQKIAQAKNLKVYPNHGFDLITPTVTELKGIYEALDKNNKFDLDNWFPVLDSFKIDRNLSVNKKASTGELKYLLDNGIFQTASFLLPYFPRMVIKHGSKGIYIFSMEKDTDPATLELISKYSDYSMYCTGEHVGGQQQGVLVEHHAVPAGNTTVTSVTGAGDTLVGILLNEISIDPEFLELKDPARRKHRLDRAQYGARITLEDKETISKNLKELP

SEQ ID NO: 2219 - DNA, 1041 bp, Debaryomyces hansenii CBS767
  CDS (1)..(1041)
atgaagcaacataaacattacttatcaagatgtcaattcgccataactacaaagttgagaagaaattttgtttcaattcctttagtaatttcggaagaaatacaacaaactttgaatgataaacagaagccaattgtctccttagaatcaacaattatcactcatggattgccctatcctgataatttatctatggcaactgaagtggagagaataattagggccaatggtgcagttccagctacatgtgcttttatagagggaataccgtatgttggattaacatcacaccaacttgaatatttatccgaacaggcttcaaagaaggaaataaataaggtttctcgtcgggatattggatatactatggccaataaggtaaacggtggtaccaccattgcactgacaatgattttatctcatttagcaggaatcaaagtattcgctaccggtggattagggggagttcataaagacgggcatttaacaatggatgtttctgctgatttaactgaattaggcagaactccagtatctgtcgtatgcgccggaccaaaatcaattttggatattggtttaactatggagtatttggaaacacaaggtgtcttcgttggcacgtataacgataataatagaaccaggattgaaatccctggcttttactgtcgtgattcaggaattcaatcgccatattcatttaattcatttgttcaagctgcgtcaataattcatagtcaaaataatttgatgtctttaaagtctgggaatgtcttttgcatccccccacctgaggattcagccttgccttcggaacttattaataatataattgaaaaagctaatgaagaagcaaaagaaaaaggtataaggggaaaaaatttaaccccatttttattaagcaaaattgctaatgatactaagggaaaatcagttgaatgcaacattaattttgtctacaataacgctgtatctgcaactaaaattgctaaagaattacttttattggaaaataatagtgagcctaatgtatgttattaa

SEQ ID NO: 2220 - protein, 346 aa, Debaryomyces hansenii CBS767
MKQHKHYLSRCQFAITTKLRRNFVSIPLVISEEIQQTLNDKQKPIVSLESTIITHGLPYPDNLSMATEVERIIRANGAVPATCAFIEGIPYVGLTSHQLEYLSEQASKKEINKVSRRDIGYTMANKVNGGTTIALTMILSHLAGIKVFATGGLGGVHKDGHLTMDVSADLTELGRTPVSVVCAGPKSILDIGLTMEYLETQGVFVGTYNDNNRTRIEIPGFYCRDSGIQSPYSFNSFVQAASIIHSQNNLMSLKSGNVFCIPPPEDSALPSELINNIIEKANEEAKEKGIRGKNLTPFLLSKIANDTKGKSVECNINFVYNNAVSATKIAKELLLLENNSEPNVCY

SEQ ID NO: 2221 - DNA, 1017 bp, Yarrowia lipolytica CLIB122
  CDS (1)..(1017)
atgctttcaattcgacgaatcgcaagtcaaaagccgattttccaaactttggtttttcgccagtttgccaccgccccacccagatcgcccctcgtcatctcggaggagatccagcaggccatcaatgacaagaagcccgtgatcgcactggaatccaccatcatcacccatgggctgccatatcctcagaatctgcagatgcatagcgatacggagcagatcattcgtaaggaaggcggaatccccgccctcacggctttcgtcaacggtgtgcctcgagtgggagttcctgaggaggaggtcaaggtgctggccgaaaacacagacggaaaccacatcaaggtgtcgagacgcgatattggctacgtcatggcaaatggactcatgggaggcaccaccgtggctgccaccatgattctggctcacatggcaggtatcaaggtgtttgctaccggaggcattggaggagtgcatcgaggtgcggagtcgacatttgatatctctgccgatctcgacgagctgtccaatacccccgtggctgtggtctgcgctggcccaaagtccattctcgacattcctctgaccgttgagtacctggagaccaagggcgtgcatgtgagcacctatggagccgacgggacaaacattcctggattcttcaccaccgattcgggcgtcagcagcccctacaacttcttcgacaccctggaggccgctaagatcatccaagctaactcctcgatgaacctccagtccggaacggtctggtgtgtgcctcctcccgaccccatcccttccaacctcatccatgacgtgattgaccaggccctggtggaagccaacgagctgggcattaagggtaaggctacgacccccttccttctggacgccattcgacgggaataccccgaggtgctcaaaactaacattggactggtccagcagaacgccgttatcgcgacccgtatcgccagcgatctggcaaccctagaggtaggtggcaagtttgaatactga

SEQ ID NO: 2222 - protein, 338 aa, Yarrowia lipolytica CLIB122
MLSIRRIASQKPIFQTLVFRQFATAPPRSPLVISEEIQQAINDKKPVIALESTIITHGLPYPQNLQMHSDTEQIIRKEGGIPALTAFVNGVPRVGVPEEEVKVLAENTDGNHIKVSRRDIGYVMANGLMGGTTVAATMILAHMAGIKVFATGGIGGVHRGAESTFDISADLDELSNTPVAVVCAGPKSILDIPLTVEYLETKGVHVSTYGADGTNIPGFFTTDSGVSSPYNFFDTLEAAKIIQANSSMNLQSGTVWCVPPPDPIPSNLIHDVIDQALVEANELGIKGKATTPFLLDAIRREYPEVLKTNIGLVQQNAVIATRIASDLATLEVGGKFEY

SEQ ID NO: 2223 - DNA, 924 bp, Candida albicans SC5314
  CDS (1)..(924): transl_table=12
atgaaacgatcacttttacgtatatcacaagaagttagacaagcactatttgagaaacggccagtagtttccttagagtctacaatcatttcccatgggttgccgtatccgcagaacattgaaatggccaaaagtgttgagcaagtgttacgagacaatggtgttgttcctgccacctgtgcctttattgacggtgttccacacgttggactagacaattttgaacaattgcgcaatgccgtgaaggtatcgagacgtgatattgggtatgttatggccaacaagttgaatggtggcaccacaattgcactgacgatgatcttgtcgcatcttgcagggattaaggtctttgcgacgggcggacttggcggtgtgcaccgtgatgggcagtatacgatggacgtttccgcagatttgaccgagttggggagaacacccgttagtgttgtgtgtgctggcccgaaatcgattttggatattgggttgactatggagtatttggagacccaaggtgtttttgttgggacgtataaccccgaaaaggtggacaatttgcaggtgccggggttttattgtcgtgaatcgggcgtgccttcgccatatgggtttgaatcgtttgcagaagcagcaagggttagttattaccaggggatggtcggcagtggaagtgtgttttgtattccgccaccacaagagactgccatggatagtgagtatatcaggagcgtgattgagaaggccaacgagaaggcgaaggaggtgggtgtcacaggcaagaagttgaccccgttcttgttaaaggagattgccgttgccacgcagggccagtctgtggaaagtaatatagcgttggtgaagaacaatgccagggccgcggcagaaattgccaaagaattgagtcaattggtatgtaaagaaaaataa

SEQ ID NO: 2224 - protein, 307 aa, Candida albicans SC5314
MKRSLLRISQEVRQALFEKRPVVSLESTIISHGLPYPQNIEMAKSVEQVLRDNGVVPATCAFIDGVPHVGLDNFEQLRNAVKVSRRDIGYVMANKLNGGTTIASTMILSHLAGIKVFATGGLGGVHRDGQYTMDVSADLTELGRTPVSVVCAGPKSILDIGLTMEYLETQGVFVGTYNPEKVDNLQVPGFYCRESGVPSPYGFESFAEAARVSYYQGMVGSGSVFCIPPPQETAMDSEYIRSVIEKANEKAKEVGVTGKKLTPFLLKEIAVATQGQSVESNIALVKNNARAAAEIAKELSQLVCKEK

SEQ ID NO: 2225 - DNA, 2025 bp, Ustilago maydis 521
  CDS (1)..(2025)
atggtccgatcaacacaactgctgcgtcaagcagcacgggctctaacacgtacgccgcatccaacgctcgccctctctcctgccgtccgttctgcgctgactgcatcgaccaaagcacccatcgtggcgctcgagtcgactatcatcactcacggtctaccatacccttacaatctggaggtggcacaggagcttgagcagaccgtgatcgaccacggtgcggtgcctgctaccatcgcgctgctcgacggcaagccgcttgtcggactggattcgcagcagctcgagaggcttgcacgatgcgcgatcgacccggccaggaacgaagctgtcaaggcgagcagaagggatattgctcatgttctcgccaagggcaagaacaccgtcggtggcaccacagttagcgggaccatggttcttgctcatatggcaggaattaaaatctttgccaccggtggaattggtggtgtccaccgaggcggcgagtcgaccatggatatttctgccgacttgaccgaactcggccgtacaccggtcgccgtcttctgctcgggtcccaaatcgattctcgacattcctcgcaccctcgaagttctagagacgtttggcgtgtctgtcacaacattcaactcgaccggcgaattcccggcgttctacacttccaactcggggctctacgttccttatgcgggaagcaatgtgcaggcagccacctcgatcctggtcaactcgcaaatcggcctgcagagcggtcaggtgtttgcgaatcctattccagccgagtttaaccaagtgggagcaaagatacaagagtgcgtcgaacaggcggtgcgcgaggcgatcgaacagggaattgataaacgtggtaaagaggtcactccgtggcttctcaagcgactagcagagctcatcccagaaagcaagcagagcaaccgtgcgctcgtagtcaataacgccaagaaagcagcacaagtggccgtcgaactcgacagaatcgagaaggaggcagagcgtacacgtgatacacacgctctcggtgggattgcatcgacttcctcgaacgacaaggccaggatcctattttttggagcagctgccgtcgacattacctctcagaccgaatctgcgggagccgatcaactggcagcaaccacctatccaggtcgcgtacttgtcactctgggaggtgtagcacgcaacatggcagagacggctacgcgcgttctgtcgtcgcattgcgcgtcttcagtgaaactcgtttctccgcatggaaacgacgaatttggcttgctgctacggacgggcatgcaacaagcaggcatgcgaacggatgggcttttcgttcctcggaacggcagcggagccacgaggacggcagtgtgctcgttgatgttggacgatcgaggcgacttgatctcaggtgttgcggatatggacattggccgcactgcactgtgtgcgcacaaggacgaggatgcagccgagtcgcacttggcagatctgctgcaagctgagtcgcccgagctggtggtatttgatggaaacatcggcagcgagcaagcaagccagctgctggcggcttgcgacgcatacaatgtagatcaaacagacagtgccgtcagacgtcccttgcttaccatgtttgagccgacaagcatcgccaagtcgacaattgccctcgagcactttgctactgccaaggcgacgcgccaagccacacagcccatcagcttcgttacaccaaacgcagtcgagctggaccgcatctgtacgatttcaagaaagctgggccttatcacaccatcatcgaacactacctcgttgcatccctacaacatcgacccaaacatcctcgatcccgacacgatcctgtccgccaaatgcctcgttgatgcacgcctcttctcgaccatcttgctcaaagtgggtcgccatggtgtcatcacgatcgatgcagacacggtgcaacatcatcctatccccgcaggccaagtcaagctgtcatcgacgcagctgtcgaggtag

SEQ ID NO: 2226 - protein, 674 aa, Ustilago maydis 521
MVRSTQLLRQAARALTRTPHPTLALSPAVRSALTASTKAPIVALESTIITHGLPYPYNLEVAQELEQTVIDHGAVPATIALLDGKPLVGLDSQQLERLARCAIDPARNEAVKASRRDIAHVLAKGKNTVGGTTVSGTMVLAHMAGIKIFATGGIGGVHRGGESTMDISADLTELGRTPVAVFCSGPKSILDIPRTLEVLETFGVSVTTFNSTGEFPAFYTSNSGLYVPYAGSNVQAATSILVNSQIGLQSGQVFANPIPAEFNQVGAKIQECVEQAVREAIEQGIDKRGKEVTPWLLKRLAELIPESKQSNRALVVNNAKKAAQVAVELDRIEKEAERTRDTHALGGIASTSSNDKARILFFGAAAVDITSQTESAGADQLAATTYPGRVLVTLGGVARNMAETATRVLSSHCASSVKLVSPHGNDEFGLLLRTGMQQAGMRTDGLFVPRNGSGATRTAVCSLMLDDRGDLISGVADMDIGRTALCAHKDEDAAESHLADLLQAESPELVVFDGNIGSEQASQLLAACDAYNVDQTDSAVRRPLLTMFEPTSIAKSTIALEHFATAKATRQATQPISFVTPNAVELDRICTISRKLGLITPSSNTTSLHPYNIDPNILDPDTILSAKCLVDARLFSTILLKVGRHGVITIDADTVQHHPIPAGQVKLSSTQLSR

SEQ ID NO: 2227 - DNA, 846 bp, Thermus thermophilus HB27
  CDS (1)..(846): transl_table=11
atgcgcgaaccccgggtggctttggagtccgcggtcctgacccacggcctcccttaccccttgaacctggaggtggccctggccctggaggaggcggtgcgggaggagggggccacccccaagaccatcgccctggtgcggggggaggtgcgggtgggcctttcgcccgaggagatggaggccttggcggcgggcggggcggagaaggcgagcctttggaacctcgcggccctccttgcccagggaaggagcgccgggaccacggtggcggccacggtccacctggcccacctccacggcatccccgttttcgccaccggggggatcgggggggtccaccccgagccctacgacgagagcgccgacctcgtcgccctctcccgcacccccatcctggtggtctcctctggccccaaggccatcctggacctcagggccaccctggagcgcctggagactttgggggtgagcgtggtgggctaccggacggaccgcctccccgccttcttctccccggactcccccttccccgtccccgcccgggtggacacccccatggaggcggcccgggtctacctccgggcccgggccttgggcctcgggggggtgctcctggtgaaccccgtttcccagggcctcccttatgagcaggtggccctttgggtggaggaggcgggccggatggcggcccgggagggggtcttcgggaaggccctcaccccctacctcctgaggaagctctcggagctctcctcgggggagacggaccgggtcaaccggaggctcctcctggagaacgcccgccttgcggcccgggtcgccctggccctggcggggctagaatag

SEQ ID NO: 2228 - protein, 281 aa, Thermus thermophilus HB27
MREPRVALESAVLTHGLPYPLNLEVALALEEAVREEGATPKTIALVRGEVRVGLSPEEMEALAAGGAEKASLWNLAALLAQGRSAGTTVAATVHLAHLHGIPVFATGGIGGVHPEPYDESADLVALSRTPILVVSSGPKAILDLRATLERLETLGVSVVGYRTDRLPAFFSPDSPFPVPARVDTPMEAARVYLRARALGLGGVLLVNPVSQGLPYEQVALWVEEAGRMAAREGVFGKALTPYLLRKLSELSSGETDRVNRRLLLENARLAARVALALAGLE

SEQ ID NO: 2229 - DNA, 912 bp, Listeria monocytogenes str. 4b F2365
  CDS (1)..(912): transl_table=11
atgaaaaattatttatcattatccgaagaagtaaaacaagcaaaagcagaaggaaaagcaatcgttgcgctagaatctacaattatctctcacggcatgccttatccgcaaaatgttgaaatggcacgtgacgtagaacaaattattcgcgataacggtgccgtaccagcgacaatcgctttaatcgacggaaaaattaaaattggtctttctgatgaagaactagaactattcgctaaaagtagcaatgtggcaaaagtttctcgtcgtgatatcggttaccttattgcaacaaaacaacttggcgcaacaactgtagcagcaacaatgatttgtgctgaactcgcagaaatcggcatcttcgtaactggcgggattggcggcgttcaccgtggtgccgaaacaacaatggacgtttcagctgacttagaagaattagcgaaaacaaatgttgctgtcgtttgtgcaggagctaaatcaatcctagacctaaacttaacaatggaatacttagaaacaaaaggggttccagttattggttaccaaaccgacgtattaccagcattttacacgcgttcaagcgatgtagaattaacattgcgtgcagatgctccagaagttatcgcagaatcgcttaaagcgaaatgggatcttcaaatcgaaggtggcgcagtaattactaacccaatcccagaagaattcgctatggacgaaaaagtaattaacgatgtaatccaaacagcgcttaaagaagctgaagaaaatcacattcacgggaaagacgttacaccattcctacttggtaaagtaaaagaactaacagatggtaagagcctcgaagcaaatatcgagcttgtaaaacacaatgctttaatcggtacgcaaatcgccgtagcataccaaaatatctaa

SEQ ID NO: 2230 - protein, 303 aa, Listeria monocytogenes str. 4b F2365
MKNYLSLSEEVKQAKAEGKAIVALESTIISHGMPYPQNVEMARDVEQIIRDNGAVPATIALIDGKIKIGLSDEELELFAKSSNVAKVSRRDIGYLIATKQLGATTVAATMICAELAEIGIFVTGGIGGVHRGAETTMDVSADLEELAKTNVAVVCAGAKSILDLNLTMEYLETKGVPVIGYQTDVLPAFYTRSSDVELTLRADAPEVIAESLKAKWDLQIEGGAVITNPIPEEFAMDEKVINDVIQTALKEAEENHIHGKDVTPFLLGKVKELTDGKSLEANIELVKHNALIGTQIAVAYQNI

SEQ ID NO: 2231 - DNA, 924 bp, Staphylococcus aureus subsp. aureus MRSA252
  CDS (1)..(924): transl_table=11
atggcaaatttacaaaagtatattgagtattctcgagaagttcagcaagcacgggagaacaatcaaccgattgtagcattagaatcaacaattatttcgcatggtatgccgtacccacaaaatgttgaaatggtaacaacagtagagcaaattatcaggaataatggtgccattccagcaaccatagccattatagatggcaaaattaaaattggtttagaaagcgaagatttagaaatactggcaactagtaaagacgttgctaaagtatctagaagggatttagcagaagttgttgcgatgaagcgtattggtgctactactgtagcgacgacgatgatatgtgctgcaatggctggtattcaattttttgttactggaggtattgggggtgtccataaaggtgcagaacatacgatggacatttcagcagacttagaagaattgtctaaaacaaatgtcactgttatctgtgcaggtgccaaatcaattttagacttacctaagacgatggaatatttagaaacaaaaggcgttccagttattggatatcaaacgaatgaattgccagcattcttcactcgcgaaagcggtgttaagttaacaagttcggttgaaacgccagaacgacttgctgacattcatttaacaaaacagcagttaaatcttgaaggtggcattgttgttgctaatccaattccatatgagcatgccttatcaaaagcatatattgaggcaatcataaatgaagctgttgttgaagccgaaaatcaaggtattaaaggtaaggacgccacaccgttcttgttagggaaaattgtagaaaaaacgaatggtaaaagtttagcagcaaatataaaacttgttgaaaacaatgcggtgttgggtgctaaaattgctgtcgctgttaataaattattgtag

SEQ ID NO: 2232 - protein, 307 aa, Staphylococcus aureus subsp. aureus MRSA252
MANLQKYIEYSREVQQARENNQPIVALESTIISHGMPYPQNVEMVTTVEQIIRNNGAIPATIAIIDGKIKIGLESEDLEILATSKDVAKVSRRDLAEVVAMKRIGATTVATTMICAAMAGIQFFVTGGIGGVHKGAEHTMDISADLEELSKTNVTVICAGAKSILDLPKTMEYLETKGVPVIGYQTNELPAFFTRESGVKLTSSVETPERLADIHLTKQQLNLEGGIVVANPIPYEHALSKAYIEAIINEAVVEAENQGIKGKDATPFLLGKIVEKTNGKSLAANIKLVENNAVLGAKIAVAVNKLL

SEQ ID NO: 2233 - DNA, 924 bp, Staphylococcus aureus subsp. aureus MSSA476
  CDS (1)..(924): transl_table=11
atggcaaatttacaaaagtatattgagtattctcgagaagttcagcaagcactggagaacaatcaaccgattgtagcattagaatcaacaattatatcgcatggtatgccgtacccacaaaatgttgaaatggcaacaacagtagagcaaattatcaggaataatggtgccattccagcaaccatagccattatagatggcaaaattaaaattggtttagaaagcgaagatttagaaatactggcaactagtaaagacgttgctaaagtatctagaagggatttagcagaagttgttgcgatgaagtgtgttggtgctactactgtagcgacgacgatgatatgtgctgcaatggctggtattcaattttttgttacaggaggtattgggggcgtccataaaggtgcagaacatacgatggacatttcagcagacttagaagaactgtctaaaacaaatgtcactgttatctgtgcaggtgccaaatcaattttagacttacctaagacgatggagtatttagaaacaaaaggcgttccagttattggatatcaaacgaatgaattgccagcattcttcactcgcgaaagcggtgttaagttaacaagttcggttgaaacgccagaacgacttgctgacattcatttaacaaaacagcagttaaatcttgaaggtggcattgttgttgctaatccaattccatatgagcatgccttatcaaaagcatatattgaggcaatcataaatgaagctgttgttgaagcggaaaatcaaggtattaaaggtaaggacgccacaccgttcttgttagggaaaattgtagaaaaaacgaatggtaaaagtttagcagcaaatataaaacttgttgaaaacaatgcggcgttgggtgctaaaattgctgtcgctgttaataaattattgtag

SEQ ID NO: 2234 - protein, 307 aa, Staphylococcus aureus subsp. aureus MSSA476
MANLQKYIEYSREVQQALENNQPIVALESTIISHGMPYPQNVEMATTVEQIIRNNGAIPATIAIIDGKIKIGLESEDLEILATSKDVAKVSRRDLAEVVAMKCVGATTVATTMICAAMAGIQFFVTGGIGGVHKGAEHTMDISADLEELSKTNVTVICAGAKSILDLPKTMEYLETKGVPVIGYQTNELPAFFTRESGVKLTSSVETPERLADIHLTKQQLNLEGGIVVANPIPYEHALSKAYIEAIINEAVVEAENQGIKGKDATPFLLGKIVEKTNGKSLAANIKLVENNAALGAKIAVAVNKLL

SEQ ID NO: 2235 - DNA, 927 bp, Symbiobacterium thermophilum IAM 14863
  CDS (1)..(927): transl_table=11
atgaagtacctgttgtcgtatacgccggaggttcgggaggccctggaccggaaccggcccgtggtggccctggagtcgaccatcatcagccacggcatgccgtaccccgagaacctgcgcaccgcccgggaggtggaggagatcgtccgcagccagggcgcggtcccggcgacgattgcggtgatcggcggccgctgcaaggtggggctgacggacgaggagctggagctgctcgcgacctcgcccgaggcggtgaaggtgtcgctgcgcgacctgccggtggtgctggcgcgcaagtccctgggggcgaccaccgtcgccaccacggcgaccatcgcggcggcggcggggatcgaggtgttcgtgaccggcggcatcggcggtgtccatcgcaagagcccgggcgaccccgcgcagatgtgggacgtgtccgcggacctgaccgtgctgggccgcacggacatcacggtggtctgcgccggggccaagtcggtgctggacatcggcgcgaccctggaggttctggagacgctgggggtgacggtgctgggctaccggaccgaccggttccccggcttctacacccgggacaccgggttcggcgtggacgcccgggtggacacgccggaggaggccgcggccgtcatccacgcgcggcagcagaccatgctccccggcggcgtgctggtggtcaaccccgtgccggaggagcacgccatggaccccgacgaggtggagcggcacatcgcggacgccctgaaggccatggcggccgagggggtgaccggcaaggcggtgaccccgtacctgctggcccggctgaaggaggtcaccagcggccgggcgctgcagaccaacatcgcgctggtcaagcacaacgccctggtgggcgcgcagatcgccgtcgccctgaaggccggaaagtag

SEQ ID NO: 2236 - protein, 308 aa, Symbiobacterium thermophilum IAM 14863
MKYLLSYTPEVREALDRNRPVVALESTIISHGMPYPENLRTAREVEEIVRSQGAVPATIAVIGGRCKVGLTDEELELLATSPEAVKVSLRDLPVVLARKSLGATTVATTATIAAAAGIEVFVTGGIGGVHRKSPGDPAQMWDVSADLTVLGRTDITVVCAGAKSVLDIGATLEVLETLGVTVLGYRTDRFPGFYTRDTGFGVDARVDTPEEAAAVIHARQQTMLPGGVLVVNPVPEEHAMDPDEVERHIADALKAMAAEGVTGKAVTPYLLARLKEVTSGRALQTNIALVKHNALVGAQIAVALKAGK

SEQ ID NO: 2237 - DNA, 927 bp, Legionella pneumophila subsp. pneumophila str. Philadelphia 1
  CDS (1)..(927): transl_table=11
atgtttcatgacttgttggaatttaacgaagaagtactggatgctatcaatgataaaaacccaattgttgctcttgagtcgaccattatctctcatggaatgccctaccctgataatttaactacggcaatagaggttgaaaatattattcgtagacaaggcgccattccagctactatagcgatgcaccaagggaaaatccgtgttggtttaactcaagaagttatggaacatctcgcgcttcaaaaagaagtaataaaagcctctcgcagagacatttcttttgtattatctcgtaaagtgactgccagcacgacggtagcagcaaccatgttttgtgcccatatggctaagctccccctatttgtcaccggaggtataggtggtgttcatcaagacgtgacgatgagttttgatatttcagctgatcttatagagctatccaatacgccagttaccgtagtctgttctggcgcaaaatcgattctcgacttaccaaaaacattggaagttcttgaaacgtttggggtgccggtcataggttatgccacagacgaattccctgctttttatagcagatcgagtggaataccagttccacaacgcttaaactcggccgaggaagtagcaaatctcatgtcaattcaacagaaattgaatatgaaaaatggaatagtcgtcgcaaaccccattccagtatcagccgaactatccgatgaggaaatcagtccatacataaaacaggctcatgatgaagccaaacacatgagcggaaaatcattaacccccttcctgttaaaacgtattgctgaattaactgcgggcaagagcctggaagctaatattgagcttatcaaaaacaacgcttttctaggagcagaaattgccatagcctaccaaaaaaaattattttcaaaaaaaacttaa

SEQ ID NO: 2238 - protein, 308 aa, Legionella pneumophila subsp. pneumophila str. Philadelphia 1
MFHDLLEFNEEVLDAINDKNPIVALESTIISHGMPYPDNLTTAIEVENIIRRQGAIPATIAMHQGKIRVGLTQEVMEHLALQKEVIKASRRDISFVLSRKVTASTTVAATMFCAHMAKLPLFVTGGIGGVHQDVTMSFDISADLIELSNTPVTVVCSGAKSILDLPKTLEVLETFGVPVIGYATDEFPAFYSRSSGIPVPQRLNSAEEVANLMSIQQKLNMKNGIVVANPIPVSAELSDEEISPYIKQAHDEAKHMSGKSLTPFLLKRIAELTAGKSLEANIELIKNNAFLGAEIAIAYQKKLFSKKT

SEQ ID NO: 2239 - DNA, 915 bp, Silicibacter pomeroyi DSS-3
  CDS (1)..(915): transl_table=11
gtgatcgacctgcacctgtccgccgaggttcacgccgcccgtgtcgcgggcacccccatcgtggcgctggaaagcaccatcatcacccatggcatgccctatccgcagaatgtcgagaccgcccgcgcggtggaacaggacatccgcgacgccggcgccgtgcccgccaccatcgcggtgatcgaggggcggctgcatgtggggctggaccccgatcagctggacgcgctgggccaggcgcagggggtggcgaagctctcgcgcgccgacatggccgcctgcatcgccaccggcggcaccggtgctaccaccgtggccgccaccatgatcgccgcccggtttgccgggatcgaggtgtttgccaccggtggcatcggcggcgtgcacaagggggccgagcagagctttgacatctcggccgatctgcacgaactggccgagaccccggtcaccgtggttgccgccggggccaaggccattctcgatctgcccaagacgcttgaggtgctggaaaccctcggcgtgccggtcatcgcctatgggcaggacagctttcccgccttctggtcggcgacctcggatctgcccgcaccgctccggatggatgacagcgccagcatcgcccgcgcccatgccgcccgacgcgcgctgggcctgccgggcggccagctggtcgccaacccgatcccggcagacgcgcagatcgccgccgaggatctggccccggtcatcgcccaggcgcaggcccaggccgatgcgcagggtatcgcgggcaaggcagtcacgcccttcctgctacaggcgattttcgaggcgaccgggggccgctcgctgaccgccaatatcgcgctggtgcggaacaatgcgcgcctggccgcgaaaatcgcccgggatctgatcgccttggggggctga

SEQ ID NO: 2240 - protein, 304 aa, Silicibacter pomeroyi DSS-3
MIDLHLSAEVHAARVAGTPIVALESTIITHGMPYPQNVETARAVEQDIRDAGAVPATIAVIEGRLHVGLDPDQLDALGQAQGVAKLSRADMAACIATGGTGATTVAATMIAARFAGIEVFATGGIGGVHKGAEQSFDISADLHELAETPVTVVAAGAKAILDLPKTLEVLETLGVPVIAYGQDSFPAFWSATSDLPAPLRMDDSASIARAHAARRALGLPGGQLVANPIPADAQIAAEDLAPVIAQAQAQADAQGIAGKAVTPFLLQAIFEATGGRSLTANIALVRNNARLAAKIARDLIALGG

SEQ ID NO: 2241 - DNA, 1053 bp, Ralstonia eutropha JMP134
  CDS (1)..(1053): transl_table=11
gtggatcgatctgaaggggatgaccaaagaggtgtaaggcctgagaacgccggggcgcaactgtcgctccggcaatacctaacgatcttgcctaccgggaacatcgaattgtctaccgacctcgcccaatcctggctgaccctcagcgcaccggttgccgcagcgcgtgccgcgggtcggccgctcgtcgcactcgaatcgacgatcatcgcgcacggcatgccctacccagaaaacgtgcggacggcgcacgaggtagaggcactgattcttgagctgggcgcggagcccgcgacgatcgcgctgatcgacgggcgcatccgcgtcggcctgtcggacgatgaactcgaacggctcggccgctcgggcaaggcccacaaggtcagccgccgcgacctgcccgcggtgctgaccagcggcgagcttggtgcgactaccgtggcgggcacgatgatctgcgcggcgctggccggcatcgaggtcttcgtgaccggcggcattggcggcgtgcaccgcggcgcgcaggagactttcgatatctccgccgacctgcaggaacttgcgcgaacgtcagtagcggtggtgtgcgcgggcgccaagtccattctcgacatcggcctgacgctggaatacctggaaacgcagggcgtccccgtgctcacttgcgagcaagaaaacttcgctgcgttctacaagcgcgacagcggttttcgcgcggactaccggctcgacgatccggcggaacaggcacgctttatccgcacgaaatgggatctcggacttgccggtggcgtgttgctgagcacgccggtgccagaggcggcggccatggcgtcggaggaaatcgatgcgctgacgcagcaggcacttgacgaagcgcaggcgcaaggcatcaccggcaaggctgtgacaccgttcctgctcgcgcgcatcaaggcgctcactggtggccgcagcctggccaccaatatcgcgctggtgaagcacaacgccgaagtcggcgcacggctcgcactggcgctggcacaggcggcacgcggcgcagtggcctag

SEQ ID NO: 2242 - protein, 350 aa, Ralstonia eutropha JMP134
MDRSEGDDQRGVRPENAGAQLSLRQYLTILPTGNIELSTDLAQSWLTLSAPVAAARAAGRPLVALESTIIAHGMPYPENVRTAHEVEALILELGAEPATIALIDGRIRVGLSDDELERLGRSGKAHKVSRRDLPAVLTSGELGATTVAGTMICAALAGIEVFVTGGIGGVHRGAQETFDISADLQELARTSVAVVCAGAKSILDIGLTLEYLETQGVPVLTCEQENFAAFYKRDSGFRADYRLDDPAEQARFIRTKWDLGLAGGVLLSTPVPEAAAMASEEIDALTQQALDEAQAQGITGKAVTPFLLARIKALTGGRSLATNIALVKHNAEVGARLALALAQAARGAVA

SEQ ID NO: 2243 - DNA, 912 bp, Rhodobacter sphaeroides 2.4.1
  CDS (1)..(912): transl_table=11
atgaatgcaccgctcgcactcgaccgggaaatcgccgaggccctgctcaccgggcaacccgtcgtggccctcgaatcgaccatcatcacccacgggatgccctatccgcagaatgtggacaccgcgcgcgaggtcgaggccaccgtccgtgccgcgggcggcgtccccgccaccatcgccgtgatggacggccagatccgcgtgggtctgggcgaggccgagctcgagcggctggcgcgcgccgaggaggtgcagaaactgtcgcgggcggatctcgccacctgcctcgccaccggcgccatgggctcgaccacggtcgcggccaccatgatcgcagccaacctcgccgggatctcggtcttcgccaccggcggcatcggcggggtgcaccggggcgccgagaccagcttcgacatctcggccgacctgaacgaactggcgcagacgcccgtcaccgtcgtctcggcgggtgccaaggccatcctcgatctgcccaagaccttcgaagtgctcgagacgctgggcgtgccggtgatcgccgtgggccaggacgagatccccgccttctggtcgcgacgctcggggctgaaggcgccgatccggctcgacacggccgaagagatcgccgcggcccatatgatgcgcgcgaggctcggcctgccgggcgggcagctcgtggccaatccgatcccggccgaggcggagatcccgctcgccgagatggcggcggtggtcgaccgcgccatcgcgcgggccgaggcgcagggcgtggccgccaaggccgtgacgccgttcctgctcgacctgatcttcgatctgaccgagggccggtcgctcgaggccaaccgggcgctcgtcctgtcgaacgcccggctcgcgaccgacatcgcccgcgccatcgccagaggctga

SEQ ID NO: 2244 - protein, 303 aa, Rhodobacter sphaeroides 2.4.1
MNAPLALDREIAEALLTGQPVVALESTIITHGMPYPQNVDTAREVEATVRAAGGVPATIAVMDGQIRVGLGEAELERLARAEEVQKLSRADLATCLATGAMGSTTVAATMIAANLAGISVFATGGIGGVHRGAETSFDISADLNELAQTPVTVVSAGAKAILDLPKTFEVLETLGVPVIAVGQDEIPAFWSRRSGLKAPIRLDTAEEIAAAHMMRARLGLPGGQLVANPIPAEAEIPLAEMAAVVDRAIARAEAQGVAAKAVTPFLLDLIFDLTEGRSLEANRALVLSNARLATDIARAIARG

SEQ ID NO: 2245 - DNA, 915 bp, Carboxydothermus hydrogenoformans Z-2901
  CDS (1)..(915): transl_table=11
atgaatgaatatttggttttaagtaaggaagtaaaagaggctttggctgaaggtgtgccggtagtagccttggaatcaaccattattgctcatggtatgccgcatccgcaaaatgtagagactgctttagcggtagaaaaggttgttcgggaaaatgaggccgttccggccactattgcggttattggcgggaaaataaaggtagggttgacttgcgaggaaatagagtatcttggagaaaaggggccggaggttataaaggtaagccgccgggacctgccgtatgtggtagccaaagggttggatggggcgacaacggtagctgcaaccatgtttattgctgcgatgagcggtataaaagtttttgctaccggtggcataggtggagttcaccggggaggcgaaaaaagctttgatatttccgccgatttacaggagcttgcccggaccaatgtggcggtggtgtcggcaggagtaaagtcaattttagatattggacttaccttagaatatcttgaaacctatggagttccggtgataggttttggtaccgatgaatttcccgctttttatacgcggaaaagcggctataaggtgcatattactgctgatactccagcggagcttgcgcgcattattaaagttaagtgggatttaggtttaaagggaggcgttgtagtggccaatccgatacctgaagaatactctttggattatgaagaaattacgcgggcgatagatagtgcggttttggaagctgcagaaaaaggggtaaggggaaaagaagtaactccatatttgttggcgaaagtaaaagatataaccggcggtaaaagtttggaggctaatattcaattggttcttaataatgcccggcttgccgccaaacttgcacaagaactaagtaaactataa

SEQ ID NO: 2246 - protein, 304 aa, Carboxydothermus hydrogenoformans Z-2901
MNEYLVLSKEVKEALAEGVPVVALESTIIAHGMPHPQNVETALAVEKVVRENEAVPATIAVIGGKIKVGLTCEEIEYLGEKGPEVIKVSRRDLPYVVAKGLDGATTVAATMFIAAMSGIKVFATGGIGGVHRGGEKSFDISADLQELARTNVAVVSAGVKSILDIGLTLEYLETYGVPVIGFGTDEFPAFYTRKSGYKVHITADTPAELARIIKVKWDLGLKGGVVVANPIPEEYSLDYEEITRAIDSAVLEAAEKGVRGKEVTPYLLAKVKDITGGKSLEANIQLVLNNARLAAKLAQELSKL

SEQ ID NO: 2247 - DNA, 909 bp, Silicibacter sp. TM1040
  CDS (1)..(909): transl_table=11
ttgatcgacattacctattccgcagaagtcgaagcagcccgcgccgcaggcaaaccaattgttgcgcttgaaagcaccatcattacccacggtatgccttacccgcagaatgtcgaggtggccgcacaggtcgaggctgacatccgcgctgcaggcgctgtgcccgcgaccatggctgtgatcaatggtacactgcatgtcgggcttgaggccgacacgctgcagtcgctcggtcaggcaaaagacgttgcaaaaatctcgcgcgctgattttgccgcctgcatggcgacgggcggcaccggggcaaccacggtggctgcgaccatgatcgcggcgcggctcgccggtatttccgtctttgccacgggcggcattggcggcgttcacaagggcgctgagacgagctttgatatttctgccgatctgctggagctggcgcagacgcctgtgacggttgtggccgccggcgccaaggcaatcctcgatgtgcccaaaacgctggaagtgcttgaaacacagggcgttccggtcatcgcctatggtcaggacagctttcctgcgttctggtccgcgacctcggatctgaaggcccccctgcgcatggacagagccaccgagattgctcgcgcgcatttcctgcgcggcgcgatggagttgcccggcggtcagctggtggcaaacccgatccctgtccaggaccaaatcgcagccaccgacctggccccgatcattgcacaagcgcaaagcgaggcagatgcacagggtgtgaccggcaaggatgtgacccccttcctgctgcagcgcatttttgagctcaccgaagggcggtctttggaggccaatatcgcacttgtgcgcaacaacgcgcgccttgcggctgaaattgccaaagaattggccaaactctga

SEQ ID NO: 2248 - protein, 302 aa, Silicibacter sp. TM1040
MIDITYSAEVEAARAAGKPIVALESTIITHGMPYPQNVEVAAQVEADIRAAGAVPATMAVINGTLHVGLEADTLQSLGQAKDVAKISRADFAACMATGGTGATTVAATMIAARLAGISVFATGGIGGVHKGAETSFDISADLLELAQTPVTVVAAGAKAILDVPKTLEVLETQGVPVIAYGQDSFPAFWSATSDLKAPLRMDRATEIARAHFLRGAMELPGGQLVANPIPVQDQIAATDLAPIIAQAQSEADAQGVTGKDVTPFLLQRIFELTEGRSLEANIALVRNNARLAAEIAKELAKL

SEQ ID NO: 2249 - DNA, 912 bp, Myxococcus xanthus DK 1622
  CDS (1)..(912): transl_table=11
atggacctacgcttttcggaagaggtgcgccgcgcgctcgaggccggccaaccgctggtggccctggagacgagtgtcgtggcccagggccttccgtatccggacaacctggccgcggcccgggcgtgtgaggaggccattcgtcgcgctggcgccgttcccgccgccaccgccatcatcgacgggcagttgtgcgtcgggctggaggagccggagatgcgccggctggcggagggcaaggaacgcctgctcaaggtggcgtctcgggacttcgccgtcgccatggccacgcgcgccacgggaggcaccaccgtgagcgccacgtgtgagatggccgccgccgcgggcattcgtgtcttctccaccggtggtattgggggcgtgcaccgcggggcgtcggagcacttcgacatctcccaggacatcgccgcgctggcgcgcttccccgtcgccgtggtgtgcgcgggcgccaagtccgtgttggacctgcccaagacgatggagctgctcgagacggccggcgtgcccgtcatcggcgtggggacggacgagttgccgtcgttctacagccggggttctggcatccccctggagcaccgcgcggatgacgtggacacggccgcccgcatcgcccgcgcccgcttcgagtcgctgaagcagggtggggtgctctacaccgtgcctccgcccgaggagacgtccctgcctcgcaacgaggtggagttgcacatcgccgcgacgctcgccgacgcggaccggcagggcatccgcggcaaggccgtgacgcccttcctcctgtcggaaatggcgaagcgcaccgggggcaagacgctcaaggccaacctggcgctgctcaccaacaacgcgcgcttcgccggtcagctcgccgtggcgtacgcacgcgcgagctga

SEQ ID NO: 2250 - protein, 303 aa, Myxococcus xanthus DK 1622
MDLRFSEEVRRALEAGQPLVALETSVVAQGLPYPDNLAAARACEEAIRRAGAVPAATAIIDGQLCVGLEEPEMRRLAEGKERLLKVASRDFAVAMATRATGGTTVSATCEMAAAAGIRVFSTGGIGGVHRGASEHFDISQDIAALARFPVAVVCAGAKSVLDLPKTMELLETAGVPVIGVGTDELPSFYSRGSGIPLEHRADDVDTAARIARARFESLKQGGVLYTVPPPEETSLPRNEVELHIAATLADADRQGIRGKAVTPFLLSEMAKRTGGKTLKANLALLTNNARFAGQLAVAYARAS

SEQ ID NO: 2251 - DNA, 909 bp, Rubrobacter xylanophilus DSM 9941
  CDS (1)..(909): transl_table=11
atgcgcccggtgcagcccgctcccgaggtcgcggaggccctggaggggggccggccggtggtggcgctggagtccaccctgatctcccacggcctgccgcgcccggacaacctgcgggtggcgcgggcgctggaggaggccgtccggcgggagggggccgtcccggccaccgtaggggtggtggggggcgtggcccgcgtgggactcgggccggaggagctcgagctcctggcctccggggaggtgcccaagctctccgcgcgcgacctgccggctgcggcggccacggggtcgagcggggccaccacggttgccgccaccgcccacctcgccgcgctgtgcgggataaagctcttcgccaccggcgggctcggcggggtgcaccggggggcccgcgagagctgggacgtctcggcggacctggccgcgctctcccgcgcccccgtggccgtggtgtgctccggggtgaagtccatccttgacgtgcccgccacgctggagcagctggagaccctgggggtcccggtggtgggcttccggagccgcagcttcgccggcttctacctcaccgactcgggctgcgcgctggactggtcggtggaggacgagggggaggcggcggccctgatccgggcgctccccgggctggggctcggctgcggcgtggtgatctccaaccccctgccccccgaggagcagctcgacccgtccctgcacgagcgggcgctgcgctcggggctggaggagctggcgcggcgcggcatctcgggcaaggaggtgacccctttcctgctggagcacttcagggagcgcacgggcggggagagcctgcgggcgaacgagcgcctggtggtccgcaacgcccggctcgccgcccgcatcgcgcgccgcctcgccgccgggaggtga

SEQ ID NO: 2252 - protein, 302 aa, Rubrobacter xylanophilus DSM 9941
MRPVQPAPEVAEALEGGRPVVALESTLISHGLPRPDNLRVARALEEAVRREGAVPATVGVVGGVARVGLGPEELELLASGEVPKLSARDLPAAAATGSSGATTVAATAHLAALCGIKLFATGGLGGVHRGARESWDVSADLAALSRAPVAVVCSGVKSILDVPATLEQLETLGVPVVGFRSRSFAGFYLTDSGCALDWSVEDEGEAAALIRALPGLGLGCGVVISNPLPPEEQLDPSLHERALRSGLEELARRGISGKEVTPFLLEHFRERTGGESLRANERLVVRNARLAARIARRLAAGR

SEQ ID NO: 2253 - DNA, 915 bp, Mesorhizobium sp. BNC1
  CDS (1)..(915): transl_table=11
atgaaccttgcgcgagagatcgacatatacggccccgtggctgaggcgctctcggccggaaagcctgtcgtggcgctcgaaagcacgatcatcacgcatggcatgccctggccccagaacagttcgatggcggccgaggtggaggccatcgtcgcggcggagggcgccgtgccggcgacgattgccgtcatggccggccgtctcaagatcggcctttccggtgaggagcgcgaaaagctcgcgcgggctgaagatgccatgaagctgtcgcgcgccgatctggcctttgccattgccgaagggcgcactggcggcacgacggtggctgcgacgatgattggcgcgcatctggccggaattggcgtcttcgccaccggcggcatcggtggagtacaccagggggcggagaagagtttcgatatctcctcggatctcgatgaactggcgcgcaccccggtcatcgtcgtgtcggccgggccgaaggctattctcgatattccgaagacgctcgaagtgctggaaacgcgcggcgtaccggtggttggtttcggtactgacgccatgcccgcattctggtctaggacatccaaatgcccggcgccgctgaggctcgacacggcgcaggagatcgcgcgtttccagaagacccgctctcggctcggcatcgtcggcggcatgctgatcgccaacccggtgccggaggaggccgaaatcccggcggaggagatggcggcctatatcgtcgaggcgcaggcggacgcggaaagtgccgggatcggcggcaaggcggtcacgccctttctgctcgcccgcattctggagatcaccggcggcagaagcctgaagaccaatatcgcgctcgttaagaacaatgcgcgccttgccgcaaggatcgcgatcgctctggctgcctag

SEQ ID NO: 2254 - protein, 304 aa, Mesorhizobium sp. BNC1
MNLAREIDIYGPVAEALSAGKPVVALESTIITHGMPWPQNSSMAAEVEAIVAAEGAVPATIAVMAGRLKIGLSGEEREKLARAEDAMKLSRADLAFAIAEGRTGGTTVAATMIGAHLAGIGVFATGGIGGVHQGAEKSFDISSDLDELARTPVIVVSAGPKAILDIPKTLEVLETRGVPVVGFGTDAMPAFWSRTSKCPAPLRLDTAQEIARFQKTRSRLGIVGGMLIANPVPEEAEIPAEEMAAYIVEAQADAESAGIGGKAVTPFLLARILEITGGRSLKTNIALVKNNARLAARIAIALAA

SEQ ID NO: 2255 - DNA, 930 bp, Rhizobium leguminosarum bv. viciae 3841
  CDS (1)..(930): transl_table=11
atgaccctcatgaagccccgactgagccgcgaaatggccgaagccattgcagccggcagcccggtcgtagcgcttgaatccaccatcatcacccatggcatgccttatccggccaacctcgaaacggccctgggcgtggaaacggtgatccgtgaaaacggcgccattccggccacgatcgctgtcgtcaagggcgaactgcgcgttggccttgagcacgatgagctggaagagctggcgcagtcaaagggcatcgtgaaggcctctggccgcgacctggccgtcgccatgatacgcggtcagtcggccggcacgacggtttcggccaccatgctgatggcagacctcgccggcatcgacgtctttgcgaccggcggtgtcggcggcgtgcatcgcggcgccgagcagaccttcgacatctccgccgacctgacggaattgggcagaacgaaaaccgctgtcgtctgcgccggcgtaaaatcgatcctcgacatcgccaagacgctcgaatatctcgaaactcagcgagtgccggtgatcgcctacggcaccgaggatttcccggctttcttcacgcgcaggagcggcttcaaggccgaccatcggctcgacacgccggaagagatcgccaaggcgatgtggttgcaccatcaactcggcacgggcaccggccttttgatcgccaacccgatcccggaagcgtcagcgctggcgccagacttcatcgacggcacgattgccgatgcggtgcgcgatgccgacgagcgtggcatcgaccgcaaggaactgacacctttcctgctcgcccgcatcaacgaattgacgaagggcgaaagcctcaaggccaatattgaactggtgaagaacaatgcccgcctcgccgccaggatagcggtcgcctatgcgccgctgaagaaggcccgcaactga

SEQ ID NO: 2256 - protein, 309 aa, Rhizobium leguminosarum bv. viciae 3841
MTLMKPRLSREMAEAIAAGSPVVALESTIITHGMPYPANLETALGVETVIRENGAIPATIAVVKGELRVGLEHDELEELAQSKGIVKASGRDLAVAMIRGQSAGTTVSATMLMADLAGIDVFATGGVGGVHRGAEQTFDISADLTELGRTKTAVVCAGVKSILDIAKTLEYLETQRVPVIAYGTEDFPAFFTRRSGFKADHRLDTPEEIAKAMWLHHQLGTGTGLLIANPIPEASALAPDFIDGTIADAVRDADERGIDRKELTPFLLARINELTKGESLKANIELVKNNARLAARIAVAYAPLKKARN

SEQ ID NO: 2257 - DNA, 954 bp, Rhizobium leguminosarum bv. viciae 3841
  CDS (1)..(954): transl_table=11
atgctcagtcgatcacaggacaagaccatgactaagcccatctcccctcttctgccgatcgcctattcgaaggaagtcgccagcgccaagcagcgcggcgcgccgctggtggcgctggaatcgacgatcatcacccacggcatgccctatcccggcaatatcgagatggcccgcagcgtcgaggccatcattcgcgaacagggtgcggtgccggcaacgatcgccgtcattcacggcacgctgcatatcggcctcgaagctgcggaactggagcaactcgccaaggcgaccgaagtgatgaaggtgtcacgcgccgatctcgccttcgccatcgccgagcgccgcaccggcgccaccacggtcgcggcgacgatgatcgcggcggcgcgcgccggcatccgcgtctttgccacaggcggcatcggcggcgtgcatcgcggtgccgaggaaagtttcgatatatcagccgatctcgaggaactggcgcgcaccggcgtcatcgtcgtctgcgccggcgccaaggcgatcctcgacattccgaagacgctggaagtgctggaaacccgcggcgtgcctgtcgtcacctatgagagcgaggaattccccgccttctggtcgcgctcctcgggcatccgcagcccgctgtcgctgaacagcccggccgcgatcgccaatttccagacggttcgcgaacaactcggcatcgacggcggcatgctcgtcgccaatccggtcccggaggccgacgagatcgcgagcgaggagatggaaatctatatcgagcgggcgctcgacagcgccgaacgcgacgaagtcaccggcaaggcggtcacaccctatcttctgtcgaccatcttcgacctgacggacggccagagcctgaagaccaacatcgcgctcgtcgaaaacaacgcgcgacttgccgctgaaatcgcggtggcgctgggtgaatga

SEQ ID NO: 2258 - protein, 317 aa, Rhizobium leguminosarum bv. viciae 3841
MLSRSQDKTMTKPISPLLPIAYSKEVASAKQRGAPLVALESTIITHGMPYPGNIEMARSVEAIIREQGAVPATIAVIHGTLHIGLEAAELEQLAKATEVMKVSRADLAFAIAERRTGATTVAATMIAAARAGIRVFATGGIGGVHRGAEESFDISADLEELARTGVIVVCAGAKAILDIPKTLEVLETRGVPVVTYESEEFPAFWSRSSGIRSPLSLNSPAAIANFQTVREQLGIDGGMLVANPVPEADEIASEEMEIYIERALDSAERDEVTGKAVTPYLLSTIFDLTDGQSLKTNIALVENNARLAAEIAVALGE

SEQ ID NO: 2259 - DNA, 900 bp, Solibacter usitatus Ellin6076
  CDS (1)..(900): transl_table=11
atgcatctcaagattgatcccgaagttcgccgcgcccttcagggcaagcgacccgtcgtggcgctggaaagcaccatcatcacccacggtatgccgtaccccgagaatctcgcgaccgcgcgttcgctcgaaagccaggttcgggccggcggcgcagtgcccgccacgatcgcggtaatcggcggcgtcatctgcgtcggcctatccgacaaagaactggagtggctggccggcgcgaagaacgtcctcaaactcagccgcaacgatcttccctacgccatcgccacgcaaaaaatcggcgccaccaccgtcgccgccaccatgatcgccgccaacctcgccggcatcaggatcttcgccaccggcggcatcggcggcgtccatcgcggcgccgagaccaccttcgatatctctgccgatctggaagagttcgcccgcacctccgtcgccgtggtctgcgccggcgccaaggccatcctcgatctgcccaaaacgctggagtatctcgagacccgcggcgtccccgtcatcgcctatggcaccgacgaattcccagcgttctggagccgccagagcggcctcaaagctcccctgcggctcgacacccccgccgagatcgcgcgcttcctcgaagtgaaatggagcctcaacctcactggtggcgccgtcatctgcaaccccgtcccggccgaagacgaaatccctttccacgagatgcgcaccttcatcgatagcgccgtggacgaagctgagcgctacggtatcaaaggtaaagcggtgactccatacatcctggcacgcatcgtcgaactcacgggcggacgcagcctgcgtaccaatatggcgctcgcccaaaacaacgcccgcctcgccgccgaactcgcaacgcacctgcaataa

SEQ ID NO: 2260 - protein, 299 aa, Solibacter usitatus Ellin6076
MHLKIDPEVRRALQGKRPVVALESTIITHGMPYPENLATARSLESQVRAGGAVPATIAVIGGVICVGLSDKELEWLAGAKNVLKLSRNDLPYAIATQKIGATTVAATMIAANLAGIRIFATGGIGGVHRGAETTFDISADLEEFARTSVAVVCAGAKAILDLPKTLEYLETRGVPVIAYGTDEFPAFWSRQSGLKAPLRLDTPAEIARFLEVKWSLNLTGGAVICNPVPAEDEIPFHEMRTFIDSAVDEAERYGIKGKAVTPYILARIVELTGGRSLRTNMALAQNNARLAAELATHLQ

SEQ ID NO: 2261 - DNA, 924 bp, Nocardioides sp. JS614
  CDS (1)..(924): transl_table=11
atgaccgcacctcaccccctgctcaccctcaccgacgaggtcgccgacgcgctgcgcgacggcgccccggtggtcgcgctggagagcacgatcatcagccacgggatgccctacccgcagaacgtcgcgatggcgaccgaggtcgaggggatcatccgcgcggccggggcagtgccggcgaccatcgccgtcctcgagggccggccgcggatcgggctcaccgccgacgacctcgagctgctcgcgagcgacgaggacgtggcgaaggtcagcgtgcgggacctgccgttcgtcgtcgcccgccgcagccacggcgcgacgacggtcgccgcgacgatgcgcctggccgccctcgccggcatccgcgtcttcgtcaccggcggcctcggcggcgtccaccgcggtgcccagcagtccttcgacgagtccgccgacctgaccgagctcggcagcaccgacgtcgccgtcatctccgccggggtcaagagcatcctcgacatcggcctcaccctggagcgcctcgagaccctcggagtcccggtcctcgcctacggctcggacgagttcccctccttctactcccgctccagcggccacgccgccccgatgcgggtcgactccgccgcggaggtcgccgcggtgatggccgccaagtgggacctcggcatcgccggcggtgtcgtcgtcgcgaacccgatccccgaggccgacgagatccccgccgacgagatcggcgggatcatcgagcaggcgctcgccgacatggcggcccggggcatccacggcaacgaggcgacgccgtacctcctcggccggatcgtcgagatcaccggcggcgcctcgctgaccgcgaacatcgcgctggtgcgggccaacgcgcgactcggcgcatcgatcgcgcgggagtacgccggcctcaggtga

SEQ ID NO: 2262 - protein, 307 aa, Nocardioides sp. JS614
MTAPHPLLTLTDEVADALRDGAPVVALESTIISHGMPYPQNVAMATEVEGIIRAAGAVPATIAVLEGRPRIGLTADDLELLASDEDVAKVSVRDLPFVVARRSHGATTVAATMRLAALAGIRVFVTGGLGGVHRGAQQSFDESADLTELGSTDVAVISAGVKSILDIGLTLERLETLGVPVLAYGSDEFPSFYSRSSGHAAPMRVDSAAEVAAVMAAKWDLGIAGGVVVANPIPEADEIPADEIGGIIEQALADMAARGIHGNEATPYLLGRIVEITGGASLTANIALVRANARLGASIAREYAGLR

SEQ ID NO: 2263 - DNA, 912 bp, Listeria monocytogenes str. 4b H7858
  CDS (1)..(912): transl_table=11
atgaaaaattatttatcattatccgaagaagtaaaacaagcaaaagcagaaggaaaagcaatcgttgcgctagaatctacaattatctctcacggcatgccttatccgcaaaatgttgaaatggcacgtgacgtagaacaaattattcgcgataacggtgccgtaccagcgacaatcgctttaatcgacggaaaaattaaaattggtctttctgatgaagaactagaactattcgctaaaagtagcaatgtggcaaaagtttctcgtcgtgatatcggttaccttattgcaacaaaacaacttggcgcaacaactgtagcagcaacaatgatttgtgctgaactcgcagaaatcggcatcttcgtaactggtgggattggcggcgttcaccgtggtgccgaaacaacaatggacgtttcagctgacttagaagaattagcgaaaacaaatgttgctgtcgtttgtgcaggagctaaatcaatcctagacctaaacttaacaatggaatacttagaaacaaaaggggttccagttattggttaccaaaccgacgtattaccagcattttacacgcgttcaagcgatgtagaattaacattgcgtgcagatgctccagaagttatcgcagaatcgcttaaagcgaaatgggatcttcaaatcaaaggtggcgcagtaattactaacccaatcccagaagaattcgctatggacgaaaaagtaattaacgatgtaatccaaacagcgcttaaagaagctgaagaaaatcacattcacgggaaagacgttacaccattcctacttggtaaagtaaaagaactaacagatggtaagagcctcgaagcaaatatcgagcttgtaaaacacaatgctttaatcggtacgcaaatcgccgtagcataccaaaatatctaa

SEQ ID NO: 2264 - protein, 303 aa, Listeria monocytogenes str. 4b H7858
MKNYLSLSEEVKQAKAEGKAIVALESTIISHGMPYPQNVEMARDVEQIIRDNGAVPATIALIDGKIKIGLSDEELELFAKSSNVAKVSRRDIGYLIATKQLGATTVAATMICAELAEIGIFVTGGIGGVHRGAETTMDVSADLEELAKTNVAVVCAGAKSILDLNLTMEYLETKGVPVIGYQTDVLPAFYTRSSDVELTLRADAPEVIAESLKAKWDLQIKGGAVITNPIPEEFAMDEKVINDVIQTALKEAEENHIHGKDVTPFLLGKVKELTDGKSLEANIELVKHNALIGTQIAVAYQNI

SEQ ID NO: 2265 - DNA, 915 bp, Sulfitobacter sp. EE-36
  CDS (1)..(915): transl_table=11
atgattcccctgcaccgctctgccgaagtcgccaaagcccatgcgaatggcacccccgttgttgcgctggaaagcacgatcatcacccacgggatgccctatccgcaaaacctagaggtcgcgcgtcaggtcgaggcggatgtgcgtgaggccggtgcgatccccgccaccatcgctgtgatcgacgggcggttgcacatcgggctcgaggacgacgagctgacagcattggcgcaggccaagaatgtcgccaaactgtcgcgtgccgatatggcggcctgcatcgccacgggcggcaccggcgccacaacggttgccgcgacaatgatcgccgcccatctggccgagatcgcggttttcgccaccggcggtatcggcggcgtgcataagggcgcagaagacagctttgatatctctgccgacctgatggagcttgcccaaacgccggtgaccgttgtcgccgcgggggccaaggccattctggatgtggccaaaacgctcgaggtgctggaaacgcaaggcgtgccggtgatcaccgtcggccaagacagcttccccgcgttctggagcagcacctccccgctgaaatcgcccctgcgcatggatagcgcgactgatatcgccgccgcccataaaatgcgcggtcatatgggtttgcctggggggcagctggtcgccaacccgatcccgaaagaggatgaaatcgccgccgctgatctggcacccatcatcaaggccgcccaagccgatgccaatacccacggcatcagcggtaaggccgtgaccccctatctgttgcagcgcatcttcgaactgaccgaaggccggtcgctgaccgcgaacatcgcattggtgcgcaacaacgcccgttttgcgtccaaaattgcggctgcacttatgtcaaaagacgcataa

SEQ ID NO: 2266 - protein, 304 aa, Sulfitobacter sp. EE-36
MIPLHRSAEVAKAHANGTPVVALESTIITHGMPYPQNLEVARQVEADVREAGAIPATIAVIDGRLHIGLEDDELTALAQAKNVAKLSRADMAACIATGGTGATTVAATMIAAHLAEIAVFATGGIGGVHKGAEDSFDISADLMELAQTPVTVVAAGAKAILDVAKTLEVLETQGVPVITVGQDSFPAFWSSTSPLKSPLRMDSATDIAAAHKMRGHMGLPGGQLVANPIPKEDEIAAADLAPIIKAAQADANTHGISGKAVTPYLLQRIFELTEGRSLTANIALVRNNARFASKIAAALMSKDA

SEQ ID NO: 2267 - DNA, 924 bp, Oceanicola batsensis HTCC2597
  CDS (1)..(924): transl_table=11
atggaaaatcgccattcgaccgaagtcgcccgcgcccgcgaggccggacaggccatcgtggcgctggaaagcacgatcatcacccacgggatgccctatccccagaacctcgaaaccgcccgccaggtcgaggatgacgtccgccaggccggtgcggtgcccgcgaccatcgccgtgatcgagggccggcttcacatcggtctctcgggggccgagctcgaggcgctcgcgcaggccgaggatgtcgcgaagctgtcgcgcgcggatctggccgtctgcctctcgcggggcggcaccggagcgacgaccgtcgcggcgacgatgatcgccgcccggctggcggggatcggggtcttcgccacgggcgggatcggcggcgtccacaggggcggcgagatcagcctcgacgtctcggccgaccttcaggaactggcgcagacgcctgtgacggtggtctgcgccggggccaaggcgatcctcgacatcccgcgcacgctggaggtgctggaaaccctcggggtgccggtcatcgcctacggccaggacgccctgcccgccttctggagccgcgatggcggggtgccggcgcccctgcggctggatagccccgccgagatcgcgcttgcacagcagacccgcgccgcactcggcctgccgggcggtcagcttgtcgccaacccggtgccggcggagcatgaaatcccgcgcgacgagatcgagcccatcatcacgcaggcgctggaggccgccgaacgcgacggcatcgcggccaaggccgtgacgccctacctcctcgagcggatcttcaacctgaccggggggcgttcgctggccaccaatatcgccctcgtgcggaacaatgcccggctcgccgcgaaaatcgcacaggaaatggtcgtactcggggcaaagtcctcaaaataa

SEQ ID NO: 2268 - protein, 307 aa, Oceanicola batsensis HTCC2597
MENRHSTEVARAREAGQAIVALESTIITHGMPYPQNLETARQVEDDVRQAGAVPATIAVIEGRLHIGLSGAELEALAQAEDVAKLSRADLAVCLSRGGTGATTVAATMIAARLAGIGVFATGGIGGVHRGGEISLDVSADLQELAQTPVTVVCAGAKAILDIPRTLEVLETLGVPVIAYGQDALPAFWSRDGGVPAPLRLDSPAEIALAQQTRAALGLPGGQLVANPVPAEHEIPRDEIEPIITQALEAAERDGIAAKAVTPYLLERIFNLTGGRSLATNIALVRNNARLAAKIAQEMVVLGAKSSK

SEQ ID NO: 2269 - DNA, 900 bp, Ostreococcus tauri
  CDS (1)..(900)
atggccggcgctgcgatcggcgcgccggtggtggcgctggagtccacgatcgtggcgcacgggatgccgtttccggagaatttaaagacggcgctggaggtggaggcgctcgtgcgaacgctcggggcgacgccggccacgatcgcggtgatcgatggtgtcgcccgcgttgggctgaacgattcggaattgaaacgtatcgccgagttaggggagcggtgcgccaaggcgtcgaggagggatctcgcgcacgcgtgcgggacgggatcgacggcggcgacgacggtgagcggaaccatggcgctcgcgcgaatggcgggtgtggacgtgttcgtcacgggcgggatcggtggcgtgcatcgaggtggggagagcacgatggacgtgagcgcggatttgatcgagctcggacggacgaatgtggcggtgatttgcgccggggtgaagtcgattttagacgtgccgcgaacgctcgaggtgctggagacgcatggggcgacggtgtgcgcgtacggcgtcgatgagttcccggcgttcttcacgaggacaagtggctcgagggctcctttgcgcgtcgataccccgctcgaagcggcgcgcgtgatcgacgccagtttgcgcctaggtttgagcaacggaagcgtctttgcggtgccgattccaagcgaacacgaggcgctcgggcaagtcgtcgagcaggcgacgagtcaagccctacgcgagatcgagacgcgtaagattatcggtagggaagtcacgccgtacgtcttaaagcgcgtggctgagctcacggatggggctagtctcaaggcgaacatcgctttggtgaaaaacaatgcgcgaatcggcgcggcaatcgcagtcgagctggcaaagttgcgtaaaggggtgagcgcgtaa

SEQ ID NO: 2270 - protein, 299 aa, Ostreococcus tauri
MAGAAIGAPVVALESTIVAHGMPFPENLKTALEVEALVRTLGATPATIAVIDGVARVGLNDSELKRIAELGERCAKASRRDLAHACGTGSTAATTVSGTMALARMAGVDVFVTGGIGGVHRGGESTMDVSADLIELGRTNVAVICAGVKSILDVPRTLEVLETHGATVCAYGVDEFPAFFTRTSGSRAPLRVDTPLEAARVIDASLRLGLSNGSVFAVPIPSEHEALGQVVEQATSQALREIETRKIIGREVTPYVLKRVAELTDGASLKANIALVKNNARIGAAIAVELAKLRKGVSA

SEQ ID NO: 2271 - DNA, 2373 bp, Aspergillus oryzae
  CDS (1)..(2373)
atgcttgcttcgcgagctgcagctcgccattgctgcaggagaaccagggtaccagtattggttgctcccgtacgacgccttcatggccttgcgcaaagcaagtttctccaagtctcggaggaagttcgcgacgctgtagccacaggaaagcctgtggtagctctagagtccacaatctacactcacggatttccgtatcccgagagcgttgctcttgcgtcgttgctggaaacagtcgttcgggcaaatggcggagttcctgctacgattggaatcttgaatggagtggccaaggtgggcctcaatgctgaagagcttatcgagctggcctctaccgcagagagcaagagtgcactgaaggtttcccgcagggatttgggttacatatgcggtttgggcctggctgggaaacgactacacggtggtacaacagtttcgggcacgatgattcttgcccatctggctggtattaaggtcttcgggactggaggtcttggtggtgtccatcgcggtggagagagttctatggatatatctgccgacctcaccgaactggggcggaccccggttgctgttgtcagctctggatgcaaaagcttcctcgacatcccacgaactctggaataccttgaaaccgaaggtgtttgtgttgggacgtttgcggatggtcgtacgggccaggtagatttccccgcattttttacgcgcgacagtggcatcaagagtccaaaggttattcaagatgaggcagaggcagctgccataatttatgcgcaatcaaaactccccgtttcatcggggatgcatttcgccaacccggtgcccgtgcagcagtctattcctaaaaacgaaatggatgatattattgaggaggcaatccgccttgctaaggtcgagggccaccagggcagcgacaacactccattcgtactatccaaaatcaagcaactcagtggcggcaagagtgttactgctaatcgtgctctggttgaggctaatgtgcagcgcgctgcacgcgttgctgtagaactttcaaagctggaacggacgaacggaacacttaatgagcggcatatgccagcaatttccgaggacgtcaaagctgaccaagcaacctcagaggcagagcttaagctcaacccaactactgaaggacctatcgaggcattggacaaggtagacgttctcgttgctggctctcttgcagttgatctttcctgtgactatactcctcctgcaggagaaaaagacatcaaacctgtttccgatacttccaatccagccaccatcacacagagccttggcggtgtgggtcacaatgttgccattgctaccaagtatcttggcagctccgttcttttctgtagtgttgtcggagacgatctaagtggccgtgcagccctaacggctcttcgaacagaggggctctccactgctggcgtacaggtgctacccgcgtcaaacagcgccaggaccgcacagtatgtagctgttaatgatgcgaagaaagacctcgttatggctatggcggacatgggcattatggaactgccagagcagaaattggacttcgagggcttttgggagactctgctctcccgcacgaagcctcaatgggttatcgttgattcgaactggagccctgaagttctaactaagtgggtcgctgtagccaagaagcatggcgcacgagttgcgttcgagcccgtatccaacgccaaaagctgccgcctgttcagcaaaagcgccgaggtaaatgcggcaatcagcccgtcggcatctgtccccaacaatgcgatcagcttggcgactcccaaccagtttgaactcactaccatgtacatggcagcgcgtgacagcgggctgtttgactccgagggctggtggcacatcatagatgcgatgggtatgtcgtcgggaggttctcgagatcgactcgttgcaatgacatcaaaccaacttgtggatcaaggcataccccagcagaatatccaactccttccttatatcccctgtctcattaccaaattagggtcacagggtgtcctcgtcactcaacttcttcgtcccggtgacccgcgtctcacttcgcccgattctgctccttatatcctgtcgcgtgctgcactggctgatgagttagtcggtggcgtgtacatgagattgttcccaccagccgccgtcctggccgacgaggaaattgtcagtgtcaacggagctggagatacacttctgggggcggtaatctcaggactcgtgaagggagcaaagaccgtagaagatgtcattccttttgcacaggaggccagtcttaggacgttgaagagtccaggaggtgtcagcagtgatattgccagcttggtgcgctcctaa

SEQ ID NO: 2272 - protein, 790 aa, Aspergillus oryzae
MLASRAAARHCCRRTRVPVLVAPVRRLHGLAQSKFLQVSEEVRDAVATGKPVVALESTIYTHGFPYPESVALASLLETVVRANGGVPATIGILNGVAKVGLNAEELIELASTAESKSALKVSRRDLGYICGLGLAGKRLHGGTTVSGTMILAHLAGIKVFGTGGLGGVHRGGESSMDISADLTELGRTPVAVVSSGCKSFLDIPRTLEYLETEGVCVGTFADGRTGQVDFPAFFTRDSGIKSPKVIQDEAEAAAIIYAQSKLPVSSGMHFANPVPVQQSIPKNEMDDIIEEAIRLAKVEGHQGSDNTPFVLSKIKQLSGGKSVTANRALVEANVQRAARVAVELSKLERTNGTLNERHMPAISEDVKADQATSEAELKLNPTTEGPIEALDKVDVLVAGSLAVDLSCDYTPPAGEKDIKPVSDTSNPATITQSLGGVGHNVAIATKYLGSSVLFCSVVGDDLSGRAALTALRTEGLSTAGVQVLPASNSARTAQYVAVNDAKKDLVMAMADMGIMELPEQKLDFEGFWETLLSRTKPQWVIVDSNWSPEVLTKWVAVAKKHGARVAFEPVSNAKSCRLFSKSAEVNAAISPSASVPNNAISLATPNQFELTTMYMAARDSGLFDSEGWWHIIDAMGMSSGGSRDRLVAMTSNQLVDQGIPQQNIQLLPYIPCLITKLGSQGVLVTQLLRPGDPRLTSPDSAPYILSRAALADELVGGVYMRLFPPAAVLADEEIVSVNGAGDTLLGAVISGLVKGAKTVEDVIPFAQEASLRTLKSPGGVSSDIASLVRS

SEQ ID NO: 2273 - DNA, 1086 bp, Oryza sativa
  CDS (1)..(1086)
atgtcgccgtcgtcgtcgtcgtcgagcacggggccgatgggggtggcggtgtcgccggaggtggaagcggcgctggcgcgcggcggcgcggtcgtcgccctcgagtccaccatcatctgccacggtatgccctacccgaagaatctccagaccgccatggaggtggaggccgtcgtgagggagaacggggcggttcctgccaccatagccattctgaacggcgtgccacatgttggccttagcggcgagcaattgaagagcttggctgtaagtggaagacagtttcagaagacggctagaagggatattgcacatgttgtggcctctggtggtaatggtgcaacaacagtttctgccactatgtttttcgctcataaggttggcataccaattttcgtaactggagggattggaggtgttcatagaaatggtgaacagaccatggacatctcctcagacttaactgaacttggaaagactcctgtcactgttatttcagctggtgtgaaatctattttggacataccacggacacttgagtacttggaaactcaaggagtaacggttgctgcttacaaaaccaatgaatttcctgctttctttacagaagtcagcggatgtaaggtgccatgtcgcgttgattctcccgaagagtgtgccaagataatatatgcaaacaagaatttacatctaggatctgggattttgattgctgtgccgattcccaaggaacatgcagcttcaggaaatgctatagagtctgcaatacagaaagccctcaaggaagcagagtattgtccttactcccaacctcctgctctctcactttatcttttctgtgtatttgtgatactaacagaaatgatatctaatgactttctatgttgtttcagggataaaaatataataggcaacgcgatcactcccttcatgcttgacagagtgaaagtactaactggacgatcttcgctagaagccaatattgcgcttgtaaagaacaatgctcttgttggtgctaaaattgctgtggccctttctgatcttcaccagagagtaacaaacagatttcggaggtctgccttatag

SEQ ID NO: 2274 - protein, 361 aa, Oryza sativa
MSPSSSSSSTGPMGVAVSPEVEAALARGGAVVALESTIICHGMPYPKNLQTAMEVEAVVRENGAVPATIAILNGVPHVGLSGEQLKSLAVSGRQFQKTARRDIAHVVASGGNGATTVSATMFFAHKVGIPIFVTGGIGGVHRNGEQTMDISSDLTELGKTPVTVISAGVKSILDIPRTLEYLETQGVTVAAYKTNEFPAFFTEVSGCKVPCRVDSPEECAKIIYANKNLHLGSGILIAVPIPKEHAASGNAIESAIQKALKEAEYCPYSQPPALSLYLFCVFVILTEMISNDFLCCFRDKNIIGNAITPFMLDRVKVLTGRSSLEANIALVKNNALVGAKIAVALSDLHQRVTNRFRRSAL

SEQ ID NO: 2275 - DNA, 984 bp, Oryza sativa
  CDS (1)..(984)
atgtcgccgtcgtcgtcgtcgtcgagcacggggccgatgggggtggcggtgtcgccggaggtggaagcggcgctggcgcgcggcggcgcggtcgtcgccctcgagtccaccatcatctgccacggtatgccctacccgaagaatctccagaccgccatggaggtggaggccgtcgtgagggagaacggggcggttcctgccaccatagccattctgaacggcgtgccacatgttggccttagcggcgagcaattgaagagcttggctgtaagtggaagacagtttcagaagacggctagaagggatattgcacatgttgtggcctctggtggtaatggtgcaacaacagtttctgccactatgtttttcgctcataaggttggcataccaattttcgtaactggagggattggaggtgttcatagaaatggtgaacagaccatggacatctcctcagacttaactgaacttggaaagactcctgtcactgttatttcagctggtgtgaaatctattttggacataccacggacacttgagtacttggaaactcaaggagtaacggttgctgcttacaaaaccaatgaatttcctgctttctttacagaagtcagcggatgtaaggtgccatgtcgcgttgattctcccgaagagtgtgccaagataatatatgcaaacaagaatttacatctaggatctgggattttgattgctgtgccgattcccaaggaacatgcagcttcaggaaatgctatagagtctgcaatacagaaagccctcaaggaagcagaggataaaaatataataggcaacgcgatcactcccttcatgcttgacagagtgaaagtactaactggacgatcttcgctagaagccaatattgcgcttgtaaagaacaatgctcttgttggtgctaaaattgctgtggccctttctgatcttcaccagagagtaacaaacagatttcggaggtctgccttatag

SEQ ID NO: 2276 - protein, 327 aa, Oryza sativa
MSPSSSSSSTGPMGVAVSPEVEAALARGGAVVALESTIICHGMPYPKNLQTAMEVEAVVRENGAVPATIAILNGVPHVGLSGEQLKSLAVSGRQFQKTARRDIAHVVASGGNGATTVSATMFFAHKVGIPIFVTGGIGGVHRNGEQTMDISSDLTELGKTPVTVISAGVKSILDIPRTLEYLETQGVTVAAYKTNEFPAFFTEVSGCKVPCRVDSPEECAKIIYANKNLHLGSGILIAVPIPKEHAASGNAIESAIQKALKEAEDKNIIGNAITPFMLDRVKVLTGRSSLEANIALVKNNALVGAKIAVALSDLHQRVTNRFRRSAL

SEQ ID NO: 2277 - DNA, 1089 bp, Arabidopsis thaliana
  CDS (1)..(1089)
atggcttcttctttagctcaatctagaatctcgaatctccagaatcatctttcacctcttgaagcaaacaacaagcagctcaggagtctggtcaagatttctccccaagtatctgaagccttgtctaatggacgtgctgttgtcgctcttgagtcaaccattatctcccatgggatgccttaccctcaaaatctgcaaacagcaaaagaggtggagtcaattgtgagagaaaatggagcaatccctgcaacaattgctatccttaatggagtaccttgcataggtctgagcgaggaagaactagaacgtcttgcatctctcggaaaaagtgtccaaaagacagcgggaagggacatagcaaatgttgtggctacaagaggaaacggtgcaactacagtctctgcaacgttgtttttcgcttcaatggttggcatccaagtttttgtgacgggcgggataggtggtgtccatagacatgccaaccattcgatggacatatcatctgatcttactgcacttgggaggactccaatagcagtgatatcagcaggcgttaaatcaatacttgatattccaaagactcttgaatatttggaaactcaagaagtgtatgttgctgcatacaagagcgatgagtttccagcatttttcacagaaaaaagtggctgtaaggcaccttcccgtgtaaatagccctgaagactgtgctagagtaataggcaagtgtagtctttctctcaaaatttcctcttttaaaacgtatttatgcactttgatcccttaccaccttgagataaaaccacttttgccagatgcaaacatgaagctaaaccgtcaggcggggattctatttgccattccaattccgaaacaccattcagccgctggaaatcttatcgaatcagcaacacagcgtgctcttacagaagcaagggaacaaaacgttactggaaatgcagaaactccattcttacttgcacgggtaaatgagttaaccggaggcacatcacttgcagcaaacattgcgcttgtgaaaaacaatgcccttatcggttctcagattgcagtagccctttctcagctgatgtga

SEQ ID NO: 2278 - protein, 362 aa, Arabidopsis thaliana
MASSLAQSRISNLQNHLSPLEANNKQLRSLVKISPQVSEALSNGRAVVALESTIISHGMPYPQNLQTAKEVESIVRENGAIPATIAILNGVPCIGLSEEELERLASLGKSVQKTAGRDIANVVATRGNGATTVSATLFFASMVGIQVFVTGGIGGVHRHANHSMDISSDLTALGRTPIAVISAGVKSILDIPKTLEYLETQEVYVAAYKSDEFPAFFTEKSGCKAPSRVNSPEDCARVIGKCSLSLKISSFKTYLCTLIPYHLEIKPLLPDANMKLNRQAGILFAIPIPKHHSAAGNLIESATQRALTEAREQNVTGNAETPFLLARVNELTGGTSLAANIALVKNNALIGSQIAVALSQLM

SEQ ID NO: 2279 - DNA, 951 bp, Erwinia chrysanthemi
  CDS (1)..(951): transl_table=11
atgtctaaaacggatttttcgcatgagttactgcggtttagcgatgaggtaaaggaggcgctgcataccggtaagccggtggtggcgctggagtcgaccgtgatcgcccacggcctgccttatcctgagaatgtggctacggccagaaagattgaggccgctgtgcgtgccgaaggggcgattcctgcgacgatcggcatcgaaaacggccgatttctgattggtatgtcggatgccgatattgaacggtttggctcgaccaagggcattccgaaagccagcagccgcgatattccggtgattctggcgcaaggcggcatgggcgcgaccaccgtggcttcgtcgctggtggcggcggacctggccggtattcctttctttgcatcggcgggcatcggcggcgtgcaccgcggcgccgagcggtcgatggatatttccgccgacctgatccagttcacccgctcccgggtcgcggtggtgtgtgccggcgccaagagtattctcgaccttggtttgacgcttgaatatctggaaacccagtgcgtacccatcatttcctatcaatctgacgattttcccgctttttactgccgttccagtggttttcacagcccccatcggctggacgacgccacggttattgcccgttccatcgagatgcactggaagctgggtaaccagagctcggtgctgattacccatccgattcacgaagaggacgccatcgacaccgatgaagtggagtcgattatccgtgaagccgccgttcaggcggagcgtgaaggtattcgcgggccgggcgccacgccgtatctgatgcgcgccgtcgccaaagccacgcaagggcggacggtcaaggccaatatgtcggtgctgatcagtaccgccgcgctggccggcaaactggcccgcgcccataccgactacctacggcagcaaaaccaggcataa

SEQ ID NO: 2280 - protein, 316 aa, Erwinia chrysanthemi
MSKTDFSHELLRFSDEVKEALHTGKPVVALESTVIAHGLPYPENVATARKIEAAVRAEGAIPATIGIENGRFLIGMSDADIERFGSTKGIPKASSRDIPVILAQGGMGATTVASSLVAADLAGIPFFASAGIGGVHRGAERSMDISADLIQFTRSRVAVVCAGAKSILDLGLTLEYLETQCVPIISYQSDDFPAFYCRSSGFHSPHRLDDATVIARSIEMHWKLGNQSSVLITHPIHEEDAIDTDEVESIIREAAVQAEREGIRGPGATPYLMRAVAKATQGRTVKANMSVLISTAALAGKLARAHTDYLRQQNQA

SEQ ID NO: 2281 - DNA, 951 bp, Erwinia chrysanthemi
  CDS (1)..(951): transl_table=11
atgtctaaaacggatttttcgcatgatttatcgcggtttagtgatgaggtaaaggaggcgctgcattccggtaaaccggtggtggcgctggagtcgaccgtgatcgcccacggcctgccttatcctgagaatgtggctacggccagaaagattgaggccgcggtgcgtgccgaaggggcgattcctgcgacgatcgacatcgaaaacggccggtttctgattggcatgtcggacgccgatcttgaacggtttggttcgaccaggggcattccgaaagccagcagccgtgatattccggtgattctggcgcaaggcggcatgggcgcgaccacggtggcgtcgtcgctggtggcggcggatctggccggcattcctttctttgcgtcggcgggcatcggcggcgtacatcgcggcgccgagcggtcgatggatatttccgccgacctgatccagttcacccgctcccgggtcgcggtggtgtgcgccggcgccaagagtattctcgatcttggcttgacgcttgaatatctggaaacccagtgcgtccccatcatttcctatcaatctgacgatttccccgctttttattgtcgttccagcggttttcacagcccccatcggctggacgacgccacggtcattgcccgttccatcgacatgcactggaaactgggtaaccagagttcggtgttgattacccatcctattcacgaagaggacgccatcggcacagatgaggtggagtcgattatccgtgaagccgccgttcaggcggagcatgaaggtattcgtgggccgggcgccacgccttatctgatgcgtgccgtcgctaaagccacggaagggaagacggtcaaagccaacatgtcggtgctgatcagtacggccgcgctggccggcaaactggcctgcgctcatatcgactatctgcggcagcaaaaccaggcataa

SEQ ID NO: 2282 - protein, 316 aa, Erwinia chrysanthemi
MSKTDFSHDLSRFSDEVKEALHSGKPVVALESTVIAHGLPYPENVATARKIEAAVRAEGAIPATIDIENGRFLIGMSDADLERFGSTRGIPKASSRDIPVILAQGGMGATTVASSLVAADLAGIPFFASAGIGGVHRGAERSMDISADLIQFTRSRVAVVCAGAKSILDLGLTLEYLETQCVPIISYQSDDFPAFYCRSSGFHSPHRLDDATVIARSIDMHWKLGNQSSVLITHPIHEEDAIGTDEVESIIREAAVQAEHEGIRGPGATPYLMRAVAKATEGKTVKANMSVLISTAALAGKLACAHIDYLRQQNQA

SEQ ID NO: 2283 - DNA, 975 bp, Arabidopsis thaliana
  CDS (1)..(975)
atggcggcgatgatcgccggcgacggagatcggatcggtccttcgtttttgaagcagctcaggagtctggtcaagatttctccccaagtatctgaagccttgtctaatggacgtgctgttgtcgctcttgagtcaaccattatctcccatgggatgccttaccctcaaaatctgcaaacagcaaaagaggtggagtcaattgtgagagaaaatggagcaatccctgcaacaattgctatccttaatggagtaccttgcataggtctgagcgaggaagaactagaacgtcttgcatctctcggaaaaagtgtccaaaagacagcgggaagggacatagcaaatgttgtggctacaagaggaaacggtgcaactacagtctctgcaacgttgtttttcgcttcaatggttggcatccaagtttttgtgacgggcgggataggtggtgtccatagacatgccaaccattcgatggacatatcatctgatcttactgcacttgggaggactccaatagcagtgatatcagcaggcgttaaatcaatacttgatattccaaagactcttgaatatttggaaactcaagaagtgtatgttgctgcatacaagagcgatgagtttccagcatttttcacagaaaaaagtggctgtaaggcaccttcccgtgtaaatagccctgaagactgtgctagagtaatagatgcaaacatgaagctaaaccgtcaggcggggattctatttgccattccaattccgaaacaccattcagccgctggaaatcttatcgaatcagcaacacagcgtgctcttacagaagcaagggaacaaaacgttactggaaatgcagaaactccattcttacttgcacgggtaaatgagttaaccggaggcacatcacttgcagcaaacattgcgcttgtgaaaaacaatgcccttatcggttctcagattgcagtagccctttctcagctgatgtga

SEQ ID NO: 2284 - protein, 324 aa, Arabidopsis thaliana
MAAMIAGDGDRIGPSFLKQLRSLVKISPQVSEALSNGRAVVALESTIISHGMPYPQNLQTAKEVESIVRENGAIPATIAILNGVPCIGLSEEELERLASLGKSVQKTAGRDIANVVATRGNGATTVSATLFFASMVGIQVFVTGGIGGVHRHANHSMDISSDLTALGRTPIAVISAGVKSILDIPKTLEYLETQEVYVAAYKSDEFPAFFTEKSGCKAPSRVNSPEDCARVIDANMKLNRQAGILFAIPIPKHHSAAGNLIESATQRALTEAREQNVTGNAETPFLLARVNELTGGTSLAANIALVKNNALIGSQIAVALSQLM

SEQ ID NO: 2285 - DNA, 900 bp, Oryza sativa
  CDS (1)..(900)
atgtcgccgtcgtcgtcgtcgtcgagcacggggccgatgggggtggcggtgtcgccggaggtggaagcggcgctggcgcgcggcggcgcggtcgtcgccctcgagtccaccatcatctgccacggtatgccctacccgaagaatctccagaccgccatggaggtggaggccgtcgtgagggagaacggggcggttcctgccaccatagccattctgaacggcgtgccacatgttggccttagcggcgagcaattgaagagcttggctgtaagtggaagacagtttcagaagacggctagaagggatattgcacatgttgtggcctctggtggtaatggtgcaacaacagtttctgccactatgtttttcgctcataaggttggcataccaattttcgtaactggagggattggaggtgttcatagaaatggtgaacagaccatggacatctcctcagacttaactgaacttggaaagactcctgtcactgttatttcagctggtgtgaaatctattttggacataccacggacacttgagtacttggaaactcaaggagtaacggttgctgcttacaaaaccaatgaatttcctgctttctttacagaagtcagcggatgtaaggtgccatgtcgcgttgattctcccgaagagtgtgccaagataatatatgcaaacaagaatttacatctaggatctgggattttgattgctgtgccgattcccaaggaacatgcagcttcaggaaatgctatagagtctgcaatacagaaagccctcaaggaagcagaggataaaaatataataggcaacgcgatcactcccttcatgcttgacagagtgaaagtactaactggacgatcttcgctagaagccaaacaatgctcttgttggtgctaa

SEQ ID NO: 2286 - protein, 299 aa, Oryza sativa
MSPSSSSSSTGPMGVAVSPEVEAALARGGAVVALESTIICHGMPYPKNLQTAMEVEAVVRENGAVPATIAILNGVPHVGLSGEQLKSLAVSGRQFQKTARRDIAHVVASGGNGATTVSATMFFAHKVGIPIFVTGGIGGVHRNGEQTMDISSDLTELGKTPVTVISAGVKSILDIPRTLEYLETQGVTVAAYKTNEFPAFFTEVSGCKVPCRVDSPEECAKIIYANKNLHLGSGILIAVPIPKEHAASGNAIESAIQKALKEAEDKNIIGNAITPFMLDRVKVLTGRSSLEAKQCSCWC

SEQ ID NO: 2287 - DNA, 984 bp, Triticum aestivum
  CDS (1)..(984)
atgtcgaaggcgccgccgcgggaagacccgtcgccgacaggcgtcgcggtgtctccggaggtcgaggccgcgctcgcgagcggcggggcggtcgtcgccctcgagtccaccatcatctgccacggcatgccctacccgaagaacctccagacggccatggaggtggaggccatcgtcagggagaacggcgctgttcctgccaccatagccattctgaacggcgtgccacatgttgggcttaacagtgaacagctgaagaacttggctataagcggaagtcagtttcagaagacagctagaagagatatcgcgcaagttgttgcgtcaggcggcaatggtgctacgacagtctctgccaccatgttttttgctcataaggttggtataccaatttttgtgactgggggaattggaggcgtacacagatacggtgaaaaaaccatggacatctcatctgacttaactgaacttggaaagactcctgtggctgttatttcagccggtgtgaagtccattttggatatcgcacggacgctcgagtacttggaaactcaaggggtaactgttgctgcttacagaaccaacgaatttccagctttcttcacagaaaccagtggatgtaaggtgccatgtcgcgttgattctccagaagagtgtgcgaagataatatatgcaaaccagaatatgcatctaggatctggaattcttattgcagtgccagttcccaagcaacatgcagcctcaggaaaggttatagagtctgcaatacagcaatccctcaaggaagcagatgataaaaagataataggaaatgcaatcacccccttcatccttgacagagtgaaagtactaactggaggatcttcattggaagccaacattgcacttgtgaagaacaatgctctcactggtgctaaaattgctgtagccctttcagatcttcgcaagagagtaacaaacaggcctgtgaggtctgcgctataa

SEQ ID NO: 2288 - protein, 327 aa, Triticum aestivum
MSKAPPREDPSPTGVAVSPEVEAALASGGAVVALESTIICHGMPYPKNLQTAMEVEAIVRENGAVPATIAILNGVPHVGLNSEQLKNLAISGSQFQKTARRDIAQVVASGGNGATTVSATMFFAHKVGIPIFVTGGIGGVHRYGEKTMDISSDLTELGKTPVAVISAGVKSILDIARTLEYLETQGVTVAAYRTNEFPAFFTETSGCKVPCRVDSPEECAKIIYANQNMHLGSGILIAVPVPKQHAASGKVIESAIQQSLKEADDKKIIGNAITPFILDRVKVLTGGSSLEANIALVKNNALTGAKIAVALSDLRKRVTNRPVRSAL

SEQ ID NO: 2289 - DNA, 26 bp, Artificial sequence
  primer
atgtctgaattaaaaatttcccctga

SEQ ID NO: 2290 - DNA, 23 bp, Artificial sequence
  primer
ttaacccgcgagacgctgatatt

SEQ ID NO: 2291 - protein, 374 aa, Artificial sequence
  consensus sequence
  Variant (3)..(4): Xaa in position 3 to 4 is any amino acid
  Variant (6)..(10): Xaa in position 6 to 10 is any amino acid
  Variant (11)..(13): Xaa in position 11 to 13 is any or no amino acid
  Variant (22)..(22): Xaa in position 22 is any amino acid
  Variant (25)..(25): Xaa in position 25 is any amino acid
  Variant (29)..(29): Xaa in position 29 is any amino acid
  Variant (31)..(33): Xaa in position 31 to 33 is any amino acid
  Variant (35)..(35): Xaa in position 35 is any amino acid
  Variant (36)..(37): Xaa in position 36 to 37 is any or no amino acid
  Variant (39)..(41): Xaa in position 39 to 41 is any amino acid
  Variant (43)..(44): Xaa in position 43 to 44 is any amino acid
  Variant (47)..(47): Xaa in position 47 is any amino acid
  Variant (53)..(55): Xaa in position 53 to 55 is any amino acid
  Variant (57)..(60): Xaa in position 57 to 60 is any amino acid
  Variant (63)..(72): Xaa in position 63 to 72 is any amino acid
  Variant (73)..(83): Xaa in position 73 to 83 is any or no amino acid
  Variant (85)..(88): Xaa in position 85 to 88 is any amino acid
  Variant (90)..(94): Xaa in position 90 to 94 is any amino acid
  Variant (96)..(99): Xaa in position 96 to 99 is any amino acid
  Variant (100)..(104): Xaa in position 100 to 104 is any or no amino acid
  Variant (106)..(106): Xaa in position 106 is any amino acid
  Variant (110)..(111): Xaa in position 110 to 111 is any amino acid
  Variant (113)..(115): Xaa in position 113 to 115 is any amino acid
  Variant (117)..(119): Xaa in position 117 to 119 is any amino acid
  Variant (122)..(123): Xaa in position 122 to 123 is any amino acid
  Variant (125)..(125): Xaa in position 125 is any amino acid
  Variant (129)..(129): Xaa in position 129 is any amino acid
  Variant (134)..(137): Xaa in position 134 to 137 is any amino acid
  Variant (138)..(144): Xaa in position 138 to 144 is any or no amino acid
  Variant (146)..(146): Xaa in position 146 is any amino acid
  Variant (148)..(148): Xaa in position 148 is any amino acid
  Variant (151)..(152): Xaa in position 151 to 152 is any amino acid
  Variant (154)..(155): Xaa in position 154 to 155 is any amino acid
  Variant (157)..(157): Xaa in position 157 is any amino acid
  Variant (159)..(159): Xaa in position 159 is any amino acid
  Variant (161)..(162): Xaa in position 161 to 162 is any amino acid
  Variant (165)..(165): Xaa in position 165 is any amino acid
  Variant (167)..(167): Xaa in position 167 is any amino acid
  Variant (171)..(173): Xaa in position 171 to 173 is any amino acid
  Variant (175)..(175): Xaa in position 175 is any amino acid
  Variant (177)..(177): Xaa in position 177 is any amino acid
  Variant (181)..(181): Xaa in position 181 is any amino acid
  Variant (184)..(184): Xaa in position 184 is any amino acid
  Variant (186)..(193): Xaa in position 186 to 193 is any amino acid
  Variant (194)..(198): Xaa in position 194 to 198 is any or no amino acid
  Variant (202)..(205): Xaa in position 202 to 205 is any amino acid
  Variant (207)..(219): Xaa in position 207 to 219 is any amino acid
  Variant (220)..(220): Xaa in position 220 is any or no amino acid
  Variant (222)..(232): Xaa in position 222 to 232 is any amino acid
  Variant (233)..(265): Xaa in position 233 to 265 is any or no amino acid
  Variant (267)..(270): Xaa in position 267 to 270 is any amino acid
  Variant (271)..(271): Xaa in position 271 is any or no amino acid
  Variant (273)..(273): Xaa in position 273 is any amino acid
  Variant (275)..(288): Xaa in position 275 to 288 is any amino acid
  Variant (289)..(290): Xaa in position 289 to 290 is any or no amino acid
  Variant (292)..(294): Xaa in position 292 to 294 is any amino acid
  Variant (296)..(296): Xaa in position 296 is any amino acid
  Variant (297)..(335): Xaa in position 297 to 335 is any or no amino acid
  Variant (337)..(339): Xaa in position 337 to 339 is any amino acid
  Variant (342)..(342): Xaa in position 342 is any amino acid
  Variant (345)..(350): Xaa in position 345 to 350 is any amino acid
  Variant (352)..(352): Xaa in position 352 is any amino acid
  Variant (354)..(354): Xaa in position 354 is any amino acid
  Variant (357)..(358): Xaa in position 357 to 358 is any amino acid
  Variant (360)..(361): Xaa in position 360 to 361 is any amino acid
  Variant (364)..(365): Xaa in position 364 to 365 is any amino acid
  Variant (368)..(373): Xaa in position 368 to 373 is any amino acid
EVXXAXXXXXXXXVALESTIIXHGXPYPXNXXXAXXXEXXXRXXGAXPATIAXXXGXXXXGLXXXXXXXXXXXXXXXXXXXXXKXXXXDXXXXXAXXXXXXXXXGXTTVXXTXXXAXXXGIXXFXTGGXGGVHXXXXXXXXXXXDXSXDLXXLXXTXVXVXXAGXKXILDXXXTXEXLETXGVXVXXXXXXXXXXXXXPAFXXXXSXXXXXXXXXXXXXXAXXXXXXXXXXXXXXXXXXXXXXXXXXXXXXXXXXXXXXXXXXXXGXXXXXPXPXXXXXXXXXXXXXXXXAXXXAXXXXXXXXXXXXXXXXXXXXXXXXXXXXXXXXXXXXXXXXGXXXTPXLLXXXXXXTXGXSLXXNXXLVXXNAXXXXXXA

SEQ ID NO: 2292 - protein, 39 aa, Artificial sequence
  protein pattern
  Variant (2)..(2): Xaa in position 2 is any amino acid
  Variant (4)..(4): Xaa in position 4 is Ala or Ser
  Variant (7)..(8): Xaa in position 7 to 8 is any amino acid
  Variant (10)..(10): Xaa in position 10 is Ala, Gly or Ser
  Variant (11)..(11): Xaa in position 11 is any amino acid
  Variant (13)..(15): Xaa in position 13 to 15 is any amino acid
  Variant (17)..(17): Xaa in position 17 is Phe, Ile or Val
  Variant (18)..(18): Xaa in position 18 is Ala, Cys or Ser
  Variant (19)..(19): Xaa in position 19 is Ala or Ser
  Variant (21)..(21): Xaa in position 21 is Ala, Pro or Val
  Variant (23)..(23): Xaa in position 23 is Ala or Ser
  Variant (27)..(27): Xaa in position 27 is Ile, Leu or Val
  Variant (28)..(29): Xaa in position 28 to 29 is any amino acid
  Variant (31)..(31): Xaa in position 31 is any amino acid
  Variant (32)..(32): Xaa in position 32 is Glu or Gln
  Variant (33)..(33): Xaa in position 33 is any amino acid
  Variant (36)..(36): Xaa in position 36 is Ser or Thr
  Variant (37)..(38): Xaa in position 37 to 38 is any amino acid
  Variant (39)..(39): Xaa in position 39 is Ala, Cys or Val
DXSXDLXXLXXTXXXVXXXGXKXILDXXXTXXXLEXXXX

SEQ ID NO: 2293 - protein, 28 aa, Artificial sequence
  protein pattern
  Variant (4)..(4): Xaa in position 4 is any or no amino acid
  Variant (6)..(6): Xaa in position 6 is any or no amino acid
  Variant (8)..(10): Xaa in position 8 to 10 is any amino acid
  Variant (11)..(11): Xaa in position 11 is Ala or Ser
  Variant (12)..(15): Xaa in position 12 to 15 is any amino acid
  Variant (16)..(16): Xaa in position 16 is Ile, Leu or Val
  Variant (17)..(17): Xaa in position 17 is any amino acid
  Variant (18)..(18): Xaa in position 18 is Phe, Ile, Leu or Val
  Variant (19)..(19): Xaa in position 19 is Phe or Val
  Variant (20)..(20): Xaa in position 20 is Ala, Ser or Val
  Variant (24)..(24): Xaa in position 24 is any amino acid
TTVXAXTXXXXXXXXXXXXXTGGXGGVH

SEQ ID NO: 2294 - protein, 25 aa, Artificial sequence
  protein pattern
  Variant (2)..(2): Xaa in position 2 is Ala or Ser
  Variant (8)..(8): Xaa in position 8 is Ile or Val
  Variant (9)..(9): Xaa in position 9 is Ala, Cys, Ser or Thr
  Variant (12)..(12): Xaa in position 12 is Leu or Met
  Variant (14)..(14): Xaa in position 14 is any amino acid
  Variant (16)..(16): Xaa in position 16 is any amino acid
  Variant (18)..(22): Xaa in position 18 to 22 is any amino acid
  Variant (23)..(24): Xaa in position 23 to 24 is any or no amino acid
VXLESTIXXHGXPXPXNXXXXXXXE

SEQ ID NO: 2295 - protein, 19 aa, Artificial sequence
  protein pattern
  Variant (2)..(2): Xaa in position 2 is any or no amino acid
  Variant (4)..(4): Xaa in position 4 is any amino acid
  Variant (8)..(8): Xaa in position 8 is any amino acid
  Variant (9)..(9): Xaa in position 9 is Ala or Gly
  Variant (10)..(10): Xaa in position 10 is Phe, Ile, Leu, Met or Val
  Variant (11)..(12): Xaa in position 11 to 12 is any amino acid
  Variant (14)..(16): Xaa in position 14 to 16 is any amino acid
  Variant (17)..(17): Xaa in position 17 is Ala, Ile or Val
  Variant (19)..(19): Xaa in position 19 is Leu or Met
GXAXPATXXXXXGXXXXGX

SEQ ID NO: 2296 - protein, 21 aa, Artificial sequence
  protein pattern
  Variant (3)..(3): Xaa in position 3 is any amino acid
  Variant (4)..(4): Xaa in position 4 is any or no amino acid
  Variant (6)..(11): Xaa in position 6 to 11 is any amino acid
  Variant (12)..(12): Xaa in position 12 is any or no amino acid
  Variant (14)..(14): Xaa in position 14 is any or no amino acid
  Variant (16)..(16): Xaa in position 16 is any amino acid
  Variant (17)..(17): Xaa in position 17 is Ser or Thr
  Variant (18)..(19): Xaa in position 18 to 19 is any amino acid
  Variant (20)..(20): Xaa in position 20 is Ala, Glu, Ser or Thr
  Variant (21)..(21): Xaa in position 21 is Ala or Asn
TPXXLXXXXXXXTXGXXXXXX

SEQ ID NO: 2297 - DNA, 1323 bp, Escherichia coli K12
  CDS (1)..(1323): transl_table=11
atgattggtcgcatatcgcgttttatgacgcgttttgtcagccggtggcttcccgatccactgatctttgccatgttgctgacattgctaacattcgtgatcgcgctttggttaacaccacaaacgccgatcagcatggtgaaaatgtggggtgacggtttctggaacttgctggcgtttggtatgcagatggcgcttatcatcgttaccggtcatgcccttgccagctctgctccggtgaaaagtttgctgcgtactgccgcctccgccgcaaagacgcccgtacagggcgtcatgctggtcactttcttcggttcagtcgcttgtgtcatcaactggggatttggtttggttgtcggcgcaatgtttgcccgtgaagtcgcccggcgagtccccggttctgattatccgttgctcattgcctgcgcctacattggttttctcacctggggtggcggcttctctggatcaatgcctctgttggctgcaacaccgggcaacccggttgagcatatcgccgggctgatcccggtgggcgatactctgttcagtggttttaacattttcatcactgtggcgttgattgtggtgatgccatttatcacccgcatgatgatgccaaaaccgtctgacgtggtgagtatcgatccaaaactactcatggaagaggctgattttcaaaagcagctaccgaaagatgccccaccatccgagcgactggaagaaagccgcattctgacgttgatcatcggcgcactcggtatcgcttaccttgcgatgtacttcagcgaacatggcttcaacatcaccatcaataccgtcaacctgatgtttatgattgcgggtctgctgctacataaaacgccaatggcttatatgcgtgctatcagcgcggcagcacgcagtactgccggtattctggtgcaattccccttctacgctgggatccaactgatgatggagcattccggtctgggcggactcattaccgaattcttcatcaatgttgcgaacaaagacaccttcccggtaatgaccttttttagttctgcactgattaacttcgccgttccgtctggcggcggtcactgggttattcagggacctttcgtgatacccgcagcccaggcgctgggcgctgatctcggtaaatcggtaatggcgatcgcctacggcgagcaatggatgaacatggcacaaccattctgggcgctgccagcactggcaatcgccggactcggtgtccgcgacatcatgggctactgcatcactgccctgctcttctccggtgtcattttcgtcattggtttaacgctgttctaa

SEQ ID NO: 2298 - protein, 440 aa, Escherichia coli K12
MIGRISRFMTRFVSRWLPDPLIFAMLLTLLTFVIALWLTPQTPISMVKMWGDGFWNLLAFGMQMALIIVTGHALASSAPVKSLLRTAASAAKTPVQGVMLVTFFGSVACVINWGFGLVVGAMFAREVARRVPGSDYPLLIACAYIGFLTWGGGFSGSMPLLAATPGNPVEHIAGLIPVGDTLFSGFNIFITVALIVVMPFITRMMMPKPSDVVSIDPKLLMEEADFQKQLPKDAPPSERLEESRILTLIIGALGIAYLAMYFSEHGFNITINTVNLMFMIAGLLLHKTPMAYMRAISAAARSTAGILVQFPFYAGIQLMMEHSGLGGLITEFFINVANKDTFPVMTFFSSALINFAVPSGGGHWVIQGPFVIPAAQALGADLGKSVMAIAYGEQWMNMAQPFWALPALAIAGLGVRDIMGYCITALLFSGVIFVIGLTLF

SEQ ID NO: 2299 - DNA, 1465 bp, Helicobacter pylori
  CDS (51)..(1415): transl_table=11
  misc_feature (976)..(976): n is a, g, c or t
gacagaagctgaatttgaggtgcgcttatagcttgtaaaagggggtgtttatgtttttattaaggcatttgacttcagcgtgcgtgtttttggcgtctaaatgtttgccggactcctttgtcttggtcgctcttttatcgtttgtcgtgtttgttcttgtttattgcttgacagggcaagacgctttttctgtcatttctagttgggggaatggcgcttggacgcttttaggtttttctatgcaaatggcccttattttggtgttgggtcaggctctggctaacgctaaattagtccaaaagcttttaaaatatctagcgtctttacctaaagggtattatacggctttatggttggttacttttttatcgttaatcgctaattggatcaactggggttttggcttggtgattagtgcgatttttgcaaaagagatcgccaaaaatgttaagggggtggattacaggctgctcattgctagcgcttattcgggttttgtcatctggcatgggggtttatcaggctctatccctttaagcgttgccacccaaaatgaaaatctatccaaaataagcgctggggtgattgaaaaagctatccctatcagtcagacgattttttcttcttataatttaatcattatagggatcattcttgtagggttaccctttttaatggcaatgatccaccctaaaaaagaagaaatcgttgagattgattcaaagcttttaaaagacgagtacaaagagattgaactcattagccaccaacaagacaaaacgatcgcgcattttttggaaaacagcgctttgctttcttatcttttggtttttttgggttttgggtatcttggtgtttatttttttaaagggggagggattagtttaaacattgtcaatacgattttcctttttttagggattttactgcataaaacccctttagcttatgtgaaagcgatcgatcgttccgctangagcgtggctgggattttattgcaattccctttttacgctgggattatggggatgatggcaagccatagcgtggggggtcattctttagcgcaaatgctttctttagctttcacgcacatcgctaatgaaaaaactttcgtgctcatgacttttttgagcgcagggattgtcaatatttttattccgtctggcggagggcaatgggcgattcaagctcctatcatgcttccggctgggcaaagcttaggggtggatccgggagtggtttctatggctatcgcttggggagatgcttggacgaatatgatacagcctttttgggctttgcccgctttagccattgcgggtttgggcgctaaagatattatgggctattgcgttttgactttaatttttgtaggcttagtcgtgtgtggggtgttttattttttagtgtgagttttttatgcctaaaaccatgctcttttcaatggggtaaggttttctct

SEQ ID NO: 2300 - protein, 454 aa, Helicobacter pylori
  misc_feature (309)..(309): The Xaa at location 309 stands for Arg, Lys, Met, or Thr.
MFLLRHLTSACVFLASKCLPDSFVLVALLSFVVFVLVYCLTGQDAFSVISSWGNGAWTLLGFSMQMALILVLGQALANAKLVQKLLKYLASLPKGYYTALWLVTFLSLIANWINWGFGLVISAIFAKEIAKNVKGVDYRLLIASAYSGFVIWHGGLSGSIPLSVATQNENLSKISAGVIEKAIPISQTIFSSYNLIIIGIILVGLPFLMAMIHPKKEEIVEIDSKLLKDEYKEIELISHQQDKTIAHFLENSALLSYLLVFLGFGYLGVYFFKGGGISLNIVNTIFLFLGILLHKTPLAYVKAIDRSAXSVAGILLQFPFYAGIMGMMASHSVGGHSLAQMLSLAFTHIANEKTFVLMTFLSAGIVNIFIPSGGGQWAIQAPIMLPAGQSLGVDPGVVSMAIAWGDAWTNMIQPFWALPALAIAGLGAKDIMGYCVLTLIFVGLVVCGVFYFLV

SEQ ID NO: 2301 - DNA, 1461 bp, Archaeoglobus fulgidus DSM 4304
  CDS (1)..(1461): transl_table=11
atggaggatgggcggtacagcgccctggagagaatgggagcaagactgtgcgcaagcgtggagaaatggatgccggacccattaatctttgctctgcttctgactttggtgacttatctgttggtaatagtggtgatgaagccgtacacagtgatggatgcgggaacgatggttaagtggctcctcgtggatgtttggtacaaaggcttctggggtctcctgtccttcgccatgcaaatgtgtttgattcttgttaccggttatgcaatagcctatcatccaatcgtttacaggattttgaaaaagatagcgacactcccttcagatactaaatcggctgcagctcttacggcacttattgcaatgattgcagcttggataaactggggacttggacttatagttggggccattttggccagaacaattggaattgaattctacagaacaggaaagccattgcactatccggctgtagtagcagccggttatgccggtttaggacttacttggcattggggtttatcggcttctgcaccattattgattaacacgccaaatcactttctaaaggatgttttcgtggagttgttcggcagggagacagttccgctgaacgagaccatctttcatccatatactcttataaatctggcaataatcatttctttcggggtactggcttattacgcgcttgcgcctaacaggggtgaattgaaaggaatagacaaagttgcaccacacataattgagctggtgaagaaagaaaaggaagaggagctgaaagaaaaaagtaaagagcgcgtaacgattgctgacaagcttgagaacagtaaagttctcgccctactaataagcatattggggattatcacgatgggctactggttctacgagaaaggctttttcggtggactaaacctaaattcgctgaattttacgtttataatggttggccttcttctctacatgaatcccatagcttacatgagggctatcaccagagcggcaggagcagtagcaggaatactggttcagtttccgttctatgcgggtattatgggaatgatgaggtacagtgcagttgttgcagggggaccaaatcttgcaactgttatagccaacagtatagcgagcgttgcaacgccgtttacgtggccggcaatatgtttatacattgcagggctgataaacatattcataccttctggaggtggagaatgggcagcagttggagagattttagcaagaacgtcagctgccctgggtgtgcctattggaaaaaccgtaattgcttatggtgtaggggacgcttggacaaacctcttccagccattctgggcgattcctctcctcggacttacgggaacaagggccagagatgtttttggatacacgatctccgtgatgatattggcaaccattccgctctcgctcggtttagttctcgttccatattga

SEQ ID NO: 2302 - protein, 486 aa, Archaeoglobus fulgidus DSM 4304
MEDGRYSALERMGARLCASVEKWMPDPLIFALLLTLVTYLLVIVVMKPYTVMDAGTMVKWLLVDVWYKGFWGLLSFAMQMCLILVTGYAIAYHPIVYRILKKIATLPSDTKSAAALTALIAMIAAWINWGLGLIVGAILARTIGIEFYRTGKPLHYPAVVAAGYAGLGLTWHWGLSASAPLLINTPNHFLKDVFVELFGRETVPLNETIFHPYTLINLAIIISFGVLAYYALAPNRGELKGIDKVAPHIIELVKKEKEEELKEKSKERVTIADKLENSKVLALLISILGIITMGYWFYEKGFFGGLNLNSLNFTFIMVGLLLYMNPIAYMRAITRAAGAVAGILVQFPFYAGIMGMMRYSAVVAGGPNLATVIANSIASVATPFTWPAICLYIAGLINIFIPSGGGEWAAVGEILARTSAALGVPIGKTVIAYGVGDAWTNLFQPFWAIPLLGLTGTRARDVFGYTISVMILATIPLSLGLVLVPY

SEQ ID NO: 2303 - DNA, 1455 bp, Aeropyrum pernix K1
  CDS (1)..(1455): transl_table=11
gtgggctcattgggggacgagtctaggcgtcccttcctagaggctttcggcgaggcgctggagcgaagggtcaggggcgtcatgccagaccccttcatcttcgccatactccttacattcatagcaatagtgctcgacctcatcctcctgaggcccatacagcatgtggggctggggggtactgtcaagtttctagtctacagtgcatggtacggcggcttctggaagctcctgaccttcagcatgcagatgacccttatactggtgacgggctacgttatagcctaccacccactcgtatacagggttctctccaggatagccggcctacctagggacacgaagcaggcagccgtcctcgccgcagccgtcgccatagcactctcatacctcagctggggcctgagcctgataggcggggccatactggccagggagatagggaggcaggccgccttccgcggaaggaagatccactatccagtagtggtcgtcgctgcatacagcggcctagggctaacatggcactggggtctcacggcaagcgccccgctgctcatgaacactcccggccacttcctggccaacgttgtgaaggagctctacggcgtcgagacaataccgctctcacagacgattttccacccctacactatcataaacttcctgctgataaccctggcagcactggcgatatactggctcataagcccctcccgagggcccgtcagggggatagaggagttcgaccccgacgccctcaaggaagaggctgcgcccgctggtgagaagcccaggatcgagaccctggcggacaggcttgagaactccaggacactggccatactcaccgtcatactgggtttcacggcggttgcaatagagctgtatacacggggcataagcagggcgctcaacctcaacaccatgaacttcatcttcctaatgacaggactcctgctctacgccaaccccatgagctacgcaagggccttctacaggagcgtctcatcggccgcgggcgtcatactacagttccacttctacgccggcatcttcggcctcctaaacacgcccttcgagcctctcggcaagagctcggcccagatcatcgcagaaggcctggccgacgtttcaacacccttcatatggccggtagtggccttcctaaccgcgggcatagtgaacctcttcataccaagcgggggcggcgagtgggctgcgataggagaaatactagtcagggccggccacgagctgggagtgccgataggtaaaaccataatagcctacggcttcggcgactcgtggacaaacttactccagcccttctgggcaatacccctcctagacataactaggacgagggctagggatgtattcggctacaccatagcactcatgatactcatagctccagtggctgcggtaaccctgaccctgataccgtactga

SEQ ID NO: 2304 - protein, 484 aa, Aeropyrum pernix K1
MGSLGDESRRPFLEAFGEALERRVRGVMPDPFIFAILLTFIAIVLDLILLRPIQHVGLGGTVKFLVYSAWYGGFWKLLTFSMQMTLILVTGYVIAYHPLVYRVLSRIAGLPRDTKQAAVLAAAVAIALSYLSWGLSLIGGAILAREIGRQAAFRGRKIHYPVVVVAAYSGLGLTWHWGLTASAPLLMNTPGHFLANVVKELYGVETIPLSQTIFHPYTIINFLLITLAALAIYWLISPSRGPVRGIEEFDPDALKEEAAPAGEKPRIETLADRLENSRTLAILTVILGFTAVAIELYTRGISRALNLNTMNFIFLMTGLLLYANPMSYARAFYRSVSSAAGVILQFHFYAGIFGLLNTPFEPLGKSSAQIIAEGLADVSTPFIWPVVAFLTAGIVNLFIPSGGGEWAAIGEILVRAGHELGVPIGKTIIAYGFGDSWTNLLQPFWAIPLLDITRTRARDVFGYTIALMILIAPVAAVTLTLIPY

SEQ ID NO: 2305 - DNA, 1365 bp, Helicobacter pylori 26695
  CDS (1)..(1365): transl_table=11
atgtttttattaaggcatttgacttcagcgtgcgtgtttttggcgtctaaatgtttgccggactcctttgtcttggtcgctcttttatcgtttgtcgtgtttgttcttgtttattgcttgacagggcaagacgctttttctgtcatttctagttgggggaatggcgcttggacgcttttaggtttttctatgcaaatggcccttattttggtgttgggtcaggctctggctaacgctaaattagtccaaaagcttttaaaatatctagcgtctttacctaaagggtattatacggctttatggttggttacttttttatcgttaatcgctaattggatcaactggggttttggcttggtgattagtgcgatttttgcaaaagagatcgccaaaaatgttaagggggtggattacaggctgctcattgctagcgcttattcgggttttgtcatctggcatgggggtttatcaggctctatccctttaagcgttgccacccaaaatgaaaatctatccaaaataagcgctggggtgattgaaaaagctatccctatcagtcagacgattttttcttcttataatttaatcattatagggatcattcttgtagggttaccctttttaatggcaatgatccaccctaaaaaagaagaaatcgttgagattgattcaaagcttttaaaagacgagtacaaagagattgaactcattagccaccaacaagacaaaacgatcgcgcattttttggaaaacagcgctttgctttcttatcttttggtttttttgggttttgggtatcttggtgtttatttttttaaagggggagggattagtttaaacattgtcaatacgattttcctttttttagggattttactgcataaaacccctttagcttatgtgaaagcgatcgatcgttccgctaggagcgtggctgggattttattgcaattccctttttacgctgggattatggggatgatggcaagccatagcgtggggggtcattctttagcgcaaatgctttctttagctttcacgcacatcgctaatgaaaaaactttcgtgctcatgacttttttgagcgcagggattgtcaatatttttattccgtctggcggagggcaatgggcgattcaagctcctatcatgcttccggctgggcaaagcttaggggtggatccgggagtggtttctatggctatcgcttggggagatgcttggacgaatatgatacagcctttttgggctttgcccgctttagccattgcgggtttgggcgctaaagatattatgggctattgcgttttgactttaatttttgtaggcttagtcgtgtgtggggtgttttattttttagtgtga

SEQ ID NO: 2306 - protein, 454 aa, Helicobacter pylori 26695
MFLLRHLTSACVFLASKCLPDSFVLVALLSFVVFVLVYCLTGQDAFSVISSWGNGAWTLLGFSMQMALILVLGQALANAKLVQKLLKYLASLPKGYYTALWLVTFLSLIANWINWGFGLVISAIFAKEIAKNVKGVDYRLLIASAYSGFVIWHGGLSGSIPLSVATQNENLSKISAGVIEKAIPISQTIFSSYNLIIIGIILVGLPFLMAMIHPKKEEIVEIDSKLLKDEYKEIELISHQQDKTIAHFLENSALLSYLLVFLGFGYLGVYFFKGGGISLNIVNTIFLFLGILLHKTPLAYVKAIDRSARSVAGILLQFPFYAGIMGMMASHSVGGHSLAQMLSLAFTHIANEKTFVLMTFLSAGIVNIFIPSGGGQWAIQAPIMLPAGQSLGVDPGVVSMAIAWGDAWTNMIQPFWALPALAIAGLGAKDIMGYCVLTLIFVGLVVCGVFYFLV

SEQ ID NO: 2307 - DNA, 1365 bp, Helicobacter pylori J99
  CDS (1)..(1365): transl_table=11
atgtttttattaaggcatttgacttcagcgtgcgtgtttttagcgtctaaatgtttgccggactcctttgtcttggtcgctcttttatcgtttgtcgtgttcgttcttgtttattgtttgacagggcaagacgcttcgtctgtcatttctagttgggggaatggtgcttggacgcttttaggtttttctatgcaaatggctcttattttggtattgggtcaggctctagctagcgctaaattagtccaaaaacttttaaaatacttggcgtctttgcctaaggggtattacaccgctttatggttggttacttttttatcgttaatcgctaattggatcaactggggttttggcttggtgattagcgcgatttttgcaaaagagatcgccaaaaatgttaagggggtggattataggttgctcattgctagcgcttattcgggttttgtgatctggcatgggggtttatcaggctctatccctttaagcgttgccacccaaaatgaaaatctatccaaaataagcgctggggtgattgaaaaagctatccctatcagtcagacgattttttcttcttataatttgatcattatagggatcattcttatagggttaccctttttaatggcaatgatccaccctaaaaaagaagaaatcgttgaaattgattcaaagcttttaaaagacgaatacaaagaaacagaactcattagccaccaacaagataaaacgatcgcgcattttttggaaaacagcgctttgctttcttatcttttggtttttttgggttttgggtatcttggtatttatttttttaaagggggagggattagtttaaacattgtcaatacgattttcctttttttagggattttgctccataaaacccctttagcttatgtgaaagcgatcaatcattccgctaggagcgtggctgggattttactccaattccctttttacgctgggattatggggatgatggcaagccatagcgtgggggggcattctttagcgcaaatgctctctttagccttcacgcacatcgctaatgaaaaaactttcgcgctcatgacttttttgagcgcggggattgtcaatatttttattccatcaggcggagggcaatgggcgattcaagctcctatcatgctccctgctgggcaaagcttgggggtggatccgggcgtgatttctatggctatcgcttggggagacgcttggacgaacatgatacagcctttttgggctttgcccgcattagccattgcgggtttgggcgctaaggatattatgggctattgcgttttgactttaatttttgtaggcttagtggtgtgcggggtgttttattttttggtgtga

SEQ ID NO: 2308 - protein, 454 aa, Helicobacter pylori J99
MFLLRHLTSACVFLASKCLPDSFVLVALLSFVVFVLVYCLTGQDASSVISSWGNGAWTLLGFSMQMALILVLGQALASAKLVQKLLKYLASLPKGYYTALWLVTFLSLIANWINWGFGLVISAIFAKEIAKNVKGVDYRLLIASAYSGFVIWHGGLSGSIPLSVATQNENLSKISAGVIEKAIPISQTIFSSYNLIIIGIILIGLPFLMAMIHPKKEEIVEIDSKLLKDEYKETELISHQQDKTIAHFLENSALLSYLLVFLGFGYLGIYFFKGGGISLNIVNTIFLFLGILLHKTPLAYVKAINHSARSVAGILLQFPFYAGIMGMMASHSVGGHSLAQMLSLAFTHIANEKTFALMTFLSAGIVNIFIPSGGGQWAIQAPIMLPAGQSLGVDPGVISMAIAWGDAWTNMIQPFWALPALAIAGLGAKDIMGYCVLTLIFVGLVVCGVFYFLV

SEQ ID NO: 2309 - DNA, 1326 bp, Bacillus halodurans C-125
  CDS (1)..(1326): transl_table=11
ttgaagtatatgatttcattgtcaaatcgattgatgcagcgctatttaccggacccttttctctttgttgttcttctcacgtttctcgtatttgctctatccttgatcttcacggagagtacacctcttacaattgttcaatactggggagaaggcttttgggggctgctgtcgttttccatgcagatggttcttgtgcttgtaacaggacatgtgctagcaagcagtcctttgtttaaaaaggggctcggtgcgctagctgggcttccagcttctccagggcaggcgattttattagtaaccgtcgtttctttagtcgctagttttattaattgggggtttggtttagtcataggtgccttgtttgcaaaagagttagcgaaaaaagtagacaacgttgattatcggttgttgatcgcgagcgcctacagtgggtttatgatttggcatggcggattatcaggctccgtgcctttgacgattgctacaccagatcacttcgcccaagatatgattggagtcattccgacaagtgagacgatttttgcgccgtataacttggcgattgtttttgcactatttattgcgattccccttgccaatcgcttaatgatgccgggaaaatcagatacggtgacggtggatcgctccttgttggacgatggacgggatctgcaagcggcttcccttgaattagaggcgatgacaccttcagaccgccttgagaatagtcggatgatctccctgttggttggtgtgctcggacttgtttttttaggttattactttgcaaccaatggatttgagttaaaccttgatatcgtcaactccttgtttctcttcctcgggattttatttcacggcacgccaaaattgtttttgaaagcggtaacaagtgcggtgaaaggggcgagtggcattatcattcaatttcctttttacgcggggttaatggggatcatggtttcctctgggctggctaccgtgatgtccgaagcctttgtgtcgttttcaaacgaagtgaccttcccgctgttcgtttttctcagtgcgggcattgttaatgtgtttgttccttccggtggcggccagtgggcggtgcaagcgcccgttgtgctagaagctgcgcaaagcttaggagttcctgcggctaaggcagcgatggccgttgcgtggggagatgcgtggacgaatatgattcaaccgttttgggcgcttcccgctcttgcgattgctggtttgaaagcgaaagacattatgggcttttgcgtgatgattttagttgtgagcggcgtagtgatatcgctcggatttttgcttatgtaa

SEQ ID NO: 2310 - protein, 441 aa, Bacillus halodurans C-125
MKYMISLSNRLMQRYLPDPFLFVVLLTFLVFALSLIFTESTPLTIVQYWGEGFWGLLSFSMQMVLVLVTGHVLASSPLFKKGLGALAGLPASPGQAILLVTVVSLVASFINWGFGLVIGALFAKELAKKVDNVDYRLLIASAYSGFMIWHGGLSGSVPLTIATPDHFAQDMIGVIPTSETIFAPYNLAIVFALFIAIPLANRLMMPGKSDTVTVDRSLLDDGRDLQAASLELEAMTPSDRLENSRMISLLVGVLGLVFLGYYFATNGFELNLDIVNSLFLFLGILFHGTPKLFLKAVTSAVKGASGIIIQFPFYAGLMGIMVSSGLATVMSEAFVSFSNEVTFPLFVFLSAGIVNVFVPSGGGQWAVQAPVVLEAAQSLGVPAAKAAMAVAWGDAWTNMIQPFWALPALAIAGLKAKDIMGFCVMILVVSGVVISLGFLLM

SEQ ID NO: 2311 - DNA, 1425 bp, Pseudomonas aeruginosa PAO1
  CDS (1)..(1425): transl_table=11
atgaccgctatccttcccatccaagaaagccgctccgcgcgcttcgccatgcgttgctcgaactgggccgagcgctggtttcccgactcctgggtgttcgccgccctggccatcctcatcgtcagcctggccgcgctggccatgggcgccggaccgaccgccacggcgaaagccttcggcgacggtttctggagcctgatcccgttcaccatgcagatggccttcgtggtcatcggcggctatgtggtggccagttcaggccccgcctcgcgtctcatcgacctgctcgcgcgggtgccgaagaatggccgctcggcggtctgctgggtggcgctggtgtcgatgctcgcctcgctgctcaactggggcctcagcctggtcttcggcggcctgctggtacgcgccctggcgcgccgcagcgacctgcgcatggactatcgcgccgccggcgccgcggcctacctcgggctgggcgcggtgtgggcgctgggcctgtcgtcgtcggccgcgcagttgcaggccaacccggccagcctgccaccgtcgatcctggcgatcaccggggtgatcccgttcaccgagaccatcttcctctggcagtccggggtcatgctgctggcgctgatcctggtctcgctggtgatcgcctacatgaccgcgccgagcgccgccagcgcccgcgacgccaaggattgcggggtcgacgtgagcttcaccgctccggccaggctggcgccgacccggcccggcgagtggctggagcacagcccgttgctgatcatcctgctggtactgctggccggcggctggctggtacacgagttctcgaccaagccggcgatcctggcgatctccgggttgaacacctataacctgctgttcctgatgctcggcgcgttgctgcactggcgcccgcgcagcttcctcgacgcggtggcgcgcgcggtgccgaccaccaccggggtgctgatccagttcccgctgtacggctcgatcgcggcgatcatgaccacggtcaacggcagcgacggcgagaccctggcccaccatatctcgaccttcttcgtacagatcgcctcccacgacacctacgcgctgctgatgggcgtgtactcggcggtgctgggcttcttcattccctccggcggcggcaagtggatcatcgaggcgccgtacgtgatgcaggtggccaacgagctgcaataccacctcggctgggcggtgcagatctacaacgccgccgaggcgctgccgaacctgatcaacccgttctacatgctgccgttgctcggcgtgctggggctgaaggcgcgcgacctgatcggcttctcgttcgtccagttgctggtgcacatcccgctggtgctggtgctgctctgggccctgggcagcaccctggcgtacatcccgccggtgatgccgtag

SEQ ID NO: 2312 - protein, 474 aa, Pseudomonas aeruginosa PAO1
MTAILPIQESRSARFAMRCSNWAERWFPDSWVFAALAILIVSLAALAMGAGPTATAKAFGDGFWSLIPFTMQMAFVVIGGYVVASSGPASRLIDLLARVPKNGRSAVCWVALVSMLASLLNWGLSLVFGGLLVRALARRSDLRMDYRAAGAAAYLGLGAVWALGLSSSAAQLQANPASLPPSILAITGVIPFTETIFLWQSGVMLLALILVSLVIAYMTAPSAASARDAKDCGVDVSFTAPARLAPTRPGEWLEHSPLLIILLVLLAGGWLVHEFSTKPAILAISGLNTYNLLFLMLGALLHWRPRSFLDAVARAVPTTTGVLIQFPLYGSIAAIMTTVNGSDGETLAHHISTFFVQIASHDTYALLMGVYSAVLGFFIPSGGGKWIIEAPYVMQVANELQYHLGWAVQIYNAAEALPNLINPFYMLPLLGVLGLKARDLIGFSFVQLLVHIPLVLVLLWALGSTLAYIPPVMP

SEQ ID NO: 2313 - DNA, 1377 bp, Fusobacterium nucleatum subsp. nucleatum ATCC 25586
  CDS (1)..(1377): transl_table=11
atggaaagtgtaaaagaaagaaaaggaatctttaagagatttacttcaatgtgtgtgcgtgttatggaaagatggcttccagatccatttatattttgtgctttgttaacttttatagtgtttataggagctatatttcttacaaaagcaactcctttacaagtagttggattttgggctgatggtttttggtctttactttctttctcaatgcaaatggcattagttttggttacagggcatactttggcaagttccagattatttaaaaagatgttgtcaacatttgcttctggaataaaaggaccaaaacaagcaatacttattgtatcaatagtttcaggaatagcttgtgcattaaactggggttttggacttgttataggagctttatttgcaaaagaaattgcaaaaaaagtgaaaggagtagattatagacttcttatagcttcagcttacacaggattcttagtatggcatggtggattatcaggttctattccattacaacttgcaagtggaggagaaggattagcaaaacaaacagcaggagtagtaacagaagctataccaacaagtcaaactttattttcaccaatgaatatttttataattgttggacttttaataatagtacctttgttgaatatggcaatgttcccaagtaaagatgaaattgttgaagttgatccaaaattattagtggaaccagaagaagttgttatggatacttcaaaaatgacaccagcagaaagagttgaaaatagtagtgcagtatctattttactttcaattatgggctttgtatacataggatattatttaaagacaaaaggatttgcattaaatcttaatttagtaaactttatattcttattcttaggaattttattacatggaactccaagaagatatttgaatgcactagcagaagcaacaaaaggtgcaggaggaatattactacaatttccattttatgcaggtatcatgggaataatggtaggagcagatgcagatggaatgtctcttgcaaaacttatgtctaatttctttgtaagtatatctactgaaaaaacattcccagtattttcatttataagtgctggagtagtaaatttctttgttccatcaggtggaggacaatgggcagttcaagctccaatagtaatgccagcaggacaagcaattggtgtatcagcagcaaagtcagctatggcaatagcttggggagatgcttggacaaatatgatacaaccattctgggctttaccagcattaggaatagcaggtttgggagctaaagatataatgggttattgtctgatagtaactgttgtatcaggaatatttatttgtacaggtttcttattattctaa

SEQ ID NO: 2314 - protein, 458 aa, Fusobacterium nucleatum subsp. nucleatum ATCC 25586
MESVKERKGIFKRFTSMCVRVMERWLPDPFIFCALLTFIVFIGAIFLTKATPLQVVGFWADGFWSLLSFSMQMALVLVTGHTLASSRLFKKMLSTFASGIKGPKQAILIVSIVSGIACALNWGFGLVIGALFAKEIAKKVKGVDYRLLIASAYTGFLVWHGGLSGSIPLQLASGGEGLAKQTAGVVTEAIPTSQTLFSPMNIFIIVGLLIIVPLLNMAMFPSKDEIVEVDPKLLVEPEEVVMDTSKMTPAERVENSSAVSILLSIMGFVYIGYYLKTKGFALNLNLVNFIFLFLGILLHGTPRRYLNALAEATKGAGGILLQFPFYAGIMGIMVGADADGMSLAKLMSNFFVSISTEKTFPVFSFISAGVVNFFVPSGGGQWAVQAPIVMPAGQAIGVSAAKSAMAIAWGDAWTNMIQPFWALPALGIAGLGAKDIMGYCLIVTVVSGIFICTGFLLF

SEQ ID NO: 2315 - DNA, 1407 bp, Streptococcus pyogenes MGAS8232
  CDS (1)..(1407): transl_table=11
atgaataacatcaaaaccaaaaaaaggtttatggatcgctatattgatggctttatgaaatggatgccagaatcgctttttatctgttttattttaacctttttagtcgttactatgtctgtgttgatgacggatagtccctttattggtacggaaaagacgggcgggattatctatggctgggtaaatggtttttgggggctgttgtcctttgccatgcagatgactattttacttgcgacagggaatgctgtagcgagttctccacctgctcataagatgtttaagttccttgccaaactgcctcaaaccaggactcagatttttattttttctattgtagtaggctctatctttggctttttacactggggtcttggtatgatggttgccattgtgtttgggaaagagttgcttgttcaggctaggcaaaaagggattaaggtgcatacacctttgtttgttgctactttattttttacctttttaccagctacttctggtttatcaggtgctgcggtgctttattcggccactccagattatttgcgaaatagtgtcgcagatgcttataaacaggttgttcctgaaagtgttcctctgacagaatcagttttgaatcttccatttatcagtcttttagtggtgtgtatgctggtaccgttttgctttgctttattggcgcatccaaaagatgaaactaaaatcatggaacttgatgatgagatctatcaccatagtcttgataccgcttcacatgttgttattgcaagaaacacacctgctgaaaagatgaacgcatctcgtttagtgatgtatcttgttggtggggccattgttagctatagcctttatcatttttcggtggtgggcttgtctggtctagatctcaatagttttaactttttatttttaggcttagggttgcttctttgtggtcaacaaggaccagaatattatggttccttattcaaagatggggtcatgtcatcttggggcttggtgcttcagtttccattttacgctggtatttttggaatcattcaaagtacaggtctaggactagagatttcccatttctttgtcgctatttcaaatgggacaacatggccggtttttgcttatctttactcggctttgctgaatattgcggtaccatcaggaggctcaaaatttgtgattgaagctccctatatcgtccctgcaactatcgaagttggtaatgacctaggtaagattttgcaggcttatcaattaggagatgccacaacaaacttgatagttcctttttgggccttatcttacctctcaaacttcaaactaaaattcaatcagattgtggcttatactattccttgtgtcttggtggtcacaggtattgccatcatttacctatttgtattttag

SEQ ID NO: 2316 - protein, 468 aa, Streptococcus pyogenes MGAS8232
MNNIKTKKRFMDRYIDGFMKWMPESLFICFILTFLVVTMSVLMTDSPFIGTEKTGGIIYGWVNGFWGLLSFAMQMTILLATGNAVASSPPAHKMFKFLAKLPQTRTQIFIFSIVVGSIFGFLHWGLGMMVAIVFGKELLVQARQKGIKVHTPLFVATLFFTFLPATSGLSGAAVLYSATPDYLRNSVADAYKQVVPESVPLTESVLNLPFISLLVVCMLVPFCFALLAHPKDETKIMELDDEIYHHSLDTASHVVIARNTPAEKMNASRLVMYLVGGAIVSYSLYHFSVVGLSGLDLNSFNFLFLGLGLLLCGQQGPEYYGSLFKDGVMSSWGLVLQFPFYAGIFGIIQSTGLGLEISHFFVAISNGTTWPVFAYLYSALLNIAVPSGGSKFVIEAPYIVPATIEVGNDLGKILQAYQLGDATTNLIVPFWALSYLSNFKLKFNQIVAYTIPCVLVVTGIAIIYLFVF

SEQ ID NO: 2317 - DNA, 1326 bp, Oceanobacillus iheyensis HTE831
  CDS (1)..(1326): transl_table=11
ttgaaaacggtaacttctttttttgacagaatggttcaacggtatctgccagatgcttttttattcgccatcatcttaaccattatcgtattttttattgggttgttatttcctgataacggaccacttgaaatggttcaattttggggtaatggattttggggattattagaatttgcaatgcagatgtcacttgtcgtaattactggatacatcctagcaagcaccaatgtggtcaaaagatttttatctaggctgagtaaactagcaaacacacctgctcaagcaattattttagttacttttattgcattaatcgcatgttttatcaattatggttttggactcgtagtaggggctttatttgccactcatgttgcaaaacaagttccttccgttgattatcggttattaatcgccagcgcttatagtggttttctaatttggcatggtggattttccggatctgtaccattaactatcgctacagctggtcattttctggaaggacaagtaggtatcattcctattacagaaacattatttagtccttataatttgtttattgttatcactttattagtggcactaccattatttaatcgctaccttttaaatggaattgcagataataatacttactttgcagaaaaaattcaacaaacagagcaaaaaccaaatgttgatgctaatagtataccaacaacacctgctgaaaaattagaaaatagcccaatcgtctcgatgataattggaattttaggcttaagttttatcgtgtattattttgtaactaacggatttaatttaaatattaatattgttaattttatatttttgtttctgggaataattttacaccggacaccgagacaatttcttgataatgtcagtcaaggagttaaaaatgctggcgcgatcattatccaatttccattttatgccggaattatgggaatgatggttgattcaggtatttcagaggcattgtctttgtggtttgtaaatatttctactgagtatacactcccatttctatcttttattagtgcgggtatcgtaaatttcttcattccatctggtggtggtcagtgggcaatacagggtccaattatgattgaatctgcacttgaattaggggcagacacagctaaaacagccatggggattgcatggggagatgcatggacaaatatgattcagcctttttgggcacttccagcacttgctattgcaggcttaaaagtgagagatattatgggattctgtgtcatgattttaatatttagctttatccccatatcaattggactgttattcttttaa

SEQ ID NO: 2318 - protein, 441 aa, Oceanobacillus iheyensis HTE831
MKTVTSFFDRMVQRYLPDAFLFAIILTIIVFFIGLLFPDNGPLEMVQFWGNGFWGLLEFAMQMSLVVITGYILASTNVVKRFLSRLSKLANTPAQAIILVTFIALIACFINYGFGLVVGALFATHVAKQVPSVDYRLLIASAYSGFLIWHGGFSGSVPLTIATAGHFLEGQVGIIPITETLFSPYNLFIVITLLVALPLFNRYLLNGIADNNTYFAEKIQQTEQKPNVDANSIPTTPAEKLENSPIVSMIIGILGLSFIVYYFVTNGFNLNINIVNFIFLFLGIILHRTPRQFLDNVSQGVKNAGAIIIQFPFYAGIMGMMVDSGISEALSLWFVNISTEYTLPFLSFISAGIVNFFIPSGGGQWAIQGPIMIESALELGADTAKTAMGIAWGDAWTNMIQPFWALPALAIAGLKVRDIMGFCVMILIFSFIPISIGLLFF

SEQ ID NO: 2319 - DNA, 1332 bp, Shewanella oneidensis MR-1
  CDS (1)..(1332): transl_table=11
atgttaaccaaagcagcaaaacctctggtcaagctggtcgaccgttatttacccgatccctatatctttgtcttactcctcacgttagtcgtgatgatctcggccgtggtggccgagcaaaaaacacccctggacgtcatcagctactggggcgatggtttttgggcactgctgagtttttcaatgcagatgctattagtgctggtggcgggatttatgctcgccagctcgccaccgattaaaaaattgcttgatgcgattgctggattcgctaagtctgcgccgcaggcgattatcttagtgacgttggtttctctggctgccagttggattaactggggctttggtttggtggtcggcgcgttatttgccaaagcgttagcccgcaagttacgagtggactaccgtttgttggttgccagtgcgtactcgggttttgtggtttggcacggtggcttggcgggttcgattccgttaaccattgccactgctgggcactttgcagaagcacagattggcattattcctaccagtgataccatttttgccagttttaacttgctgttagtgttgattttatttgtggtgatgccgctggtaaaccgctttatgttgccagaagacaaagacagcatctatatcgaccctaaggcgcttgaagatgtgagcagtgaagagagcaacacagggcatgcgccaaacgcgatgatgcgtcccgcggataaattagaaaacagccgtttactgggctggagtgtaggcggcgcagggctggtgtacttaggttattattttgcggtgcaaggcggcagcttaaaccttaatttagttaactttttgtttttgttcctcgcgattgtgctgcatcaaacgccacgcagtttactgcttagccttaacgaagcgattaaaggcggcgcgggtattgtgattcagtttcctttctacgctggcattatggcggtgatgatgcaatcgggattagcccaaagcatctccgaaggattcgtggccattgccagcgctgaaagcctgccattttggagttttatcagcgcaggcatcgtgaatatttttgtgccttcgggcggcggacaatgggcggtgcaggccccgattatgttgcctgctgccgaagccttgggcgccgatgtggcacgtgttgccatggctgtagcatggggtgatgcgtggacgaatcttattcagcctttctgggcactgcctgtgctggccattgccggattaaaggcgcgggatattatgggattttgtttaatgcagttgattatcacaggtgtgattatcagtatcgcgttgagctggttttaa

SEQ ID NO: 2320 - protein, 443 aa, Shewanella oneidensis MR-1
MLTKAAKPLVKLVDRYLPDPYIFVLLLTLVVMISAVVAEQKTPLDVISYWGDGFWALLSFSMQMLLVLVAGFMLASSPPIKKLLDAIAGFAKSAPQAIILVTLVSLAASWINWGFGLVVGALFAKALARKLRVDYRLLVASAYSGFVVWHGGLAGSIPLTIATAGHFAEAQIGIIPTSDTIFASFNLLLVLILFVVMPLVNRFMLPEDKDSIYIDPKALEDVSSEESNTGHAPNAMMRPADKLENSRLLGWSVGGAGLVYLGYYFAVQGGSLNLNLVNFLFLFLAIVLHQTPRSLLLSLNEAIKGGAGIVIQFPFYAGIMAVMMQSGLAQSISEGFVAIASAESLPFWSFISAGIVNIFVPSGGGQWAVQAPIMLPAAEALGADVARVAMAVAWGDAWTNLIQPFWALPVLAIAGLKARDIMGFCLMQLIITGVIISIALSWF

SEQ ID NO: 2321 - DNA, 1419 bp, Pseudomonas putida KT2440
  CDS (1)..(1419): transl_table=11
gtggccgctgaaattcaagacagccgctccgcgcgctttgccttgcgctgctccaactgggctgaacgctggttccccgactcctgggtgttcgccgcgctggcggtgctgctggtgtgtatcggcgcactggccatgggcgccaaaccgaccgacaccgccaaggcgtttggcgacggcttctggagcctgataccgttcaccatgcagatggcattcgtggtcatcggcggttatgtggtggccagctcgccgcccgccgcgaggctgatcgatcgtttggcgcgcatccccggcaatgggcgctcggcagtgtgctgggtagcactgatctcgatgctggcctccttgctcaactgggggctgtcgctggtgtttggaggtttgctggtgcgcgccctggcaaggcgcaccgacctgaagatggattaccgcgcagcgggtgcggccgcttacctgggcctgggtgcggtgtgggcgttgggcctgtcatcctcggcggcgcagctgcaggccaacccggccagcctgccaccttcaatcctgtcgataaccggggtgatcccctttaccgaaaccatctttctctggcagtccggcgtgatgctggcggcgctggtggtggtctcgctggtgatcgcctacgccaccgctccgggcccgaacagcgcccgtagcgcagaagactgcggtgtcgaccccagcttcacagcgccacccgcgccgcaacgcacgcgcccgggagagtggctggaacacagcccgatccttatcctgctgttggtggccttggctgctggctggctgtatcaggagtttgcgacgaaacctgcgattaccgccatctcggggctcaacacctacaacctgttgttcatcatgctcggtgctttgctgcactggcgcccacgcagcttccttgacgcggtggcgcgtgcggtaccgaccaccaccggtgtgctgatccagttcccgctgtatggttcgatcgccgccatcctcacccaggtgaagggcgtcgatgaacagaccctggcccaccatatttcactgttcttcacccagattgccacccatgacacgtatgccgtgctgatgggcgtgtattcggctgtgctgggcttcttcatcccttcgggcggcggcaagtggatcatcgaggccccttacgtgatgctggtggccaacgacctgcagtaccacctggggtgggccgtgcagatctacaacgcggccgaagccttgccgaacctgatcaacccgttctacatgctgccgttgctgggcgtgctggggctcaaggcgcgcgacctgatcggtttctcgttcgtgcaattgctggtgcatgtgccgttggtgctggtgttgctgtgggcgctgggtacaacgctgcagtacgtgccgccagtgatgccttga

SEQ ID NO: 2322 - protein, 472 aa, Pseudomonas putida KT2440
MAAEIQDSRSARFALRCSNWAERWFPDSWVFAALAVLLVCIGALAMGAKPTDTAKAFGDGFWSLIPFTMQMAFVVIGGYVVASSPPAARLIDRLARIPGNGRSAVCWVALISMLASLLNWGLSLVFGGLLVRALARRTDLKMDYRAAGAAAYLGLGAVWALGLSSSAAQLQANPASLPPSILSITGVIPFTETIFLWQSGVMLAALVVVSLVIAYATAPGPNSARSAEDCGVDPSFTAPPAPQRTRPGEWLEHSPILILLLVALAAGWLYQEFATKPAITAISGLNTYNLLFIMLGALLHWRPRSFLDAVARAVPTTTGVLIQFPLYGSIAAILTQVKGVDEQTLAHHISLFFTQIATHDTYAVLMGVYSAVLGFFIPSGGGKWIIEAPYVMLVANDLQYHLGWAVQIYNAAEALPNLINPFYMLPLLGVLGLKARDLIGFSFVQLLVHVPLVLVLLWALGTTLQYVPPVMP

SEQ ID NO: 2323 - DNA, 1419 bp, Pseudomonas syringae pv. tomato str. DC3000
  CDS (1)..(1419): transl_table=11
atggccgccaacatcgaagaaagccgctccgcccgatttgccttgcggtgtgccgcctgggctgagcgctggtttccggattcgtgggtattcgccgcactagcggtggtcatcgtcacgctggcgacgctcgccatcggtgcgcgtccgaccgacgccgccaaggccttcggagacggtttctggagcctgattccgttcaccatgcagatggccttcgtggtcatcggtggttacgtggtcgccagctcaccgcccgcagtacgcctgatcgaccgtctggcacgggtgccgcgcaacggccgctcggcggtggcctgggtggcgctgatttccatgctggcctcgctgctcaactgggggctgtcactggtgttcggcggtttgctggtgcgtgcgctcgcccgccgcaccgacctgcgtatggactaccgcgcagccggtgccgccgcctatctggggcttggcgcggtatgggcgctggggctgtcatcgtccgctgcacagttgcaggccaacccggccagcctgccgccatcgattctggcgatcaccggtgtaattccgttcactgaaaccatctttctctggcagtccggagtcatgctcgcagcgctgctcgtcatctcgctgatcgtcgcctatgccacggcgcccggccccaacagcgcccgcgacgccaaggcctgcggcatcgacccggcgttcaatctgccgccgctgcccgccagaacccggccaggcgaatggctggaatacagcccgctgctgattatcctgatggttgtgctgggggttggctggctgttcaacgagttttccaacaagcctgcaatcactgcgatatcggggctcaatacctacaactttctgttcatcatgctcggtgcgctattgcactggcggccgcgcagttttctcgatgccgtggcgcgggccgtgccgaccaccaccggcgtgctgattcagtttccgctgtacggctcgatcgccgccttgctgacaacggtcaagggcgctgatgcccagaccctggcgcattacatttcgacgttcttcaccagcattgcttcccacgacacctacgcgattctgatgggcgtctattcggcgattctggggttcttcattccctcgggtggcggcaagtggatcatcgaagccccttacgtgatgcaggtggccaatgatctgcagtatcacctcggctgggcagtgcagatctacaacgcagccgaagccttgcccaacctgatcaacccgttctacatgctgccgctactgggcgtgctgggcctgaaggcgcgggacctgatcggcttttcgttcgtgcagttgcttgtccatgcgccgctggtgctgtttctgctttgggcgctgggcaccaccctgacgtatacgccgccgatcatgccctga

SEQ ID NO: 2324 - protein, 472 aa, Pseudomonas syringae pv. tomato str. DC3000
MAANIEESRSARFALRCAAWAERWFPDSWVFAALAVVIVTLATLAIGARPTDAAKAFGDGFWSLIPFTMQMAFVVIGGYVVASSPPAVRLIDRLARVPRNGRSAVAWVALISMLASLLNWGLSLVFGGLLVRALARRTDLRMDYRAAGAAAYLGLGAVWALGLSSSAAQLQANPASLPPSILAITGVIPFTETIFLWQSGVMLAALLVISLIVAYATAPGPNSARDAKACGIDPAFNLPPLPARTRPGEWLEYSPLLIILMVVLGVGWLFNEFSNKPAITAISGLNTYNFLFIMLGALLHWRPRSFLDAVARAVPTTTGVLIQFPLYGSIAALLTTVKGADAQTLAHYISTFFTSIASHDTYAILMGVYSAILGFFIPSGGGKWIIEAPYVMQVANDLQYHLGWAVQIYNAAEALPNLINPFYMLPLLGVLGLKARDLIGFSFVQLLVHAPLVLFLLWALGTTLTYTPPIMP

SEQ ID NO: 2325 - DNA, 1407 bp, Streptococcus pyogenes SSI-1
  CDS (1)..(1407): transl_table=11
atgaataacatcaaaaccaaaaaaaggtttatggatcgctatattgatggctttatgaaatggatgccagaatcgctttttatctgttttattttaacctttttagtcgttactatgtctgtgttgatgacggatagtccctttattggtacggaaaagacgggcgggattatctatggctgggtaaatggtttttgggggctgttgtcctttgccatgcagatgactattttacttgcgacagggaatgctgtagcgagttctccacctgctcataaaatgtttaagtcccttgccaaactgcctcaaacaaggactcagatttttattttttctattgtagtaggctctatctttggctttttacactggggtcttggtatgatggttgccattgtgtttgggaaagagttgcttgttcaggctaggcaaaaagggattaaggtgcatacacctttgtttgttgctactttattttttacctttttaccagctacttctggtttatctggtgctgcggtgctttattcggctactccagattatttgcgaaatagtgtcgcagatgcttataaacaggttgttcctgaaagtgttcctctgacagaatcagttttgaatcttccatttatcagtcttttagtggtgtgtatgctggtaccgctttgctttgctttattggcgcacccaaaagatgaaactaaaatcatggaacttgatgatgagatctatcaccatagtcttgataccgcttcacatgttgttattgcaagaaacacacctgctgaaaagatgaacgcatctcgcttagtgatgtatcttgttggtggggccattgttagctatagcctttatcatttttcggtggtgggcttgtctggtctagatctcaatagttttaactttttatttttaggcttagggttgcttctttgtggtcaacaaggaccagaatattatggttccttattcaaagatggggtcatgtcatcttggggcttggtgcttcagtttccattttacgctggtatttttggaatcattcaaagtacaggtctaggactagagatttcccatttctttgtcgctatttcaaatgggacaacatggccggtctttgcttatctttactcggctttgctgaatattgcggtaccatcaggaggctcaaaatttgtgattgaagctccctatatcgtccctgcaactatcgaagttggtaatgacttaggtaagattttgcaggcttatcaattaggagatgccacaacaaacttgatagttcctttttgggccttatcttacctctcaaacttcaaactaaaattcaatcaaattgtggcttatactattccttgtgtcttggtggtcacaggtattgccatcatttacctatttgtattttag

SEQ ID NO: 2326 - protein, 468 aa, Streptococcus pyogenes SSI-1
MNNIKTKKRFMDRYIDGFMKWMPESLFICFILTFLVVTMSVLMTDSPFIGTEKTGGIIYGWVNGFWGLLSFAMQMTILLATGNAVASSPPAHKMFKSLAKLPQTRTQIFIFSIVVGSIFGFLHWGLGMMVAIVFGKELLVQARQKGIKVHTPLFVATLFFTFLPATSGLSGAAVLYSATPDYLRNSVADAYKQVVPESVPLTESVLNLPFISLLVVCMLVPLCFALLAHPKDETKIMELDDEIYHHSLDTASHVVIARNTPAEKMNASRLVMYLVGGAIVSYSLYHFSVVGLSGLDLNSFNFLFLGLGLLLCGQQGPEYYGSLFKDGVMSSWGLVLQFPFYAGIFGIIQSTGLGLEISHFFVAISNGTTWPVFAYLYSALLNIAVPSGGSKFVIEAPYIVPATIEVGNDLGKILQAYQLGDATTNLIVPFWALSYLSNFKLKFNQIVAYTIPCVLVVTGIAIIYLFVF

SEQ ID NO: 2327 - DNA, 1350 bp, Bordetella pertussis Tohama I
  CDS (1)..(1350): transl_table=11
atgaataaactcacgtcctttttcacggagctgatgcgcaagtatctgcccgatccattcgttttcgcgatcgcgctgaccctgttgaccgtgctgatggctttcggcatcgaaggccagccgctggaccagatcacccgtgaatggggcaagggattctggagcctgctggccttcaccacccagatggccgtcatcctggccatgggctatgtgctggccaccgcgccgctgaccgaccgcctgctcgaccgcatcgtcagccacgtgcaccagccgcgcaccgccatcattgtcgcgaccctggtcggcggcgtcggcagctacctgaactgggggttcggcctggtgatcggcggcgtggtcgccaagaaactggcgctgaaggtcaagggcgtgcactacccgctgatcatcgccgccgcctacagcggcttcacgatgtacggcctgggcctgtcggccagcatcccggtgctggtcaccacgcccggccatccgacggccgaccagatgggcgtgattccgctgtcggaaaccattttctcgctgcccatgctgatcaccagcctggtgatcatcgtcaccttgccgctgctcaacgcctggctgcaccccaagcagggcgaacaggtcgtcgaagtggacccggccatcgaccagagcagcgcgccggccaagaccgccgacgagctgaccgccgaggatacgctggccagccgcctgaacaacagccgcatcctcagcctgctgatcggcctgctgggcatcgcctatgtggtgttctacttcatggacggcaagtcgctggacctgaacctgatcaacttcatcatcctgttcctgggcatcatcctgctgggcacccccgcggcctatgtggccaagctgaacgaaggcatcaagaccatctccggcatcatcctgcagtaccccttctatgcgggcatcatggccatcatggccatcatggccggctccgggctggtggccaccatttccaaggtgttcgtcgacgtcgcctcgccgggcagcctgccgttctggggcctgatcagctcgttcgtcatcaacttcttcgcgccctcggccggcggccactgggtgatccagggcccgttcatgatcgacgccgccaaggagatcggcagcgcgctcaaccagaccaccatggccgtgatgctgggcaacgcctggaacgacctggtgcagccgttctggatcctgcccgccctggcgctgtcgaagctgaaactgcgcgacgtgatgggctataccgtcatcatgatgctgtgggtcggcgtcatccacattgccgcggtgcttgcctggggttacctgacccactga

SEQ ID NO: 2328 - protein, 449 aa, Bordetella pertussis Tohama I
MNKLTSFFTELMRKYLPDPFVFAIALTLLTVLMAFGIEGQPLDQITREWGKGFWSLLAFTTQMAVILAMGYVLATAPLTDRLLDRIVSHVHQPRTAIIVATLVGGVGSYLNWGFGLVIGGVVAKKLALKVKGVHYPLIIAAAYSGFTMYGLGLSASIPVLVTTPGHPTADQMGVIPLSETIFSLPMLITSLVIIVTLPLLNAWLHPKQGEQVVEVDPAIDQSSAPAKTADELTAEDTLASRLNNSRILSLLIGLLGIAYVVFYFMDGKSLDLNLINFIILFLGIILLGTPAAYVAKLNEGIKTISGIILQYPFYAGIMAIMAIMAGSGLVATISKVFVDVASPGSLPFWGLISSFVINFFAPSAGGHWVIQGPFMIDAAKEIGSALNQTTMAVMLGNAWNDLVQPFWILPALALSKLKLRDVMGYTVIMMLWVGVIHIAAVLAWGYLTH

SEQ ID NO: 2329 - DNA, 1464 bp, Bordetella pertussis Tohama I
  CDS (1)..(1464): transl_table=11
atgcccaacaatcatctagccgccgctgcccccgcacagggcaggcaggccatagccagtcccatggaacgcttctcccaggccatggtcgcctgggcggagaaatggtttcccgatgcctacgtcttcgtggtcgtggcgtgcgcggtggtcgcgctcggcgccgtcctgcacggcggcgacccgctggccgtcagcaaggccttcggcgaaggcttctggagcatcatccccttcacgatgcagatggccatggtggccattaccggctacgtgctggccttgtccccgcccgtggcgcggctgctgcgggcgctggcgcacgtgccctcgaccccgcgcggcgccgtggtgttcatcggcaccctgagcatcctgctgtcgctggtcaactggggcctgagcctgattttctcgggcttgctggtgcgcgaaatggcccgtcgcaccgacctgcgtctggattaccgggcagccggcgccgccgggtacctggggctgggctgcgggttcacgctgggcatgagctcgtcggccgcgcagctgcaggccacgccggccagcattccggcgtcgctgatgcccatcaccggcgtgatcggcttctccgaaaccatactgacctggcagaacctggtggtggtgatcctggttaccgtggtttcgggactggtgtgctacttcacggcgcccagcccggagcgctccttgaccgcccaggaccttggcgtggacctgacggaacccgaggcgcaggcggcgcaacgccagcgccccggcgattacctggagttcagcccctggctgaccgtggccgttgtcgggctggcgtcgggatggctgtacctcaccttccgcagcggcaaccccttcatcacgatgtcgcagctgaacacctacaacttcgtgttcctgttgctgggcctgctgctgcactggcggccgcgcagcttcctggagagtttcggccgcgccatgcccagcatcggcggcgtgatgctgcagttcccgttctacggcggcatcggctacgtgctcaccaaggtcgccaacgtgcaggggcatacgttgtcggatgcgatcgcgcactggttcgtcagcctggcgcacgacagcagcgtgttctcgatactggtcagcatctattcggcgttcctcggcttcttcatcccgtcggccggcggcaagtgggtgatcgaggcgccgtacatcatggacgcggccaaccagatccaggcccacctgggctggaccgtcatggtctacaacatcgccgaaacgctgcccaacttcatcaacccgttctggatgctgccgctgctggggatactgcgcctcaaatccaaggacctggtcggctataccgccatgcagttcctggtgcacttccccatcgtcgtggccgccggcgcgatcctgatgcacaccttcagctatgttccgcccgtcatcccgggacagtga

SEQ ID NO: 2330 - protein, 487 aa, Bordetella pertussis Tohama I
MPNNHLAAAAPAQGRQAIASPMERFSQAMVAWAEKWFPDAYVFVVVACAVVALGAVLHGGDPLAVSKAFGEGFWSIIPFTMQMAMVAITGYVLALSPPVARLLRALAHVPSTPRGAVVFIGTLSILLSLVNWGLSLIFSGLLVREMARRTDLRLDYRAAGAAGYLGLGCGFTLGMSSSAAQLQATPASIPASLMPITGVIGFSETILTWQNLVVVILVTVVSGLVCYFTAPSPERSLTAQDLGVDLTEPEAQAAQRQRPGDYLEFSPWLTVAVVGLASGWLYLTFRSGNPFITMSQLNTYNFVFLLLGLLLHWRPRSFLESFGRAMPSIGGVMLQFPFYGGIGYVLTKVANVQGHTLSDAIAHWFVSLAHDSSVFSILVSIYSAFLGFFIPSAGGKWVIEAPYIMDAANQIQAHLGWTVMVYNIAETLPNFINPFWMLPLLGILRLKSKDLVGYTAMQFLVHFPIVVAAGAILMHTFSYVPPVIPGQ

SEQ ID NO: 2331 - DNA, 1434 bp, Bordetella parapertussis 12822
  CDS (1)..(1434): transl_table=11
ttgccgcccgtcttccggggcctgtccccgcggggacaggccccccacaccacgcaaacgcaacgccttaccaagaaatatgtaggaagcaccatgaataaactcacgtcctttttcacggagctgatgcgcaagtatctgcccgatccattcgttttcgcgatcgcgctgaccctgttgaccgtgctgatggctttcggcatcgaaggccagccgctggaccagatcacccgtgaatggggcaagggattctggagcctgctggccttcaccacccagatggccgtcatcctggccatgggctatgtgctggccaccgcgccgctgaccgaccgcctgctcgaccgcatcgtcagccacgtgcaccagccgcgcaacgccatcattgtcgcgaccctggtcggcggcgtcggcagctacctgaactggggtttcggcctggtgatcggcggcgtggtcgccaagaaactggcgctgaaggtcaagggcgtgcactacccgctgatcatcgccgccgcctacagcggcttcacgatgtacggcctgggcctgtcggccagcatcccggtgctggtcgccacgcccggccatccgacggccgaccagatgggcgtgattccgctgtcggaaaccattttctcgctgcccatgctgatcaccagcctggtgatcatcgtcaccctgccgctgctcaacgcctggctgcaccccaagcagggcgaaaaggtcgtcgaagtggacccggccatcgaccagggcagcgcgccggccaaggccgccgacgagctgaccgccgaggatacgctggccagccgcctgaacaacagccgcatcctcagcctgctgatcggcctgctgggcatcgcctatgtggtgttctatttcatggacggcaagtcgctggacctgaacctgatcaacttcatcatcctgttcctgggcatcatcctgctgggcacccccgcggcctatgtggccaagctgaacgaaggcatcaagaccatctccggcatcatcctgcagtaccccttctatgcgggcatcatggccatcatggccggctccgggctggtggccaccatttccaaggtcttcgtcgacgtcgcctcgccgggcagcctgccgttctggggcctgatcagctcgttcgtcatcaacttcttcgcgccctcggccggcggccactgggtgatccagggcccgttcatgatcgacgccgccaaggaaatcggcagcgcgctcaaccagaccaccatggccgtgatgctgggcaacgcctggaacgacctggtgcagccgttctggatcctgcccgccctggcgctgtcgaagctgaaactgcgcgacgtgatgggctataccgtcatcatgatgctgtgggtcggcgtcatccacattgccgcggtgcttgcctggggttacctgacccactga

SEQ ID NO: 2332 - protein, 477 aa, Bordetella parapertussis 12822
MPPVFRGLSPRGQAPHTTQTQRLTKKYVGSTMNKLTSFFTELMRKYLPDPFVFAIALTLLTVLMAFGIEGQPLDQITREWGKGFWSLLAFTTQMAVILAMGYVLATAPLTDRLLDRIVSHVHQPRNAIIVATLVGGVGSYLNWGFGLVIGGVVAKKLALKVKGVHYPLIIAAAYSGFTMYGLGLSASIPVLVATPGHPTADQMGVIPLSETIFSLPMLITSLVIIVTLPLLNAWLHPKQGEKVVEVDPAIDQGSAPAKAADELTAEDTLASRLNNSRILSLLIGLLGIAYVVFYFMDGKSLDLNLINFIILFLGIILLGTPAAYVAKLNEGIKTISGIILQYPFYAGIMAIMAGSGLVATISKVFVDVASPGSLPFWGLISSFVINFFAPSAGGHWVIQGPFMIDAAKEIGSALNQTTMAVMLGNAWNDLVQPFWILPALALSKLKLRDVMGYTVIMMLWVGVIHIAAVLAWGYLTH

SEQ ID NO: 2333 - DNA, 1464 bp, Bordetella parapertussis 12822
  CDS (1)..(1464): transl_table=11
atgcccaacaatcatctaaccgccgctgcccccgcacagggcagagaggccatagccagtcccatggaacgcttctcccaggccatggtcgcctgggcggagaaatggtttcccgatgcctacgtcttcgtggtcgtggcgtgcgcggtggtcgcgcttggcgccatcctgcacggcggcgatccgcttgccgtcagcaaggcgttcggcgaaggcttctggagcatcatccccttgaccatgcagatggccatggtggccatcaccggctacgtgctggccttgtcgccgcccgtggcgcggctgctgcgggcgctggcgcgcgtgccctcgaccccgcgcggcgccgtggtgttcatcggcaccctgagcatcctgctgtcgctggtcaactggggcctgagcctgattttctcgggcctgctggtgcgcgaaatggcccgtcgcaacgatctgcgcctggactaccgcgcggccggcgcggccgggtacctggggctgggctgcgggttcacgctgggcatgagctcgtcggccgcgcagctgcaggccacgccggccagcattccggcctcgctgatgcccatcaccggcgtgatcggcttctccgaaaccatactgacctggcagaacctggtggtagtgatcctggttaccgtggtttcgggactggtgtgctacttcacggcgcccagcccggagcgctccttgaccgcccaggacctgggcgtggacctgaccgaacccgaggcgcaggcggcgcaacgccagcgccccggcgattacctggagttcagcccctggctgaccgtggccgtggtcgggctggcctcggggtggctgtatctcaccttccgcagcggcaacccgttcatcaccatgtcgcagctgaacacctacaacttcgtgttcctgctgctgggcctgctgctgcactggcggccgcgcagcttcctggagagtttcggccgcgccatgcccagcatcggcggcgtgatgctgcagtttccgttctacggcggcatcggctacgtgctgaccaaggtcgccaacgtgcaggggcataccctgtcggacgcgatcgcgcactggttcgtcagcctggcgcacgacagcagcgtgttctcgatactggtcagcatctattcggcattcctcggcttcttcattccgtcggccggcggcaagtgggtgatcgaggcgccgtacatcatggacgcggccaaccagatccaggcccacctgggctggaccgtcatggtctacaacatcgccgaaacgctgcccaacttcatcaacccgttctggatgctgccgctgctggggatactgcgcctcaaatccaaggacctggtcggctataccgccatgcagttcctggtgcacttccccatcgtcgtggccgccggcgcgatcctgatgcacaccttcagctatgtcccgcccgtcatcccgggacagtga

SEQ ID NO: 2334 - protein, 487 aa, Bordetella parapertussis 12822
MPNNHLTAAAPAQGREAIASPMERFSQAMVAWAEKWFPDAYVFVVVACAVVALGAILHGGDPLAVSKAFGEGFWSIIPLTMQMAMVAITGYVLALSPPVARLLRALARVPSTPRGAVVFIGTLSILLSLVNWGLSLIFSGLLVREMARRNDLRLDYRAAGAAGYLGLGCGFTLGMSSSAAQLQATPASIPASLMPITGVIGFSETILTWQNLVVVILVTVVSGLVCYFTAPSPERSLTAQDLGVDLTEPEAQAAQRQRPGDYLEFSPWLTVAVVGLASGWLYLTFRSGNPFITMSQLNTYNFVFLLLGLLLHWRPRSFLESFGRAMPSIGGVMLQFPFYGGIGYVLTKVANVQGHTLSDAIAHWFVSLAHDSSVFSILVSIYSAFLGFFIPSAGGKWVIEAPYIMDAANQIQAHLGWTVMVYNIAETLPNFINPFWMLPLLGILRLKSKDLVGYTAMQFLVHFPIVVAAGAILMHTFSYVPPVIPGQ

SEQ ID NO: 2335 - DNA, 1446 bp, Bordetella parapertussis 12822
  CDS (1)..(1446): transl_table=11
gtgctgtctgtgcgcatccccgggcctgcgcgccaggcctgggctatcgtcgaacaacgaccatggcttgcgcgccgcccgttcattatccatggacctccgtggcgcctggccagccaacaggaggatgatgtgttcaaactgatgtctcgttcagccgtgaaaatggttgagcgctatttgcccgacccttacgtattcgtggtgctgctgacgctggtcgccgccggcgcggccatgatcatcgagggccagacccccatggccgtcgtgcgctggtggggcaacggcttctgggggctgctgactttcgcgatgcagatgctgctggtgctggtcaccggctacatgctggccagcacgccgctggtcaagcggatgctggcgcggctggccagcctggccaccagcgccggcggggcgatcatcctggtcagcgtggtgtcgctggccgccagctggatcaactggggcttcgggctggtggtgggcgcgctgttcgccaagcagatcgcccgccaggtgcgggtcgattaccggctgctggtggccagcgcctattccggcttcatcatctggcacggcggtctggccggctcgattccgctgaccatcgcgaccgaggggcatttctccgccgacaagatcggcatcattcccaccggcgatacgattttcgcggtattcaacctggtgatcgtggtggcgatgttcatcctcgtgccgctggtcaaccggctgatgctgcccgacgagaaggaaagcgtctatgtcgatccggcgcgcctggaagaggcctcggtgccggcctcggacgacgacaagcgtccggccgcgcgcctggagaacagcaggctgctggcctggctgatcgccgcgggcgggctggcctacatgttcgactactacgtcgtgcgcggcgccggcttgaacctcaatgtcatcaacttcagcttcctgatcctggccatcctgctgcacggcacgccgcgccgcctgctgaccagcctggacgaagccatcaagggaggcgcgggcatcgtgatccagttcccgttctatgcgggaatcatggccatcatgatggactcggggctggccgccaccttgtccgagtggttcgtgtcgatcgcctcggccgccacgctgccgttctggaccttcatcagcgccggcatcgtgaacatcttcattccgtcgggcggcgggcaatgggcggtgcaaagccccatcgtgatcagcgcggcgcaggcgctcggcgcggatatgccgagggtggcgatggccgttgcctggggcgacgcctggaccaacatgctccagccgttctgggccttgccggtgctggcgattgccggcctgaaggccaaggacatcatgggctattgcatcatccagctgctggtgaccggcgtcatcatttcggtgggactgagcttcttctag

SEQ ID NO: 2336 - protein, 481 aa, Bordetella parapertussis 12822
MLSVRIPGPARQAWAIVEQRPWLARRPFIIHGPPWRLASQQEDDVFKLMSRSAVKMVERYLPDPYVFVVLLTLVAAGAAMIIEGQTPMAVVRWWGNGFWGLLTFAMQMLLVLVTGYMLASTPLVKRMLARLASLATSAGGAIILVSVVSLAASWINWGFGLVVGALFAKQIARQVRVDYRLLVASAYSGFIIWHGGLAGSIPLTIATEGHFSADKIGIIPTGDTIFAVFNLVIVVAMFILVPLVNRLMLPDEKESVYVDPARLEEASVPASDDDKRPAARLENSRLLAWLIAAGGLAYMFDYYVVRGAGLNLNVINFSFLILAILLHGTPRRLLTSLDEAIKGGAGIVIQFPFYAGIMAIMMDSGLAATLSEWFVSIASAATLPFWTFISAGIVNIFIPSGGGQWAVQSPIVISAAQALGADMPRVAMAVAWGDAWTNMLQPFWALPVLAIAGLKAKDIMGYCIIQLLVTGVIISVGLSFF

SEQ ID NO: 2337 - DNA, 1464 bp, Bordetella bronchiseptica RB50
  CDS (1)..(1464): transl_table=11
atgcccaacaatcatctaaccgccgctgcccccgcacagggcagagaggccatagccagtcccatggaacgcttctcccaggccatggtcgcctgggcggagaaatggtttcccgatgcctacgtcttcgtggtcgtggcgtgcgcggtggtcgcgcttggcgccatcctgcacggcggcgatccgcttgccgtcagcaaggcgttcggcgaaggcttctggagcatcatccccttcaccatgcagatggccatggtggccatcaccggctacgtgctggccttgtcgccgcccgtggcgcggctgctgcgggcgctggcgcgcgtgccctcgaccccgcgcggcgccgtggtgttcatcggcaccctgagcatcctgctgtcgctggtcaactggggcctgagcctgattttctcgggcctgctggtgcgcgaaatggcccgtcgcaacgatctgcgcctggactaccgcgcggccggcgcggccgggtacctggggctgggctgcgggttcacgctgggcatgagctcgtcggccgcgcagctgcaggccacgccggccagcattccggcctcgctgatgcccatcaccggcgtgatcggcttctccgaaaccatactgacctggcagaacctggtggtggtggtcctggttaccgtggtttcgggactggtgtgctacttcacggcgcccagcccggagcgctccttgaccgcccaggacctgggcgtggacctgaccgaacccgaggcgcaggcggcgcaacgccagcgccccggcgattacctggagttcagcccctggctgaccgtggccgtggtcgggctggcctcggggtggctgtatctcaccttccgcagcggcaacccgttcatcaccatgtcgcagctgaacacctacaacttcgtgttcctgctgctgggcctgctgctgcactggcggccgcgcagcttcctggagagtttcggccgcgccatgcccagcatcagcggcgtgatgctgcagtttccgttctacggcggcatcggctacgtgctgaccaaggtcgccaacgtgcaggggcataccctgtcggacgcgatcgcgcactggttcgtcagcctggcgcacgacagcagcgtgttctcgatactggtcagcatctattcggcattcctcggcttcttcattccgtcggccggcggcaagtgggtgatcgaggcgccgtacatcatggacgcggccaaccagatccaggcccacctgggctggaccgtcatggtctacaacatcgccgaaacgctgcccaacttcatcaacccgttctggatgctgccgctgctggggatactgcgcctcaaatccaaggacctggtcggctataccgccatgcagttcctggtgcacttccccatcgtcgtggccgccggcgcgatcctgatgcacaccttcagctatgtcccgcccgtcatcccgggacagtga

SEQ ID NO: 2338 - protein, 487 aa, Bordetella bronchiseptica RB50
MPNNHLTAAAPAQGREAIASPMERFSQAMVAWAEKWFPDAYVFVVVACAVVALGAILHGGDPLAVSKAFGEGFWSIIPFTMQMAMVAITGYVLALSPPVARLLRALARVPSTPRGAVVFIGTLSILLSLVNWGLSLIFSGLLVREMARRNDLRLDYRAAGAAGYLGLGCGFTLGMSSSAAQLQATPASIPASLMPITGVIGFSETILTWQNLVVVVLVTVVSGLVCYFTAPSPERSLTAQDLGVDLTEPEAQAAQRQRPGDYLEFSPWLTVAVVGLASGWLYLTFRSGNPFITMSQLNTYNFVFLLLGLLLHWRPRSFLESFGRAMPSISGVMLQFPFYGGIGYVLTKVANVQGHTLSDAIAHWFVSLAHDSSVFSILVSIYSAFLGFFIPSAGGKWVIEAPYIMDAANQIQAHLGWTVMVYNIAETLPNFINPFWMLPLLGILRLKSKDLVGYTAMQFLVHFPIVVAAGAILMHTFSYVPPVIPGQ

SEQ ID NO: 2339 - DNA, 1314 bp, Bordetella bronchiseptica RB50
  CDS (1)..(1314): transl_table=11
gtgttcaaactgatgtctcgttcagccgtgaaaatggttgagcgctatttgcccgacccttacgtattcgtggtgctgctgacgctggtcgccgccggcgcggccatgatcatcgagggccagacccccatggccgtcgtgcgctggtggggcaacggcttctgggggctgctgactttcgcgatgcagatgctgctggtgctggtcaccggctacatgctggccagcacgccgctggtcaagcggatgctggcgcggctggccagcctggccaccagcgccggcggggcgatcatcctggtcagcgtggtgtcgctggccgccagctggatcaactggggcttcgggctggtggtgggcgcgctgttcgccaagcagatcgcccgccaggtgcgggtcgattaccggctgctggtggccagcgcctattccggcttcatcatctggcacggcggtctggccggctcgattccgctgaccatcgcgaccgaggggcatttctccgccgacaagatcggcatcattcccaccggcgatacgattttcgcggtattcaacctggtgatcgtggtggcgatgttcatcctcgtgccgctggtcaaccggctgatgctgcccgacgagaaggaaagcgtctatgtcgatccggcgcgcctggaagaggcctcggtgccggcctcggacgacgacaagcgtccggccgcgcgcctggagaacagcaggctgctggcctggctgatcgccgcgggcgggctggcctacatgttcgactactacgtcgtgcgcggcgccggcctgaacctcaatgtcatcaacttcagcttcctgatcctggccatcctgctgcacggcacgccgcgccgcctgctggccagcctggacgaagccatcaagggaggcgcgggcatcgtgatccagttcccgttctatgcgggaatcatggccatcatgatggactcggggctggccgccaccttgtccgagtggttcgtgtcgatcgcctcggccgccacgctgccgttctggaccttcatcagcgccggcatcgtgaacatcttcattccgtcgggcggcgggcaatgggcggtgcaaagccccatcgtgatcagcgcggcgcaggcgctcggcgcggatatgccgagggtggcgatggccgttgcctggggcgacgcctggaccaacatgctccagccgttctgggccttgccggtgctggcgattgccggcctgaaggccaaggacatcatgggctattgcatcatccagctgctggtgaccggcgtcatcatttcggtgggactgagcttcttctag

SEQ ID NO: 2340 - protein, 437 aa, Bordetella bronchiseptica RB50
MFKLMSRSAVKMVERYLPDPYVFVVLLTLVAAGAAMIIEGQTPMAVVRWWGNGFWGLLTFAMQMLLVLVTGYMLASTPLVKRMLARLASLATSAGGAIILVSVVSLAASWINWGFGLVVGALFAKQIARQVRVDYRLLVASAYSGFIIWHGGLAGSIPLTIATEGHFSADKIGIIPTGDTIFAVFNLVIVVAMFILVPLVNRLMLPDEKESVYVDPARLEEASVPASDDDKRPAARLENSRLLAWLIAAGGLAYMFDYYVVRGAGLNLNVINFSFLILAILLHGTPRRLLASLDEAIKGGAGIVIQFPFYAGIMAIMMDSGLAATLSEWFVSIASAATLPFWTFISAGIVNIFIPSGGGQWAVQSPIVISAAQALGADMPRVAMAVAWGDAWTNMLQPFWALPVLAIAGLKAKDIMGYCIIQLLVTGVIISVGLSFF

SEQ ID NO: 2341 - DNA, 1365 bp, Bdellovibrio bacteriovorus HD100
  CDS (1)..(1365): transl_table=11
atgaacccagcccgcgacaatgcctttcaaaaactcattcgattcagtgtgaagctcgtcaatgaatacctgcctgatccctttatcttctgcgcgcttttgacttttatcgtatttgccgcggcaatgcccgtaactggcatgagcttccttgaaactgtgaacggttggtatgaaggcttctggggcttgttgggattctcgatgcagatggtcctggtgctcgtgctcggccatgcgttggcgaactcgcgcccctgctccagcttgttgtcatctttggcctcccacctgcgcacccctggtcaggcgatcgttgtcgtttctttggtctcgctgctgggttcctggttcaactggggttttggcctggtgatcggtgctctttttgccaaagagatcgcgaaaaaagtaaaaactgtcgactaccgcctgctgatcgcttctgcttattccggctttctaatctggcacggcggtctttccggatctattcctttgacgattgccacggacgggaatctggccaaggcctctaacaatgtcgtcaccggaatgatcccagtatctgaaaccctgttttcaacctacaacctggttatcgtaattgtccttttggtgacagtgcccctgctgaacatgttcatgcacccacgcctggaagaaaccgtgagtgtggatccggctttgctaaatgacgaagtttcagacacggaaaacggcaacagtacgtgggcagatcgcattgaaaacagcaaatgggtttctttgatcttgtgcgcccttgccagcgtgtacatcgcaaactacttcttcaaaaaaggtttggatctgaatctgaacattgtgaatttcatcttcctgttcctgggcattctgttgcacgggactccacgtcgctacattctggcgattcgttctgccgtgatcagctccagcgggatcatcctgcaattcccgttctatgcgggaatcatgggtctgatggtggccagcggcagcagcggtgtttcgctggccggagccctgtctaatgtgtttgtgaacatctccaccgtcacaacattcccgttctttacctttatcagcgcgggtattgtgaatttctttgtgccctccggcggtggtcagtgggccgtacaagctccgatcatgctgcctgcggcgcaagagctgggcgtgtctgtcgccaagacctcgatggcgattgcctggggtgacgcatggacaaacatgatccagcccttctgggccttgccagccttgggaatcgcaggccttggcgcccgcgacatcatgggcttttgtttgatcgtccttttgtactcaggccttgtgatctcggcgggattcttgttcctgtaa

SEQ ID NO: 2342 - protein, 454 aa, Bdellovibrio bacteriovorus HD100
MNPARDNAFQKLIRFSVKLVNEYLPDPFIFCALLTFIVFAAAMPVTGMSFLETVNGWYEGFWGLLGFSMQMVLVLVLGHALANSRPCSSLLSSLASHLRTPGQAIVVVSLVSLLGSWFNWGFGLVIGALFAKEIAKKVKTVDYRLLIASAYSGFLIWHGGLSGSIPLTIATDGNLAKASNNVVTGMIPVSETLFSTYNLVIVIVLLVTVPLLNMFMHPRLEETVSVDPALLNDEVSDTENGNSTWADRIENSKWVSLILCALASVYIANYFFKKGLDLNLNIVNFIFLFLGILLHGTPRRYILAIRSAVISSSGIILQFPFYAGIMGLMVASGSSGVSLAGALSNVFVNISTVTTFPFFTFISAGIVNFFVPSGGGQWAVQAPIMLPAAQELGVSVAKTSMAIAWGDAWTNMIQPFWALPALGIAGLGARDIMGFCLIVLLYSGLVISAGFLFL

SEQ ID NO: 2343 - DNA, 1347 bp, Bacillus cereus ATCC 10987
  CDS (1)..(1347): transl_table=11
ttgtttcgttcttttactaatggctgcgtcgccttagtgcaacgtttcttgccagaaccgtttattttatcatgtttattaaccgtatttgttattttcttcggcatgtttgcaacgcatcaaacacctgtggaaatgattaatcactgggggaatggcatttggggacttctcgccttttctatgcaaatggcacttgtactcgtgacaggatctgctttagcaaacgctcctctcattaaaaaatggttaacgaaagctgcaagactaccgaaaacgaatggacaaggtattattgccatttcaatcgtaagtttactaggggcgtacataaactggggctttggtattgttgtatctgttttatatgcaaaggaagtagcaaggcaacttgaaggattagattataggttagccattgcctcttcttactctggatttctcatttggcatgcggggctttctgcttctatccctctcacgttagcaactggaggcgaaacgttaatgaaaacgacagctggaagtattaaagaagcgattccaataacagaaacgttattctcaccatacgctctcgtgccagttattatttttctcgttacgatgcctctcattaataaagcgatgcatccagatgaaaaacatacgataacggtagatcctagcgtattccatgaagaagctgccgctcaagaagtaggaaacaatacgttcgctgagaaaatggaaaatagcatcattattacactttgcgttggattgttaggtctcatttatattttcaattacttttatacgaaaggttttaaccttacacttgatatcgttatttttatgttattaattgctggacttattttccaccgtactccgattcaatatattcgtgctttttcagattctacaaaaagtgcttctggtattttacttcagtttccattttatgcaggaattatgggcatgatgattggagcaaatagtgaaggactttcacttggaggagctatttcaaatttctttattagcatttcaaacgaaacgactttcccactctttacttttttaagtgctggcatcgttaatattttcgttccatctggtggcggtcaatgggctgtgcaagcacccattatgattccagctggtgctgaacttggtgtacctgctgcaaaaacagcaatggccattgcatggggcgatgcttggacgaatttaattcaacctttctgggcattacccgcattggcaatagctggtttaggcgctcgtgatattatgggattttgcgtcgtgaacttactatatgcaggatttatcataagtctatgtttcttatttatttaa

SEQ ID NO: 2344 - protein, 448 aa, Bacillus cereus ATCC 10987
MFRSFTNGCVALVQRFLPEPFILSCLLTVFVIFFGMFATHQTPVEMINHWGNGIWGLLAFSMQMALVLVTGSALANAPLIKKWLTKAARLPKTNGQGIIAISIVSLLGAYINWGFGIVVSVLYAKEVARQLEGLDYRLAIASSYSGFLIWHAGLSASIPLTLATGGETLMKTTAGSIKEAIPITETLFSPYALVPVIIFLVTMPLINKAMHPDEKHTITVDPSVFHEEAAAQEVGNNTFAEKMENSIIITLCVGLLGLIYIFNYFYTKGFNLTLDIVIFMLLIAGLIFHRTPIQYIRAFSDSTKSASGILLQFPFYAGIMGMMIGANSEGLSLGGAISNFFISISNETTFPLFTFLSAGIVNIFVPSGGGQWAVQAPIMIPAGAELGVPAAKTAMAIAWGDAWTNLIQPFWALPALAIAGLGARDIMGFCVVNLLYAGFIISLCFLFI

SEQ ID NO: 2345 - DNA, 1347 bp, Bacillus anthracis str. Sterne
  CDS (1)..(1347): transl_table=11
ttgtttcgttcttttactaatggttgcgtcgccttagtgcaacgtttcttgccagaaccgtttatattatcatgtttattaactgtttttgttattttcttcggcatgtttgcaacgcatcaaacacctgtggaaatgattaatcactggggtaatggcatttggggacttctcgccttttctatgcaaatggcacttgtactcgtgacaggatctgctttagcaaacgctcctcttattaaaaaaggattaatgaaagcggcaagactaccaaaaacaaatggacaaggtattattgccatttcaatcgtaagtttactaggggcatacataaactggggatttggtattgttgtatctgttttatacgcaaaagaagtggcaagacaattagaaggattggattatagactagcaatcgcttcttcttactctggatttctcatttggcatgcggggctttctgcttctatccctcttacgttagcaacaggcggagaaacgttaatgaaaacgacagctggaagtattaaagaagcgattccaatcactgaaacgttattctcaccatatgctctcgttccagttattatctttttagttacgatgcctctcattaataaggcgatgcatccagatgcaaaacatacaataacagtagatcctagcgtattccatgaagaagctgccgctcaagaggcaggaaaaaatacgttcgcggaaaaaatggaaaatagcattattattacactttgcgttggattgttaggtctcatttatattttcaactacttttatacgaaaggctttaaccttacactcgatatcgttatttttatgttattaattgctggactcattttccaccgtactccaattcaatatattcgcgctttttcagattccacgaaaagtgcttctggtattttacttcaatttccgttttacgcaggaattatggggatgatgatcggagcaaatagtgaaggcctttcacttggaggagctatttcgaatttctttattagcatttcaaacgaaacaactttcccgctctttacttttttaagtgcgggcatcgttaatattttcgttccatctggtggcggtcaatgggctgtgcaagcacccattatgattccagctggcgctgaacttggtgtacctgctgcaaaaacagcaatggccattgcgtggggcgatgcttggacaaatttaattcaacctttctgggcattaccagcattagcgatagctggtttaggtgctcgtgatattatgggattttgcgttgtgaacttactatatgcaggatttatcataagtctatgtttcttatttatttaa

SEQ ID NO: 2346 - protein, 448 aa, Bacillus anthracis str. Sterne
MFRSFTNGCVALVQRFLPEPFILSCLLTVFVIFFGMFATHQTPVEMINHWGNGIWGLLAFSMQMALVLVTGSALANAPLIKKGLMKAARLPKTNGQGIIAISIVSLLGAYINWGFGIVVSVLYAKEVARQLEGLDYRLAIASSYSGFLIWHAGLSASIPLTLATGGETLMKTTAGSIKEAIPITETLFSPYALVPVIIFLVTMPLINKAMHPDAKHTITVDPSVFHEEAAAQEAGKNTFAEKMENSIIITLCVGLLGLIYIFNYFYTKGFNLTLDIVIFMLLIAGLIFHRTPIQYIRAFSDSTKSASGILLQFPFYAGIMGMMIGANSEGLSLGGAISNFFISISNETTFPLFTFLSAGIVNIFVPSGGGQWAVQAPIMIPAGAELGVPAAKTAMAIAWGDAWTNLIQPFWALPALAIAGLGARDIMGFCVVNLLYAGFIISLCFLFI

SEQ ID NO: 2347 - DNA, 1347 bp, Bacillus thuringiensis serovar konkukian str. 97-27
  CDS (1)..(1347): transl_table=11
ttgtttcgttcttttactaatggttgcgtcgccttagtgcaacgtttcttgccagaaccgtttatattatcatgtttattaactgtttttgttattttctttggcatgtttgcaacgcatcaaacacctgtggaaatgattaatcactggggtaatggcatttggggacttctcgccttttctatgcaaatggcacttgtactcgtgacaggatctgctttagcaaacgctcctcttattaaaaaaggattaacgaaagcggcaagactaccaaaaacaaatggacaaggtattattgccatttcaatcgtaagtttactaggggcatacataaactggggatttggtattgttgtatctgttttatacgcaaaagaagtagcaagacagctggaaggattagattatagactggcaattgcttcttcttactctggatttctcatttggcatgcggggctttctgcttctatccctcttacgttagcaacaggcggagaaacattaatgaaaacgacagctggaagtattaaagaagcaatcccaatcactgaaacgttattctcatcatacgctctcgttccggttattatctttttagttacgatgcctcttattaataaggcgatgcatccagatgaaaaacatacaataacggtagatcctagcgtatttcatgaagaagctgcggctcaagaagtaggaaataatacgttcgctgaaaaaatggaaaatagtatcattattacactttgcattggattgttaggtctcatttatattttcaactacttttatacgaaaggctttaaccttacgctagatatcgttatttttatgttattaattgctggacttattttccaccgtactccgattcaatatattcgtgctttttcagattccacgaaaagtgcttctggtattttacttcaatttccgttttacgcaggaattatggggatgatgattggagcaaatagtgaaggactttcacttggaggagctatttcgaatttctttattagcatttcaaacgaaacaactttcccgctctttacttttttaagtgctggcattgttaacattttcgttccatctggtggtggtcaatgggctgtgcaagcaccaattatgattccagctggtgctgaacttggtgtacctgctgcaaaaacagcaatggccattgcgtggggagatgcttggacaaatttaattcaacctttctgggcattaccagcattggcgatagctggtttaggcgctcgtgatattatgggattttgcgttgtgaacttactatatgcaggttttatcattagtctatgcttcttatttatttaa

SEQ ID NO: 2348 - protein, 448 aa, Bacillus thuringiensis serovar konkukian str. 97-27
MFRSFTNGCVALVQRFLPEPFILSCLLTVFVIFFGMFATHQTPVEMINHWGNGIWGLLAFSMQMALVLVTGSALANAPLIKKGLTKAARLPKTNGQGIIAISIVSLLGAYINWGFGIVVSVLYAKEVARQLEGLDYRLAIASSYSGFLIWHAGLSASIPLTLATGGETLMKTTAGSIKEAIPITETLFSSYALVPVIIFLVTMPLINKAMHPDEKHTITVDPSVFHEEAAAQEVGNNTFAEKMENSIIITLCIGLLGLIYIFNYFYTKGFNLTLDIVIFMLLIAGLIFHRTPIQYIRAFSDSTKSASGILLQFPFYAGIMGMMIGANSEGLSLGGAISNFFISISNETTFPLFTFLSAGIVNIFVPSGGGQWAVQAPIMIPAGAELGVPAAKTAMAIAWGDAWTNLIQPFWALPALAIAGLGARDIMGFCVVNLLYAGFIISLCFLFI

SEQ ID NO: 2349 - DNA, 1410 bp, Acinetobacter sp. ADP1
  CDS (1)..(1410): transl_table=11
atggataaacaacctgcgcttttggagcgttttgccttaaaagtcagtgactggtcagaaaaatggtttcctgattcttatatttttgcgctacttggcgtcattattgtgtcgcttgccgcaattttcattggtgcgccagtcaaagatgtggcaggcgcatttggaaacggtttttggagtctcatcccgtttacactgcaaatgaccatgctgattattgtcggttatgtggtttctgtttctgcacctgtgaaaaaactcattcagaaaatggcacgtttgccacattcaggtcgcggtgccattgtaatggtggccaccgtgagtttgctcatttctttggtcaactgggcaattagtacgatcttgacagcattactggtcattgcgctggcaaaacgcaaagaactcaacatggattatcgtgctgctgccgctgccgcaattattggcatgggcgccacttgggcactcggtattagctcatcggctgcacagttgcaggccaataaaaccagtttgccagaatccatttataacctgacaggtgtgattccatttacccaaactattttcttatggcaatcactggtcatgacactggtgctggtgattgtgtctattgtgattgcatattggtcggcacctaaaggtcaaaatgtcaaaaccatgcaggattttcatctggattttgaagatgaagaaaaagctgaacccaaatcgacccgccctggtgactggctagaaaattcgcctattttaaccattttaattgtggtacttgggctgggctggatgcttatggaattttccaaaaacaatcctattattgcaatttctagtttgaatacttacaactttatctttttgatgctcggtctggcgttgcatcggacaccccgtaatttcctcaatgccgtgagcaaggccgttcctgcggtttcaggcgtgctgatccagtttccactgtatggcagcattgctttcattatgacgcaagcggtcaatgctcaggacttttcgctctctcattatattgctgaattttttgtttcgattgcatcacatgatacttttgcagtggtgatgggaatttactctgccattctgggattttttgtaccttctggcggtggcaaatggattatcgaagcaccttatgtcatgcaggctgcaaacgatcttcagtatcatttgggttggtcagttcaaatttacaatgcagccgaagccttacccaacctgatcaatccattttttatgttgcccatgctaggcattcttaaactcaaacccaaagatgtcattgggtttaccgtaacgcaactggtggtacatttaccgctggtgatgtttttattatggattcttggaaaaacactgagctataccccacccgtattttaa

SEQ ID NO: 2350 - protein, 469 aa, Acinetobacter sp. ADP1
MDKQPALLERFALKVSDWSEKWFPDSYIFALLGVIIVSLAAIFIGAPVKDVAGAFGNGFWSLIPFTLQMTMLIIVGYVVSVSAPVKKLIQKMARLPHSGRGAIVMVATVSLLISLVNWAISTILTALLVIALAKRKELNMDYRAAAAAAIIGMGATWALGISSSAAQLQANKTSLPESIYNLTGVIPFTQTIFLWQSLVMTLVLVIVSIVIAYWSAPKGQNVKTMQDFHLDFEDEEKAEPKSTRPGDWLENSPILTILIVVLGLGWMLMEFSKNNPIIAISSLNTYNFIFLMLGLALHRTPRNFLNAVSKAVPAVSGVLIQFPLYGSIAFIMTQAVNAQDFSLSHYIAEFFVSIASHDTFAVVMGIYSAILGFFVPSGGGKWIIEAPYVMQAANDLQYHLGWSVQIYNAAEALPNLINPFFMLPMLGILKLKPKDVIGFTVTQLVVHLPLVMFLLWILGKTLSYTPPVF

SEQ ID NO: 2351 - DNA, 1347 bp, Bacillus cereus E33L
  CDS (1)..(1347): transl_table=11
ttgtttcgttcttttactaatggttgcgtcgccttagtgcaacgcttcttgccagaaccgtttattttatcatgtttattaactgtttttgttattttctttggcatgtttgcaacgcatcaaacacctgtggaaatgattaatcactgggggaatggcatttggggacttctcgccttttctatgcaaatggcacttgtactcgtaacaggatctgctttagcaaacgctcctcttattaaaaaaggattaacgaaagcggcaagactaccaaaaacaaatggacaaggtattattgctatttcaatcgtaagtttactaggggcatacataaactggggatttggtattgttgtatctgttttatacgcaaaagaagtggcaagacaattagaaggattggattatagactagcaatcgcttcttcttactctggatttctcatttggcatgctgggctttctgcttctatccctcttacgttagcgacaggcggagaaacgttaatgaaaacgacagctggtagtattaaagaagcgattccaatcactgaaacgttattctcaccatacgctctcgttccagttattatctttttagttacgatgcctctcattaataaggcgatgcatccagatgaaaaacatacgattacagtagaccctagcgtgttccatgaagaagctgcagctcaagaggtagggaaaaatacgttcgctgagaaaatggaaaatagtatcatcattacactttgcgttggattgttaggtctcatttatattttcaattacttttatacgaaaggctttaaccttacacttgatatcgttattttcatgctattaattgctggacttattttccaccgtactccgattcaatatattcgcgctttctcagactctacgaaaagtgcttctggcattctacttcaatttccgttttatgcaggaattatggggatgatgatcggagcaaatagtgaaggactttcacttggaggagctatttcgaatttctttattagcatttcaaacgaaacaactttcccgctctttacttttttaagtgctggcatcgttaatattttcgttccatctggtggcggtcaatgggctgtgcaagcacccattatgattccagctggcgctgaacttggtgtacctgctgcaaaaacagcaatggccattgcgtggggggatgcttggacgaatttgattcaacctttctgggcattaccggcattagcgatagccggtttaggcgctcgtgatattatgggattttgcgttgtgaacttactatatgcaggatttatcataagtctatgtttcttatttatttaa

SEQ ID NO: 2352 - protein, 448 aa, Bacillus cereus E33L
MFRSFTNGCVALVQRFLPEPFILSCLLTVFVIFFGMFATHQTPVEMINHWGNGIWGLLAFSMQMALVLVTGSALANAPLIKKGLTKAARLPKTNGQGIIAISIVSLLGAYINWGFGIVVSVLYAKEVARQLEGLDYRLAIASSYSGFLIWHAGLSASIPLTLATGGETLMKTTAGSIKEAIPITETLFSPYALVPVIIFLVTMPLINKAMHPDEKHTITVDPSVFHEEAAAQEVGKNTFAEKMENSIIITLCVGLLGLIYIFNYFYTKGFNLTLDIVIFMLLIAGLIFHRTPIQYIRAFSDSTKSASGILLQFPFYAGIMGMMIGANSEGLSLGGAISNFFISISNETTFPLFTFLSAGIVNIFVPSGGGQWAVQAPIMIPAGAELGVPAAKTAMAIAWGDAWTNLIQPFWALPALAIAGLGARDIMGFCVVNLLYAGFIISLCFLFI

SEQ ID NO: 2353 - DNA, 1404 bp, Haloarcula marismortui ATCC 43049
  CDS (1)..(1404): transl_table=11
atgtcagctaataacacaggcgaaactgccctcgaacgtatcggctatcgactctctgcgtgggtggaacggtggatgccaagcccgttcctgttcgcgctcatcctcagttacgtcgtatttctggccggcgtcggcctcaccggggccggtcccgtggagatggtcgggttctggtacgacggcttctgggccttcctgacgttctcgatgcagatggtcctcatcctgatgacgggcttcgtcgtcgcgtaccacccgcgtgtcaacgccggcatccggcggctgacagagattcccagcaccggaaaacaggcggttgtcctcgtcggcctgttgacgatgctgctcggctgggtccactggggactgagcctcatcctcggcgcgattttcgcccgggagatgggcaagaccgcccacgagaacggcatcgatgtccactatccggtcctctgcgtggcgggctatctcggcctcggtctcacctggcactgggggctgtccgggtccgcgccgctcctgcttgcgacagagggcaacgagttcatccagcagggcgtcatcgacgtcgtcgtctccgcctcggagaccatcttccacccctacggcctcattctgaccggcctgtcgatagcctacgcgctcgtcgtcctctacgtcatcacgccgactggtgaccaggcgcggggcatcacgcactacatccccgaagacgatttgttcgagtccgcgagtgacggcggtgttgagacgactgcgaccaccaagcaggtcccggccgagcgtctcaaccacagccgcgttctcggcgggattatcggtctgaccggtattgcgctggtcgcctcgcagttcgttcagtccggcatcgacgcgctcggactgaacatcgtcaatttcggcttcctgacgattgggatcttcatctacatggacccacagacctaccgggagaagttcggcgaggcggcgaccgccgcgtcgggcatcgtgttgctctttccgttcttcgctggcattcaggggatgatggctacctccgggctggcgcagctgatggccaacgcgctcatctcggtctcgacaccacagacgttcccggtcatcgcctggctcactggtgccacggtcaacattttcgcaccgtccggcggcggtgagtggatcattctcgggccgccgattctcgaagccgcgcagaacctcggcgtcccggccgggcaggcgacgatggcctacgccgtcggtgacgcccacacgaacctcctgaaccccttctgggcgctgccgctgctcgccatcacccgcatcaaggcccgggagatgttcggctacgccatcgcaatgttgctcgcgctcacgccattcctggctgtcgtgctgttcgtcctgccgtactga

SEQ ID NO: 2354 - protein, 467 aa, Haloarcula marismortui ATCC 43049
MSANNTGETALERIGYRLSAWVERWMPSPFLFALILSYVVFLAGVGLTGAGPVEMVGFWYDGFWAFLTFSMQMVLILMTGFVVAYHPRVNAGIRRLTEIPSTGKQAVVLVGLLTMLLGWVHWGLSLILGAIFAREMGKTAHENGIDVHYPVLCVAGYLGLGLTWHWGLSGSAPLLLATEGNEFIQQGVIDVVVSASETIFHPYGLILTGLSIAYALVVLYVITPTGDQARGITHYIPEDDLFESASDGGVETTATTKQVPAERLNHSRVLGGIIGLTGIALVASQFVQSGIDALGLNIVNFGFLTIGIFIYMDPQTYREKFGEAATAASGIVLLFPFFAGIQGMMATSGLAQLMANALISVSTPQTFPVIAWLTGATVNIFAPSGGGEWIILGPPILEAAQNLGVPAGQATMAYAVGDAHTNLLNPFWALPLLAITRIKAREMFGYAIAMLLALTPFLAVVLFVLPY

SEQ ID NO: 2355 - DNA, 1320 bp, Bacillus clausii KSM-K16
  CDS (1)..(1320): transl_table=11
ttgtttgcggccgttactaggtggtttgaccgcatcgtgcaacgctatttgccagatgcctttttgtttgcgggattgttaaccattcttgtttttctattgggcgtgtttgttacagatgcttcgcctgtacaaatggttgattattggggctctggcttttgggatttgctttcctttacgatgcaaatggcgctcattgttgtaaccggttacattttggcgaatacgccactgtttaagcgcctattatcaacgttggccgtattagcaaaaacgccaggccaggcaattgtgcttgtaacgtttgtggccagcattgcttgtctgatcaattatggctttggcctcgttgtcggagcgctttttgccaggcacgttgttcgccaagtaccaagcgtcgactatcgtatactggtggcggctgcctacagtggttttcttgtatggcatgggggattatcggcgtctatccctctgacgattgcaacagaggaccactttttggcggatgtaatggggacgattccaattgccgatacattgctgtctccggccaacctttttattgtatgcgctttcttaattagcttgcctgtcgtgaattatttccttctcaaaacgtcgacttcttcttacacaattgatatggctcgatttgctgaagaaaaacgtgaggaagcggcagctgttgcggaaacgccagcggaaaagttggagaatagtcaatgggtgtcacttgccattgctctgcttggcttaacgtatgtcgtactgtattttatcgaaaacggccttgacttgaacattaatattgtcaattttacgtttttgtttttaggcattttatgccatcgtacgccaaggcgctttttaacagcagttggcgaaggcgtgaaaaacgccggaggcattattattcaattcccattttacgccggaattatggggatgatggtcggctcagggctgtctgaacagctttccctttggtttgtgtcgatttcatcagcagagacgttcccgctatggacgtttcttagcgcagggttactaaacatgtttatcccttctggaggcggacaatgggctgttcaagggccgattatggtgccggcagcactggaactcggtgcggatatggcgaaaacagctatggctgtcgcttggggagacgcatggacgaacatgatccaaccattttgggcgctgccattattagcgatcgcaggcttaaaagtccgtgacatcatgggcttttgtgtcatattgcttttttgggcatttgtgccaattgccattggcctgatgtttttttaa

SEQ ID NO: 2356 - protein, 439 aa, Bacillus clausii KSM-K16
MFAAVTRWFDRIVQRYLPDAFLFAGLLTILVFLLGVFVTDASPVQMVDYWGSGFWDLLSFTMQMALIVVTGYILANTPLFKRLLSTLAVLAKTPGQAIVLVTFVASIACLINYGFGLVVGALFARHVVRQVPSVDYRILVAAAYSGFLVWHGGLSASIPLTIATEDHFLADVMGTIPIADTLLSPANLFIVCAFLISLPVVNYFLLKTSTSSYTIDMARFAEEKREEAAAVAETPAEKLENSQWVSLAIALLGLTYVVLYFIENGLDLNINIVNFTFLFLGILCHRTPRRFLTAVGEGVKNAGGIIIQFPFYAGIMGMMVGSGLSEQLSLWFVSISSAETFPLWTFLSAGLLNMFIPSGGGQWAVQGPIMVPAALELGADMAKTAMAVAWGDAWTNMIQPFWALPLLAIAGLKVRDIMGFCVILLFWAFVPIAIGLMFF

SEQ ID NO: 2357 - DNA, 1419 bp, Pseudomonas syringae pv. syringae B728a
  CDS (1)..(1419): transl_table=11
atggccgccaacatagaagaaagccgctccgcccgatttgccttgcgctgtgctgcgtgggctgaacgctggtttcccgattcatgggtatttgccgcactggcggtggtcatcgtcacgctggcgacgctggccatcggcgcacgtccggtcgaggccgccaaggcgttcggtgacgggttctggagcctgattccgttcaccatgcaaatggccttcgtggtcatcggcggttacgtggtcgccagctcaccgcctgcggtacgcctgatcgaccgcctggcccgggtaccgcgcaacggccgttcggcggtggcctgggtggcgctgatttccatgctcgcttcgctgctcaactggggcctgtcgctggtgttcggcggcctgctggtgcgcgccctcgcccgccgcactgacctgcgcatggattaccgtgcagccggcgccgcggcctatctgggcctgggcgcggtctgggcgctggggctgtcgtcttcggccgcgcaattgcaggccaacccggccagtctgccgccgtcgatcctggcgattaccggggtgatcccgttcaccgaaaccatctttctctggcaatccggggtcatgctcgccgcgctggtggtcatctcactgatcgttgcctacgccaccgcgcccggcccgaacagcgcccgcgacgccaaggcctgcggtgtcgacccggccttcaacctgccgccgctgccgccccgcacacggcccggggaatggctggaatacagcccgctgctgatcatcctcatggtgctgctgggggttggctggctgttcaacgagttttcgagcaaaccggtgatcacagcgatttccgggctcaatacctacaatttcctgttcatcatgctcggtgccctgctgcactggcggccgcgcagttttctcgatgccgtcgcacgggcggtgcccaccaccaccggcgtgctgattcaattccctctgtacggttcgatcgccgcgctactgaccacggtcaagggcggcgatgcgcaaaccctggcgcattacatctcgacgttcttcaccagcattgcttcccacgatacttacgcgattctgatgggggtctattcagccatattgggctttttcattccgtcaggcggcggcaagtggattatcgaagcgccctacgtgatgcaggtcgccaacgacctgcagtatcacctcggctgggcagtacagatctacaacgcagccgaagccctgcccaacctgataaacccgttctacatgctgccgctgctgggtgtactgggcctgaaggcgcgtgacctgatcggcttctcgttcgtgcaactgctggtccacacgccgctggtgctgtttctgctctgggcactgggcaccacgctggcctatgtgccgccggtaatgccctga

SEQ ID NO: 2358 - protein, 472 aa, Pseudomonas syringae pv. syringae B728a
MAANIEESRSARFALRCAAWAERWFPDSWVFAALAVVIVTLATLAIGARPVEAAKAFGDGFWSLIPFTMQMAFVVIGGYVVASSPPAVRLIDRLARVPRNGRSAVAWVALISMLASLLNWGLSLVFGGLLVRALARRTDLRMDYRAAGAAAYLGLGAVWALGLSSSAAQLQANPASLPPSILAITGVIPFTETIFLWQSGVMLAALVVISLIVAYATAPGPNSARDAKACGVDPAFNLPPLPPRTRPGEWLEYSPLLIILMVLLGVGWLFNEFSSKPVITAISGLNTYNFLFIMLGALLHWRPRSFLDAVARAVPTTTGVLIQFPLYGSIAALLTTVKGGDAQTLAHYISTFFTSIASHDTYAILMGVYSAILGFFIPSGGGKWIIEAPYVMQVANDLQYHLGWAVQIYNAAEALPNLINPFYMLPLLGVLGLKARDLIGFSFVQLLVHTPLVLFLLWALGTTLAYVPPVMP

SEQ ID NO: 2359 - DNA, 1344 bp, Haemophilus influenzae 86-028NP
  CDS (1)..(1344): transl_table=11
atgattagtcgcgtttctcgttttatgacgacattcgtcagtaaatacctgccagacccacttatttttgccgtgttacgcacctttgtcacattcatttgtgcttggggattaaccgatagtacacctgttgatttagttaatatgtggggtaatggcttttggaatttacttggttttggtatgcaaatggcattaattgtcgtaactggtaatgctcttgcaacctcaccacaaattcgtaagtttctttctacaatcgcttcaatagcaaaaacaccagcacaaggtgttgtcttagttacgtttatgggttcaattgcctgtatcattaactggggcttcggtttggtcgttggtgcgatgtttgcaaaagaagtcgcgcggagaataaaaggcagtgactacgccttactgattgcctgcgcctatattgcatttatgacatggggtggaggtttttcaggctcaatgccacttttagccgcaacaccaggcaacccagttgctcatttaatggtgagcgaaagcaacccacaaggtattattcctgcagttagtacgcttttctctgggtacaatatttttatcacgttaagtttagtcatttgcttgcctttcattacctatatgatgatgcccaaaaatggcgaagcaaaaagtattgatccaaaacttattgcgcccgatccaacatttgataaaaaattggataaagatgcaacacttgctgaaaaaatggaagaaagccgcttcttagcctatacaatcggggcattaggatatagttacctcggtatgtatttctacaaaaacggattcaatctcacaattaataatgtaaaccttattttcttaatcacaggaattgtgcttcatggctcgccaatggcctatatgcgagcaattattaatgccacaagaagcacagcagggatcttagtgcaattcccattctatgcgggtgtgcaactaatgatggagcattcaggcttaggtggtttaatcacagaattctttatcaatgttgctaacaaagattctttcccattattaaccttctttagttctgcctttattaactttgcagtgccttctggtggcggtcactgggtcatccaaggaccatttgttatccctgctgctcaagcattaggtacagatctgggtaagtctacaatggcaattgcctatggtgagcaatggatgaacatggctcagccattttgggcattaccagcactgggtatcgcagggcttggcgtgagagatattatgggcttctgtatgaccgcacttatcttcaccgcaccaatttttattattggtttatatttcttatag

SEQ ID NO: 2360 - protein, 447 aa, Haemophilus influenzae 86-028NP
MISRVSRFMTTFVSKYLPDPLIFAVLRTFVTFICAWGLTDSTPVDLVNMWGNGFWNLLGFGMQMALIVVTGNALATSPQIRKFLSTIASIAKTPAQGVVLVTFMGSIACIINWGFGLVVGAMFAKEVARRIKGSDYALLIACAYIAFMTWGGGFSGSMPLLAATPGNPVAHLMVSESNPQGIIPAVSTLFSGYNIFITLSLVICLPFITYMMMPKNGEAKSIDPKLIAPDPTFDKKLDKDATLAEKMEESRFLAYTIGALGYSYLGMYFYKNGFNLTINNVNLIFLITGIVLHGSPMAYMRAIINATRSTAGILVQFPFYAGVQLMMEHSGLGGLITEFFINVANKDSFPLLTFFSSAFINFAVPSGGGHWVIQGPFVIPAAQALGTDLGKSTMAIAYGEQWMNMAQPFWALPALGIAGLGVRDIMGFCMTALIFTAPIFIIGLYFL

SEQ ID NO: 2361 - DNA, 1419 bp, Pseudomonas fluorescens Pf-5
  CDS (1)..(1419): transl_table=11
gtggccgctgatattcaagatagccgctccgcccgctttgccctgcgctgctcgaactgggccgaacgctggtttcccgactcctgggtgttcgccgcgctggcggtgatcatcgttgccctggccacgctggccatgggcgccaagcccaccgatgccgccatggcgtttggcgacggcttctggagcctgatccccttcaccatgcagatggccttcgtggtcattggcggctatgtggtagccagctcgccgccggcggtgaagctgatcgacaagctggcgcgcattcccaggaacggccgctcggcggtggcctgggtggcgctgatttccatggtcgcctccctgctcaactggggcctgtccctggtgttcggtggcctgctggtgcgggccctggcccggcgtaccgaactgcgcatggactaccgcgccgccggcgctgccgcctacctgggcctgggcgcggtctgggccctggggctgtcgtcttcggcggcgcagttgcaggccaaccccggcagcctgccaccgtcgatcctggccatcaccggggtcattcccttcacccagaccatctttctctggcaatccggcgtcctgctgctggccctggtggtggtctcgctgatcgtcgcctacgccacggcgcccggccccggcagcgcccgggatgcccaggcctgcggggtcgacccgagcttcagcatgcccaagccgcaaccccggacccgacctggcgaatggctggaatacagcccgctgctgacccttctcctggcgctgctggcggccggctggctgtatcacgagttcgccaccaaaccggcgatcaccgcgatctccgggctcaacacctacaacttcctgttcctgatggccggcgccctgctgcactggcgcccgcgcagcttcctcgatgccgtggcccgggcagtgcccaccaccaccggggtgctgatccagttcccgctgtacggttcgatcgccgcgctgatgaccgtggtcaagggcgtggatggccagaccctggcccaccacatctcgaccttcttcgtgcagatcgcttcccacgacacctacgcgctgctgatggggctgtactcagcggtgctgggcttcttcattccttcgggcggcggcaagtggatcatcgaggcgccctacgtgatgcaggtggccaatgacctgcagtaccacctgggctgggcggtacagatctacaacgccgccgaggccctgccgaacctgatcaaccccttctacatgctgccgctgctgggggtgctgggcttgaaggcccgggacctgatcggcttctcctttgtccagttgctggtgcatgcgcccctggtgctggtgctgctctgggccctggggaccaccctgtcctacctgccgccggtcattccctga

SEQ ID NO: 2362 - protein, 472 aa, Pseudomonas fluorescens Pf-5
MAADIQDSRSARFALRCSNWAERWFPDSWVFAALAVIIVALATLAMGAKPTDAAMAFGDGFWSLIPFTMQMAFVVIGGYVVASSPPAVKLIDKLARIPRNGRSAVAWVALISMVASLLNWGLSLVFGGLLVRALARRTELRMDYRAAGAAAYLGLGAVWALGLSSSAAQLQANPGSLPPSILAITGVIPFTQTIFLWQSGVLLLALVVVSLIVAYATAPGPGSARDAQACGVDPSFSMPKPQPRTRPGEWLEYSPLLTLLLALLAAGWLYHEFATKPAITAISGLNTYNFLFLMAGALLHWRPRSFLDAVARAVPTTTGVLIQFPLYGSIAALMTVVKGVDGQTLAHHISTFFVQIASHDTYALLMGLYSAVLGFFIPSGGGKWIIEAPYVMQVANDLQYHLGWAVQIYNAAEALPNLINPFYMLPLLGVLGLKARDLIGFSFVQLLVHAPLVLVLLWALGTTLSYLPPVIP

SEQ ID NO: 2363 - DNA, 1425 bp, Pseudomonas syringae pv. phaseolicola 1448A
  CDS (1)..(1425): transl_table=11
atggccgccaacgccaacatagaagaaagccgctctgcccgattcgccttgcgctgcgccgcatgggctgaacgctggtttcccgattcatgggtatttgccgcgctggcggtggtcatcgtcacactggcaacactggccattggcgcacgtccggccgaggctgccaaagcgttcggtgacgggttttggagcctgattccgttcaccatgcaaatggccttcgtggtcatcggcggttacgtcgtggccagttcgccgcccgcggtgcgcctgatcgaccgcttggcccttgtgccgcgtaacggtcgttcggcagtggcatgggtggcgctgatttccatgctggcttcgctgctcaactgggggctgtcactggtgttcggcggcctgctggtgcgcgccctcgcccgccgtaccgacctgcgcatggattatcgtgcagccggtgctgccgcgtatctggggctgggcgcagtctgggcgttggggctgtcgtcttcggcggcacagttgcaggccaacccggccagtctgccgccttcgatcctggcgataaccggcgtgatccctttcactgaaaccatctttctctggcaatccggggtcatgctcgccgcgctggtagtcatatcgctgatcgtggcctatgccaccgcccctggcccgaacagcgcccgggacgccaaagcctgcggtgtcgacccggcattcagcctgccgccactggcacctcgcacacggcccggcgaatggctggaatacagcccgctgttgatcatcctgatggtgctgctgggggtcggctggctgttcagcgagttttcgagcaaaccggcgatcaccgcaatctccgggctcaacacctacaattttctgttcatcatgctcggagcgttgctgcactggcgaccacgcagctttctcgatgccgtagcgcgggccgtgcccaccaccaccggcgtgttgattcaattcccgctttacggctcgatcgctgcgttactgaccacagtcaaaggcgctgatgcgcagaccctggcgcactacatctcgacattctttaccagcattgcctcccacgacacctacgcgattctgatgggcgtctattcggccattctgggcttcttcattccgtcgggcggcggcaagtggatcattgaagcgccttacgtgatgcaagtcgccaacgacctgcagtatcacctcggttgggcggtgcagatctacaatgcagccgaagcgctgcccaacctgatcaatccgttctacatgctgccgctgctgggcgtgctgggcctcaaggcacgtgacctgatcggtttctcgttcgtgcagttgctggtccacacgccgctggtgctgtttctgctctgggcattgggcactacgctggtctatacgccaccggtaatgccctga

SEQ ID NO: 2364 - protein, 474 aa, Pseudomonas syringae pv. phaseolicola 1448A
MAANANIEESRSARFALRCAAWAERWFPDSWVFAALAVVIVTLATLAIGARPAEAAKAFGDGFWSLIPFTMQMAFVVIGGYVVASSPPAVRLIDRLALVPRNGRSAVAWVALISMLASLLNWGLSLVFGGLLVRALARRTDLRMDYRAAGAAAYLGLGAVWALGLSSSAAQLQANPASLPPSILAITGVIPFTETIFLWQSGVMLAALVVISLIVAYATAPGPNSARDAKACGVDPAFSLPPLAPRTRPGEWLEYSPLLIILMVLLGVGWLFSEFSSKPAITAISGLNTYNFLFIMLGALLHWRPRSFLDAVARAVPTTTGVLIQFPLYGSIAALLTTVKGADAQTLAHYISTFFTSIASHDTYAILMGVYSAILGFFIPSGGGKWIIEAPYVMQVANDLQYHLGWAVQIYNAAEALPNLINPFYMLPLLGVLGLKARDLIGFSFVQLLVHTPLVLFLLWALGTTLVYTPPVMP

SEQ ID NO: 2365 - DNA, 1407 bp, Streptococcus pyogenes MGAS5005
  CDS (1)..(1407): transl_table=11
atgaataacatcaaaaccaaaaaaaggtttatggatcgctatattgatggctttatgaaatggatgccagaatcgctttttatctgttttattttaacctttttagtcgttactatgtctgtgttgatgacggatagtccctttattggtacggaaaagacgggcgggattatctatggctgggtaaatggtttttgggggctgttgtcctttgccatgcagatgactattttacttgcgacagggaatgctgtagcgagttctccacctgctcataagatgtttaagtcccttgccaaactgcctcaaaccaggactcagatttttatcttttccattgtagtaggctctatctttggctttttacactggggtcttggtatgatggttgctattgtgtttgggaaagagttgcttgttcaggctaggcaaaaagggattaaggtgcatacgcctttgtttgttgctactttattttttacctttttaccagctacttctggtctatctggtgctgcggtgctttattcggctactccagattatttgcgaaatagtgtcgcagatgcttataaacaggttgttcctgaaagtgttcctctgacagaatcagttttgaatcttccatttatcagtcttttagtggtgtgtatgctggaaccgctttgctttgctttattggcgcacccaaaagatgaaactaaaatcatggaacttgatgatgagatctatcaccatagtcttgataccgcttcacatgttgttattgcaagaaacacacctgctgaaaagatgaacgcatctcgcttagtgatgtatcttgttggtggggccattgttagctatagcctttatcatttttcggtggtgggcttgtctggtctagatctcaattgttttaactttttatttttaggcttaggcttgcttctttgtggtcaacaaggaccagaatattatggttccttattcaaagatggggtcatgtcatcttggggcttggtgcttcagtttccattttacgctggtatttttggaatcattcaaagtacaggtttaggattagagatttcccatttctttgtcgctatttcaaatgggacaacatggccggtctttgcttatctttactcggctttgctgaatattgcggtaccatcaggaggctcaaaatttgtgattgaagctccctatatcgtccctgcaactatcgaagttggtaatgacttaggtaagattttgcaggcttatcaattaggagatgccacaacaaacttgatagttcctttttgggccttatcttacctctcaaacttcaaactaaaattcaatcaaattgtggcttatactattccttgtgtcttggtggtcacaggtattgccatcatttacctatttgtattttag

SEQ ID NO: 2366 - protein, 468 aa, Streptococcus pyogenes MGAS5005
MNNIKTKKRFMDRYIDGFMKWMPESLFICFILTFLVVTMSVLMTDSPFIGTEKTGGIIYGWVNGFWGLLSFAMQMTILLATGNAVASSPPAHKMFKSLAKLPQTRTQIFIFSIVVGSIFGFLHWGLGMMVAIVFGKELLVQARQKGIKVHTPLFVATLFFTFLPATSGLSGAAVLYSATPDYLRNSVADAYKQVVPESVPLTESVLNLPFISLLVVCMLEPLCFALLAHPKDETKIMELDDEIYHHSLDTASHVVIARNTPAEKMNASRLVMYLVGGAIVSYSLYHFSVVGLSGLDLNCFNFLFLGLGLLLCGQQGPEYYGSLFKDGVMSSWGLVLQFPFYAGIFGIIQSTGLGLEISHFFVAISNGTTWPVFAYLYSALLNIAVPSGGSKFVIEAPYIVPATIEVGNDLGKILQAYQLGDATTNLIVPFWALSYLSNFKLKFNQIVAYTIPCVLVVTGIAIIYLFVF

SEQ ID NO: 2367 - DNA, 1449 bp, Ralstonia eutropha JMP134
  CDS (1)..(1449): transl_table=11
atgaaagagacaacaagcatggcattcccggatgccgggaagctgcaacaaggcggactggaacgccttgcgatacgggtgactgactggtccgagcggtggttcccggactcgtatatttttgcggccatcgccgtggtcgtggtggcgttgggcgcaatgttggtgggcgcgccagcgcaggccgtggcgaaggcctttggcgacggcttctggagcctgatccctttcaccatgcagatggcagtggtcgcgattgccggctacgtggtggcggtgtcgccgccggcagccatgctgatcaaccgtctggcagccttgccgcggacagcgcgcggtgccgtggctttcgtcgcgctcgtgagcctgtcgacgtcgctgctcaactgggcaatcagtttgatcttcagtggcttgctggtacgcgcaattgccaggcggcgcggcttccgtgtcgactacagggcagccagcgcggcagcctaccttggcatgggggcaacctgggcactgggactcagctcctccgccgcgcagctacaggcaaatgccgccagcctgcccaaatctctgctggatatcaccggggtcatcccgttctccgatacgatctttctttggcaatccatggcgatgaccgccgtattgatcgtcgtgtccctggcggtggcgtacttctcggcccctaccgaggcgcgtgctcgcacggcggccgatatgggggttgacctgaacgatgccgatgaagcggtcgcgcggccatctcggccaggtgaatggctggaatacagtccgatcctgacgttggttctggtcgccatgggcgcgagctggctctatcaggagttttcgaccaagaatccgattctcgccatctccaacctgaatacctacaacttcctgttcctgctgctcggcatgctgctgaactggcgtccgaagcgctttctgcgcgccgtcgcgaagtccgtgccgtccacggccggcgtcctgatccagtttccgctgtatggcggcattgcctttatcctgaccaaggcgaccggcggcaacggcgccccgctgtcgcaccatctggcgtcagcctttgtctccatggcgaccacggagtcgttctccgcggtcatgggagtgtattccgccgtgctcggcttcttcgtaccgtccggcggcggcaaatggatcatcgaagctccttacgtgatgcaggccgccaacgaactaaaggtacaccttggctgggcagtacaggtctacaacgccgctgaagcgctgccgaatttgatcaatcctttttggatgctgccgttgctcggtgtgctcggcatccgggccaaggacgtggtcggcttcaccttcacccagttgctggtgcatacgccgttagttctgctcatgttatgggctttcgccgcgacgctttcctaccatcctccggtgatgccctga

SEQ ID NO: 2368 - protein, 482 aa, Ralstonia eutropha JMP134
MKETTSMAFPDAGKLQQGGLERLAIRVTDWSERWFPDSYIFAAIAVVVVALGAMLVGAPAQAVAKAFGDGFWSLIPFTMQMAVVAIAGYVVAVSPPAAMLINRLAALPRTARGAVAFVALVSLSTSLLNWAISLIFSGLLVRAIARRRGFRVDYRAASAAAYLGMGATWALGLSSSAAQLQANAASLPKSLLDITGVIPFSDTIFLWQSMAMTAVLIVVSLAVAYFSAPTEARARTAADMGVDLNDADEAVARPSRPGEWLEYSPILTLVLVAMGASWLYQEFSTKNPILAISNLNTYNFLFLLLGMLLNWRPKRFLRAVAKSVPSTAGVLIQFPLYGGIAFILTKATGGNGAPLSHHLASAFVSMATTESFSAVMGVYSAVLGFFVPSGGGKWIIEAPYVMQAANELKVHLGWAVQVYNAAEALPNLINPFWMLPLLGVLGIRAKDVVGFTFTQLLVHTPLVLLMLWAFAATLSYHPPVMP

SEQ ID NO: 2369 - DNA, 1323 bp, Burkholderia sp. 383
  CDS (1)..(1323): transl_table=11
ttgattcagcgtatttcccaattcttcacgcaggtggtccaccgcgtgttgcccgacccgttgattttcgcgatcctgctgacggtcgtcgcgttcgcactcgcgttcggcctcacgccgaacacgcccgtgcagctcacgacgatgtggggttcgggtttctggaacctgctcgcgttctcgatgcagatggtgatgattctcgtcaccggccacgcactcgcgagttcgccgccggtgaagcgcatgctcgtcgcgctcgcgagcaccgcgcgcacgccggggcagggcgtgatgctcgtcgcgttcgtcggcgcgctcgcgtgcgcgatcaactggggcttcggcctcgtgctcggtgcgatgctcgcgcgcgaagtggcgcgccgtgtcgccggcagcgattaccggctgctcgttgcgtccgcgtacatgggcttcctgagctggcacggcggattgtcgggttcggtcccgctcgtcgcggccacgaagggcaatccgatggaaaagaccatcgggctgattcccgtgtcgcagacgatcttcaccggctacaacgcgttcatcacgatcggcctgatcgtgatgctgccgttcctcgcgcggatgatgatgccgaagccgggtgaggtcgtcagcgtcgatccggcgctgctggccgaaccgccgagcgtggagcgccagctcgggcccgacgcgacgttcgcggaacggctggaggaaagccgcttgctgtcggttctcgtcgcggcgctgtgcgcggcgttcctcgtgctgaagttcgtgcagaagggcttcgcgctcgacatcgacaccgtgaaccttgcgttcctcgcggccggcatcctgctgcaccgtacgccgatggcctatgcgcgcgcggtggccggtgcggcgcgcggcgcgtcggggatcatgatccagttcccgttctacgcgggcatccaggcgctgatggatcactcggggctcgcgggcgtgatcacgaaatggttcgtcgatatcgcgaacgtgcacacgttcccgctgctcgcgttcctgagctcggccgtgatcaatttcgcggtgccgtccggcggcggccactgggtcgtgcagggtccgttcgtgatgccggccgcccaggcgctcggcgccgatctcggcaaggccgcgatggcgatcgcgtatggcgaagcgtggaccaacatggcgcagccgttctgggcgctgcccgcgctggcgattgccgggctcggcgtgcgcgacatcatggggtattgcgtgacgacgctgctgttctcgggtgttgtgttcgtcgcggggatgtatctgttctga

SEQ ID NO: 2370 - protein, 440 aa, Burkholderia sp. 383
MIQRISQFFTQVVHRVLPDPLIFAILLTVVAFALAFGLTPNTPVQLTTMWGSGFWNLLAFSMQMVMILVTGHALASSPPVKRMLVALASTARTPGQGVMLVAFVGALACAINWGFGLVLGAMLAREVARRVAGSDYRLLVASAYMGFLSWHGGLSGSVPLVAATKGNPMEKTIGLIPVSQTIFTGYNAFITIGLIVMLPFLARMMMPKPGEVVSVDPALLAEPPSVERQLGPDATFAERLEESRLLSVLVAALCAAFLVLKFVQKGFALDIDTVNLAFLAAGILLHRTPMAYARAVAGAARGASGIMIQFPFYAGIQALMDHSGLAGVITKWFVDIANVHTFPLLAFLSSAVINFAVPSGGGHWVVQGPFVMPAAQALGADLGKAAMAIAYGEAWTNMAQPFWALPALAIAGLGVRDIMGYCVTTLLFSGVVFVAGMYLF

SEQ ID NO: 2371 - DNA, 1329 bp, Shewanella sp. MR-4
  CDS (1)..(1329): transl_table=11
atgttaaccaaagcggcaaaacctctggtcaagctcgtcgaccgatatttacccgatccttatatctttgtcttgctcttaaccttagtggtgctgatttcggccgtggtagccgagcagaaaaccccactcgaagtcatcaattactggggcgatggcttttgggcgctgctgagtttttcgatgcagatgctattagtgctggtggcgggatttatgctcgccagctcgccaccgattaagaaattactcgatggcatcgcaggatttgccaagtcggcgcctcaggccattatcttagtgaccttggtttccctcgccgccagttggattaactggggatttggcttagtggtcggcgccttattcgctaaggccttagcgcgtaaagtgcgtgtggattaccgtttattggtcgccagtgcttactcgggatttgtggtttggcatggcggcttagcgggctcgattccgttaactattgccactgctgggcatttctcagaatcacaaatcggtattatccccaccagcgagaccatcttcgctagctttaacctgctgttagtactgattttgtttgtggtgatgccactggtgaaccgctttatgttgccagaagataaagactgcatttatgttgatcctaaggcgctggaggatgggggcgcagacgataaagcggtacagttaacggccaatacgactcgccctgcggataaattagaaaacagtcgcttgctcggttggagtgtcggcggcgcgggactcgtttacttaggctattactttgcggtgcagggcggcagcttaaaccttaacctagtcaacttcttatttttattcctcgccatagtgctacatcaaacgccacgcagtttattactgagtctcaacgaggccattaaaggcggcgcgggtatcgtcatccagtttcctttttacgctgggattatggcggtgatggtgcaatcggggttagcccagagtatttccgaaggttttgtggccatcgccagtgccgaaagtctaccattttggagctttatcagtgcagggattgtgaatattttcgtgccttcggggggcggacaatgggcggtgcaggcgccaattatgttacccgccgccgaagccttgggcgccgatgtagcacgtgttgctatggcagtggcttggggtgatgcgtggaccaatcttattcagcctttctgggcgctgccagtgctggcaatcgccggattaaaggcgagggatatcatggggttctgtttaatgcagttgctgatcaccggggggattatcagtatcgccctcagctggttttaa

SEQ ID NO: 2372 - protein, 442 aa, Shewanella sp. MR-4
MLTKAAKPLVKLVDRYLPDPYIFVLLLTLVVLISAVVAEQKTPLEVINYWGDGFWALLSFSMQMLLVLVAGFMLASSPPIKKLLDGIAGFAKSAPQAIILVTLVSLAASWINWGFGLVVGALFAKALARKVRVDYRLLVASAYSGFVVWHGGLAGSIPLTIATAGHFSESQIGIIPTSETIFASFNLLLVLILFVVMPLVNRFMLPEDKDCIYVDPKALEDGGADDKAVQLTANTTRPADKLENSRLLGWSVGGAGLVYLGYYFAVQGGSLNLNLVNFLFLFLAIVLHQTPRSLLLSLNEAIKGGAGIVIQFPFYAGIMAVMVQSGLAQSISEGFVAIASAESLPFWSFISAGIVNIFVPSGGGQWAVQAPIMLPAAEALGADVARVAMAVAWGDAWTNLIQPFWALPVLAIAGLKARDIMGFCLMQLLITGGIISIALSWF

SEQ ID NO: 2373 - DNA, 1329 bp, Shewanella sp. MR-7
  CDS (1)..(1329): transl_table=11
atgttaaccaaagcggcaaaacctctggtcaagctcgtcgaccgttatttacccgacccttatatctttgtcttgctcttaaccttagtggtactgatctcggcggtggtggccgagcagaaaaccccactcgaagtcatcaattattggggcgatggcttttgggcgctactgagtttttcgatgcagatgctattagtgctggtggcgggatttatgctcgccagctcgccaccgattaagaaattactcgatggcatcgcaggatttgccaagtcggcgccgcaggcgattatcttagtaaccttggtttccctcgccgccagttggattaactggggttttggcttagtggttggcgccttattcgctaaggccttagcgcgtaaagtgcgtgtggattaccgtttattggtcgccagtgcttactcgggatttgtggtttggcatggcggcttagcgggctcgattccgttaactattgccactgcggggcatttctcagaatcacaaatcggtattatccccaccagcgagaccatcttcgctagctttaacctgctgttagtgctgattttatttgtggtgatgccactggtgaaccgctttatgttgcccgaagagaaagacagcatttatgtcgatcctaaggcgcttgaggatgggggcgcagacgataaagcggcacagttaacggccaatacgactcgtcctgcggataaattagaaaacagtcgcttgctcggttggagtgtcggcggcgcgggactcgtttacttgggctattactttgaggtgcagggcggcagcttaaaccttaatctagtcaacttcttatttttattcctcgccattgtgctgcatcaaacgccacgcagtttactgctaagcctcaacgaagccattaaaggcggcgcgggtatcgttattcagtttcccttttacgctggcattatggcggtgatggtgcaatcggggttagcccagagtatttccgaaggttttgtggccatcgctagcgccgaaagcctgccattttggagctttatcagtgcagggattgtgaatattttcgtgccttcggggggcggacaatgggctgtgcaggcgccgattatgttgcctgcggccgaagccttgggcgccgatgtggcacgtgttgccatggcagtggcttggggtgatgcgtggaccaatcttattcagcctttctgggcgctgccagtgctagcgatcgccggattaaaagcgcgggatatcatggggttctgtttaatgcagttgctgataaccggggtgattatcagtatcgccctaagctggttttaa

SEQ ID NO: 2374 - protein, 442 aa, Shewanella sp. MR-7
MLTKAAKPLVKLVDRYLPDPYIFVLLLTLVVLISAVVAEQKTPLEVINYWGDGFWALLSFSMQMLLVLVAGFMLASSPPIKKLLDGIAGFAKSAPQAIILVTLVSLAASWINWGFGLVVGALFAKALARKVRVDYRLLVASAYSGFVVWHGGLAGSIPLTIATAGHFSESQIGIIPTSETIFASFNLLLVLILFVVMPLVNRFMLPEEKDSIYVDPKALEDGGADDKAAQLTANTTRPADKLENSRLLGWSVGGAGLVYLGYYFEVQGGSLNLNLVNFLFLFLAIVLHQTPRSLLLSLNEAIKGGAGIVIQFPFYAGIMAVMVQSGLAQSISEGFVAIASAESLPFWSFISAGIVNIFVPSGGGQWAVQAPIMLPAAEALGADVARVAMAVAWGDAWTNLIQPFWALPVLAIAGLKARDIMGFCLMQLLITGVIISIALSWF

SEQ ID NO: 2375 - DNA, 1329 bp, Shewanella sp. ANA-3
  CDS (1)..(1329): transl_table=11
atgttaaccaaagcggcaaaacctctggtcaaactcgtcgaccgttatttacccgacccttatatctttgtcttgctcttaaccttagtggtgttgatttcggccgtggtggctgagcagaaaaccccactcgaagtcatcaattactggggcgatggcttttgggcactgctgagtttttcgatgcagatgctattagtgctggtggcgggatttatgctcgccagctcgccaccgattaagaaattactcgatggcatcgctggattcgctaagtcggcgccacaggcgattatcttagtaacactggtttcactcgccgccagttggattaactggggatttggtttagtggtcggcgccttattcgcgaaggccttagcgcgtaaagtgcgtgtggattaccgtttattggtcgccagtgcttactcgggatttgtggtttggcatggcggcttagcgggctcgattccgctaaccattgccacggcggggcatttctctgaatcacaaatcggcatcatccccaccagcgagaccatcttcgcgagctttaacctgctgttagtgctgattttgtttgtggtgatgcctctggtaaaccgctttatgctgcccgaagagaaagacggtatctatgtcgatcctaaggctcttgaggatggggccgcagacgataacgcggcgcagttaacggccaatacgactcgccctgcggataaattagaaaacagtcgcttgctcggttggagcgtgggcggcgcgggactcgtttacttaggctactactttgctgtgcagggcggcagcttaaaccttaacctagtcaacttcttatttttattcctcgccatcgtgctgcatcaaacgccacgcagtctattgctgagtctcaacgaagccattaaaggcggcgcgggtatcgttatccagtttcctttttacgcagggattatggcggtgatggtgcaatcgggattagcccagagtatttccgaaggttttgtggccatcgccagtgccgaaagtctgccattttggagctttatcagtgccgggattgtgaatattttcgtgccttctgggggcggacaatgggcggtgcaggcgccgattatgttgcctgcggccgaagccttgggcgccgatgtggcacgtgttgctatggccgtagcttggggagatgcgtggaccaatcttatccagcctttctgggcgctgcctgtgctggccatcgccgggttaaaggcgcgggatatcatggggttttgtttaatgcagctgctgataaccggggtgattatcagtatcgccctaagctggttttaa

SEQ ID NO: 2376 - protein, 442 aa, Shewanella sp. ANA-3
MLTKAAKPLVKLVDRYLPDPYIFVLLLTLVVLISAVVAEQKTPLEVINYWGDGFWALLSFSMQMLLVLVAGFMLASSPPIKKLLDGIAGFAKSAPQAIILVTLVSLAASWINWGFGLVVGALFAKALARKVRVDYRLLVASAYSGFVVWHGGLAGSIPLTIATAGHFSESQIGIIPTSETIFASFNLLLVLILFVVMPLVNRFMLPEEKDGIYVDPKALEDGAADDNAAQLTANTTRPADKLENSRLLGWSVGGAGLVYLGYYFAVQGGSLNLNLVNFLFLFLAIVLHQTPRSLLLSLNEAIKGGAGIVIQFPFYAGIMAVMVQSGLAQSISEGFVAIASAESLPFWSFISAGIVNIFVPSGGGQWAVQAPIMLPAAEALGADVARVAMAVAWGDAWTNLIQPFWALPVLAIAGLKARDIMGFCLMQLLITGVIISIALSWF

SEQ ID NO: 2377 - DNA, 1344 bp, Haemophilus somnus 2336
  CDS (1)..(1344)
atgattagccgtatttctcggtttatgacaactatcgttagtaagtatatgccagagccactggttttagcagtgctattgagtatcatcatcttcttttgggcactttggggcacagaacacagtacaggtgcattggttgagatgtggggtaatggtttttggaatttgcttgctttctcaatgcagatggcgatggtggtagtaactggtaatgctcttgcttcagctccacaaattcgtcgatttctttcaactgctgcatctattgcgaaaacaccaactcaaagcattatgcttgttacctttatgagttgtgttgcctgtgcaattaactgggggtttggcttggttgtgggagcaatgtttgcaaaagaagttgcacgccgtattaaaggtgtggactacgccttgctgattgcctgtgcatacattggctttatgacttggggaggtggcttttcaggctcaatgccactccaagcggcaacgccaaataacccaattgcacgttttatcacagatggaaattatgctgatggtattattcctgttactaaaacactattaaccagctataacatattcattattggtatgttaatcattacgttaccgtttctcactaaaatgatgcacccaaaagcagaaaatgtaaaaataattgatcctcgcttattacaagaagatccaaaattcagcaaaaagttaacagaatcttccactattgctgagaaaattgaagagagttgcattctggcttacattattgcagggacaggttttgcttatcttgcaatatattttgcgaaaaacggcttcaatttaacgatcaacaccgtaaatcttatctttttaatggctggtttagccttgcatggctcaccagctgcttatgttcgtgctattacccatgcagcacacagtacagcaggaatattaattcaatttccgttctatgctggtatgcagttaatgatggagcattccggtttaggtggcatgattacagaattttttgtaaatatttcaacgaaagacacctttccggtattaacctttttcagttcagcattagtgaattttgcagtaccgtctggcggtggtcactgggtagtgcaaggtccatttattattcccgcagcacaagaactgggtgcagatttaggcaaatcagtcatgggtattgcgtatggtgatatgtgggcgaatatggcacagccattttgggcattgcctgctttaggtatagcaggacttggtgtgcgtgacattatgggctactgcatgacagcattacttttcacagcaccaattttcgttattggactttatttcctttaa

SEQ ID NO: 2378 - protein, 447 aa, Haemophilus somnus 2336
MISRISRFMTTIVSKYMPEPLVLAVLLSIIIFFWALWGTEHSTGALVEMWGNGFWNLLAFSMQMAMVVVTGNALASAPQIRRFLSTAASIAKTPTQSIMLVTFMSCVACAINWGFGLVVGAMFAKEVARRIKGVDYALLIACAYIGFMTWGGGFSGSMPLQAATPNNPIARFITDGNYADGIIPVTKTLLTSYNIFIIGMLIITLPFLTKMMHPKAENVKIIDPRLLQEDPKFSKKLTESSTIAEKIEESCILAYIIAGTGFAYLAIYFAKNGFNLTINTVNLIFLMAGLALHGSPAAYVRAITHAAHSTAGILIQFPFYAGMQLMMEHSGLGGMITEFFVNISTKDTFPVLTFFSSALVNFAVPSGGGHWVVQGPFIIPAAQELGADLGKSVMGIAYGDMWANMAQPFWALPALGIAGLGVRDIMGYCMTALLFTAPIFVIGLYFL

SEQ ID NO: 2379 - DNA, 1326 bp, Fusobacterium nucleatum subsp. vincentii ATCC 49256
  CDS (1)..(1326): transl_table=11
gtgtgtttcgtgtatggaaagatggcttccagatccatttatattttgtgcttgttaacttttatagtgtttataggggctatatttcttacaaaagcaactcctttacaagtagttggattttgggctgatggtttttggtctttacttgctttctcaatgcaaatggcattagttttagttacagggcatactttggcaagttcaagattatttaaaaagatgttgtcaacatttgcttctggaataaagggacctaaacaagcaatacttattgtatcaatagtttcaggaatagcttgtgcattaaactggggttttggactagtaattggggctatttttgccaaagaaattgctaaaaaagtaaaaggagtggattatagacttcttatagcttcagcttatacagggttcttagtatggcatggaggattatcaggttctattccattacaacttgcaagtggtggagaaggattagcaaagcaaacagcaggtgctgtaacagaggctgttccaataagtcaaacattgttttcaccaatgaacatttttataattgtagggcttttaataatagtacctttattgaatatggcaatgtttccaagtaaggatgaagttgtagaagttgatccaaaattattagcagaaccaaaagaaattgtacttgatgtttctaaaatgactccagctgaaagaatagaaaatagcagagtagtttctatcttactttcaattatgggatttatatatataggatattatttaatgacaaaaggatttgcattaaatcttaatatagtaaactttatattcttattcttaggaattttattacatggaactccaagaagatatttgaatgcacttgcagaagcagtaaagggtgcagggggaatattattacaatttccattttatgcaggtattatgggaataatggtaggaatggatgctgatggaatatctcttgcaaagcttatgtctaatttctttgtaaatatttctactgaaagaacattcccagtattttcatttatcagtgcaggagttgtaaatttctttgttccatcaggtggaggacaatgggcagttcaagctccaatagtaatgccagcaggacaagcaataggagtaacagcagcaaaatctgctatggcaatagcttggggagatgcttggacaaatatgatacaaccattctgggctttaccagcattaggaattgcaggattaggtgctaaggatataatgggctattgtttaattgtaacagtggtatcaggattattcatttgcacaggtttcttattattctaa

SEQ ID NO: 2380 - protein, 441 aa, Fusobacterium nucleatum subsp. vincentii ATCC 49256
MCFVYGKMASRSIYILCLLTFIVFIGAIFLTKATPLQVVGFWADGFWSLLAFSMQMALVLVTGHTLASSRLFKKMLSTFASGIKGPKQAILIVSIVSGIACALNWGFGLVIGAIFAKEIAKKVKGVDYRLLIASAYTGFLVWHGGLSGSIPLQLASGGEGLAKQTAGAVTEAVPISQTLFSPMNIFIIVGLLIIVPLLNMAMFPSKDEVVEVDPKLLAEPKEIVLDVSKMTPAERIENSRVVSILLSIMGFIYIGYYLMTKGFALNLNIVNFIFLFLGILLHGTPRRYLNALAEAVKGAGGILLQFPFYAGIMGIMVGMDADGISLAKLMSNFFVNISTERTFPVFSFISAGVVNFFVPSGGGQWAVQAPIVMPAGQAIGVTAAKSAMAIAWGDAWTNMIQPFWALPALGIAGLGAKDIMGYCLIVTVVSGLFICTGFLLF

SEQ ID NO: 2381 - DNA, 1344 bp, Haemophilus influenzae R2866
  CDS (1)..(1344)
atgattagtcgtgtttctcgttttatggcgacattcgtcagtaaatacctgccagacccacttatttttgccgtgttactcacctttgtcacattcatttgtgcttggggattaaccgatagtacacctgttgatttagttaatatgtggggtaatggcttttggaatttacttggttttggtatgcaaatggcattaattgtcgtaactggtaatgctcttgcaacctcaccacaaattcgtaagtttctttctacaatcgcttcaatagcaaaaacaccggcacaaggtgttgtcttagttacgtttatgggttcaattgcctgtatcattaactggggcttcggtttggtcgttggtgcgatgtttgcaaaagaagtcgcgcggagaataaaaggcagtgactacgccttactgattgcctgtgcctatattgcatttatgacatggggtggaggtttttcaggctcaatgccacttttagccgcaacaccaggcaacccagttgctcatttaatggtgagcgaaagcaacccacaaggtattattcctgcagttagtacgcttttctctgggtacaatatttttatcacgttaagtttagtcatttgcttgcctttcattacctatatgatgatgcccaaaaatggcgaaacaaaaagtattgatccaaaacttattgcgcccgatccaacatttgataaaaaattggataaagatgcaacacttgctgaaaaaatggaagaaagccgcttcttagcctatacaatcggggcattaggatatagttacctcggtatgtatttctacaaaaacggattcaatctcacaattaataatgtaaaccttattttcttaatcacaggaattgtgcttcatggctcgccaatggcctatatgcgagcaattattaatgccacacgaagcacagcagggatcttagtgcaattcccattctatgcgggtgtgcaactaatgatggagcattcaggcttaggtggtttaatcaccgaattctttatcaatgttgctaacaaagattctttcccattattaaccttctttagttctgcctttattaactttgcagtgccttctggtggcggtcactgggtcatccaaggaccatttgttatccctgctgctcaagcattaggtgcagatctaggtaagtctacaatggcgattgcctatggtgagcaatggatgaacatggctcagccattttgggcattaccagcactgggtatcgcagggcttggcgtgagagatattatgggcttctgtatgaccgcacttatcttcaccgcaccaatttttattattggtttatatttcttatag

SEQ ID NO: 2382 - protein, 447 aa, Haemophilus influenzae R2866
MISRVSRFMATFVSKYLPDPLIFAVLLTFVTFICAWGLTDSTPVDLVNMWGNGFWNLLGFGMQMALIVVTGNALATSPQIRKFLSTIASIAKTPAQGVVLVTFMGSIACIINWGFGLVVGAMFAKEVARRIKGSDYALLIACAYIAFMTWGGGFSGSMPLLAATPGNPVAHLMVSESNPQGIIPAVSTLFSGYNIFITLSLVICLPFITYMMMPKNGETKSIDPKLIAPDPTFDKKLDKDATLAEKMEESRFLAYTIGALGYSYLGMYFYKNGFNLTINNVNLIFLITGIVLHGSPMAYMRAIINATRSTAGILVQFPFYAGVQLMMEHSGLGGLITEFFINVANKDSFPLLTFFSSAFINFAVPSGGGHWVIQGPFVIPAAQALGADLGKSTMAIAYGEQWMNMAQPFWALPALGIAGLGVRDIMGFCMTALIFTAPIFIIGLYFL

SEQ ID NO: 2383 - DNA, 1452 bp, Burkholderia cepacia R18194
  CDS (1)..(1452)
atgaaggatctgatggaagtgccgcacgttggtgcggcggcgacggaccgtgaaggggcgctcgagcggatggccgccggcgtggcgcgctggtcggagaagtggttcccggacgcttatattttcgccgcgattgccgtggtcgtcgtggcggcgggcgcgacggcaatcggcgcgccaatcaggcaggtcggtgtggcgttcggcgacggcttctggagtctcatcccgttcacgatgcagatggcgatcgttgccatttcgggttatgtcgtcgcggtatcgccacccgcgtcgaaactgatcggcgcgctcgcgcgctttccgtcgtccggacgggcggccgtggcgttcgttgcattcgtcagcatcgtcgcgtccctgttcaactgggcgatcagcctgatcttcagcggcctgctggttcgggcactggcgcgtcgcgccgatctccgcatggactaccgggcagcgggcgcggcggcttatctcggcatgggggcgacgtgggcgcttggattgagctcgtccgcatcgcaactgcaagcgaatccggacagcctgcccaagacgctgctcgccatctccggcgtcattcccttcgcggaaaccatcttcctgccgcagtcgatgttgatggccgccgtgctgacggtcgtgtcgctgctgattgcctggctgtccgcgcccggcggcacgcgtgcaaagacggcggcggagctcgggattccgctcgacgaggcccacgcgacgatcccgcgcccgactcgcccgggtgactggctcgagtacagcccgctcatcaccctcgcgatcgttgcgatcgggtcggtctgggtcgcgcacgaattcacgacgaaaaacccgatgatcgcgatttcgaacctgaacacgtacaacttcctgttcctgatgctgggcatgctgctgaactggcgaccgaggcgattcctcaatgccgtcgcgcgtgccgtgccatcggtcgcaggtgtactgatccagtttccgttgtacggcggcatcgcctacatcctgaccaaggcgtcggcgcctgccggactgccgctctccgatcatctcgcgcatttcttcgtcgcgctgtcgtcgcaatcgtcgtttcccgcggtgatgggggcgtactcggccgtcctcggattcttcgtgccgtccggcggcggcaagtggatcatcgaagcgccctacgtgatcgaggcggcaaaactgctgcacgtccatctgggctgggcggtgacggtctacaacgcggccgaggcattgccgaacctggtcaatccgttctggatgctgccgctcctcggtgtgctcgggctgcgcgcccgcgacatcgtgggattcacgttcacgcagctggcggtgcatcttccgctggtgattttcatgctctgggcgcttgcgagcacgctcagctaccatccgccagtcatgccgtga

SEQ ID NO: 2384 - protein, 483 aa, Burkholderia cepacia R18194
MKDLMEVPHVGAAATDREGALERMAAGVARWSEKWFPDAYIFAAIAVVVVAAGATAIGAPIRQVGVAFGDGFWSLIPFTMQMAIVAISGYVVAVSPPASKLIGALARFPSSGRAAVAFVAFVSIVASLFNWAISLIFSGLLVRALARRADLRMDYRAAGAAAYLGMGATWALGLSSSASQLQANPDSLPKTLLAISGVIPFAETIFLPQSMLMAAVLTVVSLLIAWLSAPGGTRAKTAAELGIPLDEAHATIPRPTRPGDWLEYSPLITLAIVAIGSVWVAHEFTTKNPMIAISNLNTYNFLFLMLGMLLNWRPRRFLNAVARAVPSVAGVLIQFPLYGGIAYILTKASAPAGLPLSDHLAHFFVALSSQSSFPAVMGAYSAVLGFFVPSGGGKWIIEAPYVIEAAKLLHVHLGWAVTVYNAAEALPNLVNPFWMLPLLGVLGLRARDIVGFTFTQLAVHLPLVIFMLWALASTLSYHPPVMP

SEQ ID NO: 2385 - DNA, 1290 bp, Burkholderia cepacia R18194
  CDS (1)..(1290)
atggtccaccgcgtgttgcccgacccgttgattttcgcgatcctgctgacggtcgtcgcgttcgcactcgcgttcggcctcacgccgaacacgcccgtgcagctcacgacgatgtggggttcgggtttctggaacctgctcgcgttctcgatgcagatggtgatgattctcgtcaccggccacgcactcgcgagttcgccgccggtgaagcgcatgctcgtcgcgctcgcgagcaccgcgcgcacgccggggcagggcgtgatgctcgtcgcgttcgtcggcgcgctcgcgtgcgcgatcaactggggcttcggcctcgtgctcggtgcgatgctcgcgcgcgaagtggcgcgccgtgtcgccggcagcgattaccggctgctcgttgcgtccgcgtacatgggcttcctgagctggcacggcggattgtcgggttcggtcccgctcgtcgcggccacgaagggcaatccgatggaaaagaccatcgggctgattcccgtgtcgcagacgatcttcaccggctacaacgcgttcatcacgatcggcctgatcgtgatgctgccgttcctcgcgcggatgatgatgccgaagccgggtgaggtcgtcagcgtcgatccggcgctgctggccgaaccgccgagcgtggagcgccagctcgggcccgacgcgacgttcgcggaacggctggaggaaagccgcttgctgtcggttctcgtcgcggcgctgtgcgcggcgttcctcgtgctgaagttcgtgcagaagggcttcgcgctcgacatcgacaccgtgaaccttgcgttcctcgcggccggcatcctgctgcaccgtacgccgatggcctatgcgcgcgcggtggccggtgcggcgcgcggcgcgtcggggatcatgatccagttcccgttctacgcgggcatccaggcgctgatggatcactcggggctcgcgggcgtgatcacgaaatggttcgtcgatatcgcgaacgtgcacacgttcccgctgctcgcgttcctgagctcggccgtgatcaatttcgcggtgccgtccggcggcggccactgggtcgtgcagggtccgttcgtgatgccggccgcccaggcgctcggcgccgatctcggcaaggccgcgatggcgatcgcgtatggcgaagcgtggaccaacatggcgcagccgttctgggcgctgcccgcgctggcgattgccgggctcggcgtgcgcgacatcatggggtattgcgtgacgacgctgctgttctcgggtgttgtgttcgtcgcggggatgtatctgttctga

SEQ ID NO: 2386 - protein, 429 aa, Burkholderia cepacia R18194
MVHRVLPDPLIFAILLTVVAFALAFGLTPNTPVQLTTMWGSGFWNLLAFSMQMVMILVTGHALASSPPVKRMLVALASTARTPGQGVMLVAFVGALACAINWGFGLVLGAMLAREVARRVAGSDYRLLVASAYMGFLSWHGGLSGSVPLVAATKGNPMEKTIGLIPVSQTIFTGYNAFITIGLIVMLPFLARMMMPKPGEVVSVDPALLAEPPSVERQLGPDATFAERLEESRLLSVLVAALCAAFLVLKFVQKGFALDIDTVNLAFLAAGILLHRTPMAYARAVAGAARGASGIMIQFPFYAGIQALMDHSGLAGVITKWFVDIANVHTFPLLAFLSSAVINFAVPSGGGHWVVQGPFVMPAAQALGADLGKAAMAIAYGEAWTNMAQPFWALPALAIAGLGVRDIMGYCVTTLLFSGVVFVAGMYLF

SEQ ID NO: 2387 - DNA, 1347 bp, Bacillus cereus G9241
  CDS (1)..(1347): transl_table=11
ttgtttcgttcctttacaaatggttgcgtcgccttagtgcaacgtttcttgccagagccgtttattttatcatgtttattaactgtttttgttatcttcttcggcatgtttgcaacgcatcaaacacctgtggaaatgattaatcattggggtaatggcatttggggactactcgccttttctatgcaaatggcacttgtacttgtgacaggatctgctttagcaaacgcgcctctcattaaaaaaggactaacgaaagcggcaaaactaccgaaaacgactggacaaggtattattgccatttcaatcgtaagtttacttggggcatacataaactggggatttggtattgttgtatctgttttatatgcaaaagaagtggcaaggcagctggaaggattagattatagactggcaattgcttcttcttactctggatttctcatttggcatgcggggctttctgcttctattcctcttacgttagcaactggcggtgaaacgttaattaaaacgacagcaggaagtataaaagaagcgattccaataacagaaacgttattctcaccatacgctctcgtgccagttattatttttctcgttacgatgcctctcattaataaagcgatgcatccagatgaaaaacatacgataacggtagatcctagtgtattccatgaagaagctgccgctcaagaagtaggaaacaatacgttcgctgagaaaatggaaaatagtatcatcattacactttgtgttggattgttaggtctcatttatatttccaattacttttatacgaaaggttttaaccttacgctagacatcgttatttttatgttattaattgctggacttatttttcaccgtactccgattcaatatattcgcgctttttcagactctacgaaaagtgcttctggtattttactccagtttccgttttatgctggaattatgggaatgatgattggagcaaatagtgacggactttcacttggaggagctatttcgaatttctttattagcatttcaaatgaaacgactttcccactctttacatttttaagtgctggcatcgttaatatttttgttccatctggtggcggtcaatgggctgtgcaagcccccattatgattccagctggagctgaacttggtgtacctgctgcaaaaacagcgatggccattgcttggggagatgcttggacgaatttaattcaaccattctgggcattaccggcattagcgatagcaggtttaggcgctcgtgatattatgggattttgcgttgtgaacttactatatgcaggatttatcataagtctatgtttcttatttatttaa

SEQ ID NO: 2388 - protein, 448 aa, Bacillus cereus G9241
MFRSFTNGCVALVQRFLPEPFILSCLLTVFVIFFGMFATHQTPVEMINHWGNGIWGLLAFSMQMALVLVTGSALANAPLIKKGLTKAAKLPKTTGQGIIAISIVSLLGAYINWGFGIVVSVLYAKEVARQLEGLDYRLAIASSYSGFLIWHAGLSASIPLTLATGGETLIKTTAGSIKEAIPITETLFSPYALVPVIIFLVTMPLINKAMHPDEKHTITVDPSVFHEEAAAQEVGNNTFAEKMENSIIITLCVGLLGLIYISNYFYTKGFNLTLDIVIFMLLIAGLIFHRTPIQYIRAFSDSTKSASGILLQFPFYAGIMGMMIGANSDGLSLGGAISNFFISISNETTFPLFTFLSAGIVNIFVPSGGGQWAVQAPIMIPAGAELGVPAAKTAMAIAWGDAWTNLIQPFWALPALAIAGLGARDIMGFCVVNLLYAGFIISLCFLFI

SEQ ID NO: 2389 - DNA, 1332 bp, Pseudomonas fluorescens PfO-1
  CDS (1)..(1332)
atgttcgccgcactggcggtgatcatcgtcgcgctggcgaccctggccatgggcgccaaacccaccgacgccgccatggcgttcggggacggattctggagcctgatcccgttcaccatgcagatggcgttcgtggtgatcggtggttatgtcgtggccagttcgccgcccgccgtgaaactgatcgatcgcctggcgcggatcccgaagaacggtcgctctgccgtggcgtgggtcgcgctgatctcgatggtcgcgtccttgctcaactggggcctgtcgctggtgttcggcggtctgctggttcgcgccctcgcccgccgcaccgatctgaaaatggactatcgcgccgccggtgccgccgcctaccttggcctcggcgccgtgtgggcactgggactgtcgtcgtccgccgcgcagttgcaggccaacccggccagcctgccgccgtcgatcctgtcgatcaccggggtgattccgttcacccagacgattttcctctggcagtcgggcgtgatgctgctggcgctgatcgtgatttcgatcatcatcgcctacgccaccgcgcccggcccgaactcggcgcgtgacgccaaggcctgcggcatcgacccggccttcaacctgccaccgctgcaaccgcgcacccgccctggcgaatggctggaacacagcccgctgctgatcatcctgctggtgctgctggcggccggatggctgttccacgagttttcgaccaaacctgcgatcaccgcgatttccgggctcaacacctacaacttcctgttcatcatgctcggcgcgttgctgcactggcgcccgcgcagtttcctcgatgcggtgtcgcgcgccgtgccgaccaccaccggggtactgatccagttcccgctgtacggctcgattgccgcgctgatgaccacggtcaagggcaccgacgcccagaccctggcccatcacatctcgacgttcttcgtaagcatcgcttcccacgacacctatgcgttgctgatgggtgtgtactcggcgattctcggtttcttcattccgtccggcggcggcaaatggatcatcgaggcgccgtacgtaatgcaggtggccaacgatctcaactatcacctcggctgggcggtgcagatctacaacgccgcagaagccctgccgaatctgatcaacccgttttatatgctgccgctgctgggcgtgctggggctcaaggcgcgggatctgatcggtttttcgttcgtgcaattactggtgcacacgccgctggtattggtgctgctgtgggctctgggtacgacgctgtcgtatctgccgcccgtcatgccctaa

SEQ ID NO: 2390 - protein, 443 aa, Pseudomonas fluorescens PfO-1
MFAALAVIIVALATLAMGAKPTDAAMAFGDGFWSLIPFTMQMAFVVIGGYVVASSPPAVKLIDRLARIPKNGRSAVAWVALISMVASLLNWGLSLVFGGLLVRALARRTDLKMDYRAAGAAAYLGLGAVWALGLSSSAAQLQANPASLPPSILSITGVIPFTQTIFLWQSGVMLLALIVISIIIAYATAPGPNSARDAKACGIDPAFNLPPLQPRTRPGEWLEHSPLLIILLVLLAAGWLFHEFSTKPAITAISGLNTYNFLFIMLGALLHWRPRSFLDAVSRAVPTTTGVLIQFPLYGSIAALMTTVKGTDAQTLAHHISTFFVSIASHDTYALLMGVYSAILGFFIPSGGGKWIIEAPYVMQVANDLNYHLGWAVQIYNAAEALPNLINPFYMLPLLGVLGLKARDLIGFSFVQLLVHTPLVLVLLWALGTTLSYLPPVMP

SEQ ID NO: 2391 - DNA, 1434 bp, Rhodospirillum rubrum
  CDS (1)..(1434)
atggaaaccaccgcggaccaggaaagccgcggcaagaccggggttgaatcccaaggtcgtctggcgcatatggccttcgagttcacccgcatcgccgagaagtggtttcccgacgccttcgtcttcgtcgtcctgaccacccttgtcgtcaccgccgccgatctggccatcggcgcctcgcccttgcagatcgccaagggcttcggagcggggttctggacgctcattcccttcaccatgcagatggcgatggtcgccatcaccggctatgtggtcgccacctcgccgccctgcacccggctgatcaccaaattagccgccttcccgtcaacgccggccggcgccgtcgcctgggtggccttcatctcgatggcggcctcctatctcaactgggcgctcagtctagtgctgggtggtttgctcgtccgcgccctcgcccgccgcgtcgacctgaagatggactatcgcgccgccggagccgccgcctatatgggcctgggctcgacctgggcgctggggctcagttcgtcctcggccatgctgcaggccaatccgctgtccctgcccaagtcgatctccgacatcagcggcgtcattccgctcagccaaacgatcttcctgtggcagtcggtggttctgtatctcagcttgatgaccctggccgtcgtcgtcttctacttcgccgcgccgcgcggcaagcatgtgcgcaccgcccaggacatgggcgtggacgtctcgatcgagcccgagcccgcgcagaagcccaagcgccccggcgaatggctggaattcacccccgtcctgcccatcctcgtcgtcatcttgtcggtcggctacttctgggagcagttcagcagccagggcgtgctggtcacggtttccagcctcaacaactataacttcgccttcctgatgctcggcctgctgctgcaccgcaatatccgcagcttcctgaccgccgtcacccgggcggtgccgacctcggcgggcgtgctgatccagttcccgttctatggcgccatcgccgccatgctgaccggcgtgctgggatcggacgggatctcgatctcccaccacatctcggagctgttcgtcagcatcgccaccaccaacagcttcccgatcgtcatcggcatctattcggccatcctcggcttcctcatcccctcgggtggcggcaagtggatcatcgaggcgccctatgtgttgcaggcggccaaggacatccacgcccacatgggctgggcggttcaggtctacaacgcggccgaagccctgcccaatctgatcaaccccttctggatgctccccttgctcggcatcctcaagcttcaggcccgcgacatcgtcggcttctgcttcacccagctgatcttcagcgccccggtggtgatgctgttgctgtgggtttttgcccagactctcgcgccctga

SEQ ID NO: 2392 - protein, 477 aa, Rhodospirillum rubrum
METTADQESRGKTGVESQGRLAHMAFEFTRIAEKWFPDAFVFVVLTTLVVTAADLAIGASPLQIAKGFGAGFWTLIPFTMQMAMVAITGYVVATSPPCTRLITKLAAFPSTPAGAVAWVAFISMAASYLNWALSLVLGGLLVRALARRVDLKMDYRAAGAAAYMGLGSTWALGLSSSSAMLQANPLSLPKSISDISGVIPLSQTIFLWQSVVLYLSLMTLAVVVFYFAAPRGKHVRTAQDMGVDVSIEPEPAQKPKRPGEWLEFTPVLPILVVILSVGYFWEQFSSQGVLVTVSSLNNYNFAFLMLGLLLHRNIRSFLTAVTRAVPTSAGVLIQFPFYGAIAAMLTGVLGSDGISISHHISELFVSIATTNSFPIVIGIYSAILGFLIPSGGGKWIIEAPYVLQAAKDIHAHMGWAVQVYNAAEALPNLINPFWMLPLLGILKLQARDIVGFCFTQLIFSAPVVMLLLWVFAQTLAP

SEQ ID NO: 2393 - DNA, 1431 bp, Ralstonia eutropha JMP134
  CDS (1)..(1431)
atggcattcccggatgccgggaagctgcaacaaggcggactggaacgccttgcgatacgggtgactgactggtccgagcggtggttcccggactcgtatatttttgcggccatcgccgtggtcgtggtggcgttgggcgcaatgttggtgggcgcgccagcgcaggccgtggcgaaggcctttggcgacggcttctggagcctgatccctttcaccatgcagatggcagtggtcgcgattgccggctacgtggtggcggtgtcgccgccggcagccatgctgatcaaccgtctggcagccttgccgcggacagcgcgcggtgccgtggctttcgtcgcgctcgtgagcctgtcgacgtcgctgctcaactgggcaatcagtttgatcttcagtggcttgctggtacgcgcaattgccaggcggcgcggcttccgtgtcgactacagggcagccagcgcggcagcctaccttggcatgggggcaacctgggcactgggactcagctcctccgccgcgcagctacaggcaaatgccgccagcctgcccaaatctctgctggatatcaccggggtcatcccgttctccgatacgatctttctttggcaatccatggcgatgaccgccgtattgatcgtcgtgtccctggcggtggcgtacttctcggcccctaccgaggcgcgtgctcgcacggcggccgatatgggggttgacctgaacgatgccgatgaagcggtcgcgcggccatctcggccaggtgaatggctggaatacagtccgatcctgacgttggttctggtcgccatgggcgcgagctggctctatcaggagttttcgaccaagaatccgattctcgccatctccaacctgaatacctacaacttcctgttcctgctgctcggcatgctgctgaactggcgtccgaagcgctttctgcgcgccgtcgcgaagtccgtgccgtccacggccggcgtcctgatccagtttccgctgtatggcggcattgcctttatcctgaccaaggcgaccggcggcaacggcgccccgctgtcgcaccatctggcgtcagcctttgtctccatggcgaccacggagtcgttctccgcggtcatgggagtgtattccgccgtgctcggcttcttcgtaccgtccggcggcggcaaatggatcatcgaagctccttacgtgatgcaggccgccaacgaactaaaggtacaccttggctgggcagtacaggtctacaacgccgctgaagcgctgccgaatttgatcaatcctttttggatgctgccgttgctcggtgtgctcggcatccgggccaaggacgtggtcggcttcaccttcacccagttgctggtgcatacgccgttagttctgctcatgttatgggctttcgccgcgacgctttcctaccatcctccggtgatgccctga

SEQ ID NO: 2394 - protein, 476 aa, Ralstonia eutropha JMP134
MAFPDAGKLQQGGLERLAIRVTDWSERWFPDSYIFAAIAVVVVALGAMLVGAPAQAVAKAFGDGFWSLIPFTMQMAVVAIAGYVVAVSPPAAMLINRLAALPRTARGAVAFVALVSLSTSLLNWAISLIFSGLLVRAIARRRGFRVDYRAASAAAYLGMGATWALGLSSSAAQLQANAASLPKSLLDITGVIPFSDTIFLWQSMAMTAVLIVVSLAVAYFSAPTEARARTAADMGVDLNDADEAVARPSRPGEWLEYSPILTLVLVAMGASWLYQEFSTKNPILAISNLNTYNFLFLLLGMLLNWRPKRFLRAVAKSVPSTAGVLIQFPLYGGIAFILTKATGGNGAPLSHHLASAFVSMATTESFSAVMGVYSAVLGFFVPSGGGKWIIEAPYVMQAANELKVHLGWAVQVYNAAEALPNLINPFWMLPLLGVLGIRAKDVVGFTFTQLLVHTPLVLLMLWAFAATLSYHPPVMP

SEQ ID NO: 2395 - DNA, 1380 bp, Brevibacterium linens BL2
  CDS (1)..(1380)
atgtcggcaccgaagccgtcgacccaggtcaacgccgcggcctcaaaagggttcatgcgtccgatcaaccgtttcctcgaacagtggattccgtcagcactgacgttcgccatcgttctcactctcatcgtcgccgtcctggcgttcatccttaccggggccagtcccgtcgacgttgtcaccggctggggtgagggactggccgggctcctcgagttcatgacccagatggccctcattctgttgctcggtcacatcctcgcgaacaccggacccgtgcagaagctgctgacatggctagcccgagttcccggcaacccggccttcgcctatgtcttcgtcttcgtcatcgccgcagtggcctgtctcatcacctggggcctcggcctcgtcgtcggcgctctgctgtctcgcgagatcgctgttcaggcccgcgagcgcgggtacaaggtccacttccctctcctcgtggccgccggctattcggggatggtcgtctggcacatggggtattcgggttcgggccccctgaccgcggcgacccctgattccttcctcgccgagtccttgggcggtgaggtcattcctgtcagcgagaccatcttctcgacctggaatctcctcgccatccttgccgtcatcgtcgtctgtgcgctcctgttcttcttcgttgcgccgaagaaggacgcgcccgtctacgaattgtccgactcggtcaattccgaatcgcgggcagccttcgacgaagatgtcgtcacgcccgccgaccgcatcgatgcttcgcgggtcctcacgctcatcatcggtctggcgctcgtgatctacctgatcatccacttcgcccagggtggtggactgacgctggacatcgtcaattggtcattcctcgcactcatcttcctgctcgtgaagaaccccttcgaactcatccacctgacgaaggaagccgcctcgaacgtcggcgagatcctgctgcagttccccctctacgcaggaattctgggcatcatgtccggcaccggcctcatcgcagtcttctccgacgctctcgtctcgatcgcgaacccgacgaccttcggcgtcctcgcgctgctctcggcaggactggtcaacttcttcgtcccttcaggcggcggccagttcgccgtccaggggccgatcatgctcgatgccgccaaccagctgggagtcgatccgtcgatcgcgatcatggcggtctcctacggtgaccagtggacgaacatgctccagcccttctgggctctgccggtgctggccatcgcgggactgaagatgcgtgacattctcggctacacctcggtgaccttcctcggatccggtgtcgtcatggctctggctctgttactcgtctcactgtga

SEQ ID NO: 2396 - protein, 459 aa, Brevibacterium linens BL2
MSAPKPSTQVNAAASKGFMRPINRFLEQWIPSALTFAIVLTLIVAVLAFILTGASPVDVVTGWGEGLAGLLEFMTQMALILLLGHILANTGPVQKLLTWLARVPGNPAFAYVFVFVIAAVACLITWGLGLVVGALLSREIAVQARERGYKVHFPLLVAAGYSGMVVWHMGYSGSGPLTAATPDSFLAESLGGEVIPVSETIFSTWNLLAILAVIVVCALLFFFVAPKKDAPVYELSDSVNSESRAAFDEDVVTPADRIDASRVLTLIIGLALVIYLIIHFAQGGGLTLDIVNWSFLALIFLLVKNPFELIHLTKEAASNVGEILLQFPLYAGILGIMSGTGLIAVFSDALVSIANPTTFGVLALLSAGLVNFFVPSGGGQFAVQGPIMLDAANQLGVDPSIAIMAVSYGDQWTNMLQPFWALPVLAIAGLKMRDILGYTSVTFLGSGVVMALALLLVSL

SEQ ID NO: 2397 - DNA, 1242 bp, Bacillus anthracis str. A2012
  CDS (1)..(1242)
  misc_feature (128)..(128): y is t or c
  misc_feature (246)..(246): w is a or t
  misc_feature (385)..(385): m is a or c
atgtttgcaacgcatcaaacacctgtggaaatgattaatcactggggtaatggcatttggggacttctcgccttttctatgcaaatggcacttgtactcgtgacaggatctgctttagcaaacgctcytcttattaaaaaaggattaatgaaagcggcaagactaccaaaaacaaatggacaaggtattattgccatttcaatcgtaagtttactaggggcatacataaactggggatttggtatwgttgtatctgttttatacgcaaaagaagtggcaagacaattagaaggattggattatagactagcaatcgcttcttcttactctggatttctcatttggcatgcggggctttctgcttctatccctcttacgttagcamcaggcggagaaacgttaatgaaaacgacagctggaagtattaaagaagcgattccaatcactgaaacgttattctcaccatatgctctcgttccagttattatctttttagttacgatgcctctcattaataaggcgatgcatccagatgcaaaacatacaataacagtagatcctagcgtattccatgaagaagctgccgctcaagaggcaggaaaaaatacgttcgcggaaaaaatggaaaatagcattattattacactttgcgttggattgttaggtctcatttatattttcaactacttttatacgaaaggctttaaccttacactcgatatcgttatttttatgttattaattgctggactcattttccaccgtactccaattcaatatattcgcgctttttcagattccacgaaaagtgcttctggtattttacttcaatttccgttttacgcaggaattatggggatgatgatcggagcaaatagtgaaggcctttcacttggaggagctatttcgaatttctttattagcatttcaaacgaaacaactttcccgctctttacttttttaagtgcgggcatcgttaatattttcgttccatctggtggcggtcaatgggctgtgcaagcacccattatgattccagctggcgctgaacttggtgtacctgctgcaaaaacagcaatggccattgcgtggggcgatgcttggacaaatttaattcaacctttctgggcattaccagcattagcgatagctggtttaggtgctcgtgatattatgggattttgcgttgtgaacttactatatgcaggatttatcataagtctatgtttcttatttatttaa

SEQ ID NO: 2398 - protein, 413 aa, Bacillus anthracis str. A2012
  misc_feature (43)..(43): The Xaa at location 43 stands for Leu, or Pro.
  misc_feature (129)..(129): The Xaa at location 129 stands for Pro, or Thr.
MFATHQTPVEMINHWGNGIWGLLAFSMQMALVLVTGSALANAXLIKKGLMKAARLPKTNGQGIIAISIVSLLGAYINWGFGIVVSVLYAKEVARQLEGLDYRLAIASSYSGFLIWHAGLSASIPLTLAXGGETLMKTTAGSIKEAIPITETLFSPYALVPVIIFLVTMPLINKAMHPDAKHTITVDPSVFHEEAAAQEAGKNTFAEKMENSIIITLCVGLLGLIYIFNYFYTKGFNLTLDIVIFMLLIAGLIFHRTPIQYIRAFSDSTKSASGILLQFPFYAGIMGMMIGANSEGLSLGGAISNFFISISNETTFPLFTFLSAGIVNIFVPSGGGQWAVQAPIMIPAGAELGVPAAKTAMAIAWGDAWTNLIQPFWALPALAIAGLGARDIMGFCVVNLLYAGFIISLCFLFI

SEQ ID NO: 2399 - DNA, 1440 bp, Azotobacter vinelandii AvOP
  CDS (1)..(1440): transl_table=11
atggcaacctgtgccgaagaccgtcgctacatcgaagaagacagtcgctatgcccgtttcgcaatcaattgttcgaactgggccgagcgctggtttcccgattcctgggtattcgccgtgctggcggtggtcgtcgtcgcgctggcggcgctggccatgggcgcgcgcccggccgagaccgccaaggccttcggcgacggtttctggagcctgatcccgttcaccatgcagatggccttcgtggtcatcggcggctacgtggtcgccagctcgccgccggcctcccggctgatcggcctgctcgcggccgtgccgaacaacggtcgctcggcggtctgctgggtggccctgatctcgatgctcgcctcgctgctgaactggggcctgagcctggtgttcggcggcttgctggtgcgcgcgctggcgcgccgcgaggagttgcgcatggactaccgggcggccggcgccgccgcctacctgggcctgggcgcggtgtgggcgctcggcctgtcgtcctcggcggcgcagttgcaggcgaatccgggcagcctgccgccttcgatcctgtcgatcaccggcgtcattcccttcaccgagaccatcttcctctggcagtccggcgtactgctggtggcgctcgtgctggtgtcgctgctggtcgcctatgtcaccgcgccgggcgccgccagcgcgcgcaccgcgcaggcctgcggggtcgacccgggcttcgcgccgccgccaccggcgcagcgcacgcgccccggcgagtggctggaatacagcccgctgctgatcatcctgctggttctgctcgccgccggctggctggcccaggagttcgccagcaagccggccatcgaggcgatttccgggctcaacacctacaacctgctgttcctgatgctcggcgcgctgcttcactggcggccgcgcagcttcctcgatgccgtggcgcgcgcggtgccggccaccgccggggtgctgatccagtttccgctgtacggttccatcgccgcgatcatgaccaaggtcgccggtggcgacggccagacccttacccatcacatttccacgctcttcgtgcaggtcgcctcgcacgacacctacgctctgctgatgggggtgtattcggccgtgctcgggttcttcattccgtcggggggcggcaagtggatcatcgaggcgccctacgtgatgcaggtcgccaacgaactgcgctaccacctgggctgggcggtgcagatctacaatgccgccgaggcgctgcccaacctgatcaacccgttctacatgctgcctctgctgggtgtgctgggactgaaggcgcgcgacgtgatcggcttttccttcgtccaactggtggtgcatgcgccgttggtgctggtacttctctgggcgttgggaacgacattggaataccgaccgccgcttgtgccctga

SEQ ID NO: 2400 - protein, 479 aa, Azotobacter vinelandii AvOP
MATCAEDRRYIEEDSRYARFAINCSNWAERWFPDSWVFAVLAVVVVALAALAMGARPAETAKAFGDGFWSLIPFTMQMAFVVIGGYVVASSPPASRLIGLLAAVPNNGRSAVCWVALISMLASLLNWGLSLVFGGLLVRALARREELRMDYRAAGAAAYLGLGAVWALGLSSSAAQLQANPGSLPPSILSITGVIPFTETIFLWQSGVLLVALVLVSLLVAYVTAPGAASARTAQACGVDPGFAPPPPAQRTRPGEWLEYSPLLIILLVLLAAGWLAQEFASKPAIEAISGLNTYNLLFLMLGALLHWRPRSFLDAVARAVPATAGVLIQFPLYGSIAAIMTKVAGGDGQTLTHHISTLFVQVASHDTYALLMGVYSAVLGFFIPSGGGKWIIEAPYVMQVANELRYHLGWAVQIYNAAEALPNLINPFYMLPLLGVLGLKARDVIGFSFVQLVVHAPLVLVLLWALGTTLEYRPPLVP

SEQ ID NO: 2401 - DNA, 1311 bp, Chromohalobacter salexigens DSM 3043
  CDS (1)..(1311): transl_table=11
atgctgaagctgctgtctcgccccgcggtacgcctggtcgaacgctacctgcccgatccttacatcttcgtgctgatcctgaccctggtggcggccatcgcggccatgctggtcgagcggcagtcgccactggcgatcatgcgctactggggagatggcttctggggactgctgtccttctcgatgcagatgctgctggtgctggtcactggcttcatgctggccagcagcccacccgtcaagcgcctgctcgacaggatcgcccggctcgccaagagcccggccggcgccatcgtgctggtgtcgctggtctcgctggccgccagctggatcaactggggcttcggcctggtcatcggcgccctgttcgccaaggccctcgcacgacaggtgcgtgtcgactaccgcctgttgatcgccagcgcctattcgggcttcgtggtatggcacggcggcctggccggctcgattcccttgaccatcgccaccgaagggcatttcacggcggaccagatcggtgtcattcccacctccgagaccatcttcgcgttcttcaacctggccatcgtgctggcgatgttcgtggccgtgccgctggtcaaccggttcatgcttcccgacgagcgtgacagcgtctacatcgaccccgcacaactcgacgacgccccgcgcgacctcggtcccgccacgcgtccggcggaacgcctggaaaagagctcctggctgtcatggctggtcggcattcccggcttgctgttcctgctcgaccatttcgtgttccgtgacggcggcctgaacctcaacgtggtcaatttcctgttcctgtccctggccatcgtgctgcatcgcacgccccgcagcctgctggacagcctccacgaggccatcaagggtggtaccggtatcgtcatccagtttcccttctacgccggcatcatggcgatcatcatgcagtccgggctggcacagacgctttccgaggggttcgtggcgatctccaccgcccagacgctgcctttctggtcattcatcagtgccggcatcgtcaacctgttcgtgccttcgggcggcgggcaatgggccgtccaggccccggtcatgctgcccgccgccgcctccctgggcgcggatatcccccgcgtcgccatggcggtcgcctggggcgatgcctggaccaacctgctgcagccgttctgggcgcttcccatgctcgccatcgcggggctcaaggccaaggacatcatgggcttctgcctgatccagctggtggtgacgggcgtcatcatcgcgctcgggctgacctttctgtga

SEQ ID NO: 2402 - protein, 436 aa, Chromohalobacter salexigens DSM 3043
MLKLLSRPAVRLVERYLPDPYIFVLILTLVAAIAAMLVERQSPLAIMRYWGDGFWGLLSFSMQMLLVLVTGFMLASSPPVKRLLDRIARLAKSPAGAIVLVSLVSLAASWINWGFGLVIGALFAKALARQVRVDYRLLIASAYSGFVVWHGGLAGSIPLTIATEGHFTADQIGVIPTSETIFAFFNLAIVLAMFVAVPLVNRFMLPDERDSVYIDPAQLDDAPRDLGPATRPAERLEKSSWLSWLVGIPGLLFLLDHFVFRDGGLNLNVVNFLFLSLAIVLHRTPRSLLDSLHEAIKGGTGIVIQFPFYAGIMAIIMQSGLAQTLSEGFVAISTAQTLPFWSFISAGIVNLFVPSGGGQWAVQAPVMLPAAASLGADIPRVAMAVAWGDAWTNLLQPFWALPMLAIAGLKAKDIMGFCLIQLVVTGVIIALGLTFL

SEQ ID NO: 2403 - DNA, 1356 bp, Shewanella baltica OS155
  CDS (1)..(1356): transl_table=11
atgttaaacaaagcggcaaaacctttggtcaaactcgtcgaccgatatctacccgatccctatattttcgtccttttactcaccttagtggtgttaattgcagctgtggtcgcagaacacaaaactccgctggaagtcatcaactattggggcgatggcttttggaccttgctgagtttttcgatgcagatgctgttagtgctggtggcgggattcatgctggcaagctcgccgccgattaaaaagctgctcgatgcgattgcaggatgcgctaaatcggcaccgcaagccattattttagtaaccttggtctcactggccgccagttgggttaactggggattcgggctagtggtgggcgcgttatttgccaaagccttagcgcgtaaagtgaaagtggattatcggctgctggtcgccagcgcctattctggctttgtggtttggcatggtgggcttgcgggttctatcccattaaccatagcaacggcggggcatttctccgaagcacaaattggcattatccccaccagtgaaaccattttcgcgagctttaacttattgttagtggcgattctgtttgtggtcatgcccttagtgaatcgctttatgttgcctgaagacaaggactgcatttatgtcgacccaagtgcccttgacgacaaaggcagcgaacccgcagcttcggcgctggagtttacccctgccaatgtgagtgagcgtcagcttgaaaaccgtcctgcggataagttagaaaatagccgcttactcggctggagcgtgggtggcgcagggcttgtgtacttaggctattacttttgggtacagggcggcagcttaaaccttaacttagtgaacttcttattcttgttcctcgccatcctcttacaccaaacgccacgcagtttattaaccagcttgaatgaggccattaagggcggcgcagggattgtgatccaattccctttctatgcgggcattatggcggtgatggtgcagtcgggtttagcccaaagtatttcggaaggttttgtggccatagccagtgccgagagcctgccattttggagctttattagcgcgggaattgtaaatatttttgtgccatcgggaggcggtcaatgggccgtgcaggcgccgattatgttacccgctgccgaagccttgggtgccgatgttgctcgggtggctatggccgtagcttggggtgatgcctggactaacctaattcaacctttctgggcactgcccgtgctggcaattgcgggcttaaaagcacgggatattatgggtttttgtttaatgcagctgatgatcacaggcgtgattatcagtatcgcgttgagctggttttaa

SEQ ID NO: 2404 - protein, 451 aa, Shewanella baltica OS155
MLNKAAKPLVKLVDRYLPDPYIFVLLLTLVVLIAAVVAEHKTPLEVINYWGDGFWTLLSFSMQMLLVLVAGFMLASSPPIKKLLDAIAGCAKSAPQAIILVTLVSLAASWVNWGFGLVVGALFAKALARKVKVDYRLLVASAYSGFVVWHGGLAGSIPLTIATAGHFSEAQIGIIPTSETIFASFNLLLVAILFVVMPLVNRFMLPEDKDCIYVDPSALDDKGSEPAASALEFTPANVSERQLENRPADKLENSRLLGWSVGGAGLVYLGYYFWVQGGSLNLNLVNFLFLFLAILLHQTPRSLLTSLNEAIKGGAGIVIQFPFYAGIMAVMVQSGLAQSISEGFVAIASAESLPFWSFISAGIVNIFVPSGGGQWAVQAPIMLPAAEALGADVARVAMAVAWGDAWTNLIQPFWALPVLAIAGLKARDIMGFCLMQLMITGVIISIALSWF

SEQ ID NO: 2405 - DNA, 1338 bp, Ralstonia metallidurans CH34
  CDS (1)..(1338): transl_table=11
ttgagtaaggtcgccgggttctttactgaactgatgcgccggtatttgccggacccctttgtattcgccatcggcctgacgttgctgacgatggtcatggcaatgctggtagaaggacaggccgcccaggcggtcatcacgaactggggcaaggggttctggaacctgctctcgttcaccacccagatggcggtgattctggcgatgggctacgtgctggccaccgcgccgctggtcgaccgcttcctcaatgccatcgtcgcccgcgtgcagacgccgcgcggcgccatcatcgtggccacactggtcggcggtatcggcagctacctgaactggggcttcggcctggtgatcggcggcatcatcgcccgcaagctggcgctgaaggtcaagggcgtgcattaccccctgatcatcgcctcggcctacagcggcttcacgatgtatggcctgggcctgtctgccagcatcccggtactgatctccaccccgggccacccgatggaaaagctgatgggcgtgatcggtctcaaggagacgatcttctccacaccgatgctgctgacgagccttgccgtcatcgtcacgctgccgctgctcaacgcgatgctgcacccgcgtgacgccaaggaagtggtggaaatccgcgaggagaacagctccgaggaccgcgccgccgggcacggccacagcatgggcatcgagaacacgcttgccacgcgcatgaacaacagccgcctgctgagcctgatcatcggcctgtgcgggctggcctacgcgggtctgcatttctcgcagggtggttcgctggacctgaacctgatcaacttcctgatcctgtttatcggcgtgctgttgctgggcaccccggccaactacgtggccaagctgaacgaaggcatcaagacgatctccggcatcatcctgcagtatccgttctacgcaggcatcatggcggtcatggccggctccgggctggtggacagcatctcgcgcgtgttcgtcgatatcgccacgccgcagacgctgccgttctggggtctggtcagctcgttcgtgatcaacttcttcgcgccgtccggcggtggccactgggtgatccagggtccgttcatgatcgacgcggccaaggccatcaacagctcggtggcgcagacgtcgatgtcggtcatgctcggcaacgcctggaatgacctggtgcagccgttctggattctgccggcgctggcgctgtcgaagctgaagctcaaggacgtgatgggctacaccgtgatcatgatgttctgggtcggcgcgatctatatcgtcgccatgctggcctggggcgcgcagatctga

SEQ ID NO: 2406 - protein, 445 aa, Ralstonia metallidurans CH34
MSKVAGFFTELMRRYLPDPFVFAIGLTLLTMVMAMLVEGQAAQAVITNWGKGFWNLLSFTTQMAVILAMGYVLATAPLVDRFLNAIVARVQTPRGAIIVATLVGGIGSYLNWGFGLVIGGIIARKLALKVKGVHYPLIIASAYSGFTMYGLGLSASIPVLISTPGHPMEKLMGVIGLKETIFSTPMLLTSLAVIVTLPLLNAMLHPRDAKEVVEIREENSSEDRAAGHGHSMGIENTLATRMNNSRLLSLIIGLCGLAYAGLHFSQGGSLDLNLINFLILFIGVLLLGTPANYVAKLNEGIKTISGIILQYPFYAGIMAVMAGSGLVDSISRVFVDIATPQTLPFWGLVSSFVINFFAPSGGGHWVIQGPFMIDAAKAINSSVAQTSMSVMLGNAWNDLVQPFWILPALALSKLKLKDVMGYTVIMMFWVGAIYIVAMLAWGAQI

SEQ ID NO: 2407 - DNA, 1395 bp, Rubrobacter xylanophilus DSM 9941
  CDS (1)..(1395): transl_table=11
atgcaggagcggctcagcgccccgcgcagcttcgggggaaacagggtgaccggcttcttcgtcgggctcgccgagaggtacctgccggacgcctacctcttcgcggtcgtgctcaccctcatagccggcctgctcacggccatcttcgtcacggcggacatcttcgtgttggtggacgcctggtacaacgggatgtggaacatcctcaccttcgccctgcagatggcgctcatcctgctcaccggctacaccgtggcccgctcgcggcccgtctcgcggctgctcgactggatagcctccaagcccaagaaccaggggcaggcgctcgccttcatcatcgtcgtctcctccgtcgccagcctcatcaactggggcttcgggctggtcgtcgccgcgatcatggcccgctacatcggcaagcggctggagaacgtggactacgccatcctggtctccgccgggtacgccgggttcatcgtgtgggccagcggcctctcctcctccatagccctcgccgtctccacccccggcagcgaggccaacataacccagcaggtcaccgggcaggtgctggacttcggccggaccatcctcacctggtggaacatcgtccccgtggtgctcatcgtcgtgctgctcgtccccctgtactggtggatgatgcccaagcggcccgagcacatgcgcaaggtcgaccgcgccctgctcgcccgcgaggacgaggaggccgggcgggcggagaccccggacaccccggccggcaggctggagcgcttctggcccctcaacctcgcgatagccggcgccatcttcctctacttcgggcatcagctcgccgccggcgagttcgtcttcgacttcaacgccgtcatcgcgctgtttctggctgtcggcctgatcctccactggacccccatctcctacgtccggtccttcaccggcagcgcgggggccatgggccccatagccctccagtacccgctctacggcggcatccaggggctcatggtgctcaccgtgggcgggatcagcctcgccgggaccatcgccgactggttcctggccttctccaacgagtacaccttcgccttctggaccttcgtctcctccaacgtcatcagcctcttcatcccctccggcggcgggcactgggtggtgcaggggccggtgatggtcccggcggccgagaggctcggcgtggaccaggggctgaccgcgatggcggtggcctggggggaggggacggcgaacatggtgcagcccttctgggcgctccccattctgggcatcgtgggcctcgggatccgggacatcatgggctacggggtcttcaccctcgggctgagcttcgcgatctacggggccttcaccctcatagcccccttcttcctgtag

SEQ ID NO: 2408 - protein, 464 aa, Rubrobacter xylanophilus DSM 9941
MQERLSAPRSFGGNRVTGFFVGLAERYLPDAYLFAVVLTLIAGLLTAIFVTADIFVLVDAWYNGMWNILTFALQMALILLTGYTVARSRPVSRLLDWIASKPKNQGQALAFIIVVSSVASLINWGFGLVVAAIMARYIGKRLENVDYAILVSAGYAGFIVWASGLSSSIALAVSTPGSEANITQQVTGQVLDFGRTILTWWNIVPVVLIVVLLVPLYWWMMPKRPEHMRKVDRALLAREDEEAGRAETPDTPAGRLERFWPLNLAIAGAIFLYFGHQLAAGEFVFDFNAVIALFLAVGLILHWTPISYVRSFTGSAGAMGPIALQYPLYGGIQGLMVLTVGGISLAGTIADWFLAFSNEYTFAFWTFVSSNVISLFIPSGGGHWVVQGPVMVPAAERLGVDQGLTAMAVAWGEGTANMVQPFWALPILGIVGLGIRDIMGYGVFTLGLSFAIYGAFTLIAPFFL

SEQ ID NO: 2409 - DNA, 1320 bp, Psychrobacter cryohalolentis K5
  CDS (1)..(1320): transl_table=11
atgaaagggattacccgtttttcgaatagcttaatggagaagtatttaccggatccatttttgttcgttattatcttaacagtggttatttttgtactgggtttaggattaactgattcttcaccggtacaaatggtggcgttttggggtgaaggtttttgggcattactcgcattctcaatgcagatggtgttggtattagtcacaggttttgtattggcaagcagtccgatatttaaaaaaggtttaggaaggctggcaagtttagcaaaatcgccgggcagtgccattatcttggtaactttagtatcccttgcagcaagctggatcaactggggatttgggttggtgattggagcattattcgccaaagaattggcaaagcgtgtagagaatgtcgattaccgtttattgattgccagtgcttattctggttttattatttggcatgctgggttttcgggttccattccgttatccattgcgacagcaggtcatccgttcgctgataagattggtgttattccaaccagtgaaacgatttttgccagctataacttaattattgtggctgcattgattgtcatcgttcctttactcaaccgtttgatgatgccaaaaacagaagatacggtgacggtagatccgagacttctggttgaaccaattgatgaagtgctgccagcaaaatcggatatgacaccagcagagcgtttagaaaacagctggattttgtcaatggttatcggtatgttgggcattgcttttatcgtctattattttgtgcaaaatggctttgccttgacactagatttggtcaactttatgtttttgttcctcggaattatctttcacggaacgcctcgtaagtatttgattgccgttcaagaagcggtcaaaggcgccggtgctattattgtccagtttccgttttatgcaggaatcatgggtatgatgacagcgtcaggcttggcaggcgtgatgtcagaagcattcgtcaatatttcgtcagctgagacattaccacttttcgccttcttaagcgcaggactggttaacttctttgttccttcaggtggcggacagtgggcagtgcaagcacccattatgttagaggcggcagagatgctgggcagcgatcctgcaaaggttgctatggcagttgcatggggtgatgcatggacaaatatgattcagccattttgggcattgccagccttggcaattgcgggactcaaagccaaagatatcatgggtttttgtgtcattgtcctgattgttagtggtgttgtgattggtttagggctattgtttttataa

SEQ ID NO: 2410 - protein, 439 aa, Psychrobacter cryohalolentis K5
MKGITRFSNSLMEKYLPDPFLFVIILTVVIFVLGLGLTDSSPVQMVAFWGEGFWALLAFSMQMVLVLVTGFVLASSPIFKKGLGRLASLAKSPGSAIILVTLVSLAASWINWGFGLVIGALFAKELAKRVENVDYRLLIASAYSGFIIWHAGFSGSIPLSIATAGHPFADKIGVIPTSETIFASYNLIIVAALIVIVPLLNRLMMPKTEDTVTVDPRLLVEPIDEVLPAKSDMTPAERLENSWILSMVIGMLGIAFIVYYFVQNGFALTLDLVNFMFLFLGIIFHGTPRKYLIAVQEAVKGAGAIIVQFPFYAGIMGMMTASGLAGVMSEAFVNISSAETLPLFAFLSAGLVNFFVPSGGGQWAVQAPIMLEAAEMLGSDPAKVAMAVAWGDAWTNMIQPFWALPALAIAGLKAKDIMGFCVIVLIVSGVVIGLGLLFL

SEQ ID NO: 2411 - DNA, 1353 bp, Burkholderia ambifaria AMMD
  CDS (1)..(1353): transl_table=11
atgtccgtatcaggaaacgaggagctcaagttggtccaacgcatttcccgctttttcacgcaggtggtccaccgcgtgctgcccgacccgttgattttcgcgatcctgctgacgatcgtcacgttcgcgctcgccttcggtctcacgccgaccacgccggtgcaactcacgacgatgtggggttcaggcttctggaacctgctcgcgttttcgatgcagatggtgatgatcctcgtcaccggccacgcgctcgcgagttcgccgccggtgcgccgcctgctcgttgcgctcgcaagcaccgcgcgcacgccggggcagggcgtgatgctcgtcgcgttcgtcggcgcgctcgcctgcgcgatcaactggggcttcggcctcgtgctcggcgcgatgcttgcgcgcgaagtcgcgcgccgcgtcgccggcagcgactaccggctgctcgtcgcatccgcgtacatgggtttcctgagctggcacggtgggctgtcgggttcggtcccgctcgtcgccgcgacgaagggcaatccgatggaaaagaccatcgggctgattcccgtgtcggacacgatcttcaccggctacaacgcgttcatcacgatcgggctgatcgtgatgctgccgtttctcgcgcggatgatgatgccgaagccgggcgacgtcgtcagcgtcgatccggcgctgctcgcggaaccgccgagcgtcgagcgccagctcgggcccgacgcgacgttcgcggaacggatggaagagagccgcgcgctgtcggtcgtcgttgcggcgctgtgcgcggcgttcctcgtgctgcgtttcatgcagaagggcttcgcgctcgacatcgacaccgtgaacctcgcgttcctcgcggccggcatcctgctgcaccgtacgccgatggcctatgcgcgcgcggtggccggcgcggcgcgcggcgcatcggggatcatgatccagtttcccttttacgcgggcatccaggcgctgatggatcactcggggctcgcgggcgtgatcacgaagtggttcgtcgatatcgcgaacgtgcacacgttcccgctgctcgcgttcctcagttcggccgtgatcaatttcgcggtgccgtcgggcggcggccactgggtcgtgcagggcccgtttgtgatgccggccgcgcaggcgctcggtgccgatctcggcaaggccgcgatggcgatcgcctacggcgaggcgtggaccaacatggcgcagccgttctgggcgctgcccgccctcgcgatcgccgggctcggcgtgcgcgacatcatggggtactgcgtgacgacgctgttgttctcgggcgtggtgttcgtcgcagggatgtatctgttctga

SEQ ID NO: 2412 - protein, 450 aa, Burkholderia ambifaria AMMD
MSVSGNEELKLVQRISRFFTQVVHRVLPDPLIFAILLTIVTFALAFGLTPTTPVQLTTMWGSGFWNLLAFSMQMVMILVTGHALASSPPVRRLLVALASTARTPGQGVMLVAFVGALACAINWGFGLVLGAMLAREVARRVAGSDYRLLVASAYMGFLSWHGGLSGSVPLVAATKGNPMEKTIGLIPVSDTIFTGYNAFITIGLIVMLPFLARMMMPKPGDVVSVDPALLAEPPSVERQLGPDATFAERMEESRALSVVVAALCAAFLVLRFMQKGFALDIDTVNLAFLAAGILLHRTPMAYARAVAGAARGASGIMIQFPFYAGIQALMDHSGLAGVITKWFVDIANVHTFPLLAFLSSAVINFAVPSGGGHWVVQGPFVMPAAQALGADLGKAAMAIAYGEAWTNMAQPFWALPALAIAGLGVRDIMGYCVTTLLFSGVVFVAGMYLF

SEQ ID NO: 2413 - DNA, 1344 bp, Bacillus cereus
  CDS (1)..(1344): transl_table=11
ttgtttcgttcttttacaaatggttgcgtcaccttagtgcaacgtttcttgccagaaccgtttattttatcatgtttattaactgtttttgttatcttcttcggcatgtttgcaactcaccaaacaccggtcgaaatgattaatcattggggtaatggcatttggggacttctcgccttttctatgcaaatggcactagtacttgtcactggatctgctttagcgaacgctcctcttattaaaaaggggttaacgaaagctgccaggctaccgaaaacgaatggccaaggtattattgccatttcaattgtaagtttacttggtgcatacataaactggggatttggtattgttgtatctgttttatatgcaaaagaagttgcaagacaacttgaaggattagattacagattagcaattgcttcttcttactctggacttctcatttggcatgcgggtctttctgcttctatccctcttacgttagctactggcggtgaaacgttaattaaaacgacagctggaagtattaaagaagtgattccaataacagaaacgttattctcaccatacgctctcgttccagttattatctttctcattacgatgccactcattaaccgggcaatgcatcccgatgaaaaacatacggtaacagtagatcctagcgtatttcatgaagaagctgctgctatagaagtagagccaaaaacagtcgctgaaaaaatggaaaatagcatcattattacactttgcgttgggttattaggtctcatttatattttcaattacttttatacgaaaggttttaaccttacactcgatatcgttatttttatgttattaattgctggtcttatttttcaccggactccgattcaatatattcgtgcattttcagactctacaaaaagtgcttctggcattctacttcagtttccgttttacgcaggaattatgggtatgatgattggagtaaatagtgaaggtctttctcttggaggagctatttctaatttctttattagtatttcaaacgaaacgactttcccgctctttacttttttaagtgctggcatcgttaatatttttgttccatctggtggcggtcaatgggctgtacaggcacccattatgattccagctggtgctgaacttggtgtacctgctgcaaaaacagcaatggcaattgcgtggggcgatgcttggacgaatttaattcaacctttctgggcattaccagcgttagcgatagctggtttaggtgctcgtgatattatgggattttgcgttgtgaacttactatatgcaggatttatcattagtttatgcttcttattttag

SEQ ID NO: 2414 - protein, 447 aa, Bacillus cereus
MFRSFTNGCVTLVQRFLPEPFILSCLLTVFVIFFGMFATHQTPVEMINHWGNGIWGLLAFSMQMALVLVTGSALANAPLIKKGLTKAARLPKTNGQGIIAISIVSLLGAYINWGFGIVVSVLYAKEVARQLEGLDYRLAIASSYSGLLIWHAGLSASIPLTLATGGETLIKTTAGSIKEVIPITETLFSPYALVPVIIFLITMPLINRAMHPDEKHTVTVDPSVFHEEAAAIEVEPKTVAEKMENSIIITLCVGLLGLIYIFNYFYTKGFNLTLDIVIFMLLIAGLIFHRTPIQYIRAFSDSTKSASGILLQFPFYAGIMGMMIGVNSEGLSLGGAISNFFISISNETTFPLFTFLSAGIVNIFVPSGGGQWAVQAPIMIPAGAELGVPAAKTAMAIAWGDAWTNLIQPFWALPALAIAGLGARDIMGFCVVNLLYAGFIISLCFLF

SEQ ID NO: 2415 - DNA, 1341 bp, Alcaligenes eutrophus
  CDS (1)..(1341): transl_table=11
atgagcaagattgccgggttcttcaccgaactcatgcgccggtacctgccggatccctttgtatttgccatcggcctgaccttgctgacgatggcgctggcggtgacggtgcaagggcaggcagcgccggccgtgatcgccagctggggcaaggggttctggaacctgctggcatttaccacgcagatggcggtgatcctggcgatgggctacgtgctggccaccgcgccgttcactgaccgcatgctcgaccgcatcgtcagtgccgtgcactcgccgcgcaccgcggtgatcgtcgccacgctggtgggcggcatcggcagctacctgaactggggcttcgggctggtgatcggcggcatcatcgccaggaagctggcgctgaaggtccgtggcgtgcattacccgctcatcatcgccgccgcgtacagcggcttcaccctgtacgggctgggcctgtcggccagcatcccggtgctgatctccaccccgggccacccgatggaaaagctgatgggcgtgatcccgctgtctgaaaccatcttctccacgccgatgctgctgaccagcctggcggtgatcgtcacgctgccgctgctcaatgcctggctgcatccgcgcaacccggccgatgtggtggagatccgccgcgaccaggaacccgccaaggccgaggccggctcggcccacagcatgggcggcgagaacaccctggccgcgcgcctgaacaacagccgtatcctgagcctggccatcggcctgtgcggcatggcctacgcggtcatctacttcacgcagggcggctcgctcgacctgaacctgatcaacttcctgatcctgttcgcgggcgtgctgctgctgggcacgccggtcaactacgtggccaagctgaacgaaggcatcaagaccatttccggcatcatcctgcagtatccgttctatgcaggcatcatggcgatcatggccggctcggggctggtggataccatctcgcgtgtgttcgtggagatcgccacgccgcagacgctgccgttctgggggctgctcagttcgttcgtgatcaacttcttcgcaccgtcgggcggtggccactggatgatccagggcccgttcatggtcgatgcggccaaggccatcaacagctcggtcagccagacctcgatgtcggtgatgctcggcaatgcctggaacgacctggtgcagccgttctggatattgccggcgctggcgctgtccaggctgaacctgaaggacgtgatgggctacaccgtgatcatgatgttctgggtgggcctgatctacattgccgcgctgctgctgtggggcgcgcagattgcctga

SEQ ID NO: 2416 - protein, 446 aa, Alcaligenes eutrophus
MSKIAGFFTELMRRYLPDPFVFAIGLTLLTMALAVTVQGQAAPAVIASWGKGFWNLLAFTTQMAVILAMGYVLATAPFTDRMLDRIVSAVHSPRTAVIVATLVGGIGSYLNWGFGLVIGGIIARKLALKVRGVHYPLIIAAAYSGFTLYGLGLSASIPVLISTPGHPMEKLMGVIPLSETIFSTPMLLTSLAVIVTLPLLNAWLHPRNPADVVEIRRDQEPAKAEAGSAHSMGGENTLAARLNNSRILSLAIGLCGMAYAVIYFTQGGSLDLNLINFLILFAGVLLLGTPVNYVAKLNEGIKTISGIILQYPFYAGIMAIMAGSGLVDTISRVFVEIATPQTLPFWGLLSSFVINFFAPSGGGHWMIQGPFMVDAAKAINSSVSQTSMSVMLGNAWNDLVQPFWILPALALSRLNLKDVMGYTVIMMFWVGLIYIAALLLWGAQIA

SEQ ID NO: 2417 - DNA, 1344 bp, Haemophilus influenzae
  CDS (1)..(1344): transl_table=11
atgattagtcgcgtttctcgttttatgacgacattcgtcagtaaatacctgccagacccacttatttttgccgtgttactcacctttgtcacattcatttgtgcttggggattaaccgatagtacacctgttgatttagttaatatgtggggtaatggcttttggaatttacttggttttggtatgcaaatggcattaattgtcgtaactggtaatgctcttgcaacctcaccacaaattcgtaagtttctttctacaatcgcttcaatcgcaaaaacaccagcacaaggtgttgtcttagttacgtttatgggttcaattgcctgtatcattaactggggcttcggtttggtcgttggtgcgatgtttgcaaaagaagtcgcgcggagaataaaaggcagtgactacgccttactgattgcctgtgcctatattgcatttatgacatggggtggaggtttttcaggctcaatgccacttttagccgcaacaccaggcaacccagttgctcatttaatgatgagcgaaagcaacccacaaggtattattcctgcagttagtacgcttttctctgggtacaatatttttatcacgttaagtttagtcatttgcttgcctttcattacctatatgatgatgcccaaaaatggcgaaacaaaaagtattgatccaaaacttattgcgcccgatccaacatttgataaaaaattggataaagatgcaacacttgctgaaaaaatggaagaaagccgcttcttagcctatacaatcggggcattaggatatagttacctcggtatgtatttctacaaaaacggattcaatctcacaattaataatgtaaaccttattttcttaatcacaggaattgtgcttcatggctcgccaatggcctatatgcgagcaattattaatgccacacgaagcacagcagggatcttagtgcaattcccattctatgcgggtgtgcaactaatgatggagcattcaggcttaggtggtttaatcaccgaattctttatcaatgttgctaacaaagattctttcccattattaaccttctttagttctgcctttattaactttgcagttccttctggtggcggtcactgggtcatccaaggaccatttgttatccctgctgctcaagcattaggtgcagatctaggtaagtctacaatggcgattgcctatggtgagcaatggatgaacatggctcagccattttgggcattaccagcactgggtatcgcagggcttggcgtgagagatattatgggcttctgtatgaccgcacttatcttcaccgcaccaatttttattattggtttatatttcttatag

SEQ ID NO: 2418 - protein, 447 aa, Haemophilus influenzae
MISRVSRFMTTFVSKYLPDPLIFAVLLTFVTFICAWGLTDSTPVDLVNMWGNGFWNLLGFGMQMALIVVTGNALATSPQIRKFLSTIASIAKTPAQGVVLVTFMGSIACIINWGFGLVVGAMFAKEVARRIKGSDYALLIACAYIAFMTWGGGFSGSMPLLAATPGNPVAHLMMSESNPQGIIPAVSTLFSGYNIFITLSLVICLPFITYMMMPKNGETKSIDPKLIAPDPTFDKKLDKDATLAEKMEESRFLAYTIGALGYSYLGMYFYKNGFNLTINNVNLIFLITGIVLHGSPMAYMRAIINATRSTAGILVQFPFYAGVQLMMEHSGLGGLITEFFINVANKDSFPLLTFFSSAFINFAVPSGGGHWVIQGPFVIPAAQALGADLGKSTMAIAYGEQWMNMAQPFWALPALGIAGLGVRDIMGFCMTALIFTAPIFIIGLYFL

SEQ ID NO: 2419 - DNA, 24 bp, Artificial sequence
  primer
atgattggtcgcatatcgcgtttt

SEQ ID NO: 2420 - DNA, 26 bp, Artificial sequence
  primer
ttagaacagcgttaaaccaatgacga

SEQ ID NO: 2421 - protein, 450 aa, Artificial sequence
  consensus sequence
  Variant (2)..(32): Xaa in position 2 to 32 is any amino acid
  Variant (33)..(42): Xaa in position 33 to 42 is any or no amino acid
  Variant (44)..(44): Xaa in position 44 is any amino acid
  Variant (48)..(48): Xaa in position 48 is any amino acid
  Variant (50)..(51): Xaa in position 50 to 51 is any amino acid
  Variant (53)..(53): Xaa in position 53 is any amino acid
  Variant (57)..(62): Xaa in position 57 to 62 is any amino acid
  Variant (64)..(66): Xaa in position 64 to 66 is any amino acid
  Variant (68)..(79): Xaa in position 68 to 79 is any amino acid
  Variant (81)..(103): Xaa in position 81 to 103 is any amino acid
  Variant (107)..(108): Xaa in position 107 to 108 is any amino acid
  Variant (110)..(119): Xaa in position 110 to 119 is any amino acid
  Variant (121)..(125): Xaa in position 121 to 125 is any amino acid
  Variant (126)..(130): Xaa in position 126 to 130 is any or no amino acid
  Variant (133)..(136): Xaa in position 133 to 136 is any amino acid
  Variant (138)..(139): Xaa in position 138 to 139 is any amino acid
  Variant (141)..(141): Xaa in position 141 is any amino acid
  Variant (143)..(145): Xaa in position 143 to 145 is any amino acid
  Variant (146)..(146): Xaa in position 146 is any or no amino acid
  Variant (148)..(149): Xaa in position 148 to 149 is any amino acid
  Variant (153)..(153): Xaa in position 153 is any amino acid
  Variant (155)..(159): Xaa in position 155 to 159 is any amino acid
  Variant (161)..(172): Xaa in position 161 to 172 is any amino acid
  Variant (173)..(180): Xaa in position 173 to 180 is any or no amino acid
  Variant (183)..(185): Xaa in position 183 to 185 is any amino acid
  Variant (187)..(187): Xaa in position 187 is any amino acid
  Variant (189)..(211): Xaa in position 189 to 211 is any amino acid
  Variant (213)..(242): Xaa in position 213 to 242 is any amino acid
  Variant (243)..(257): Xaa in position 243 to 257 is any or no amino acid
  Variant (259)..(259): Xaa in position 259 is any amino acid
  Variant (261)..(278): Xaa in position 261 to 278 is any amino acid
  Variant (280)..(290): Xaa in position 280 to 290 is any amino acid
  Variant (291)..(294): Xaa in position 291 to 294 is any or no amino acid
  Variant (296)..(297): Xaa in position 296 to 297 is any amino acid
  Variant (300)..(301): Xaa in position 300 to 301 is any amino acid
  Variant (303)..(304): Xaa in position 303 to 304 is any amino acid
  Variant (306)..(308): Xaa in position 306 to 308 is any amino acid
  Variant (309)..(310): Xaa in position 309 to 310 is any or no amino acid
  Variant (312)..(326): Xaa in position 312 to 326 is any amino acid
  Variant (328)..(330): Xaa in position 328 to 330 is any amino acid
  Variant (334)..(334): Xaa in position 334 is any amino acid
  Variant (336)..(336): Xaa in position 336 is any amino acid
  Variant (338)..(346): Xaa in position 338 to 346 is any amino acid
  Variant (347)..(353): Xaa in position 347 to 353 is any or no amino acid
  Variant (355)..(361): Xaa in position 355 to 361 is any amino acid
  Variant (363)..(384): Xaa in position 363 to 384 is any amino acid
  Variant (385)..(385): Xaa in position 385 is any or no amino acid
  Variant (387)..(387): Xaa in position 387 is any amino acid
  Variant (393)..(393): Xaa in position 393 is any amino acid
  Variant (395)..(398): Xaa in position 395 to 398 is any amino acid
  Variant (400)..(403): Xaa in position 400 to 403 is any amino acid
  Variant (405)..(423): Xaa in position 405 to 423 is any amino acid
  Variant (425)..(426): Xaa in position 425 to 426 is any amino acid
  Variant (428)..(430): Xaa in position 428 to 430 is any amino acid
  Variant (434)..(434): Xaa in position 434 is any amino acid
  Variant (437)..(437): Xaa in position 437 is any amino acid
  Variant (439)..(442): Xaa in position 439 to 442 is any amino acid
  Variant (444)..(446): Xaa in position 444 to 446 is any amino acid
  Variant (448)..(449): Xaa in position 448 to 449 is any amino acid
PXXXXXXXXXXXXXXXXXXXXXXXXXXXXXXXXXXXXXXXXXGXGFWXLXXFXMQMXXXXXXGXXXAXXXXXXXXXXXXAXXXXXXXXXXXXXXXXXXXXXXXNWGXXLXXXXXXXXXXAXXXXXXXXXXDYXXXXAXXYXGXXXXWXXGLSXSXXXXXAXXXXXXXXXXXXXXXXXXXXIPXXXTXFXXXXXXXXXXXXXXXXXXXXXXXPXXXXXXXXXXXXXXXXXXXXXXXXXXXXXXXXXXXXXXXXXXXXXEXSXXXXXXXXXXXXXXXXXXFXXXXXXXXXXXXXXXNXXFLXXGXXLXXXXXPXXXXXXXXXXXXXXXGXXXQFPXYXGXXXXXXXXXXXXXXXXLXXXXXXXFXXXXXXXXXXXXXXXXXXXXXXXFXPSGGGXWXXXXPXXXXAXXXXXXXXXXXXXXXXXXXAXXNXXXPFWXLPXLXXXXLXXXDXXG

SEQ ID NO: 2422 - protein, 56 aa, Artificial sequence
  protein pattern
  Variant (2)..(7): Xaa in position 2 to 7 is any or no amino acid
  Variant (9)..(9): Xaa in position 9 is any amino acid
  Variant (10)..(10): Xaa in position 10 is Ile, Met or Val
  Variant (11)..(11): Xaa in position 11 is Ile, Leu, Met or Val
  Variant (12)..(12): Xaa in position 12 is any amino acid
  Variant (13)..(13): Xaa in position 13 is Ala, Ser or Val
  Variant (14)..(14): Xaa in position 14 is Ala or Gly
  Variant (15)..(16): Xaa in position 15 to 16 is any amino acid
  Variant (17)..(17): Xaa in position 17 is Ile or Leu
  Variant (18)..(21): Xaa in position 18 to 21 is any amino acid
  Variant (22)..(22): Xaa in position 22 is Ala, Gly, Pro or Ser
  Variant (23)..(26): Xaa in position 23 to 26 is any amino acid
  Variant (27)..(27): Xaa in position 27 is Ala, Gly, Ile or Val
  Variant (28)..(28): Xaa in position 28 is any amino acid
  Variant (29)..(29): Xaa in position 29 is Ala, Asn or Ser
  Variant (30)..(30): Xaa in position 30 is any amino acid
  Variant (31)..(31): Xaa in position 31 is Ala or Gly
  Variant (32)..(32): Xaa in position 32 is Asp or Glu
  Variant (33)..(35): Xaa in position 33 to 35 is any amino acid
  Variant (37)..(37): Xaa in position 37 is Phe, Leu or Met
  Variant (38)..(38): Xaa in position 38 is Ala, Ile, Leu or Val
  Variant (39)..(39): Xaa in position 39 is Asn or Gln
  Variant (42)..(42): Xaa in position 42 is Phe, Trp or Tyr
  Variant (43)..(43): Xaa in position 43 is any amino acid
  Variant (46)..(46): Xaa in position 46 is any amino acid
  Variant (48)..(48): Xaa in position 48 is Ala or Gly
  Variant (49)..(49): Xaa in position 49 is Ile or Val
  Variant (50)..(50): Xaa in position 50 is Ala, Leu or Val
  Variant (51)..(51): Xaa in position 51 is any amino acid
  Variant (53)..(54): Xaa in position 53 to 54 is any amino acid
  Variant (55)..(55): Xaa in position 55 is Lys or Arg
GXXXXXXPXXXXXXXXXXXXXXXXXXXXXXXXXXXNXXXPFXXLPXLXXXXLXXXD

SEQ ID NO: 2423 - protein, 62 aa, Artificial sequence
  protein pattern
  Variant (2)..(2): Xaa in position 2 is any amino acid
  Variant (3)..(4): Xaa in position 3 to 4 is Ile or Leu
  Variant (5)..(5): Xaa in position 5 is Ala, Gly, Pro, Ser or Thr
  Variant (6)..(6): Xaa in position 6 is Phe or Leu
  Variant (7)..(7): Xaa in position 7 is Ala, Gly, Ser or Thr
  Variant (11)..(12): Xaa in position 11 to 12 is any amino acid
  Variant (13)..(14): Xaa in position 13 to 14 is any or no amino acid
  Variant (16)..(16): Xaa in position 16 is any amino acid
  Variant (17)..(18): Xaa in position 17 to 18 is any or no amino acid
  Variant (20)..(21): Xaa in position 20 to 21 is any amino acid
  Variant (22)..(22): Xaa in position 22 is Ile, Leu or Val
  Variant (24)..(31): Xaa in position 24 to 31 is any amino acid
  Variant (32)..(32): Xaa in position 32 is Ile or Leu
  Variant (33)..(35): Xaa in position 33 to 35 is any amino acid
  Variant (37)..(38): Xaa in position 37 to 38 is any amino acid
  Variant (39)..(39): Xaa in position 39 is Ala, Ile, Leu or Pro
  Variant (40)..(40): Xaa in position 40 is any amino acid
  Variant (41)..(41): Xaa in position 41 is Asp, Gly, Asn, Ser or Thr
  Variant (42)..(43): Xaa in position 42 to 43 is any amino acid
  Variant (44)..(44): Xaa in position 44 is Ala, Gly, Gln, Ser or Thr
  Variant (45)..(45): Xaa in position 45 is Ala, Gly or Ser
  Variant (46)..(46): Xaa in position 46 is Ala, Ile, Leu or Val
  Variant (47)..(49): Xaa in position 47 to 49 is any amino acid
  Variant (50)..(50): Xaa in position 50 is Ala, Gly, Ser or Thr
  Variant (51)..(51): Xaa in position 51 is any amino acid
  Variant (52)..(52): Xaa in position 52 is Phe, Ile, Leu, Met or Val
  Variant (53)..(53): Xaa in position 53 is Ala, Gly or Ser
  Variant (54)..(56): Xaa in position 54 to 56 is any amino acid
  Variant (57)..(57): Xaa in position 57 is Ala, Cys, Asn or Ser
  Variant (58)..(58): Xaa in position 58 is any amino acid
  Variant (59)..(59): Xaa in position 59 is Phe, Ile, Leu or Val
  Variant (60)..(60): Xaa in position 60 is Asn or Ser
  Variant (61)..(61): Xaa in position 61 is Trp or Tyr
  Variant (62)..(62): Xaa in position 62 is Ala or Gly
WXXXXXXMQMXXXXVXXXGXXXAXXXXXXXXXXXXAXXXXXXXXXXXXXXXXXXXXXXXXXX

SEQ ID NO: 2424 - protein, 31 aa, Artificial sequence
  protein pattern
  Variant (2)..(7): Xaa in position 2 to 7 is any amino acid
  Variant (8)..(8): Xaa in position 8 is Phe, Ile, Leu or Val
  Variant (9)..(10): Xaa in position 9 to 10 is any amino acid
  Variant (11)..(11): Xaa in position 11 is Ala, Gly or Ser
  Variant (12)..(13): Xaa in position 12 to 13 is any amino acid
  Variant (14)..(14): Xaa in position 14 is Ala, Gly, Asn, Ser or Thr
  Variant (15)..(15): Xaa in position 15 is Ala, Gly, Ser, Thr or Val
  Variant (16)..(16): Xaa in position 16 is any amino acid
  Variant (17)..(17): Xaa in position 17 is Ala or Gly
  Variant (18)..(18): Xaa in position 18 is Ile, Leu or Val
  Variant (19)..(19): Xaa in position 19 is Ile, Leu, Met or Val
  Variant (20)..(20): Xaa in position 20 is Ile, Leu or Val
  Variant (24)..(24): Xaa in position 24 is Phe or Leu
  Variant (26)..(28): Xaa in position 26 to 28 is any or no amino acid
  Variant (30)..(30): Xaa in position 30 is any amino acid
  Variant (31)..(31): Xaa in position 31 is Ile, Leu, Met or Val
PXXXXXXXXXXXXXXXXXXXQFPXYXXXAXX

SEQ ID NO: 2425 - protein, 12 aa, Artificial sequence
  protein pattern
  Variant (2)..(2): Xaa in position 2 is any amino acid
  Variant (3)..(3): Xaa in position 3 is Ala or Leu
  Variant (4)..(4): Xaa in position 4 is Ala, Ile, Leu or Val
  Variant (5)..(5): Xaa in position 5 is any amino acid
  Variant (7)..(7): Xaa in position 7 is Ala, Cys or Ser
  Variant (8)..(8): Xaa in position 8 is Ala, Gly or Ser
  Variant (10)..(10): Xaa in position 10 is any amino acid
  Variant (12)..(12): Xaa in position 12 is Phe, Leu or Met
YXXXXAXXYXGX

SEQ ID NO: 2426 - DNA, 207 bp, Escherichia coli
  CDS (1)..(207)
atgaattttattcgacagggattaggcatcgccttacaaccagagttaacgctgaaaagcattgcaggtgaattgtgttccgttcctctcgaaccaactttctatcgacagatttcgttgctggctaaagaaaagccggtagaaggcagtccactgtttttactacaaatgtgcatggaacaattagtggcgattggaaaaatttaa

SEQ ID NO: 2427 - protein, 68 aa, Escherichia coli
MNFIRQGLGIALQPELTLKSIAGELCSVPLEPTFYRQISLLAKEKPVEGSPLFLLQMCMEQLVAIGKI

SEQ ID NO: 2428 - DNA, 879 bp, Escherichia coli O157:H7 EDL933
  CDS (1)..(879): transl_table=11
atgactcttacccaaataaattctttactcgccgtgctggattacggtggctttactgaagccagcaagcgattgttcatgacgcagtcggcggtaagtcaggcaattgctgccctcgaacaagaacttggtgtgaatatactgttacgcgatcgccgtaaagctatacaactgaccacagcaggtcaccgcattgtgcaacatctgcgcgccattaatcgggaagttaacgcagtaaaagagatagccgagcaggaaaagcagaaccctcaaagaacgctgagacttggttgtttccccagcgtctgcgcctgtatcttaccggttgtgattcgctactttgaaattcatcatccgaatataaaaattattccttttgaggaaaatagcacagcgattattgattcgcttcagaatgaatccattgatgccggttttgttcattttccggtgagcggaatgtactccgtgcccatttatcaggataaattcaccgtagtgttaccgcccaaccatgctctggcaaaaaacagcactattacagtggaagaattaatgggtgaaccattaatcattagtaaaggacgctatgaattaagcattatggcactatttaaagaaaagaatattaccccacagataaaatatgaatttaatcacccggatacagcgatcagttttattcgacagggattaggcatcgccttattaccagagttaacgctgaaaaccattgcagatgaattgtgttccgttcctctcgaaccaaccttctatcgacagatttcgttgctggctaaagaaaagccggtagaaggcagtccactgtttttactacaaatgtgtacggaacaactagtggtgagtggaaaaatttga

SEQ ID NO: 2429 - protein, 292 aa, Escherichia coli O157:H7 EDL933
MTLTQINSLLAVLDYGGFTEASKRLFMTQSAVSQAIAALEQELGVNILLRDRRKAIQLTTAGHRIVQHLRAINREVNAVKEIAEQEKQNPQRTLRLGCFPSVCACILPVVIRYFEIHHPNIKIIPFEENSTAIIDSLQNESIDAGFVHFPVSGMYSVPIYQDKFTVVLPPNHALAKNSTITVEELMGEPLIISKGRYELSIMALFKEKNITPQIKYEFNHPDTAISFIRQGLGIALLPELTLKTIADELCSVPLEPTFYRQISLLAKEKPVEGSPLFLLQMCTEQLVVSGKI

SEQ ID NO: 2430 - DNA, 879 bp, Salmonella enterica subsp. enterica serovar Typhi str. CT18
  CDS (1)..(879): transl_table=11
atgacgctaacccaaatccatgccctgcttgccgtactggagtacggcggatttaccgaggccagcaaacggctatacatgacgcaatccgccgtcagccaggccatctccgcgcttgaggaggagctcggcgttgacatattgattcgtgagcgtcgtaaagagatcgagcttaccgccgccggtagccgcatcgtcaggcacttacgcgcgatccagcgcgacgtcaacgcggtaaaagagattgtcgaacaagaaaaaaagaacccggcccgtacgctacggattggctgttttcccagcgcctgcgcctgcattttacccggcgtcattcgctattttgaaagccatcatccaaatgtaaaaattatcccctatgaagagaacagtacggctattattgattcgctgcaggacggaagtattgatgccggtttcgttccttttccggtcaacggtatgtattgcgtccccatttaccgggataaattcaccgtagtggtgcctgaaaatcatcccctggcggccaatagtacagtaacggtcgaagaactgatggacgaaccacttattgtcagtaaaggtcgttatgaattaagtattatggcgttgtttaaagaaaagggtattgaaccgatatttaaatatgaatttaaccatcccgatactgcgctgaattttattcgccagggattaggtatcgccttattgccagaattaaccttaaaagccacgacaggaaaattatgctccgtggcgctggaacccaccttttatcgacaaatttcactgttagcaaaagaaccgccggtagaaggaagcccgctatttttattacaaaaatgtatggaaacactgaccgatgagggtttgctataa

SEQ ID NO: 2431 - protein, 292 aa, Salmonella enterica subsp. enterica serovar Typhi str. CT18
MTLTQIHALLAVLEYGGFTEASKRLYMTQSAVSQAISALEEELGVDILIRERRKEIELTAAGSRIVRHLRAIQRDVNAVKEIVEQEKKNPARTLRIGCFPSACACILPGVIRYFESHHPNVKIIPYEENSTAIIDSLQDGSIDAGFVPFPVNGMYCVPIYRDKFTVVVPENHPLAANSTVTVEELMDEPLIVSKGRYELSIMALFKEKGIEPIFKYEFNHPDTALNFIRQGLGIALLPELTLKATTGKLCSVALEPTFYRQISLLAKEPPVEGSPLFLLQKCMETLTDEGLL

SEQ ID NO: 2432 - DNA, 879 bp, Salmonella typhimurium LT2
  CDS (1)..(879): transl_table=11
atgacactaacccaaatccacgccctgcttgccgtactggagtacggcggatttaccgaggccagcaaacggctatacatgacgcaatccgccgtcagccaggccatctccgcgcttgaggaggagctcggcgttgacatattgattcgtgagcgtcgtaaagagatcgagcttaccgccgccggtagccgcatcgtcaggcacttacgcgcgatccagcgcgacgtcaacgcggtaaaagagattgccgaacaagaaaaaaagaacccggcccgtacgctacggattggctgttttcccagcgcctgcgcctgcattttacccggcgtcattcgctattttgaaagccatcatccaaatgtaaaaattatcccttatgaagagaacagtacggctattattgattcgctgcaggacggaagtattgatgccggtttcgttccttttccggtcaacggtatgtattgcgtccccatttaccgggataaattcaccgtagtggtgcctgaaaatcatcccctggcggccaatagtacggtaacggtcgaagaactgatggacgaaccacttattgtcagtaaaggtcgttatgaattaagcattatggcgttgtttaaagaaaagggtattgagccgatatttaaatatgaatttaaccatcccgatactgcgctgaattttattcgccagggattaggtatcgccttattgccagaattaaccttaaaagccacgacaggaaaattatgctccgtggcgctggaacccaccttttatcgacaaatttccctgttagcaaaagaaccgccggtagaaggaagtccgctatttttattacaaaaatgtatggaaacactgaccgatgaggggttgctataa

SEQ ID NO: 2433 - protein, 292 aa, Salmonella typhimurium LT2
MTLTQIHALLAVLEYGGFTEASKRLYMTQSAVSQAISALEEELGVDILIRERRKEIELTAAGSRIVRHLRAIQRDVNAVKEIAEQEKKNPARTLRIGCFPSACACILPGVIRYFESHHPNVKIIPYEENSTAIIDSLQDGSIDAGFVPFPVNGMYCVPIYRDKFTVVVPENHPLAANSTVTVEELMDEPLIVSKGRYELSIMALFKEKGIEPIFKYEFNHPDTALNFIRQGLGIALLPELTLKATTGKLCSVALEPTFYRQISLLAKEPPVEGSPLFLLQKCMETLTDEGLL

SEQ ID NO: 2434 - DNA, 207 bp, Shigella flexneri 2a str. 301
  CDS (1)..(207): transl_table=11
atgaattttattcgacagggattaggcatcgccttacaaccagagttaacgctgaaaagcattgcaggtgaattgtgttccgttcctcacgaaccaaccttctatcgacagatttcgttgctgactaaagaaaagccggtagaaggcagtccactgtttttactacaaatgtgcatggaacaattagtggcgattggaaaaatttga

SEQ ID NO: 2435 - protein, 68 aa, Shigella flexneri 2a str. 301
MNFIRQGLGIALQPELTLKSIAGELCSVPHEPTFYRQISLLTKEKPVEGSPLFLLQMCMEQLVAIGKI

SEQ ID NO: 2436 - DNA, 879 bp, Salmonella enterica subsp. enterica serovar Choleraesuis str
  CDS (1)..(879): transl_table=11
atgacactaacccaaatccacgccctgcttgccgtattggagtacggcggatttaccgaggccagcaaacggctatacatgacgcaatccgccgtcagccaggccatctccgcgcttgaggaggagctcggcgttgacatattgattcgtgagcgtcgtaaagagattgagcttaccgccgccggtagccgcatcgtcaggcacttacgcgcgatccagcgcgacgtcaacgcggtaaaagagattgccgaacaagaaaaaaagaacccggcccgtacgctacggattggctgttttcccagcgcctgcgcctgcattttacccggcgtcattcgctattttgaaagccatcatccaaatgtaaaaattatcccctatgaagagaacagtacggctattattgattcgctgcaggacggaagtattgatgccggtttcgttccttttccggtcaacggtatgtattgcgtccccatttaccgggataaattcaccgtagtggtgcctgaaaatcatcccctggcggccaatagtacagtaacggtcgaagaactgatggacgaaccacttattgtcagtaaaggtcgttatgaattaagcattatggcgttgtttaaagaaaagggtattgagccgatatttaaatatgaatttaaccatcccgatactgcgctgaattttattcgccagggattaggtatcgccttattgccagaattaaccttaaaagccacgacaggaaaattatgctccgtggcgctggaacccaccttttatcgacaaatttccctgttagcaaaaaaaccgccggtagaaggaagtccgctatttttattacaaaaatgtatggaaacactgaccgatgaggggttgctataa

SEQ ID NO: 2437 - protein, 292 aa, Salmonella enterica subsp. enterica serovar Choleraesuis str
MTLTQIHALLAVLEYGGFTEASKRLYMTQSAVSQAISALEEELGVDILIRERRKEIELTAAGSRIVRHLRAIQRDVNAVKEIAEQEKKNPARTLRIGCFPSACACILPGVIRYFESHHPNVKIIPYEENSTAIIDSLQDGSIDAGFVPFPVNGMYCVPIYRDKFTVVVPENHPLAANSTVTVEELMDEPLIVSKGRYELSIMALFKEKGIEPIFKYEFNHPDTALNFIRQGLGIALLPELTLKATTGKLCSVALEPTFYRQISLLAKKPPVEGSPLFLLQKCMETLTDEGLL

SEQ ID NO: 2438 - DNA, 654 bp, Shigella dysenteriae Sd197
  CDS (1)..(654): transl_table=11
gtgaacgctgtgaaagaaattgccgagcaggaaaaacataacccgaccagaacgctgcgcatcggctgctttcccagcgcctgcgcgtgtattttaccgggtattattcgctattttgaaacttatcatccgcagataaaaatcattccttacgaagagaacagcagtgaaattattgattcggtgcaaaacgaaactatcgatgccggttttgtccattttccggtgaccggaatgtattccgtcccggtatatcaggataaatttaccgtggtgctgccagatgctcatcccctggcaaaaaataacgctatatcggtggaagaactggtgggagaaccgctcattatcagtaaggggcgttatgaattaagcattatggcgttatttaaggaaaagaatattacgccggtcattaaatatgaatttaaccatccagatacggcaataagttttattcgccagggattaggaattgctctgttaccggagctgacgctgaaagccgtcgccggtgagttatgctctgtcccgctggagccgacgttttatcgacaaatttcattgctggtcaaagaggcgccggtagaaggcagcccattgtttttattgcaaatgtgtatggaaaccctggtggtcaaaggcatattgtga

SEQ ID NO: 2439 - protein, 217 aa, Shigella dysenteriae Sd197
MNAVKEIAEQEKHNPTRTLRIGCFPSACACILPGIIRYFETYHPQIKIIPYEENSSEIIDSVQNETIDAGFVHFPVTGMYSVPVYQDKFTVVLPDAHPLAKNNAISVEELVGEPLIISKGRYELSIMALFKEKNITPVIKYEFNHPDTAISFIRQGLGIALLPELTLKAVAGELCSVPLEPTFYRQISLLVKEAPVEGSPLFLLQMCMETLVVKGIL

SEQ ID NO: 2440 - DNA, 207 bp, Escherichia coli E24377A
  CDS (1)..(207)
atgaattttattcgacagggattaggcatcgccttacaaccagagttaacgctgaaaagcattgcaggtgaattgtgttccgttcctctcgaaccaactttctatcgacagatttcgttgctggctaaagaaaagccggtagaaggcagtccactgtttttactacaaacgtgtacggaacaactcgtggtgaatggaaaaatttga

SEQ ID NO: 2441 - protein, 68 aa, Escherichia coli E24377A
MNFIRQGLGIALQPELTLKSIAGELCSVPLEPTFYRQISLLAKEKPVEGSPLFLLQTCTEQLVVNGKI

SEQ ID NO: 2442 - DNA, 207 bp, Escherichia coli E22
  CDS (1)..(207)
atgaagtttattcgacagggattaggcatcgccttacaaccagagttaacgctgaaaagcattgcaggtgaattgtgttccgttcctcacgaaccaaccttctatcgacagatttcgttgttggctaaagaaaagccggtagaaggcagtccactgtttttactacaaacgtgtacggaacaactcgtggtgaatggaaaaatttga

SEQ ID NO: 2443 - protein, 68 aa, Escherichia coli E22
MKFIRQGLGIALQPELTLKSIAGELCSVPHEPTFYRQISLLAKEKPVEGSPLFLLQTCTEQLVVNGKI

SEQ ID NO: 2444 - DNA, 26 bp, Artificial sequence
  primer
atgaattttattcgacagggattagg

SEQ ID NO: 2445 - DNA, 28 bp, Artificial sequence
  primer
ttaaatttttccaatcgccactaattgt

SEQ ID NO: 2446 - protein, 64 aa, Artificial sequence
  consensus sequence
  Variant (11)..(11): Xaa in position 11 is any amino acid
  Variant (18)..(20): Xaa in position 18 to 20 is any amino acid
  Variant (22)..(22): Xaa in position 22 is any amino acid
  Variant (27)..(28): Xaa in position 27 to 28 is any amino acid
  Variant (40)..(40): Xaa in position 40 is any amino acid
  Variant (43)..(43): Xaa in position 43 is any amino acid
  Variant (55)..(55): Xaa in position 55 is any amino acid
  Variant (57)..(57): Xaa in position 57 is any amino acid
  Variant (59)..(59): Xaa in position 59 is any amino acid
  Variant (61)..(63): Xaa in position 61 to 63 is any amino acid
FIRQGLGIALXPELTLKXXXGXLCSVXXEPTFYRQISLLXKEXPVEGSPLFLLQXCXEXLXXXG

SEQ ID NO: 2447 - protein, 58 aa, Artificial sequence
  protein pattern
  Variant (10)..(10): Xaa in position 10 is any amino acid
  Variant (17)..(17): Xaa in position 17 is Ala or Ser
  Variant (18)..(18): Xaa in position 18 is any amino acid
  Variant (19)..(19): Xaa in position 19 is Ala or Thr
  Variant (21)..(21): Xaa in position 21 is Glu or Lys
  Variant (26)..(26): Xaa in position 26 is Ala or Pro
  Variant (27)..(27): Xaa in position 27 is any amino acid
  Variant (39)..(39): Xaa in position 39 is Ala, Thr or Val
  Variant (41)..(41): Xaa in position 41 is Glu or Lys
  Variant (42)..(42): Xaa in position 42 is any amino acid
  Variant (54)..(54): Xaa in position 54 is any amino acid
  Variant (56)..(56): Xaa in position 56 is any amino acid
  Variant (58)..(58): Xaa in position 58 is Gln or Thr
IRQGLGIALXPELTLKXXXGXLCSVXXEPTFYRQISLLXKXXPVEGSPLFLLQXCXEX

SEQ ID NO: 2448 - protein, 28 aa, Artificial sequence
  protein pattern
  Variant (2)..(2): Xaa in position 2 is any amino acid
  Variant (3)..(4): Xaa in position 3 to 4 is any or no amino acid
  Variant (6)..(7): Xaa in position 6 to 7 is any amino acid
  Variant (8)..(9): Xaa in position 8 to 9 is any or no amino acid
  Variant (11)..(11): Xaa in position 11 is Asp or Ser
  Variant (12)..(12): Xaa in position 12 is any amino acid
  Variant (14)..(14): Xaa in position 14 is Ala, Gln or Thr
  Variant (15)..(15): Xaa in position 15 is any amino acid
  Variant (16)..(16): Xaa in position 16 is Glu or Gly
  Variant (17)..(17): Xaa in position 17 is any amino acid
  Variant (18)..(18): Xaa in position 18 is Ile or Pro
  Variant (19)..(19): Xaa in position 19 is Asp or Val
  Variant (20)..(20): Xaa in position 20 is Ala or Glu
  Variant (22)..(22): Xaa in position 22 is any amino acid
  Variant (23)..(23): Xaa in position 23 is Pro or Val
  Variant (24)..(24): Xaa in position 24 is any amino acid
  Variant (26)..(26): Xaa in position 26 is Leu or Pro
  Variant (27)..(27): Xaa in position 27 is Leu or Val
  Variant (28)..(28): Xaa in position 28 is Asn, Gln or Ser
EXXXTXXXXIXXLXXXXXXXGXXXFXXX

SEQ ID NO: 2449 - protein, 8 aa, Artificial sequence
  protein pattern
  Variant (2)..(2): Xaa in position 2 is Ile or Pro
  Variant (3)..(3): Xaa in position 3 is Arg or Ser
  Variant (4)..(4): Xaa in position 4 is Ala or Gln
  Variant (5)..(5): Xaa in position 5 is Cys or Gly
  Variant (6)..(6): Xaa in position 6 is Ala or Leu
  Variant (7)..(7): Xaa in position 7 is Cys or Gly
FXXXXXXI

SEQ ID NO: 2450 - protein, 12 aa, Artificial sequence
  protein pattern
  Variant (2)..(2): Xaa in position 2 is any amino acid
  Variant (3)..(3): Xaa in position 3 is Glu or Gly
  Variant (5)..(5): Xaa in position 5 is Gly or Ser
  Variant (7)..(7): Xaa in position 7 is any or no amino acid
  Variant (10)..(11): Xaa in position 10 to 11 is any amino acid
RXXLXIXALXXE

SEQ ID NO: 2451 - protein, 28 aa, Artificial sequence
  protein pattern
  Variant (2)..(3): Xaa in position 2 to 3 is any amino acid
  Variant (4)..(4): Xaa in position 4 is any or no amino acid
  Variant (6)..(9): Xaa in position 6 to 9 is any or no amino acid
  Variant (11)..(11): Xaa in position 11 is Ile or Val
  Variant (12)..(12): Xaa in position 12 is Ala, Asp or Asn
  Variant (13)..(13): Xaa in position 13 is Ile or Leu
  Variant (14)..(14): Xaa in position 14 is any amino acid
  Variant (15)..(15): Xaa in position 15 is Ile, Leu or Pro
  Variant (16)..(16): Xaa in position 16 is Glu or Arg
  Variant (17)..(19): Xaa in position 17 to 19 is any amino acid
  Variant (21)..(21): Xaa in position 21 is Ala, Glu or Ser
  Variant (23)..(23): Xaa in position 23 is Ala, Glu or Gln
  Variant (24)..(24): Xaa in position 24 is Gly or Leu
  Variant (25)..(25): Xaa in position 25 is Glu or Thr
  Variant (26)..(26): Xaa in position 26 is any amino acid
  Variant (27)..(27): Xaa in position 27 is Ala or Cys
  Variant (28)..(28): Xaa in position 28 is Gly or Ser
IXXXLXXXXGXXXXXXXXXKXIXXXXXX

SEQ ID NO: 2452 - DNA, 783 bp, Escherichia coli K12
  CDS (1)..(783): transl_table=11
atgaagaagtcgattctcgctctgtctttgttagtcggtctctccacagcggcttccagctatgcggcgctaccggagacggtacgtatcggaaccgataccacctacgcaccgttctcatcgaaagatgctaaaggtgattttgttggctttgatatcgatctcggtaacgagatgtgcaaacggatgcaggtgaaatgtacctgggttgccagtgactttgacgcgctgatcccctcactgaaagcgaaaaaaatcgacgctattatttcgtcgctttccattaccgataaacgtcagcaggagattgccttctccgacaagctgtacgccgcagattctcgtttgattgcggccaaaggttcaccgattcagccaacgctggattcactgaaaggtaaacatgttggtgtgctgcagggatcaacccaggaagcttacgctaacgagacctggcgtagtaaaggcgtggatgtggtggcctatgccaaccaggatttggtctattccgatctggctgcaggacgtctggatgctgcgttacaagatgaagttgctgccagcgaaggattcctcaagcaacctgctggtaaagatttcgcctttgctggctcatcagtaaaagacaaaaaatacttcggtgatggcaccggtgtagggctacgtaaagatgatgctgaactgacggctgccttcaataaggcgcttggcgagctgcgtcaggacggcacctacgacaagatggcgaaaaagtatttcgactttaatgtctacggtgactaa

SEQ ID NO: 2453 - protein, 260 aa, Escherichia coli K12
MKKSILALSLLVGLSTAASSYAALPETVRIGTDTTYAPFSSKDAKGDFVGFDIDLGNEMCKRMQVKCTWVASDFDALIPSLKAKKIDAIISSLSITDKRQQEIAFSDKLYAADSRLIAAKGSPIQPTLDSLKGKHVGVLQGSTQEAYANETWRSKGVDVVAYANQDLVYSDLAAGRLDAALQDEVAASEGFLKQPAGKDFAFAGSSVKDKKYFGDGTGVGLRKDDAELTAAFNKALGELRQDGTYDKMAKKYFDFNVYGD

SEQ ID NO: 2454 - DNA, 786 bp, Pseudomonas aeruginosa PAO1
  CDS (1)..(786): transl_table=11
atgacaagaaccctcggcagcatcgccctctccctcctcctcgccgcaccggccggcgccgccgactggacaggcaaggtcctgcgcctgggcgtcgacccgacctacccgccgctcgaatacaagcagccggacggccgcctggcaggcttcggcatcgagatcggcgaagccctctgcgcggagctgcgagcccgctgcgaatgggtcgaaagcaactgggacggcatcatcccggcgctgctgtcgcgcaagatcgacgccatcgtctcgtcgatgaccatcacgccgaaacgcgcacagcacatcgccttcaccgaccgcgtctccaacgcgccgagccgcctggtggtacgccgtggctcggcgctcctgcccgacgccgagagcctgcgcggcaagcgcgtgggggtcggccagggctccaaccaggaggcctacgccaaggccgaatgggccgccaagggggtgcgggtcgtctcctaccagaaccaggaccaggtctacgccgacctcgtcatgggccgcctcgacgcctcgctgcaaggcgcggtgcaggccagctacggcttcctcgacaagccggtcggcaaggatttcgaactggccggagcggtgctggacgaccctcgctacttcggggtcggcgacggcatcggcctgcgcaaggaggacgtggcgctgcgcgaggacctgaacaaggcgctggcgacgatccgcgccaacggaacctacgcgcgaatcaacgcccgctacttcgacttcgacctctacggcacgccctga

SEQ ID NO: 2455 - protein, 261 aa, Pseudomonas aeruginosa PAO1
MTRTLGSIALSLLLAAPAGAADWTGKVLRLGVDPTYPPLEYKQPDGRLAGFGIEIGEALCAELRARCEWVESNWDGIIPALLSRKIDAIVSSMTITPKRAQHIAFTDRVSNAPSRLVVRRGSALLPDAESLRGKRVGVGQGSNQEAYAKAEWAAKGVRVVSYQNQDQVYADLVMGRLDASLQGAVQASYGFLDKPVGKDFELAGAVLDDPRYFGVGDGIGLRKEDVALREDLNKALATIRANGTYARINARYFDFDLYGTP

SEQ ID NO: 2456 - DNA, 789 bp, Yersinia pestis CO92
  CDS (1)..(789): transl_table=11
atgtttatgaataaaaagctgcgagttcttcctttggtattcgcattcgctgcggctagtagtgcttttgccgccattccaaaagagatcaaaattggcacagatccgacttacgccccttttgaatcgaaaaactcgagtggtgaattagtgggttttgatatcgatatcgcgaaggagttatgcaaacgtatagataccaaatgtacttttgttgaaagtgactttgatgcgctaatcccgtcgctgaaagcgaaaaaagtcgatgccattatctcctctctctccattactgaaaaacgccaaaaagagattgccttcaccgataaactctttgccgccaattcccgtttaattgctgctaaaggtagcactattgagccgacactggtggcattaaaaggtaagcgcgtgggggtgttacaagggtcgactcaggaagcttttgccaatgctgagtggcagccaaaaggcattgatgttgttgcttatcaaaatcaggatctgatttatgcagatctggcctctggccgtattgatgcggctttccaggatgaagtggccgccagtgaaggtttcctaaaacaacctgtgggtaaagattatatctttgccggtccatcagtaaaaaatgatcaattcttcggtgtagggactggcatggggttgcgcaaagccgatgttgagctgaaagaggcgttaaataaagcgtttgctgaaatgcgtaatgacggcacctacgatcaatttgccaaaaaatacttcgattttgatgtttacggtgattaa

SEQ ID NO: 2457 - protein, 262 aa, Yersinia pestis CO92
MFMNKKLRVLPLVFAFAAASSAFAAIPKEIKIGTDPTYAPFESKNSSGELVGFDIDIAKELCKRIDTKCTFVESDFDALIPSLKAKKVDAIISSLSITEKRQKEIAFTDKLFAANSRLIAAKGSTIEPTLVALKGKRVGVLQGSTQEAFANAEWQPKGIDVVAYQNQDLIYADLASGRIDAAFQDEVAASEGFLKQPVGKDYIFAGPSVKNDQFFGVGTGMGLRKADVELKEALNKAFAEMRNDGTYDQFAKKYFDFDVYGD

SEQ ID NO: 2458 - DNA, 1056 bp, Yersinia pestis KIM
  CDS (1)..(1056): transl_table=11
ttgcgtgcaggaaggtggcaaccaagcgaatcttcagggccttatagaaggcaagtgactgcgggtgaacgaaggcggtcagcacaggcaatttgcagcatgacgggtatatcgattttagtcgttatcgtgcaaagaaacagtagggtggaattgattttccctccagataattactggcacgattactgcaaattgatttatggacgctcaggcttggacagaaatctaacgcgctttgtggcatcaaaaatcaatttgagggttatgtttatgaataaaaagctgcgagttcttcctttggtattcgcattcgctgcggctagtagtgcttttgccgccattccaaaagagatcaaaattggcacagatccgacttacgccccttttgaatcgaaaaactcgagtggtgaattagtgggttttgatatcgatatcgcgaaggagttatgcaaacgtatagataccaaatgtacttttgttgaaagtgactttgatgcgctaatcccgtcgctgaaagcgaaaaaagtcgatgccattatctcctctctctccattactgaaaaacgccaaaaagagattgccttcaccgataaactctttgccgccaattcccgtttaattgctgctaaaggtagcactattgagccgacactggtggcattaaaaggtaagcgcgtgggggtgttacaagggtcgactcaggaagcttttgccaatgctgagtggcagccaaaaggcattgatgttgttgcttatcaaaatcaggatctgatttatgcagatctggcctctggccgtattgatgcggctttccaggatgaagtggccgccagtgaaggtttcctaaaacaacctgtgggtaaagattatatctttgccggtccatcagtaaaaaatgatcaattcttcggtgtagggactggcatggggttgcgcaaagccgatgttgagctgaaagaggcgttaaataaagcgtttgctgaaatgcgtaatgacggcacctacgatcaatttgccaaaaaatacttcgattttgatgtttacggtgattaa

SEQ ID NO: 2459 - protein, 351 aa, Yersinia pestis KIM
MRAGRWQPSESSGPYRRQVTAGERRRSAQAICSMTGISILVVIVQRNSRVELIFPPDNYWHDYCKLIYGRSGLDRNLTRFVASKINLRVMFMNKKLRVLPLVFAFAAASSAFAAIPKEIKIGTDPTYAPFESKNSSGELVGFDIDIAKELCKRIDTKCTFVESDFDALIPSLKAKKVDAIISSLSITEKRQKEIAFTDKLFAANSRLIAAKGSTIEPTLVALKGKRVGVLQGSTQEAFANAEWQPKGIDVVAYQNQDLIYADLASGRIDAAFQDEVAASEGFLKQPVGKDYIFAGPSVKNDQFFGVGTGMGLRKADVELKEALNKAFAEMRNDGTYDQFAKKYFDFDVYGD

SEQ ID NO: 2460 - DNA, 795 bp, Shigella flexneri 2a str. 301
  CDS (1)..(795): transl_table=11
atgaaaaaactggtgctatcgctctctctggttctggccttctccagcgcaactgcggcacttgctgcaattccgcaaaacatccgcatcggtaccgacccgacctatgcgccatttgaatcaaaaaattcacaaggcgaactggttggtttcgatatcgagctggcgaaggagttgtgcaagcgcatcaatacgcaatgtacgtttgtcgaaaacccgctggatgcgttaatcccgtccttaaaagcgaagaagattgacgccatcatgtcatcgctttccattacggaaaaacgtcagcaagaaattgccttcaccgacaaactgtacgctgccgattctcgtctggtggtggcgaaaaattctgacattcagccgacagtcgagtcgctgaaaggcaaacgggtaggcgtattgcagggcaccacccaggagacgttcggtaatgaacactgggcaccaaaaggcattgaaatcgtctcgtatcaggggcaggacaacatttattctgacctgactgccggacgtattgatgccgcgttccaggatgaggtcgctgccagcgaaggtttcctcaaacaacccgtcggtaaagattacaaattcggtggtccgtctgttaaagatgaaaaactgtttggcgtagggaccggcatgggcctgcgtaaagaagataacgaactgcgcgaggcactgaacaaagcctttgccgaaatgcgcgctgacggtacttacgagaaattagcgaaaaatacttcgattttgatgtttatggtggttaatcgccatcggtga

SEQ ID NO: 2461 - protein, 264 aa, Shigella flexneri 2a str. 301
MKKLVLSLSLVLAFSSATAALAAIPQNIRIGTDPTYAPFESKNSQGELVGFDIELAKELCKRINTQCTFVENPLDALIPSLKAKKIDAIMSSLSITEKRQQEIAFTDKLYAADSRLVVAKNSDIQPTVESLKGKRVGVLQGTTQETFGNEHWAPKGIEIVSYQGQDNIYSDLTAGRIDAAFQDEVAASEGFLKQPVGKDYKFGGPSVKDEKLFGVGTGMGLRKEDNELREALNKAFAEMRADGTYEKLAKNTSILMFMVVNRHR

SEQ ID NO: 2462 - DNA, 783 bp, Pseudomonas syringae pv. tomato str. DC3000
  CDS (1)..(783): transl_table=11
atgaaaaaagcatggctgactctttccgcactggctctgtgcatcgccgccggtaatacgatggccaaggaatacaaggaactgcgcttcggcgtcgatccatcctatgcaccgtttgaatccaaagccgccgacggcagcctggtgggtttcgatatcgacttgggcaacgcgatctgcaaagagctgaaagtcacctgcaaatgggttgaaagcgatttcgacggcatgatccccggcctcaaggcgcgtaaattcgacggcgtgatctcctcgatgaccgtgaccccggctcgcgaaaaagtcatcgacttctccaacgagctgttctccggcccgacgtcgctggtgttcaagaaaggtgcaggctttaccgctgacccggccagcctgaaaggcaagaccgtgggctacgagcaaggcaccatccaggaagcctacgccaaggccgtgctggacaagtccggcgtgaccaccaaggcctacgccaaccaggatcaggtttacgccgacctgacctccggtcgtctggacgcctcgatccaggacatgctgcaagccgaactgggcttcctgaaatcgccagccggtgccgactacgaagtcagcaagcctatcgacagcgaactgctgccagcgaaaaccgccatcggtatcgcgcagggcaacaaagagctgaaagcgctgctggataaaggcatcaaggccatgcacgatgacggcacctacgctgaaatccagaaaaaacactttggcgacctgaacctgtacagcggcaaataa

SEQ ID NO: 2463 - protein, 260 aa, Pseudomonas syringae pv. tomato str. DC3000
MKKAWLTLSALALCIAAGNTMAKEYKELRFGVDPSYAPFESKAADGSLVGFDIDLGNAICKELKVTCKWVESDFDGMIPGLKARKFDGVISSMTVTPAREKVIDFSNELFSGPTSLVFKKGAGFTADPASLKGKTVGYEQGTIQEAYAKAVLDKSGVTTKAYANQDQVYADLTSGRLDASIQDMLQAELGFLKSPAGADYEVSKPIDSELLPAKTAIGIAQGNKELKALLDKGIKAMHDDGTYAEIQKKHFGDLNLYSGK

SEQ ID NO: 2464 - DNA, 783 bp, Salmonella enterica subsp. enterica serovar Typhi Ty2
  CDS (1)..(783): transl_table=11
atgaaaaaactggcgttatccctttctctggtgctggcattttccagcgctaccgcagcatttgccgctattccacaaaagattcgcatcggtaccgatcctacatacgcaccgtttgaatccaaaaatgcacaaggtgaattggtcggctttgatatcgatctggccaaagaactgtgcaaccgtatcaacacacagtgtacgttcgtggaaaacccgctggatgcgctgattccgtctttaaaagcgaagaaaattgatgccatcatgtcctcgctgtccatcactgaaaagcgccagcaggaaatcgcgtttaccgacaagctttacgccgctgattcccgtctggtggtggcgaagaactctgatattcagccgaccgtcgcgtcgctgaaaggcaagcgcgtcggcgtgctacaggggacgacgcaggagaccttcggcaatgagcactgggcgccgaaagggattgagatcgtctcttaccaggggcaggacaacatttattccgacctgacggctggccgtattgatgcggcgttccaggacgaggtcgcggccagcgaaggtttccttaaacagcccatcggaaaagactataaattcggcggcccggcggtgaaagatgagaagttattcggcgtaggaaccggtatggggctgcgcaaagaggataacgagctgcgcgaagcgctgaacaaagcctttgctgaaatgcgtgctgacggtacttacgaaaagttggcgaaaaagtactttgattttgatgtttatggcggttaa

SEQ ID NO: 2465 - protein, 260 aa, Salmonella enterica subsp. enterica serovar Typhi Ty2
MKKLALSLSLVLAFSSATAAFAAIPQKIRIGTDPTYAPFESKNAQGELVGFDIDLAKELCNRINTQCTFVENPLDALIPSLKAKKIDAIMSSLSITEKRQQEIAFTDKLYAADSRLVVAKNSDIQPTVASLKGKRVGVLQGTTQETFGNEHWAPKGIEIVSYQGQDNIYSDLTAGRIDAAFQDEVAASEGFLKQPIGKDYKFGGPAVKDEKLFGVGTGMGLRKEDNELREALNKAFAEMRADGTYEKLAKKYFDFDVYGG

SEQ ID NO: 2466 - DNA, 780 bp, Chromobacterium violaceum ATCC 12472
  CDS (1)..(780): transl_table=11
atgaagaaagcacttgctgcgctggccgtaggcctgatggccgcatctctgggggcttacgccaaggactggaaggaaatccgcttcggcgtcgacgccagctacgcgccgttcgagtacaaggcgccgaacggccaggtggtgggcttcgacatcgatctgggcaacgaaatctgcaaacgcatgaaagccaagtgcgtgtgggtggaaaacgatttcgacggcatgatcccggcgctgaaggccaagaagttcgacggcgtgctgtcgtcgatgtcgatgaccgaggcccggatgaaggaaatcgccttctccgccaagctgttcaacactccgacccgcatggtcgccaaggccggttccggcctgatgccgaccccggcctcgctgaagggcaagcgcgtgggcgtggagcagggcaccatccaggaagcctacgccaagaagcactgggcgccggcaggcgtggaagtggtcccctaccagaaccagaccctggtgctggccgacctgaccgcgggccgcctggacgcgtccttgcaggacgcggtgcaggccgacatcggcttcctgaagaagcctgagggcaagggcttcgccttcgccggcaaggacctggtcgacccgcagaccctgggcgaaggcgccggcatcggcctgcgcaaggaagacaaggacctgaaggccggcatcgacaaggcgatcgccgacatgctgaaggacggcacctacaagaagattgagaagaaatacttcaccttcgacgtgtacggcggctga

SEQ ID NO: 2467 - protein, 259 aa, Chromobacterium violaceum ATCC 12472
MKKALAALAVGLMAASLGAYAKDWKEIRFGVDASYAPFEYKAPNGQVVGFDIDLGNEICKRMKAKCVWVENDFDGMIPALKAKKFDGVLSSMSMTEARMKEIAFSAKLFNTPTRMVAKAGSGLMPTPASLKGKRVGVEQGTIQEAYAKKHWAPAGVEVVPYQNQTLVLADLTAGRLDASLQDAVQADIGFLKKPEGKGFAFAGKDLVDPQTLGEGAGIGLRKEDKDLKAGIDKAIADMLKDGTYKKIEKKYFTFDVYGG

SEQ ID NO: 2468 - DNA, 780 bp, Erwinia carotovora subsp. atroseptica SCRI1043
  CDS (1)..(780): transl_table=11
atgaagaaactgatcaaagttttgccgttggcacttattctggctgcaggcagcgccatggcggaaattcctaaaaatattaaaatcggcaccgatcctacctatgctccctttgaatctaaaaatgccagcggtgaactggttgggtttgatatcgatctggcgaaagagctgtgcaagcgtattcaggctaattgtacgtttgtagaaagcgactttgatgcgttaattccttctcttaaagctaaaaaaattgatgccatcatctcttctctgtccattaccgaaaaacgtcagcaggaaatcgccttcactgagaagctgtatgctgccaatgcacgcctgattgcgaagaaaggcgcgagcatcgagccaacgctggcttctctgggtggtaagcgtgtcggcgtactgcaggcatcaacgcaggaggcttttgccaacgcgaactggcagccaaaaggtgttgaagttgtcgcttatcaaaatcaggatctgatttacgccgatctgagcgcaggtcgtatcgatgcggcatttcaggatgaagtagcaggaagtgaaggcttcctgaaactcgatatgggcaaagactatgcgtttgctggtccggcagtaaaagacgacaagttcttcggggttggtaccggtatgggtctgcgtaaagcggataccgaactgaaagcggcgctggataaagcttttgacgctatgcgtaaagacggtacttacgacactttcgcgaaaaaatacttcgattttgacgtctacggcggctaa

SEQ ID NO: 2469 - protein, 259 aa, Erwinia carotovora subsp. atroseptica SCRI1043
MKKLIKVLPLALILAAGSAMAEIPKNIKIGTDPTYAPFESKNASGELVGFDIDLAKELCKRIQANCTFVESDFDALIPSLKAKKIDAIISSLSITEKRQQEIAFTEKLYAANARLIAKKGASIEPTLASLGGKRVGVLQASTQEAFANANWQPKGVEVVAYQNQDLIYADLSAGRIDAAFQDEVAGSEGFLKLDMGKDYAFAGPAVKDDKFFGVGTGMGLRKADTELKAALDKAFDAMRKDGTYDTFAKKYFDFDVYGG

SEQ ID NO: 2470 - DNA, 783 bp, Yersinia pseudotuberculosis IP 32953
  CDS (1)..(783): transl_table=11
atgaataaaaagctgcgagttcttcctttggtattcgcattcgctgcggctagtagtgcttttgccgccattccaaaagagatcaaaattggcacagatccgacttacgccccttttgaatcgaaaaactcgagtggtgaattagtgggttttgatatcgatatcgcgaaggagttatgcaaacgtatagataccaaatgtacttttgttgaaagtgactttgatgcgctaatcccgtcgctgaaagcgaaaaaagtcgatgccattatctcctctctctccattactgaaaaacgccaaaaagagattgccttcaccgataaactctttgccgccaattcccgtttaattgctgctaaaggtagcactattgagccgacactggtggcattaaaaggtaagcgcgtgggggtgttacaagggtcgactcaggaagcttttgccaatgctgagtggcagccaaaaggcattgatgttgttgcttatcaaaatcaggatctgatttatgcagatctggcctctggccgtattgatgcggctttccaggatgaagtggccgccagtgaaggtttcctaaaacaacctgtgggtaaagattatatctttgccggtccatcagtaaaaaatgatcaattcttcggtgtagggactggcatggggttgcgcaaagccgatgttgagctgaaagaggcgttaaataaagcgtttgctgaaatgcgtaatgacggcacctacgatcaatttgccaaaaaatacttcgattttgatgtttacggtgattaa

SEQ ID NO: 2471 - protein, 260 aa, Yersinia pseudotuberculosis IP 32953
MNKKLRVLPLVFAFAAASSAFAAIPKEIKIGTDPTYAPFESKNSSGELVGFDIDIAKELCKRIDTKCTFVESDFDALIPSLKAKKVDAIISSLSITEKRQKEIAFTDKLFAANSRLIAAKGSTIEPTLVALKGKRVGVLQGSTQEAFANAEWQPKGIDVVAYQNQDLIYADLASGRIDAAFQDEVAASEGFLKQPVGKDYIFAGPSVKNDQFFGVGTGMGLRKADVELKEALNKAFAEMRNDGTYDQFAKKYFDFDVYGD

SEQ ID NO: 2472 - DNA, 777 bp, Burkholderia pseudomallei K96243
  CDS (1)..(777): transl_table=11
atgaagaagctcgccctgtgcgcggccctcgcccttgcggcgggcggcgccttcgcgaaggaatggaagaccgtgcggatcggcgtcgacgccagctatccgccgttcgaatcgaccgcgccgagcggcgagatcgtcggattcgacgtcgatctcgcgaaggaagtctgcaagcggatcaacgcgaagtgcacatggacgccgcaggatctcgacggcatcatccccgcgctgaaggcgaagaagttcgacgtgatcgtgtcgtcgctgaccgtcaccgacaagcgccgcgagcagatcgatttctccgacaagctgtacgacgcgcccgcgcgaatgatcgcgaaggcgggctcgccgctcgcgccgagcgtcgagtcgctcaagggcaagcgcgtcggcgtcgagcagggctcgacccaggaaaccttcgcgaaggcgcactgggagccgaagggcgtgacgatcgtgtcgtaccagaaccaggatcaggtgtatgccgatctcggctcggggcgtctcgatgcgacgctgcaagacgagttgcaggccgactacggcttcctgcgcacgccgcgcggcaagggcttcgcctgggcaggtccggccgtgaaggatccgcgcacgctcggcgacggcaccgcgatgggcctgcgcaaggaagacgcggacctgaaggacgcgatcaaccgcgcgctcgcttcgatgcacaaggacggcacgtacgacaggctctcgcgcaagtacttcccgtacagcgtgtattcggcgaagtaa

SEQ ID NO: 2473 - protein, 258 aa, Burkholderia pseudomallei K96243
MKKLALCAALALAAGGAFAKEWKTVRIGVDASYPPFESTAPSGEIVGFDVDLAKEVCKRINAKCTWTPQDLDGIIPALKAKKFDVIVSSLTVTDKRREQIDFSDKLYDAPARMIAKAGSPLAPSVESLKGKRVGVEQGSTQETFAKAHWEPKGVTIVSYQNQDQVYADLGSGRLDATLQDELQADYGFLRTPRGKGFAWAGPAVKDPRTLGDGTAMGLRKEDADLKDAINRALASMHKDGTYDRLSRKYFPYSVYSAK

SEQ ID NO: 2474 - DNA, 795 bp, Burkholderia pseudomallei K96243
  CDS (1)..(795): transl_table=11
atgaagttgaactggcggaagatggccgcgcacgcggtggtgacggccacggccctggcggcgggcagcgcgttcgccgccgacctgaaggaaatccgcttcggcgtcgaggcgtcgtatgcgccgttcgagtacaagacgccggacggcaagctggcgggcttcgacatcgacatcggcaacgcggtgtgcgcgaagctgaaggtcaagtgcgtgtgggtcgagaacgcgttcgacggcctgatcccggcgctgcaggcgcgcaagttcgacgcgatcaactccgacatgacgatcaccgagcaacgtcggaaggcaatcgatttcaccgacccgatctacacgatcccgaaccagctgatcgcgaagaagggcagcggcctgctgccgaccaccgcgtcgctgaagggcaagcgcatcggcgtgctgcagggcacgatccaggaagcgtacgcgaagaagcgctgggcgccggcgggcgtcgaagtcgtgccgtaccagacgcaggatctcgcctacgaagacctgaagtcgggccgcctcgacgcgaccttccaggattcggaggccggcgcgaagggcttcctgtcgaagccgcagggcgcgggtttcgcgttcgcgggcgaccacgtgagcgacgccgagatccttggcacgggcgtgggctttggcatgcgcaagaacgacgcgcagctgaagagcgcagtcaatcaggcgctcaaggaactgaaagccgacggcacgatcgacggcctcgcgaagaagtatttcagcgtgcccgtgacgctgaagtaa

SEQ ID NO: 2475 - protein, 264 aa, Burkholderia pseudomallei K96243
MKLNWRKMAAHAVVTATALAAGSAFAADLKEIRFGVEASYAPFEYKTPDGKLAGFDIDIGNAVCAKLKVKCVWVENAFDGLIPALQARKFDAINSDMTITEQRRKAIDFTDPIYTIPNQLIAKKGSGLLPTTASLKGKRIGVLQGTIQEAYAKKRWAPAGVEVVPYQTQDLAYEDLKSGRLDATFQDSEAGAKGFLSKPQGAGFAFAGDHVSDAEILGTGVGFGMRKNDAQLKSAVNQALKELKADGTIDGLAKKYFSVPVTLK

SEQ ID NO: 2476 - DNA, 783 bp, Burkholderia pseudomallei K96243
  CDS (1)..(783): transl_table=11
gtgaaaaaaatcttggcggctttgaccgtggccctgctggcggtgtcggcaggcggcgtgcaggcgaaggattggtcgacgatccgctttggcgtcgacgcgagctacccgcctttcgaatcgaaaggtccggacggcaaggtggtcggcttcgacgtcgacctcggcaacgaaatctgcaagcgcgtgaaggcaaagtgcgtgtggatcgagaacgacttcgacggcatgatcccggcgctgaaggcgcgcaagttcgacggcgtgctgtcgtcgatgtcgatgacgccgcagcgtgaagagcagatcgcgttctcgtcgaagctgttcaacacgccgacgcgcctcgtcacgaagaagggcgcgaacctgatgccgacggccgaatcgctcaagggcaagacggtcggcgtcgagcagggcacgatccaggaaacctacgcgaaggtgcactgggcgccgatgggcgtgaaggtgcaaccgtaccagaaccaggatcaggtctacgccgacctgatcgcgggccgcctcgacgcggcgctgcaggacgcggtgcaggccgacatcggcttcctgaagacgccgcgcggcaaggactacgcgttcgccggcaccgacctcaacgatccgaagacgctcggcgaaggcgcgggcatcggcctgcgcaaggaagacaccgatctgaaggcgaagatcgacaaggcgatcgccgacatgcacaaggacggcacgtacgacaagatcgcgaagaagtacttcgacttcgacgtctacggcaagtaa

SEQ ID NO: 2477 - protein, 260 aa, Burkholderia pseudomallei K96243
MKKILAALTVALLAVSAGGVQAKDWSTIRFGVDASYPPFESKGPDGKVVGFDVDLGNEICKRVKAKCVWIENDFDGMIPALKARKFDGVLSSMSMTPQREEQIAFSSKLFNTPTRLVTKKGANLMPTAESLKGKTVGVEQGTIQETYAKVHWAPMGVKVQPYQNQDQVYADLIAGRLDAALQDAVQADIGFLKTPRGKDYAFAGTDLNDPKTLGEGAGIGLRKEDTDLKAKIDKAIADMHKDGTYDKIAKKYFDFDVYGK

SEQ ID NO: 2478 - DNA, 783 bp, Pseudomonas syringae pv. syringae B728a
  CDS (1)..(783): transl_table=11
atgaaaaaagcatggctgactctttctgcactggctctgtgcatcgccgccggtaacaccatggccaaggaatacaaggaactgcgcttcggcgtcgatccatcttatgcaccgttcgaatccaaagcagccgacggcagcctggtcggcttcgatatcgatctgggcaacgcaatctgcaaagagctgaaagtcaaatgcaaatgggtcgaaagcgacttcgacggcatgatccccggcctcaaggcacgcaaattcgacggcgttatctcctcgatgaccgtgacccctgctcgcgaaaaagtcatctacttctccaacgagctgttctccggccccacctcgctggtgttcaagaaaggtgcaggctttactgccgacccggccagcctgaaaggcaagaccgtgggctatgagcaaggcaccatccaggaagcctacgccaaggcggtactggacaaggccggtatctccaccaaggcctatgccaaccaggatcaagtttactccgacctgacctcgggccgtctcgacgcctcgatccaggacatgctgcaggccgaactgggcttcctgaaatcgccagccggtgctgactacgaagtcagcaagcctatcgacagcgaactgctgccagccaaaaccgccatcggcattgcccagggcaacaaggaactcaaggcgttgctggacaaaggcatcgaggcgatgcacaaagacggcacctacgctgaaatccagaaaaaacactttggcgacctgaacctctacagcggtaaataa

SEQ ID NO: 2479 - protein, 260 aa, Pseudomonas syringae pv. syringae B728a
MKKAWLTLSALALCIAAGNTMAKEYKELRFGVDPSYAPFESKAADGSLVGFDIDLGNAICKELKVKCKWVESDFDGMIPGLKARKFDGVISSMTVTPAREKVIYFSNELFSGPTSLVFKKGAGFTADPASLKGKTVGYEQGTIQEAYAKAVLDKAGISTKAYANQDQVYSDLTSGRLDASIQDMLQAELGFLKSPAGADYEVSKPIDSELLPAKTAIGIAQGNKELKALLDKGIEAMHKDGTYAEIQKKHFGDLNLYSGK

SEQ ID NO: 2480 - DNA, 777 bp, Pseudomonas fluorescens Pf-5
  CDS (1)..(777): transl_table=11
atgaaaaaactccccctgatcagtggcctggccttgagcctgttggcgtgcagcagcctgttcgcggccgaaaagaccctgcgcctgggcatcgaggcggcgtacccgccatttgccttcaagaccgccgaaggcaagatcggtggtttcgactacgacatcggcaatgccctgtgcgcgcagatgcaggtcaagtgcgagtggatcgagggcgagttcgacggcctgattccttcgctgaaggtgaagaagatcgacgctgcgctgtcctccatgaccattaccgccgagcgccgcaaatccgtggatttcacccacaagtactacttcacgtcgtcgcgcctggtgatgaagaagggcgccgaggtggacgaccagtacgccagcctcaagggcaagaccgtgggcgtgcagcgctccaccaccaccgaccgctatgccacggaggtgttcgagcccaagggcatcaaggtggtgcgctacagcaacaacgaggagatctacatggacctggcggccgggcgcctggacgcgatctttgccgacagcattccgctggccgactttctgtcgatgccccggggggccgcctacgcctttgtcgggcctgagctcaaagatccgaagtacgtcggcgagggcgccgggattgccgtgcgcaagggcaacagtgaactggtgggcgagttgaacaaggccatcgaggatattcgggccaatggtgaatatcagaagatccaggccaagtacttcaagtcggatatctatggggattga

SEQ ID NO: 2481 - protein, 258 aa, Pseudomonas fluorescens Pf-5
MKKLPLISGLALSLLACSSLFAAEKTLRLGIEAAYPPFAFKTAEGKIGGFDYDIGNALCAQMQVKCEWIEGEFDGLIPSLKVKKIDAALSSMTITAERRKSVDFTHKYYFTSSRLVMKKGAEVDDQYASLKGKTVGVQRSTTTDRYATEVFEPKGIKVVRYSNNEEIYMDLAAGRLDAIFADSIPLADFLSMPRGAAYAFVGPELKDPKYVGEGAGIAVRKGNSELVGELNKAIEDIRANGEYQKIQAKYFKSDIYGD

SEQ ID NO: 2482 - DNA, 783 bp, Pseudomonas fluorescens Pf-5
  CDS (1)..(783): transl_table=11
atgaaaaaagcattgctgaccctttctgcattggctctctgcatggccgccggctccgcgctggccaaggaatacaaggaactgcgcttcggcgtcgacccttcctacgcccccttcgaatccaaggccgccgacggcagcctggtgggtttcgacatcgacctgggcaatgccatctgtgccgagctgaaggtcaagtgcaagtgggtcgaaagtgacttcgacggcatgattccaggcctcaaggccaataaattcgacggtgtgatctcgtccatgaccgtcaccccggctcgcgagaaagtcatcgacttctccaacgaactgttttccggccccaccgcattcgtgttcaagaaaggctcgggcctgagcgaagacaccgcctcgctcaagggcaagaccgtcggctacgagcagggcaccattcaggaagcctacgccaaggccgtgctggacaaggccggggtcaagacccaggcctatcagaaccaggaccaggtctatgccgacctgacttccgggcgcctcgatgcctcgatccaggacatgctgcaggccgaactgggcttcctcaagtcaccgcaaggcgctgactatgagatcagcaagccggtggacgacccgctgctgccggccaagaccgcagtgggtatctcgaaaggtaacaaagagctgaaagcgcttctggataaaggtatcaaagcgttacacgatgatggcacctacgccaccatccagaaaaaacacttcggtgacctgaacctctacagcggtaaataa

SEQ ID NO: 2483 - protein, 260 aa, Pseudomonas fluorescens Pf-5
MKKALLTLSALALCMAAGSALAKEYKELRFGVDPSYAPFESKAADGSLVGFDIDLGNAICAELKVKCKWVESDFDGMIPGLKANKFDGVISSMTVTPAREKVIDFSNELFSGPTAFVFKKGSGLSEDTASLKGKTVGYEQGTIQEAYAKAVLDKAGVKTQAYQNQDQVYADLTSGRLDASIQDMLQAELGFLKSPQGADYEISKPVDDPLLPAKTAVGISKGNKELKALLDKGIKALHDDGTYATIQKKHFGDLNLYSGK

SEQ ID NO: 2484 - DNA, 780 bp, Pseudomonas fluorescens Pf-5
  CDS (1)..(780): transl_table=11
atgaacaagtttgcgctgttcggtgccctggcactgtcgctgttttccttcaccgcttcggccgacgaggccaagccgatccgtatcggtatcgaagccggctacccgccgttctcgatgaagacccccgacggcaagctcaccggtttcgatgtcgacctgggcaacgccctgtgcgagcagatgcaggccaagtgcacctgggtcgagcaggagttcgacggcctgatcccggcgctgaaagtgaagaagatcgacgccatcctgtcgtccatgaccatcaccgacgaccgcaagaagaacgtcgatttcaccatcaagtactaccacaccccggcgcgcttcgtgatgaaggccggcaccagcatcaaggacccgctgaccgagctcaagggcaagaaggtcggtgtgctgcgggccagtacccatgaccgcttcgccaccgaagtgctggtgccggcgggtatcgacctggtgcgctatggctcccagcaggaagccaacctggacatggtctccggccgcgtcgacgcgctgctggcggattcggtgaacctcgacgatggcttcctgaaaaccgacgccggcaagggcttcgccttcgtgggccctgagtacaacgatccgaaatacttcggcggcggtgccggcattgccgtgcgcaagggggatcaggaactggccgggaaattcaacaaggccatcaccgagatccgtgccaacggcaagtacaagcaagtgcaggacaagtacttcgatttcgacgtctacggcgagtaa

SEQ ID NO: 2485 - protein, 259 aa, Pseudomonas fluorescens Pf-5
MNKFALFGALALSLFSFTASADEAKPIRIGIEAGYPPFSMKTPDGKLTGFDVDLGNALCEQMQAKCTWVEQEFDGLIPALKVKKIDAILSSMTITDDRKKNVDFTIKYYHTPARFVMKAGTSIKDPLTELKGKKVGVLRASTHDRFATEVLVPAGIDLVRYGSQQEANLDMVSGRVDALLADSVNLDDGFLKTDAGKGFAFVGPEYNDPKYFGGGAGIAVRKGDQELAGKFNKAITEIRANGKYKQVQDKYFDFDVYGE

SEQ ID NO: 2486 - DNA, 783 bp, Pseudomonas syringae pv. phaseolicola 1448A
  CDS (1)..(783): transl_table=11
atgaaaaaagcatggctgactctttctgcagtggctctgtgcctcgccgccggtaatacgatggccaaggaatacaaggaactgcgcttcggcgttgatccgtcctatgcgccgtttgaatccaaagccgccgacggcagcctggtcggcttcgatatcgatctgggcaacgcgatctgcaaagagctgaaggtcacctgcaaatgggttgaaagcgatttcgacggcatgattcccggcctcaaggcacgcaagttcgacggcgtgatttcctcgatgaccgtgacccctgctcgcgaaaaagtcatcgacttctccaacgaattgttttccggcccgacctcgctggtgttcaagaaaggtgcaggctttaccgccgacaaggccagcctgaaaggcaagaccgttggctatgagcaaggcactatccaggaagcctacgccaaggccgcactggacaaggccggtgtatccaccaaggcctacgccaaccaggatcaggtttacgccgacctgacttccggtcgtctggacgcctcgatccaggacatgctgcaagccgaactgggtttcctgaaatcgccagccggtgctgattacgaagtcagcaagcctatcgacagcgaattgctgccagccaaaaccgccatcggcatcgccaagggcaacaaggagctgaaagcgctgctggataaaggcatcaaagcaatgcacgacgacggcacctacgccgagatccagaaaaagcattttggcgacctgaacctgtacagcggcaaataa

SEQ ID NO: 2487 - protein, 260 aa, Pseudomonas syringae pv. phaseolicola 1448A
MKKAWLTLSAVALCLAAGNTMAKEYKELRFGVDPSYAPFESKAADGSLVGFDIDLGNAICKELKVTCKWVESDFDGMIPGLKARKFDGVISSMTVTPAREKVIDFSNELFSGPTSLVFKKGAGFTADKASLKGKTVGYEQGTIQEAYAKAALDKAGVSTKAYANQDQVYADLTSGRLDASIQDMLQAELGFLKSPAGADYEVSKPIDSELLPAKTAIGIAKGNKELKALLDKGIKAMHDDGTYAEIQKKHFGDLNLYSGK

SEQ ID NO: 2488 - DNA, 777 bp, Pseudomonas syringae pv. phaseolicola 1448A
  CDS (1)..(777): transl_table=11
atgaagaagctcatgcttattggcgcgatggcgttgtccgtgctcgcccagccgatctttgctgatgaaaaaccgctgaaaatcggcatcgaagcggcttaccctccgttcgcttccaaggctccggatggcagcatcgtcggttttgactacgacatcggcaatgcgctgtgtgaagaaatgaaggtcaagtgcacctgggtcgagcaggaattcgacggtcttatcccggcactgaaagtgcgcaagatcgacgcgatcctttcgtccatgtcgatcaccgacgaccgcaagaagtctgtggatttcaccggcaagtactacaattccccggcccgtctggtcatgaaagacggcaccgtgatcagcgacagcctggcggaactcaagggcaagaaaatcggcgtgcagcgcggttcgatccatgagcgtttcgcccgtgaagttcttgctcccaagggtgtggaagtgacgccgtacggttcgcagaacgaaatctacctggacatcggtgcgggtcgtctggacggcaccatcgccgacgccaccctgctgcaggacggtttcctgaagaccgacgcaggcaagggttacgcgttcacaggtccatcgtttaccgacccgaaatacttcggtgacggcatcggcatcgccgtgcgcaagggtgacaaggccaaccttgagcgcctgaatgccgccattgcagccatccgtgccaacggcaagtacaaagcgattcaggacaaatatttcgacttcgatatctacggcaagtaa

SEQ ID NO: 2489 - protein, 258 aa, Pseudomonas syringae pv. phaseolicola 1448A
MKKLMLIGAMALSVLAQPIFADEKPLKIGIEAAYPPFASKAPDGSIVGFDYDIGNALCEEMKVKCTWVEQEFDGLIPALKVRKIDAILSSMSITDDRKKSVDFTGKYYNSPARLVMKDGTVISDSLAELKGKKIGVQRGSIHERFAREVLAPKGVEVTPYGSQNEIYLDIGAGRLDGTIADATLLQDGFLKTDAGKGYAFTGPSFTDPKYFGDGIGIAVRKGDKANLERLNAAIAAIRANGKYKAIQDKYFDFDIYGK

SEQ ID NO: 2490 - DNA, 777 bp, Pseudomonas fluorescens PfO-1
  CDS (1)..(777): transl_table=11
atgaagaaattccccctcattaccggtctggcgctgagcctgttggcgtgcagcagcgcgttcgccgccgagaaaaccctgcgtatcggtatcgaagcggcgtatccgcccttcgcctcgaaaaccgacaagggtgaaatcgtcggttttgactacgacatcggcaatgccctgtgcgcgcaaatgcaggtcaagtgcgtgtgggtcgagggtgagttcgacggtctgattccttccctgaaagtgaagaaaatcgacatggcgctgtcgtccatgaccatcaatgaagaccgcaagaagtcggtggacttcacccacaagtactatttcacctcgtcgcggctggtgatgaaggagggcgcgagcgtcgatgaccagtacgccagcctcaagggcaaaaccgtcggcgtgcagcgtgcgaccaccaccgaccgttacgccaccgaggtgttcgagcccaagggcatcaacgtcaagcgttacggcaacaacgaagaaatctacatggacctggcggccgggcgtctcgatgcgatcttcgccgacaccatcccgttgaccgacttcctgtcgatgccgcgcggcaagggttacgcgtttgtcgggcctgagctgaaggatccgaagtacgtgggcgagggcgcggggattgcggtgcgcaagggcaacacagaactggtcagccagttgaacactgccatcgacggtattcgcgccagtggcgagtaccagaagatttccgagaagtacttcaagtccgatatctacggcgactga

SEQ ID NO: 2491 - protein, 258 aa, Pseudomonas fluorescens PfO-1
MKKFPLITGLALSLLACSSAFAAEKTLRIGIEAAYPPFASKTDKGEIVGFDYDIGNALCAQMQVKCVWVEGEFDGLIPSLKVKKIDMALSSMTINEDRKKSVDFTHKYYFTSSRLVMKEGASVDDQYASLKGKTVGVQRATTTDRYATEVFEPKGINVKRYGNNEEIYMDLAAGRLDAIFADTIPLTDFLSMPRGKGYAFVGPELKDPKYVGEGAGIAVRKGNTELVSQLNTAIDGIRASGEYQKISEKYFKSDIYGD

SEQ ID NO: 2492 - DNA, 783 bp, Pseudomonas fluorescens PfO-1
  CDS (1)..(783): transl_table=11
atgaaaaaagcattgctgaccctttctgcactggcgttgtgcatggccgccggctccgcgctggccaaggaatacaaagaactgcggtttggcgttgacccttcctacgcaccgttcgagtcgaaagcggcagacggcagcctggttggcttcgacatcgatctgggcaacgcgatctgcgccgagctgaaggtcaagtgcaaatgggtcgaaagtgacttcgacggtatgattccgggcctcaaggccaataaattcgacggtgtgatctcgtcgatgaccgttaccgaagcccgtgaaaaagtcatcgacttctccagcgagctgttctccggcccgacggcctacgtgtcgaaaaaaggttcgggcatcaccgacgacgtcgcttccctgaaaggcaaaaccgtcggctacgagcaaggcaccatccaggaagcctatgccaaagccgtgctggacaaggccggcgtgaaaacccaggcctatcaaaatcaggaccaggtgtattccgacctgacctcgggccgtctcgatgcgggcattcaggacatgttgcaggccgaactgggctttctgaagtcgccgcaaggcgctgattatgaagtcagcaagccggtcgacaaccacttgctgccagccaagaccgctgtcggtattaagaaaggtaacaccgagctgaaagcgcttttggataaaggtatcaaagcgttacacgatgacggcaaatacgccgagattcaaaagaaacactttggcgatctgaatctgtacagcggcaaataa

SEQ ID NO: 2493 - protein, 260 aa, Pseudomonas fluorescens PfO-1
MKKALLTLSALALCMAAGSALAKEYKELRFGVDPSYAPFESKAADGSLVGFDIDLGNAICAELKVKCKWVESDFDGMIPGLKANKFDGVISSMTVTEAREKVIDFSSELFSGPTAYVSKKGSGITDDVASLKGKTVGYEQGTIQEAYAKAVLDKAGVKTQAYQNQDQVYSDLTSGRLDAGIQDMLQAELGFLKSPQGADYEVSKPVDNHLLPAKTAVGIKKGNTELKALLDKGIKALHDDGKYAEIQKKHFGDLNLYSGK

SEQ ID NO: 2494 - DNA, 780 bp, Pseudomonas fluorescens PfO-1
  CDS (1)..(780): transl_table=11
atgaaaaagctggttatgttcggtgccctggcactgtcgatgttgtccctgaccgccgtggccgaagacgccaagccgatccgtatcggtatcgaagccggttacccgccattctcgatgaaaacccctgacggcaaactggccggtttcgacgtggacatcggcgatgcgctgtgtgagcagatgaaagtcaaatgcacctgggtcgagcaggaattcgacggcctgatcccggcgctgaaagtgaagaagatcgacgcgatcctgtcctcgatgaccatcactgacgaccgcaagaaaaacgtcgatttcaccatcaagtactaccacaccccggcgcgcttcgtgatgaaggcaggctctggcgtgaaagacccgctgaccgagctcaaaggcaagaaagtcggcgtgctgcgcgccagtacccacgaccgctacgcaaccgaagtactggtgccggccggcatcgagctggtgcgttacggctcacagcaggaggccaacctggacatggtgtccggtcgtatcgacgcaatgctggccgactcggtcaacctgagcgacggcttcctgaaaaccgacgccggcaaaggcttcgaattcgtcggcccgacctacgaagacgccaagtacttcggcggcggcgccggtatcgccgtgcgtaaaggcgataccgagctggcggagaaattcaacaccgccatcaacgaaatccgcgccaacggcaagtacaagcaagtgcaggacaagtacttcgactttgacgtgtacggccattaa

SEQ ID NO: 2495 - protein, 259 aa, Pseudomonas fluorescens PfO-1
MKKLVMFGALALSMLSLTAVAEDAKPIRIGIEAGYPPFSMKTPDGKLAGFDVDIGDALCEQMKVKCTWVEQEFDGLIPALKVKKIDAILSSMTITDDRKKNVDFTIKYYHTPARFVMKAGSGVKDPLTELKGKKVGVLRASTHDRYATEVLVPAGIELVRYGSQQEANLDMVSGRIDAMLADSVNLSDGFLKTDAGKGFEFVGPTYEDAKYFGGGAGIAVRKGDTELAEKFNTAINEIRANGKYKQVQDKYFDFDVYGH

SEQ ID NO: 2496 - DNA, 774 bp, Burkholderia sp. 383
  CDS (1)..(774): transl_table=11
atgaagaggatcatgatcggactggttgcacttgccatgtccgcaaccgggtttgccaaggaatggacgacgattcgcattggcgtcgacccgtcttatcctccgtttgaatacaagaaaccgtctggcgaattgacgggcttcggcgtggatctcggcaatgaagtgtgcaggcgcctcaacgcgaaatgcctctgggtcgaaaatgcatttgacggcatgattcccggcctgaaggcgcggaaattcgacgcgatcctgtcgtcgatgtcgatgacgcctgcgcgattgaagcaaatcgatttctcgaacaagacggcgcacgcaccgacgtttcttgtcgtgaaaaagggctcgggtatccagccgacgccggcatcgctcaacggtaaagccatcggcgtgctgcaaggctcgatgcaggagacgtatgcgaaggcgcattgggaaggtggcggcgcgcgcatcctgtcgtatcagaaccaggatcaggtgtatgccgacctgaccaacggccggctcgatgcggcgttgcaaaacggcgtccaagcatcgcgcggcttcttgaatacgccgcaaggcaaggactacgcgttcgcgggcggtgagctgagcgatccgaagattttcggaccgggtcagggcatcggcattcgcaaggacgacacggacctgaaggacaagatcaacacggcgctcgccgcgatccgtgccgacgggacgtatgacaagatcgccagtcgctatttcaatttcgacatctacggcaattga

SEQ ID NO: 2497 - protein, 257 aa, Burkholderia sp. 383
MKRIMIGLVALAMSATGFAKEWTTIRIGVDPSYPPFEYKKPSGELTGFGVDLGNEVCRRLNAKCLWVENAFDGMIPGLKARKFDAILSSMSMTPARLKQIDFSNKTAHAPTFLVVKKGSGIQPTPASLNGKAIGVLQGSMQETYAKAHWEGGGARILSYQNQDQVYADLTNGRLDAALQNGVQASRGFLNTPQGKDYAFAGGELSDPKIFGPGQGIGIRKDDTDLKDKINTALAAIRADGTYDKIASRYFNFDIYGN

SEQ ID NO: 2498 - DNA, 795 bp, Burkholderia sp. 383
  CDS (1)..(795): transl_table=11
atgaagttggattggcgtaaagtggccgcgcatgcggtggtggcggcatcggccgtggcggcaggcagcgcgatggcagcggatctgaaagagatccgtttcggcgtcgaagcctcgtacgcgccgttcgaatacaagacgcccgacggcaagctgaccggcttcgatatcgacatcggcaacgcggtgtgcgcgaagctgaagacgaagtgcgtgtgggtcgagaacgacttcgacggtctgatcccggcgctgcaggcacgcaagttcgacgcgatcaactcggacatgacgatcaccgaccagcgcaagcacgcggtcgcgttcaccgacgcgatctacacgatcccgaaccagctgatcgcgaagcagggcagcggcctgctgccgaccccgcaatcgctgaagggcaagcgcgtcggcgtgctgcagggcacgatccaggaagcgtacgcgaagaagaagtgggcgccggcaggcgtcgaagtcgtgccgtaccagacgcaggacctggcctacgccgacctgaagtcgggccgtctcgacgcgacgttccaggacgcggaagccggttcgaagggcttcctgacgaagccgcaaggccagggcttcgcgttcgcgggcggtaccgtgagcgacgccgagatcctcggctcgggcgtcggtttcggcctgcgcaagaacgacgcggcgctgaagaccgcgctcgatcaggcgctgaaggaactgaaggccgacggcacgatcgacaacctcgcgaagaagtacttcagcgtgcccgtgacgctcaagtaa

SEQ ID NO: 2499 - protein, 264 aa, Burkholderia sp. 383
MKLDWRKVAAHAVVAASAVAAGSAMAADLKEIRFGVEASYAPFEYKTPDGKLTGFDIDIGNAVCAKLKTKCVWVENDFDGLIPALQARKFDAINSDMTITDQRKHAVAFTDAIYTIPNQLIAKQGSGLLPTPQSLKGKRVGVLQGTIQEAYAKKKWAPAGVEVVPYQTQDLAYADLKSGRLDATFQDAEAGSKGFLTKPQGQGFAFAGGTVSDAEILGSGVGFGLRKNDAALKTALDQALKELKADGTIDNLAKKYFSVPVTLK

SEQ ID NO: 2500 - DNA, 783 bp, Burkholderia sp. 383
  CDS (1)..(783): transl_table=11
atgaagaaggccgccctgtgcgccgccctcgccctcatggcgggtagcgccttcgcgaaggagtggaagaccgtgcggatcggcgtcgatgccagctacccgccgttcgagtcgaccgcgccgagcggcgagatcgtcggtttcgacgtcgatctcaccaaggaaatctgcaagcgaatcaacgtgaattgcgtgtgggtggcgcaggatctcgacgggatcatcccggcgctgaaggcgaagaagtacgacgtcatcgtgtcgtcgctgaccgtcacggacaagcgccgcgaacagatcgacttctccgacaaggtatacgacgcgccggcgcggatgatcgcgaagaccggctcgccgctgctgccgacgatcgcatcgctgaagggcaagcgcgtgggcgtcgagcagggctcgacgcaggaaacctacgcgaaggcgtactgggagccgcagggcgtgacgatcattccttaccagaaccaggaccaggtctatgccgatctcggctcgggccgtctcgatgcgacgctgcaggacgagctgcaggccgactacggcttcctgcgcacgccgcgcggcaagggcttcgcgttcgccgggccggaagtgaaggatccgaagacgatcggcgacggtaccgcaatcggcctgcgcaaggaagatacggacctgaagctcaagatcaacaaggcgctggccgacatgcacaaggacggcacgtacgatcggctgtcgcacaagtatttcgcgttcagcgtctattcggctgcggcccgctga

SEQ ID NO: 2501 - protein, 260 aa, Burkholderia sp. 383
MKKAALCAALALMAGSAFAKEWKTVRIGVDASYPPFESTAPSGEIVGFDVDLTKEICKRINVNCVWVAQDLDGIIPALKAKKYDVIVSSLTVTDKRREQIDFSDKVYDAPARMIAKTGSPLLPTIASLKGKRVGVEQGSTQETYAKAYWEPQGVTIIPYQNQDQVYADLGSGRLDATLQDELQADYGFLRTPRGKGFAFAGPEVKDPKTIGDGTAIGLRKEDTDLKLKINKALADMHKDGTYDRLSHKYFAFSVYSAAAR

SEQ ID NO: 2502 - DNA, 783 bp, Burkholderia sp. 383
  CDS (1)..(783): transl_table=11
gtgaaaaagattcttgcggctgtgaccgtagccctgctcgccgtatcggcaggcaccgcgtatgcgaaggactggacgaccgtgcggttcggcgtcgacgcaagctacccgcctttcgaatcgaaaggcgctgacggcaaggtggtcgggttcgacgtcgacctcggcaacgaaatctgccgccgcatgaacgcgaagtgcgtgtggatcgaaaacgacttcgacgggatgattccggcactgaaggcccgcaagttcgacggcgtgctgtcgtcgatgtcgatgacgccggcgcgtcaggagcagatcgccttctcggcgaagctgttcaacacgccgacgcgcctcgtgacgaagaagggcgccggcctgatgccgacggccgaatcgctgaagggcaagtcggtcggcgtcgagcagggcacgatccaggaaacctatgcgaagacgtactgggcctcgaagggcgtgaacgtcgtgccttaccagaaccaggaccaggtctacgccgacctgatctccggccgtctggacggcgcgctgcaggatgcggtgcaggctgaaatcggcttcctgaagacgccgcgcggcgcgaacttcgatttcgccggcaaggatctcgacgatccgaagacgctcggcgaaggcgccggcatcggcctgcgcaaggaagacaccgacctgaaggcgaagatcgacggcgcgatcgccggcatgcgcaaggacggcacgtacgcgaagatcgcgaagaagtacttcgatttcgacgtctacggcaagtaa

SEQ ID NO: 2503 - protein, 260 aa, Burkholderia sp. 383
MKKILAAVTVALLAVSAGTAYAKDWTTVRFGVDASYPPFESKGADGKVVGFDVDLGNEICRRMNAKCVWIENDFDGMIPALKARKFDGVLSSMSMTPARQEQIAFSAKLFNTPTRLVTKKGAGLMPTAESLKGKSVGVEQGTIQETYAKTYWASKGVNVVPYQNQDQVYADLISGRLDGALQDAVQAEIGFLKTPRGANFDFAGKDLDDPKTLGEGAGIGLRKEDTDLKAKIDGAIAGMRKDGTYAKIAKKYFDFDVYGK

SEQ ID NO: 2504 - DNA, 774 bp, Burkholderia sp. 383
  CDS (1)..(774): transl_table=11
atgaaacgtaccttcctgccgttcgtttacctctgccttgcgttcacggccagcgccgcgcacgcgctcgatgcgcgccccgtgcgcctcggcatcgatccgacctatccgccgatggattcgaaggcgcccgacggcagcctgaagggcttcgacgtcgatctcggcaacgagatctgtcgccgcgcgcagttgcggtgccagtgggtcgagctcgaattctccgggatgattcccgctttgcaggcacgcaagatcgacgcgatcctgtcgtcgatggcgatcaccgagaagcgcgagaagcagatcctgttctcgtcgaaactgttccgcttcaagtcgcggctcgttgcgcggcccgggagcggcgtcgacagcacgaccgcgtcgctggccggcaagcacgtcggcgtgcagtcgggcacgcagttcgaatcgtgggcgctcgcgcactgggcgccggccggcgtcagcgtggtgccgtacaagagccaggacgacgtgttcgccgatctcgtcaacggccgcctcgacgcggcgctgctcggcaccgtggaagccgactacggcttcctgcgcatgccgaagggcaagggcttcgcgttcgtgggcgcaccgctcgacatgggcgatcgcggtgtcggcatcggcatgcggcagtcggatacggcgctcaaggcgtcgatcgacggcgcgatcgcgtcgatgctgaaggacggcacgtacgaccgcatcgcgaagaaatatttcgacttcaacccgtacggcgactga

SEQ ID NO: 2505 - protein, 257 aa, Burkholderia sp. 383
MKRTFLPFVYLCLAFTASAAHALDARPVRLGIDPTYPPMDSKAPDGSLKGFDVDLGNEICRRAQLRCQWVELEFSGMIPALQARKIDAILSSMAITEKREKQILFSSKLFRFKSRLVARPGSGVDSTTASLAGKHVGVQSGTQFESWALAHWAPAGVSVVPYKSQDDVFADLVNGRLDAALLGTVEADYGFLRMPKGKGFAFVGAPLDMGDRGVGIGMRQSDTALKASIDGAIASMLKDGTYDRIAKKYFDFNPYGD

SEQ ID NO: 2506 - DNA, 783 bp, Burkholderia sp. 383
  CDS (1)..(783): transl_table=11
atgaagagactgattgccgctgtttcgatcgccctgctcgcggtatccgcaggccccgccgtcgcgaaggactggaccacgatccgcttcggcaccgacgccagctacgcgccgttcgagtcgaaggcacccgacggcaagctcgtcggcttcgacatcgacctcggcaacgagatctgcgcgcgcctgaaggcgaagtgcgtgtggctcgagaacgatttcgacgggatgattccggcgctgaaggcgaagaagttcgacgcggtgctgtcgtcgatgtcgatcacgccgcagcgcgcgcagcagatcggcttcacgacgaagatctacaaccagccgacgcggctcgtcgtgaagaagggctcgccgctgctgccgacggccgaatcgctgaagggcaaatcgatcggcgtcgaacagggcacgacgcaggaaacgtacgcgaaggcgtactggggcaagcaaggcgcgaacgtcgtgtcgtaccagaaccaggatggcgtgtacgcggacctgacctcgggccgcctcgacgcagcgctgcaggatgaagtgcaggcggccatcgggttcctgaaatcgtcgcgcggcgcgaactacacgttcgtcggccccgagctcgtcgacgacaaggtgctcggcatcggcgccggcatcgggctgcgcaaggaggacaccgacctgaaggcgaagatcgacggcgccatcctcgacatggtcaaggacggtacctacaagcggctcgcgtcgaagtacttcgacttcgacatctacggcggctga

SEQ ID NO: 2507 - protein, 260 aa, Burkholderia sp. 383
MKRLIAAVSIALLAVSAGPAVAKDWTTIRFGTDASYAPFESKAPDGKLVGFDIDLGNEICARLKAKCVWLENDFDGMIPALKAKKFDAVLSSMSITPQRAQQIGFTTKIYNQPTRLVVKKGSPLLPTAESLKGKSIGVEQGTTQETYAKAYWGKQGANVVSYQNQDGVYADLTSGRLDAALQDEVQAAIGFLKSSRGANYTFVGPELVDDKVLGIGAGIGLRKEDTDLKAKIDGAILDMVKDGTYKRLASKYFDFDIYGG

SEQ ID NO: 2508 - DNA, 774 bp, Burkholderia sp. 383
  CDS (1)..(774): transl_table=11
atgaagaaactcgcgctcagtattgcccttgcctgcatcgcggtcggtgcccacgccaaggattggtcgacgatccggttcggcgtcgacgccagctatccgccgttcgaatcgaaggacgcaagcggcaaggtcgtcggcttcgacgtcgatctcggcaacgagatctgcgcgcgcctgaaggcgaaatgcgtgtggatcgagaacgacttcgacgggatgatccccgcgctgaaggcgaagaagttcgacggcgtgctgtcgtcgatgtcgatgacgccggcgcgtgccgagcagatcgcgttctccgacaagctgttcaacacgccgacgcgcctcgtcacgaagaagggcgcgaacctgcagccgaccgccgaatcgctgaagggcaagtcggtcggcgtcgagcagggcaccatccaggaaacctacgcgaaagcctactgggcgccgaagggcgtgcaggtcgtgccttaccagaaccaggacggcgtgtaccaggacctgatgtcgggccgcctcgacgcggcgctgcaggacgcggtgcaggccgacatcgggttcctgaagacgccgcgcggcgcgaacttcgaattcgccggcaaggacatcgacgatccgaagacgctcggcaacggcgccggcatcgggctgcgcaaggacgacgccgacctgaaggcgaagatcgaccacgcgattgccgacatcatcaaggacggcacgtacaagaagctcgagaagaagtacttcgcgttcgacgtctacggcggctga

SEQ ID NO: 2509 - protein, 257 aa, Burkholderia sp. 383
MKKLALSIALACIAVGAHAKDWSTIRFGVDASYPPFESKDASGKVVGFDVDLGNEICARLKAKCVWIENDFDGMIPALKAKKFDGVLSSMSMTPARAEQIAFSDKLFNTPTRLVTKKGANLQPTAESLKGKSVGVEQGTIQETYAKAYWAPKGVQVVPYQNQDGVYQDLMSGRLDAALQDAVQADIGFLKTPRGANFEFAGKDIDDPKTLGNGAGIGLRKDDADLKAKIDHAIADIIKDGTYKKLEKKYFAFDVYGG

SEQ ID NO: 2510 - DNA, 771 bp, Burkholderia sp. 383
  CDS (1)..(771): transl_table=11
atgaaaaagctcgtcctggccgttgcgctcgcgctgacggccggcgccgccgccgcgaaagacccggcggtcctgcgcctcggcgtcgaccccagctatgcgccattcgaatcgctcgcgcccgacggcaagctcgtcggcttcgacatcgatctcggcaatgcgatctgcgaacggatgaaggtgcgttgcgtgtgggtcgagaacgcgttcgacgggatgatcccggcgctgaaggcacgcaagttcgacggcgtgctgtcgtcgatgagcgtgaccgagaagcgcctcgcgcagatcgcgttcaccgacaagatcaacaacgtgccgccccggctcgtcgcacggcgcggctcgaacctgcagccgacgcccgaatcgctgcagggcaagagcgtcggcgtcgagcagggttcgacgcaggagacgtatgcgcgcacgtactgggagccgaagggtgtgatcgtccgcacgtaccagacgcaggatctcgtctaccaggacctgctgtcggggcggctcgacgcgtcgctgcaatcgtcggtgcaggccgacctcgggttcctgaaaaccgcgaagggggcgaacttcgaattcgcggggccgccgctgcatgacccgaagacgctcggcgtgggttcggcgatcggcgtgcgcaaggatgacgacgcgctgcgcacgcagatcaaccaggcgctggcgagcctgatccaggacgggacttaccagcggatctcgaagaagtatttctcgttcgatatctataactga

SEQ ID NO: 2511 - protein, 256 aa, Burkholderia sp. 383
MKKLVLAVALALTAGAAAAKDPAVLRLGVDPSYAPFESLAPDGKLVGFDIDLGNAICERMKVRCVWVENAFDGMIPALKARKFDGVLSSMSVTEKRLAQIAFTDKINNVPPRLVARRGSNLQPTPESLQGKSVGVEQGSTQETYARTYWEPKGVIVRTYQTQDLVYQDLLSGRLDASLQSSVQADLGFLKTAKGANFEFAGPPLHDPKTLGVGSAIGVRKDDDALRTQINQALASLIQDGTYQRISKKYFSFDIYN

SEQ ID NO: 2512 - DNA, 789 bp, Burkholderia sp. 383
  CDS (1)..(789): transl_table=11
atgaagcaatggaaacggatggcggcgctcgcgatggcgctggcggcgagcgcggcgcatgcgggcgactgggcgggcaaggagatccgcctcgcggtcgatccgacttacccgccgctcgaatacaagctgcccgacggcacgctgacgggcttcgggatcgacatcacgaacgcgttgtgcgcggagctgcgtgcgcgctgcgtgtgggtcgagtcgagtttcgacgggatgattccggggctgctcgcgcgcaagttcgacgtgattgcgtcgtcgatgacgatcacgccgaagcggcagcagcagatcgccttcacgaaccggatctcgaatgcgccggcgcgcctcatcgcgcgcaagggctcgccgctgctgccgacggccgatgcgctgaagggcaagcgcgtgggcgtcgagcagggttcagcgcaggccgactacgcggtcgcgaactggcagccggccggcgtccagatcgtgtcgtaccagaaccaggaccaggtctatgccgatctcgtgacgggccggctcgacgcggcgttccaggcatcgatcgcggccagcgacggtttcctgaagaagccgcagggcaaggatttcgcgttcgtcggcgcggcgatcgacgacgtgaagtacttcgggcagggcgacgggctcgggctgcgcaagcaggacaacgacctgcgcgacgccttcaaccgcgcgctcgcgacaatcctcgcgaacggcacgtaccagcggatcaacaagaagtacttcgacttcgacatctacggcgcgaagtaa

SEQ ID NO: 2513 - protein, 262 aa, Burkholderia sp. 383
MKQWKRMAALAMALAASAAHAGDWAGKEIRLAVDPTYPPLEYKLPDGTLTGFGIDITNALCAELRARCVWVESSFDGMIPGLLARKFDVIASSMTITPKRQQQIAFTNRISNAPARLIARKGSPLLPTADALKGKRVGVEQGSAQADYAVANWQPAGVQIVSYQNQDQVYADLVTGRLDAAFQASIAASDGFLKKPQGKDFAFVGAAIDDVKYFGQGDGLGLRKQDNDLRDAFNRALATILANGTYQRINKKYFDFDIYGAK

SEQ ID NO: 2514 - DNA, 789 bp, Burkholderia thailandensis E264
  CDS (1)..(789): transl_table=11
atgacagtgaaaaaaatcttggcggctttgaccgtggccctgctggcggtgtcggcaggcggcgtgcaggcgaaggactggtcgacgatccgcttcggcgtcgacgcgagctacccgcccttcgaatcgaaaggcccggacggcaaggtggtcggcttcgacgtcgatctcggcaacgagatctgcaagcgagtgaaagccaagtgtgtgtggatcgagaacgacttcgacggcatgatcccggcgctgaaggcgcgcaagttcgacggcgtgctgtcgtcgatgtcgatgacgccgcagcgcgaagagcagatcgcgttctcgtcgaagctgttcaacacgccgacgcgcctcgtcacgaagaagggcgcgaacctgatgcccacggccgaatcgctcaagggcaagacggtcggcgtcgagcagggcacgattcaggaaacctacgcgaaggtccactgggcgccgaagggcgtgaacatccagccgtaccagaaccaggaccaggtctacgccgacctgatcgcgggccgcctcgacgcggcgctgcaagacgcggtgcaggccgacatcggcttcctgaagacgccgcgcggcaaggatttcgcgttcgccggctcggacctcaacgatccgaagacgctcggcgaaggcgcgggcatcggcttgcgcaaggaagacaccgatctgaaggcgaagatcgacaaggcgatcgccgacatgcgcaaggacggcacgtacgacaagatcgcgaagaagtatttcgacttcgacgtttacggcaagtaa

SEQ ID NO: 2515 - protein, 262 aa, Burkholderia thailandensis E264
MTVKKILAALTVALLAVSAGGVQAKDWSTIRFGVDASYPPFESKGPDGKVVGFDVDLGNEICKRVKAKCVWIENDFDGMIPALKARKFDGVLSSMSMTPQREEQIAFSSKLFNTPTRLVTKKGANLMPTAESLKGKTVGVEQGTIQETYAKVHWAPKGVNIQPYQNQDQVYADLIAGRLDAALQDAVQADIGFLKTPRGKDFAFAGSDLNDPKTLGEGAGIGLRKEDTDLKAKIDKAIADMRKDGTYDKIAKKYFDFDVYGK

SEQ ID NO: 2516 - DNA, 1092 bp, Burkholderia thailandensis E264
  CDS (1)..(1092): transl_table=11
atgcaccggttcgttgcgccgatccatgcaatcgtccgcgcgattcgcgcgcgctgccgcgccggcgagcaaagcgaggccgacgcgcccgcccggcgcgcgtcgcgctcgcccgcatcgtttctgctgggccgcggccggcgttcgggtaaaataccgcgcttttggccgccgtcgacggcgctaggcccccaggccgagccgagccgagccgatatcgacgaacgcgaattttggccgcctagaatacgcccggcgcgcgcatgcccggacgcatccggccgcgcggccggggaagtcaggaagaggaacgacatgaagaagctcgccttgtgcgcagccctcgcccttgcggcgggcggcgccttcgcgaaggaatggaagaccgtgcggatcggcgtcgacgccagctatccgccgttcgaatcgaccgcgccgagcggcgagatcgtcggattcgacgtcgatctcgcgaacgaggtctgcaagcggatcaacgcgaagtgcacatggacgccgcaggatctcgacggcatcatccccgcgctgaaggcgaagaaattcgacgtgatcgtgtcgtcgctgaccgtcaccgacaagcgccgcgagcagatcgacttctccgacaagctgtacgacgcgcccgcgcggatgatcgcgaaggcgggctcgccgctcctgccgagcgtcgagtcgctgaaaggcaagcgcgtcggcgtcgagcagggctcgacccaggagactttcgcgaaggcgcactgggagccgaagggcgtgacgatcgtgtcgtaccagaaccaggatcaggtgtacgccgatctcggctcgggccgtctcgacgcgacgctgcaagacgagttccaggccgactacggcttcctgcgcacgccgcgcggcaagggtttcgcatgggcgggcccggccgtgaaggacccgaagacgctcggcgacggcaccgcgatgggcttgcgcaaggacgacgcggacctgaagaacgcgatcaaccgcgcgctcgcgtcgatgcacaaggacggcacgtacgacaggctgtcgcgcaagtacttcccgtacagcgtctattcggcgaagtaa

SEQ ID NO: 2517 - protein, 363 aa, Burkholderia thailandensis E264
MHRFVAPIHAIVRAIRARCRAGEQSEADAPARRASRSPASFLLGRGRRSGKIPRFWPPSTALGPQAEPSRADIDEREFWPPRIRPARACPDASGRAAGEVRKRNDMKKLALCAALALAAGGAFAKEWKTVRIGVDASYPPFESTAPSGEIVGFDVDLANEVCKRINAKCTWTPQDLDGIIPALKAKKFDVIVSSLTVTDKRREQIDFSDKLYDAPARMIAKAGSPLLPSVESLKGKRVGVEQGSTQETFAKAHWEPKGVTIVSYQNQDQVYADLGSGRLDATLQDEFQADYGFLRTPRGKGFAWAGPAVKDPKTLGDGTAMGLRKDDADLKNAINRALASMHKDGTYDRLSRKYFPYSVYSAK

SEQ ID NO: 2518 - DNA, 795 bp, Burkholderia thailandensis E264
  CDS (1)..(795): transl_table=11
atgaagttgaactggcggaagatggccgcgcatgcggtggtgacggccacggccctggcggcaggcagcgcgttcgccgccgatctgaaggaaatccgcttcggcgtcgaggcgtcgtatgcgccgttcgaatacaagacgccggacggcaagctggcgggcttcgacatcgacatcggcaacgcggtgtgcgcgaagctgaaggtcaagtgcgtgtgggtcgagaacgcgttcgacggcctgatcccggcgctgcaggcgcgcaagttcgacgcgatcaactccgacatgacgatcaccgagcagcgtcggaaggcgatcgatttcaccgatccgatctacacgatcccgaaccagttgatcgcgaagaagggcagcggcctgctgccgaccaccgcgtcgctgaagggcaagcgcgtcggcgtgctgcagggcacgatccaggaggcgtatgcgaagaagcgctgggcgccggcgggcgtcgaagtcgtgccgtaccagacgcaggatctcgcgtacgaggacctgaagtcgggccgcctcgacgcgacgttccaggattcggaggcgggcgcgaagggcttcctgtcgaagccgcagggcgcgggattcgcgttcgcgggcgatcacgtgagcgacgccgagattctcggcacgggcgtcggcttcggcctgcgcaagaacgacgcgcaactgaagagcgccgtcaatcaggcgctgaaggaactgaaggccgacggcacgatcgacggcctcgcgaagaagtacttcagcgtgcccgtgacgctgaagtaa

SEQ ID NO: 2519 - protein, 264 aa, Burkholderia thailandensis E264
MKLNWRKMAAHAVVTATALAAGSAFAADLKEIRFGVEASYAPFEYKTPDGKLAGFDIDIGNAVCAKLKVKCVWVENAFDGLIPALQARKFDAINSDMTITEQRRKAIDFTDPIYTIPNQLIAKKGSGLLPTTASLKGKRVGVLQGTIQEAYAKKRWAPAGVEVVPYQTQDLAYEDLKSGRLDATFQDSEAGAKGFLSKPQGAGFAFAGDHVSDAEILGTGVGFGLRKNDAQLKSAVNQALKELKADGTIDGLAKKYFSVPVTLK

SEQ ID NO: 2520 - DNA, 783 bp, Burkholderia xenovorans LB400
  CDS (1)..(783): transl_table=11
gtgaaaaaactgctagcggctttgacggttgctctgcttgctaccgtctcgattggcgcacacgctaaagattggtcgactatccgtttcggcgttgacgccagctatcccccgtttgagtcgaagggctcggacggcaagctcgttggcttcgatatcgaccttggcaatgaaatctgcgcgcgcctgaaagccaaatgcgtgtgggtcgaaaacgacttcgacggcatgatcccggcgctgaaggcgaagaagttcgacggcgtgctgtcgtcgatgtccatgacgccgcaacgcgctgaacagatcgctttctcgtcgaagctgttcaacaccccgacgcgcctcgtggcgaagaagggttcgggcatcctgccgacggccgaatcgctcaagggcaagacggttggcgtggaacagggcacgatccaggaaacctacgccaagacgtactgggagccgaagggcgcgaaggtcgtgccgtatcagaaccaggaccaggtctatgccgacttgctgtcgggccgtctggacgcggcgctgcaagacgcggtgcaagctgagatcggcttcctgaagacgccgcgcggcgccggcttcgacttcgtcggcaaggacctcgaagatccgaagatcctcggcaacggcgcaggcatcggcatgcgcaaggaagatacggatctgaagacgaaggtcgacaaggcaatcgccgagatcatcaaggacggtacgtacaagaagctcgagaagaagtacttcgacttcgacgtgtacggcagctaa

SEQ ID NO: 2521 - protein, 260 aa, Burkholderia xenovorans LB400
MKKLLAALTVALLATVSIGAHAKDWSTIRFGVDASYPPFESKGSDGKLVGFDIDLGNEICARLKAKCVWVENDFDGMIPALKAKKFDGVLSSMSMTPQRAEQIAFSSKLFNTPTRLVAKKGSGILPTAESLKGKTVGVEQGTIQETYAKTYWEPKGAKVVPYQNQDQVYADLLSGRLDAALQDAVQAEIGFLKTPRGAGFDFVGKDLEDPKILGNGAGIGMRKEDTDLKTKVDKAIAEIIKDGTYKKLEKKYFDFDVYGS

SEQ ID NO: 2522 - DNA, 768 bp, Burkholderia xenovorans LB400
  CDS (1)..(768): transl_table=11
atgaaaatctcgctgatgatcctgagcgccgcgctggctttcagcagcggcgcgtttgccgctgattccaccacgctgcgcctcggcatcgatccgacctatccgccgatggactccaaggcgcccgacggcagcttcaaaggcttcgacgtcgatctcggcaacgaaatctgcaagcgcattcacgcgcgctgccagtgggtggagctcgaattttcggggatgattccggcgttgcaggcgcgcaagatcgacgcgattctgtcttcaatggcgatcacggaaaagcgcgagcaacagattctgttttcgtcgaaactgttccagttcaaatcgcggctgatcgcgcggcaaggttccgcgctcgcgggcagcttgaacgcgctggccggcaaggcaatcggcgtgcagtcgggcacgcagttcgaagggtacgcgctgaagaactgggcgccgctcggcgtgcacgtggtggcgtacaagagtcaggaagaagtcttcgccgacctggagaacgggcgtctcgacggcgcgctgctcggttcggtggaagcagactacggattcttgcgcacgccggcgggcaagggctttgcgttcgtcggcgaaccgctctcgatgggcgatcgcggcgtaggcatcggcttgcgtaaggacgagaccgcagtgcaggcctccatcaacgaggcgatcgcctccatgcgcaaagacggcacgtacgcgcagatcgcgaagaagtacttcgacttcgatccgtacggaaactga

SEQ ID NO: 2523 - protein, 255 aa, Burkholderia xenovorans LB400
MKISLMILSAALAFSSGAFAADSTTLRLGIDPTYPPMDSKAPDGSFKGFDVDLGNEICKRIHARCQWVELEFSGMIPALQARKIDAILSSMAITEKREQQILFSSKLFQFKSRLIARQGSALAGSLNALAGKAIGVQSGTQFEGYALKNWAPLGVHVVAYKSQEEVFADLENGRLDGALLGSVEADYGFLRTPAGKGFAFVGEPLSMGDRGVGIGLRKDETAVQASINEAIASMRKDGTYAQIAKKYFDFDPYGN

SEQ ID NO: 2524 - DNA, 795 bp, Burkholderia xenovorans LB400
  CDS (1)..(795): transl_table=11
atgaagatgaattggcgaaacatggccgcgctcgcgctgttcgcggcggccacggctacggccggcaccgcatcggctgcggatatcaaggaagtgcatttcggcgtcgaggcgtcgtatgcgccgttcgaatcgaagtcgccgtcgggcgaactgcaaggtttcgacatcgacgtcggcaatgccgtgtgcgcgaagctgaaggccagatgcgtgtgggtcgagaactcgttcgacggtctgatcccggccttgcaggcgcgcaagttcaatgccatcaactcggatatgacgatcacggaccaacgccgccaggcgatcgatttcaccgatccgatctacacgatcccgaatcagatgatcgcgaagaagggcagcggtctgctgccgacgccggcttcgctcaagggcaagcatgtgggcgtgctgcagggcacgattcaggaaacctacgcgaaggcgcgctgggcgccggccggcgtcgatgtcgtgccgtatcagacgcaggatcagatttacgccgacctcgcttcgggccgtctcgatgcggcgttccaggacgcggaggccgcgtcgaaaggcttcctgaagaagccgcaaggcgccggtttcgactttgccggtccggctgtcaccgacgaaaagctgctgggcgcgggcgttggcttcggcgttcgcaagggcgacaaggcattgaaagacgcgctgaaccaggcgctcagggaactgaaggcggacggcacgatcgaccgctttgcggccagatacttcgacgtgaaagtggtattgaagtga

SEQ ID NO: 2525 - protein, 264 aa, Burkholderia xenovorans LB400
MKMNWRNMAALALFAAATATAGTASAADIKEVHFGVEASYAPFESKSPSGELQGFDIDVGNAVCAKLKARCVWVENSFDGLIPALQARKFNAINSDMTITDQRRQAIDFTDPIYTIPNQMIAKKGSGLLPTPASLKGKHVGVLQGTIQETYAKARWAPAGVDVVPYQTQDQIYADLASGRLDAAFQDAEAASKGFLKKPQGAGFDFAGPAVTDEKLLGAGVGFGVRKGDKALKDALNQALRELKADGTIDRFAARYFDVKVVLK

SEQ ID NO: 2526 - DNA, 786 bp, Pseudomonas aeruginosa UCBPP-PA14
  CDS (1)..(786): transl_table=11
atgacaagaaccctcggcagcatcgccctctccctcctcctcgccgcaccggccggcgccgccgactggaccggcaaggtcctgcgcctgggcgtcgacccgacctacccgccgctcgaatacaagcagccggacggccgcctggcaggcttcggcatcgagatcggcgaagccctctgcgcggagctgcgagcccgctgcgaatgggtcgaaagcaactgggacggcatcatcccggcgctgctgtcgcgcaagatcgacgccatcgtctcgtcgatgaccatcacgccaaaacgcgcacagcacatcgccttcaccgaccgcgtctccaacgcgccgagccgcctggtggtacgccgcggctcggcgctcctgcccgacgccgagagcctgcgcggcaagcgcgtgggggtcggccagggctccaaccaggaggcctacgccaaggccgaatgggccgccaagggggtgcgggtcgtctcctaccagaaccaggaccaggtctacgccgacctcgtcatgggccgcctcgacgcctcgctgcaaggtgcggtgcaggccagctacggcttcctcgacaagccggtcggcaaggatttcgaactggccggagcggtgctggacgaccctcgctacttcggggtcggcgacggcatcggcctgcgcaaggaagatgtggcgctgcgcgaggacctgaacaaggcgctggcgacgatccgcgccaacgggacctacgcgcgaatcaacgcccgttacttcgatttcgacctctacggcgcgccctga

SEQ ID NO: 2527 - protein, 261 aa, Pseudomonas aeruginosa UCBPP-PA14
MTRTLGSIALSLLLAAPAGAADWTGKVLRLGVDPTYPPLEYKQPDGRLAGFGIEIGEALCAELRARCEWVESNWDGIIPALLSRKIDAIVSSMTITPKRAQHIAFTDRVSNAPSRLVVRRGSALLPDAESLRGKRVGVGQGSNQEAYAKAEWAAKGVRVVSYQNQDQVYADLVMGRLDASLQGAVQASYGFLDKPVGKDFELAGAVLDDPRYFGVGDGIGLRKEDVALREDLNKALATIRANGTYARINARYFDFDLYGAP

SEQ ID NO: 2528 - DNA, 879 bp, Burkholderia vietnamiensis G4
  CDS (1)..(879): transl_table=11
atgcgaaacggaccgtccgacgcgaagccgcgccggggcgaacgcttacggcgcggcacaaccgcgcacccatcgaacaaaacgaggagtcaccgagtgaaaaagattcttgcggctgtgaccgtggccctgctggccgtatcggccggcactgcatacgcgaaggactggtcgaccgtacgcttcggcgtcgacgcaagctacccgcctttcgaatcgaaaggcgccgacggcaaggtggtcggcttcgacgtcgacctcggcaacgagatctgccgccgcatcgccgcgaaatgcgtgtggatcgagaacgacttcgacgggatgatcccggcgctgaaggcccgcaagttcgacggcgtgctgtcgtcgatgtcgatgaccccggcccgcgaggaacagatcgccttctcggcgaagctgttcaacacgccgacgcgcctcgtcacgaagaagggcgcgggcctgctgccgacggccgaatcgctgaagggcaagacgatcggcgtcgagcaaggcacgatccaggaaacctacgcgaagacgtactgggcgccgaagggcgtcaccgtcgtcccgtatcagaaccaggaccaggtctacgccgacctgatctcgggccgcctgaacggcgcgctgcaggacgccgtgcaagccgagatcggcttcctgaagacgccgcgcggcgccggcttcgatttcgcaggcaaggacctcgacgatccgaagacgctcggcaacggcgcgggcatcggcctgcgcaaggaagacaccgacctgaagacgaagatcgacggcgcgatcgccgcgatgcgcaaggacggcacgtacgacaagattgcgaagaagtacttcgatttcgacgtgtacggcaagtaa

SEQ ID NO: 2529 - protein, 292 aa, Burkholderia vietnamiensis G4
MRNGPSDAKPRRGERLRRGTTAHPSNKTRSHRVKKILAAVTVALLAVSAGTAYAKDWSTVRFGVDASYPPFESKGADGKVVGFDVDLGNEICRRIAAKCVWIENDFDGMIPALKARKFDGVLSSMSMTPAREEQIAFSAKLFNTPTRLVTKKGAGLLPTAESLKGKTIGVEQGTIQETYAKTYWAPKGVTVVPYQNQDQVYADLISGRLNGALQDAVQAEIGFLKTPRGAGFDFAGKDLDDPKTLGNGAGIGLRKEDTDLKTKIDGAIAAMRKDGTYDKIAKKYFDFDVYGK

SEQ ID NO: 2530 - DNA, 882 bp, Burkholderia vietnamiensis G4
  CDS (1)..(882): transl_table=11
atgtcagcgcgccgaaacacgaattttggccgtctagaatacgccgcggcgcccggcacgaccggccgcgagcgtcacccggaagtgagcgacaaaaggatggaaatgaagaaggccgccctgtgcgccgccctcgccctcgtggcgggaagcgccttcgcgaaagagtggaagaccgtgcggatcggtgtcgatgccagctacccgccgttcgagtcgaccgcgccgagcggcgagatcgtcggtttcgacgtcgacctcacgaaggaaatctgcaagcggatcaacgtgaagtgcgtgtgggtcgcgcaggatctcgacgggatcattccggcgctgaaggcgaagaagtacgacgtgatcgtgtcgtcgctgaccgtcaccgacaagcgccgcgagcagatcgacttctcggacaaggtctacgacgcgcccgcgcgaatgatcgcgaaggccggctcgccgctgcagccgacggtcgcatcgctgaagggcaagcgcgtcggcgtcgaacagggttcgacgcaggaaagctacgcgaaggcgtactgggaaccgcaaggcgtgacggtcattccttaccagaaccaggaccaggtctataccgacctcggctcgggccgcctcgacgcgacgctgcaggacgagctgcaggccgactacggtttcctgcgcacgccgcgcggcaagggcttcgcgttcgccgggccggaagtgaaggatccgaagacgatcggcgacggcaccgcgatcggcctgcgcaagcaggacaccgacctgaagctgaagatcaacaacgcgctggccgacatgcacaaggacggcaccttcgaccggctgtcgcacaagtatttttcgttcagcgtctattcggctcgctga

SEQ ID NO: 2531 - protein, 293 aa, Burkholderia vietnamiensis G4
MSARRNTNFGRLEYAAAPGTTGRERHPEVSDKRMEMKKAALCAALALVAGSAFAKEWKTVRIGVDASYPPFESTAPSGEIVGFDVDLTKEICKRINVKCVWVAQDLDGIIPALKAKKYDVIVSSLTVTDKRREQIDFSDKVYDAPARMIAKAGSPLQPTVASLKGKRVGVEQGSTQESYAKAYWEPQGVTVIPYQNQDQVYTDLGSGRLDATLQDELQADYGFLRTPRGKGFAFAGPEVKDPKTIGDGTAIGLRKQDTDLKLKINNALADMHKDGTFDRLSHKYFSFSVYSAR

SEQ ID NO: 2532 - DNA, 768 bp, Burkholderia vietnamiensis G4
  CDS (1)..(768): transl_table=11
atgaagaagcttgccatttcagttgcgcttgctctggccgccaccagtgtctatgccaaagactggaaagaaatccgctttggtaccgaacccactagtcccccgtttgaatccaaagctatcgacggtaagttggtcggcttcgatatcgacttgggtaatgccatttgcgccaagctcaaagccaaatgtgtgtgggttgagaacgatttcgacggcatgattccagcactgaaagccaagaagtttgacggcatactggcgtcgatgaccgtgaccgaaaagcgtatgcaggaaatcgcattctccgacaagatctacaacaccccgacccgactggtgactaagaagggttcaggtttgctgccgatcgccacttccctgaagggtaagcgggtcggtgttgagcagggcactattcaggaaacctacgctaaggctcactgggagtcggctggtgtaaacgtgacctcgtaccagaaccaagatctggtgtatcaggatatgcaatctggccgtctggatgcctttctgcaagacgcgatcgctgcggacttgggcttcctgaaaaccccgaaaggccatgacttcgcctttgccggcccgaacctggatgatccgagtaccttgggtaccggtgctgccatcggcctacgcaaggaagatgttgacctgcgacaagccatcaatatggcgttggctgccatcatgacagacggtacctacaagaagcttgagcagaagtatttctccttcaacatctactaa

SEQ ID NO: 2533 - protein, 255 aa, Burkholderia vietnamiensis G4
MKKLAISVALALAATSVYAKDWKEIRFGTEPTSPPFESKAIDGKLVGFDIDLGNAICAKLKAKCVWVENDFDGMIPALKAKKFDGILASMTVTEKRMQEIAFSDKIYNTPTRLVTKKGSGLLPIATSLKGKRVGVEQGTIQETYAKAHWESAGVNVTSYQNQDLVYQDMQSGRLDAFLQDAIAADLGFLKTPKGHDFAFAGPNLDDPSTLGTGAAIGLRKEDVDLRQAINMALAAIMTDGTYKKLEQKYFSFNIY

SEQ ID NO: 2534 - DNA, 783 bp, Burkholderia vietnamiensis G4
  CDS (1)..(783): transl_table=11
atgaagagactgattgccgccgtttcgatcgccctgctcgcggtatcggccggccccgccgccgcgaaggactggaccacgctgcggttcggtaccgatgccagctacgcgccgttcgaatcgaaggcgccggacggcaagctcgtcggcttcgacatcgacctcggcaacgagatctgcgcgcggctgaaggcgaagtgcgtgtggctcgagaacgatttcgacgggatgatccccgcgctgaaggcgaagaagttcgatgcggtgctgtcgtcgatgtcgatcacgccgcagcgcgcggaacagatcggcttcacgacgaagatctacaaccagccgacccgtctcgtcgtgaagaagggctcgccgttgctgccgaccgccgaatcgctgaagggcaagtcgatcggcgtcgaacagggcaccacgcaggaggcgtatgcgaaggcgtactgggcgaagcagggtgcgaacgtcgtgtcgtaccagaaccaggacggcgtctatgcggacctgaccgccggccgcctcgatgccgcgctgcaggacgaggtgcaggcagcgatcggcttcctgaagtcgccgcgcggcgcgggttatcagttcgtcgggccggagctggtcgacgagaaggtgctcggcatcggcgccggcatcgggctgcgcaaggaagacaccgacctgaaggcgaagatcgaccgcgcgatcctcgacatggtcaaggacggcacctacaaacggctggcgtcgaagtacctcgacttcgatatctacggcgggtga

SEQ ID NO: 2535 - protein, 260 aa, Burkholderia vietnamiensis G4
MKRLIAAVSIALLAVSAGPAAAKDWTTLRFGTDASYAPFESKAPDGKLVGFDIDLGNEICARLKAKCVWLENDFDGMIPALKAKKFDAVLSSMSITPQRAEQIGFTTKIYNQPTRLVVKKGSPLLPTAESLKGKSIGVEQGTTQEAYAKAYWAKQGANVVSYQNQDGVYADLTAGRLDAALQDEVQAAIGFLKSPRGAGYQFVGPELVDEKVLGIGAGIGLRKEDTDLKAKIDRAILDMVKDGTYKRLASKYLDFDIYGG

SEQ ID NO: 2536 - DNA, 795 bp, Burkholderia vietnamiensis G4
  CDS (1)..(795): transl_table=11
atgaagttggtttggcgtaagttggccgcgcacgcggtcgtggcagcatcggtcgtggcggcaggcagcgcgatggccgcggatctgaaggagatccggttcggcgtcgaggcctcgtatgcgccgttcgaatacaagacgcccgacggcaagctgaccggcttcgacatcgacatcggcaacgcggtgtgcgcgaagctgaaaaccaagtgcgtgtgggtcgagaacgacttcgacgggctgattccggcgctgcaggcgcgcaagttcgacgcgatcaactcggacatgacgatcaccgagcagcgcaagcacgcggtcgcgttcaccgatccgatctacacgatccccaaccagctgatcgcgaagcagggcagcggcctgctgccgacgccgcaagcgctgaagggcaagcgcgtcggcgtgctgcagggcacgatccaggaagcctacgcgaagaagaagtgggcgccggccggcgtcgaagtcgtgccgtaccagacccaggacctcgcatacgccgacctgaagtcgggccgtctcgacgcgacgttccaggattcggaagcgggcgcgaagggcttcctgtcgaagccgcaaggccagggcttcgcattcgcgggcggcaccgtcagcgatgccgagattctcggctcgggcgtcggcttcggcctgcgcaagaacgacgcggcgctgaagaccgcgctcgatcaggcgctcaaggagctgaaggccgacggcacgatcgacacgctcgcgaagaaatacttcagcgtgccggtgacgctcaagtaa

SEQ ID NO: 2537 - protein, 264 aa, Burkholderia vietnamiensis G4
MKLVWRKLAAHAVVAASVVAAGSAMAADLKEIRFGVEASYAPFEYKTPDGKLTGFDIDIGNAVCAKLKTKCVWVENDFDGLIPALQARKFDAINSDMTITEQRKHAVAFTDPIYTIPNQLIAKQGSGLLPTPQALKGKRVGVLQGTIQEAYAKKKWAPAGVEVVPYQTQDLAYADLKSGRLDATFQDSEAGAKGFLSKPQGQGFAFAGGTVSDAEILGSGVGFGLRKNDAALKTALDQALKELKADGTIDTLAKKYFSVPVTLK

SEQ ID NO: 2538 - DNA, 783 bp, Salmonella typhimurium
  CDS (1)..(783): transl_table=11
atgaagaagaccgttctcgctttgtctttgctgataggtctgggcgcgacggcggccagttacgccgcgctcccgcaaacggttcgtattggaacagataccacctacgcgcctttctcatcaaaagatgccaaaggcgagtttattggctttgatatcgatctcggtaatgaaatgtgtaagcgtatgcaggtgaaatgtacctgggtcgccagcgactttgatgcgcttattccctcactaaaagcgaaaaaaattgatgccattatttcatcgctctctatcaccgataaacgccagcaagaaattgcgttttccgacaaactttacgcggcggattcacgcctgattgcggcaaaagggtctcccattcagccgacgctggaatcgctgaaaggcaagcatgtcggcgtgctgcaagggtccacgcaagaggcttacgccaatgataactggcgcactaaaggtgtggatgtggtggcttatgccaaccaggatcttatctattccgatttaaccgccggtcgtctggatgccgcattacaggatgaagtcgccgccagcgaaggtttcctgaagcagccagcgggcaaagagtatgcgtttgccggtccttccgtgaaggataaaaaatattttggcgacgggacgggggttgggctgcgtaaagatgataccgagctaaaagccgcgtttgataaagcgctgaccgaactgcgccaggacggaacttacgacaaaatggccaaaaagtacttcgattttaatgtttacggcgattga

SEQ ID NO: 2539 - protein, 260 aa, Salmonella typhimurium
MKKTVLALSLLIGLGATAASYAALPQTVRIGTDTTYAPFSSKDAKGEFIGFDIDLGNEMCKRMQVKCTWVASDFDALIPSLKAKKIDAIISSLSITDKRQQEIAFSDKLYAADSRLIAAKGSPIQPTLESLKGKHVGVLQGSTQEAYANDNWRTKGVDVVAYANQDLIYSDLTAGRLDAALQDEVAASEGFLKQPAGKEYAFAGPSVKDKKYFGDGTGVGLRKDDTELKAAFDKALTELRQDGTYDKMAKKYFDFNVYGD

SEQ ID NO: 2540 - DNA, 783 bp, Escherichia coli O157
  CDS (1)..(783): transl_table=11
atgaaaaaactggtgctatcgctctctctggttctggccttctccagcgcaactgcggcatttgctgcgattccgcaaaacatccgcatcggtaccgacccgacctatgcgccatttgaatcaaaaaattcacaaggcgaactggttggcttcgatatcgatctggcaaaggaattatgcaaacgcatcaatacgcaatgtacgtttgtcgaaaatccgctggatgcgttaatcccgtccttaaaagcgaagaagattgacgccatcatgtcatcgctttccattacggaaaaacgtcagcaagaaatagccttcaccgacaaactgtacgctgccgattctcgtctggtggtggcgaaaaattctgacattcagccgacagtcgagtcgctgaaaggcaaacgggtaggcgtattgcagggcactacccaggagacgttcggtaatgaacattgggcaccaaaaggcattgaaatcgtctcgtatcaggggcaggacaacatttattctgacctgactgccggacgtattgatgccgcgttccaggatgaggtcgctgccagcgaaggtttcctcaaacaacctgtcggtaaagattacaaattcggtggcccgtctgttaaagatgaaaaactgtttggcgtagggaccggcatgggcctgcgtaaagaagataacgaactgcgcgaggcactgaacaaagcctttgccgaaatgcgcgctgacggtacttacgagaaattagcgaaaaagtacttcgattttgatgtttatggtggttaa

SEQ ID NO: 2541 - protein, 260 aa, Escherichia coli O157
MKKLVLSLSLVLAFSSATAAFAAIPQNIRIGTDPTYAPFESKNSQGELVGFDIDLAKELCKRINTQCTFVENPLDALIPSLKAKKIDAIMSSLSITEKRQQEIAFTDKLYAADSRLVVAKNSDIQPTVESLKGKRVGVLQGTTQETFGNEHWAPKGIEIVSYQGQDNIYSDLTAGRIDAAFQDEVAASEGFLKQPVGKDYKFGGPSVKDEKLFGVGTGMGLRKEDNELREALNKAFAEMRADGTYEKLAKKYFDFDVYGG

SEQ ID NO: 2542 - DNA, 783 bp, Salmonella typhimurium
  CDS (1)..(783): transl_table=11
atgaaaaaactggcgttatccctttctctggtgctggcattttccagcgctaccgcagcatttgccgctattccacaaaagattcgcatcggtaccgatcctacatacgcaccgtttgaatccaaaaatgcacaaggtgaattggtcggctttgatatcgatctggccaaagagctgtgcaaacgtatcaacacacagtgtacgttcgtggaaaacccgctggatgcgctgattccgtctttaaaagcgaagaaaattgatgccatcatgtcctcgctgtccatcactgaaaagcgccagcaggaaatcgcgtttaccgacaagctttacgccgctgattcccgtctggtggtggcgaagaactctgatattcagccgaccgtcgcgtcgctgaaaggcaagcgcgtcggcgtgctacaggggacgacgcaggagaccttcggcaatgagcactgggcgccgaaagggattgagatcgtctcttaccaggggcaggacaacatttattccgacctgacggctggccgtattgatgcggcgttccaggacgaggtcgcggccagcgaaggtttccttaaacagcccgtcggaaaagactataaattcggcggcccggcggtgaaagatgagaagttattcggcgtaggaaccggtatggggctgcgcaaagaggataacgagctgcgcgaagcgctgaacaaagcctttgctgaaatgcgtgctgacggtacttacgaaaagctggcgaaaaagtactttgattttgatgtttatggcggttaa

SEQ ID NO: 2543 - protein, 260 aa, Salmonella typhimurium
MKKLALSLSLVLAFSSATAAFAAIPQKIRIGTDPTYAPFESKNAQGELVGFDIDLAKELCKRINTQCTFVENPLDALIPSLKAKKIDAIMSSLSITEKRQQEIAFTDKLYAADSRLVVAKNSDIQPTVASLKGKRVGVLQGTTQETFGNEHWAPKGIEIVSYQGQDNIYSDLTAGRIDAAFQDEVAASEGFLKQPVGKDYKFGGPAVKDEKLFGVGTGMGLRKEDNELREALNKAFAEMRADGTYEKLAKKYFDFDVYGG

SEQ ID NO: 2544 - DNA, 24 bp, Artificial sequence
  primer
atgaagaagtcgattctcgctctg

SEQ ID NO: 2545 - DNA, 26 bp, Artificial sequence
  primer
ttagtcaccgtagacattaaagtcga

SEQ ID NO: 2546 - protein, 261 aa, Artificial sequence
  consensus sequence
  Variant (3)..(18): Xaa in position 3 to 18 is any amino acid
  Variant (19)..(25): Xaa in position 19 to 25 is any or no amino acid
  Variant (27)..(32): Xaa in position 27 to 32 is any amino acid
  Variant (33)..(34): Xaa in position 33 to 34 is any or no amino acid
  Variant (36)..(36): Xaa in position 36 is any amino acid
  Variant (38)..(41): Xaa in position 38 to 41 is any amino acid
  Variant (43)..(43): Xaa in position 43 is any amino acid
  Variant (47)..(47): Xaa in position 47 is any amino acid
  Variant (49)..(51): Xaa in position 49 to 51 is any amino acid
  Variant (53)..(55): Xaa in position 53 to 55 is any amino acid
  Variant (59)..(59): Xaa in position 59 is any amino acid
  Variant (61)..(65): Xaa in position 61 to 65 is any amino acid
  Variant (67)..(72): Xaa in position 67 to 72 is any amino acid
  Variant (74)..(74): Xaa in position 74 is any amino acid
  Variant (76)..(76): Xaa in position 76 is any amino acid
  Variant (78)..(80): Xaa in position 78 to 80 is any amino acid
  Variant (82)..(83): Xaa in position 82 to 83 is any amino acid
  Variant (86)..(86): Xaa in position 86 is any amino acid
  Variant (88)..(88): Xaa in position 88 is any amino acid
  Variant (90)..(90): Xaa in position 90 is any amino acid
  Variant (92)..(92): Xaa in position 92 is any amino acid
  Variant (94)..(96): Xaa in position 94 to 96 is any amino acid
  Variant (99)..(101): Xaa in position 99 to 101 is any amino acid
  Variant (103)..(104): Xaa in position 103 to 104 is any amino acid
  Variant (106)..(108): Xaa in position 106 to 108 is any amino acid
  Variant (110)..(110): Xaa in position 110 is any amino acid
  Variant (112)..(126): Xaa in position 112 to 126 is any amino acid
  Variant (128)..(135): Xaa in position 128 to 135 is any amino acid
  Variant (141)..(141): Xaa in position 141 is any amino acid
  Variant (145)..(145): Xaa in position 145 is any amino acid
  Variant (148)..(149): Xaa in position 148 to 149 is any amino acid
  Variant (152)..(153): Xaa in position 152 to 153 is any amino acid
  Variant (155)..(161): Xaa in position 155 to 161 is any amino acid
  Variant (163)..(167): Xaa in position 163 to 167 is any amino acid
  Variant (169)..(170): Xaa in position 169 to 170 is any amino acid
  Variant (173)..(174): Xaa in position 173 to 174 is any amino acid
  Variant (176)..(176): Xaa in position 176 is any amino acid
  Variant (179)..(180): Xaa in position 179 to 180 is any amino acid
  Variant (183)..(183): Xaa in position 183 is any amino acid
  Variant (186)..(187): Xaa in position 186 to 187 is any amino acid
  Variant (190)..(195): Xaa in position 190 to 195 is any amino acid
  Variant (199)..(200): Xaa in position 199 to 200 is any amino acid
  Variant (202)..(202): Xaa in position 202 is any amino acid
  Variant (204)..(207): Xaa in position 204 to 207 is any amino acid
  Variant (209)..(209): Xaa in position 209 is any amino acid
  Variant (211)..(213): Xaa in position 211 to 213 is any amino acid
  Variant (214)..(214): Xaa in position 214 is any or no amino acid
  Variant (216)..(216): Xaa in position 216 is any amino acid
  Variant (217)..(219): Xaa in position 217 to 219 is any or no amino acid
  Variant (221)..(221): Xaa in position 221 is any amino acid
  Variant (223)..(225): Xaa in position 223 to 225 is any amino acid
  Variant (227)..(227): Xaa in position 227 is any amino acid
  Variant (230)..(230): Xaa in position 230 is any amino acid
  Variant (232)..(233): Xaa in position 232 to 233 is any amino acid
  Variant (235)..(240): Xaa in position 235 to 240 is any amino acid
  Variant (242)..(247): Xaa in position 242 to 247 is any amino acid
  Variant (252)..(256): Xaa in position 252 to 256 is any amino acid
  Variant (257)..(258): Xaa in position 257 to 258 is any or no amino acid
MKXXXXXXXXXXXXXXXXXXXXXXXAXXXXXXXXRXGXXXXYXPFEXKXXXGXXXGFDXDXXXXXCXXXXXXCXWXEXXXDXXIPXLXAXKXDXXXSSXXXTXXRXXXIXFXXXXXXXXXXXXXXXGXXXXXXXXSLKGKXVGVXQGXXQEXXAXXXXXXXGXXXXXYXXQDXXYXDLXXGRXDAXXQDXXXXXXGFLXXPXGXXXXFXGXXXXDXXXXGXGXXXGXRKXDXXLXXXXXXAXXXXXXDGTYXXXXXXXKYF

SEQ ID NO: 2547 - protein, 61 aa, Artificial sequence
  protein pattern
  Variant (2)..(2): Xaa in position 2 is any or no amino acid
  Variant (4)..(4): Xaa in position 4 is any or no amino acid
  Variant (6)..(6): Xaa in position 6 is Ala, Glu or Ser
  Variant (7)..(8): Xaa in position 7 to 8 is any amino acid
  Variant (9)..(9): Xaa in position 9 is Ala, Asp, Gly, Asn or Thr
  Variant (10)..(10): Xaa in position 10 is Ala, Asp, Pro or Ser
  Variant (11)..(11): Xaa in position 11 is any amino acid
  Variant (13)..(13): Xaa in position 13 is any amino acid
  Variant (14)..(14): Xaa in position 14 is Phe, Ile, Leu or Val
  Variant (15)..(15): Xaa in position 15 is any amino acid
  Variant (19)..(19): Xaa in position 19 is any amino acid
  Variant (21)..(21): Xaa in position 21 is Ile or Leu
  Variant (22)..(22): Xaa in position 22 is Ala, Gly or Thr
  Variant (23)..(23): Xaa in position 23 is any amino acid
  Variant (24)..(24): Xaa in position 24 is Ala or Glu
  Variant (25)..(25): Xaa in position 25 is Ile, Leu, Met or Val
  Variant (27)..(28): Xaa in position 27 to 28 is any amino acid
  Variant (29)..(29): Xaa in position 29 is Ile, Leu, Met or Val
  Variant (30)..(30): Xaa in position 30 is any amino acid
  Variant (31)..(31): Xaa in position 31 is Ala, Thr or Val
  Variant (32)..(32): Xaa in position 32 is any amino acid
  Variant (34)..(34): Xaa in position 34 is any amino acid
  Variant (35)..(35): Xaa in position 35 is Phe or Trp
  Variant (36)..(37): Xaa in position 36 to 37 is any amino acid
  Variant (38)..(38): Xaa in position 38 is Gly, Asn, Gln or Ser
  Variant (39)..(39): Xaa in position 39 is any amino acid
  Variant (40)..(40): Xaa in position 40 is Phe or Leu
  Variant (42)..(42): Xaa in position 42 is Ala or Gly
  Variant (43)..(43): Xaa in position 43 is Ile, Leu or Met
  Variant (46)..(46): Xaa in position 46 is Ala, Gly or Ser
  Variant (48)..(48): Xaa in position 48 is any amino acid
  Variant (49)..(49): Xaa in position 49 is Ala or Val
  Variant (50)..(50): Xaa in position 50 is any amino acid
  Variant (52)..(52): Xaa in position 52 is any amino acid
  Variant (54)..(54): Xaa in position 54 is any amino acid
  Variant (55)..(55): Xaa in position 55 is Ala, Ile or Val
  Variant (56)..(56): Xaa in position 56 is any amino acid
  Variant (58)..(58): Xaa in position 58 is Asp or Ser
  Variant (59)..(59): Xaa in position 59 is Leu or Met
  Variant (60)..(60): Xaa in position 60 is Ser or Thr
  Variant (61)..(61): Xaa in position 61 is Ile, Met or Val
YXPXFXXXXXXGXXXGFDXDXXXXXCXXXXXXCXXXXXXXDXXIPXLXXXKXDXXXSXXXX

SEQ ID NO: 2548 - protein, 60 aa, Artificial sequence
  protein pattern
  Variant (3)..(3): Xaa in position 3 is any amino acid
  Variant (4)..(4): Xaa in position 4 is Ile or Val
  Variant (6)..(7): Xaa in position 6 to 7 is any amino acid
  Variant (9)..(9): Xaa in position 9 is Ala or Gly
  Variant (10)..(10): Xaa in position 10 is Ser or Thr
  Variant (11)..(11): Xaa in position 11 is any amino acid
  Variant (14)..(15): Xaa in position 14 to 15 is any amino acid
  Variant (16)..(23): Xaa in position 16 to 23 is any or no amino acid
  Variant (25)..(25): Xaa in position 25 is Ala, Ile or Val
  Variant (26)..(28): Xaa in position 26 to 28 is any amino acid
  Variant (29)..(29): Xaa in position 29 is Ala, Pro, Ser or Thr
  Variant (31)..(31): Xaa in position 31 is Ala or Gln
  Variant (32)..(32): Xaa in position 32 is Gly, Asn or Thr
  Variant (35)..(35): Xaa in position 35 is any amino acid
  Variant (36)..(36): Xaa in position 36 is Ala, Ile or Val
  Variant (38)..(38): Xaa in position 38 is Ala, Glu, Gln, Ser or Thr
  Variant (40)..(40): Xaa in position 40 is Leu or Met
  Variant (41)..(42): Xaa in position 41 to 42 is any amino acid
  Variant (45)..(45): Xaa in position 45 is Ile or Leu
  Variant (46)..(46): Xaa in position 46 is Asp or Asn
  Variant (47)..(47): Xaa in position 47 is Ala or Gly
  Variant (48)..(48): Xaa in position 48 is any amino acid
  Variant (49)..(49): Xaa in position 49 is Phe, Ile or Leu
  Variant (51)..(51): Xaa in position 51 is Asp, Gly, Asn or Ser
  Variant (52)..(53): Xaa in position 52 to 53 is any amino acid
  Variant (54)..(54): Xaa in position 54 is Ala or Gln
  Variant (55)..(55): Xaa in position 55 is Ala or Gly
  Variant (56)..(56): Xaa in position 56 is Ala, Asp, Glu or Ser
  Variant (57)..(57): Xaa in position 57 is any amino acid
GKXXGXXQXXXQEXXXXXXXXXXGXXXXXYXXQDXXYXDXXXGRXXXXXQXXXXXXXGFL

SEQ ID NO: 2549 - protein, 36 aa, Artificial sequence
  protein pattern
  Variant (2)..(2): Xaa in position 2 is any amino acid
  Variant (3)..(4): Xaa in position 3 to 4 is any or no amino acid
  Variant (6)..(6): Xaa in position 6 is any amino acid
  Variant (7)..(8): Xaa in position 7 to 8 is any or no amino acid
  Variant (11)..(11): Xaa in position 11 is Ala, Asp, Glu, Gly, Asn or Gln
  Variant (13)..(13): Xaa in position 13 is any amino acid
  Variant (14)..(14): Xaa in position 14 is Ala, Asp, Glu or Gln
  Variant (15)..(18): Xaa in position 15 to 18 is any amino acid
  Variant (19)..(19): Xaa in position 19 is Phe, Ile, Leu or Val
  Variant (20)..(20): Xaa in position 20 is Asp or Asn
  Variant (21)..(21): Xaa in position 21 is any amino acid
  Variant (23)..(23): Xaa in position 23 is Phe, Ile or Leu
  Variant (24)..(24): Xaa in position 24 is any amino acid
  Variant (25)..(25): Xaa in position 25 is Ala, Asp, Glu, Gly, Ser or Thr
  Variant (26)..(26): Xaa in position 26 is Ile, Leu or Met
  Variant (27)..(28): Xaa in position 27 to 28 is any amino acid
  Variant (29)..(29): Xaa in position 29 is Asp or Asn
  Variant (31)..(34): Xaa in position 31 to 34 is any amino acid
  Variant (35)..(35): Xaa in position 35 is Phe, Ile, Leu, Met or Val
  Variant (36)..(36): Xaa in position 36 is Ala, Glu, Asn, Gln or Ser
GXXXGXXXRKXDXXXXXXXXXAXXXXXXXGXXXXXX

SEQ ID NO: 2550 - protein, 29 aa, Artificial sequence
  protein pattern
  Variant (2)..(2): Xaa in position 2 is any amino acid
  Variant (3)..(3): Xaa in position 3 is any or no amino acid
  Variant (5)..(7): Xaa in position 5 to 7 is any or no amino acid
  Variant (9)..(9): Xaa in position 9 is any amino acid
  Variant (11)..(11): Xaa in position 11 is Ser or Thr
  Variant (12)..(12): Xaa in position 12 is Ala, Asp, Asn, Ser or Thr
  Variant (13)..(13): Xaa in position 13 is any amino acid
  Variant (14)..(14): Xaa in position 14 is Ile, Leu or Val
  Variant (15)..(18): Xaa in position 15 to 18 is any amino acid
  Variant (19)..(19): Xaa in position 19 is Ala, Asn, Pro, Ser or Thr
  Variant (20)..(21): Xaa in position 20 to 21 is any amino acid
  Variant (22)..(22): Xaa in position 22 is Ile or Val
  Variant (23)..(25): Xaa in position 23 to 25 is any amino acid
  Variant (26)..(26): Xaa in position 26 is Gly or Asn
  Variant (27)..(27): Xaa in position 27 is Ala or Ser
  Variant (28)..(28): Xaa in position 28 is Ala, Asp, Gly, Asn, Pro or Thr
  Variant (29)..(29): Xaa in position 29 is Phe, Ile, Leu or Val
TXXRXXXIXFXXXXXXXXXXXXXXXXXXX

SEQ ID NO: 2551 - DNA, 927 bp, Escherichia coli
  CDS (1)..(927): transl_table=11
atggcattattattttcaggaggaacaatgtctcaggttcagagtggcattttgccagaacattgccgcgcggcgatttggatcgaagccaacgtgaaaggggaagttgacgccctgcgtgcggccagtaaaacatttgccgacaaactggcaacttttgaagcgaaattcccggacgcgcatcttggtgcggtggttgcctttggtaacaacacctggcgcgctctgagcggcggcgttggggcagaagagctgaaagattttccgggctacggtaaaggccttgcgccgacgacccagttcgatgtgttgatccacattctttctctgcgtcacgacgtaaacttctctgtcgcccaggcggcgatggaagcctttggtgactgcattgaagtgaaagaagagatccacggcttccgttgggttgaagagcgtgacctgagcggctttgttgacggtacggaaaacccggcgggtgaagagacgcgtcgcgaagtggcggttatcaaagacggcgtggatgcgggcggcagctatgtgtttgtccagcgttgggaacacaacctgaagcagctcaaccggatgagcgttcacgatcaggagatggtgatcgggcgcaccaaagaggccaacgaagagatcgacggcgacgaacgtccggaaacctctcacctcacccgcgttgatctgaaagaagatggcaaagggctgaagattgttcgccagagcctgccgtacggcactgccagtggcactcacggtctgtacttctgcgcctactgcgcgcgtctgcataacattgagcagcaactgctgagcatgtttggcgataccgatggtaagcgtgatgcgatgttgcgtttcaccaaaccggtaaccggcggctattatttcgcaccgtcgctggacaagttgatggcgctgtaa

SEQ ID NO: 2552 - protein, 308 aa, Escherichia coli
MALLFSGGTMSQVQSGILPEHCRAAIWIEANVKGEVDALRAASKTFADKLATFEAKFPDAHLGAVVAFGNNTWRALSGGVGAEELKDFPGYGKGLAPTTQFDVLIHILSLRHDVNFSVAQAAMEAFGDCIEVKEEIHGFRWVEERDLSGFVDGTENPAGEETRREVAVIKDGVDAGGSYVFVQRWEHNLKQLNRMSVHDQEMVIGRTKEANEEIDGDERPETSHLTRVDLKEDGKGLKIVRQSLPYGTASGTHGLYFCAYCARLHNIEQQLLSMFGDTDGKRDAMLRFTKPVTGGYYFAPSLDKLMAL

SEQ ID NO: 2553 - DNA, 900 bp, Salmomella typhi
  CDS (1)..(900)
atgtctcaggttcaaagtggcattttgccggaacattgccgtgcggcaatttggattgaagccaatgtaaaaggcgacctggacgccctgcgcgcggccagcagaacatttgccgataaactggcgaccttcgaagtcaaatttccggacgcccatcttggggccgttgtggcgtttggcaacaatacctggcgtgccctgagtggcggcgtcggggcggaagaactgaaagattttattccttatggtaaagggctggcgccagccacgcagtatgacgtgctgatccatatcctttccctgcgccacgatgtgaatttttctgttgctcaggcggcgatggaagccttcggcgactgtatcgacgtgaaagaagaagttcacggcttccgttgggtggaagaacgcgatctgagcggctttgtcgacgggacagagaacccggcgggcgaagagacgcgtcgtgaagtggcggtgatcaaagatggcgtggatgccggcggcagttatgtgttcgtgcagcgttgggaacacaatctcaagcaacttaaccggatgagtattcacgatcaggagatgatgatcgggcgtaccaaagaagccaatgaagagattgacggcgatgcgcgtccggcaacatctcacctgagccgcgtcgatctcaaagaagatggcaaagggctgaagattgtgcgtcagagcctgccatacggcaccgccagcggtactcatggtctctatttctgcgcttactgcgcacgcctgcacaatatcgaacagcagcttctgagtatgttcggcgataccgacggtaaacgcgacgcaatgctgcgcttcaccaaaccggtgactggcggctactattttgcgccgtcgctggatcgcctgttagcgctataa

SEQ ID NO: 2554 - protein, 299 aa, Salmomella typhi
MSQVQSGILPEHCRAAIWIEANVKGDLDALRAASRTFADKLATFEVKFPDAHLGAVVAFGNNTWRALSGGVGAEELKDFIPYGKGLAPATQYDVLIHILSLRHDVNFSVAQAAMEAFGDCIDVKEEVHGFRWVEERDLSGFVDGTENPAGEETRREVAVIKDGVDAGGSYVFVQRWEHNLKQLNRMSIHDQEMMIGRTKEANEEIDGDARPATSHLSRVDLKEDGKGLKIVRQSLPYGTASGTHGLYFCAYCARLHNIEQQLLSMFGDTDGKRDAMLRFTKPVTGGYYFAPSLDRLLAL

SEQ ID NO: 2555 - DNA, 1119 bp, Neisseria meningitidis FAM18
  CDS (1)..(1119): transl_table=11
atggttattccaaatcggaatggaaaagatatgccgaaaccgccggaagcggaaataaagggggcgggaaaggcgacgggcggcacgaaaccgaaaagcggcatcaggtatgcaaacggcggattcacgcacgccgttccggcaaaaatccgcctgccgattcggtgctataatccatccgaaacagatgacaccaaaaaggaacatctcatgaacacgccccaatccgccatcattcccgaccacgcccaagccggcatctttatcgaagccgacttcgccgccaaccgcctcaacgatattaaagccgcctgccgcgcttcgctcgacgcgttaactgccttgaaagcccgctttccggacgatattttgggtctgaccatcgccttcggcagcaaagcctgggcaacattcggacatacggacgaaggcagtgaaatcaaacccttctccgaaatgggcaacgggcttgcgccgtccacgcagcacgatatgtccatccacatccaatccttccgccaaaacgccgcctacgcgcttgcccaatccgttttaggcgcgttcggcgacagcatatgcgtcgcgtccgaagaacacggtttgcgcctgtatcaggatcgcggactggacggtttcgtcgacggcacggaaaacccgcagggcgatgaaaatgtccgcgaagtcgccatcatccccgaaggaaaacccgatgcgggcggcagctatgtcctgctgcaaaaatacctgcacgatttgaaaaaatgggatgccgtccccgtcgccgaacaggaggcctcggtcggacgcggcaaggaaaccgacgacgaattcggccgcgatgtccgcctgcccgattcgcacctcggccgcgtcaacctgaaagaaaacggagtcggcctgaaaatcgtccgccgcagcctgcccttcggcaaaatcagcggcgaacacggtttgatgtttaccgcatactgccgcacgctgcacaatatcgaagcgcaattattgagtatgttcggcgatacggacggcaaaaccgacctgctgctccgacacctctccgccgccgtttcgggcggatactactacgcgccgtctgtcgaacgcctgcaaaacctctaa

SEQ ID NO: 2556 - protein, 372 aa, Neisseria meningitidis FAM18
MVIPNRNGKDMPKPPEAEIKGAGKATGGTKPKSGIRYANGGFTHAVPAKIRLPIRCYNPSETDDTKKEHLMNTPQSAIIPDHAQAGIFIEADFAANRLNDIKAACRASLDALTALKARFPDDILGLTIAFGSKAWATFGHTDEGSEIKPFSEMGNGLAPSTQHDMSIHIQSFRQNAAYALAQSVLGAFGDSICVASEEHGLRLYQDRGLDGFVDGTENPQGDENVREVAIIPEGKPDAGGSYVLLQKYLHDLKKWDAVPVAEQEASVGRGKETDDEFGRDVRLPDSHLGRVNLKENGVGLKIVRRSLPFGKISGEHGLMFTAYCRTLHNIEAQLLSMFGDTDGKTDLLLRHLSAAVSGGYYYAPSVERLQNL

SEQ ID NO: 2557 - DNA, 909 bp, Vibrio cholerae O1 biovar eltor str. N16961
  CDS (1)..(909): transl_table=11
atgtttaagtcacagaccgcaatcttgccagaagctggcccgtttgccctgtacacactactgaaagttcgtcagaaccacgcccatgttttgcaagcgcttaaggctttgcctgcgttagttgaggaaatcaatcaaaatcagccgggagccgagctgacggtttctgtcgcgttcagcaaaggtttttggagccattttgagatggcgtcgccaccagaactgattgattttcctgagctgggtgagggcgaaactcacgcgccaagcacggatgtggatgtgttgatccattgtcacgccacgcgccacgatttgctgttttatactctacgtaaagggattagcgacatagctcaagatattgaaatcgtggatgaaacctatggtttccgttatttagacgcacgtgacatgacgggctttattgatggcacagaaaacccgaaagctgagaaacgtgcggaagtcgcgttggtggctgatggcgactttgcgggaggcagttatgtgatggtacaacgctttgtgcataatttgccggcgtggaatcgtctcaacttagcggcgcaagaaaaagtgattggtcgcactaagcctgattccgtcgagctagaaaatgttcctgccgcttcgcatgtaggtcgagtggatattaaagaagaaggtaaaggattgaagattgttcgccacagtttgccgtatggcagcgtgagcggcgatcacggcctactgtttattgcgtactgtcacacgctgcataatttcaaaactatgctggaaagcatgtacggtgtcactgatggcaaaacagaccaactgctacgctttaccaaagccgtgaccggggcttatttctttgcaccgtcgcaagtgatgttgcaggaactgacactcaagaatcaataa

SEQ ID NO: 2558 - protein, 302 aa, Vibrio cholerae O1 biovar eltor str. N16961
MFKSQTAILPEAGPFALYTLLKVRQNHAHVLQALKALPALVEEINQNQPGAELTVSVAFSKGFWSHFEMASPPELIDFPELGEGETHAPSTDVDVLIHCHATRHDLLFYTLRKGISDIAQDIEIVDETYGFRYLDARDMTGFIDGTENPKAEKRAEVALVADGDFAGGSYVMVQRFVHNLPAWNRLNLAAQEKVIGRTKPDSVELENVPAASHVGRVDIKEEGKGLKIVRHSLPYGSVSGDHGLLFIAYCHTLHNFKTMLESMYGVTDGKTDQLLRFTKAVTGAYFFAPSQVMLQELTLKNQ

SEQ ID NO: 2559 - DNA, 891 bp, Pasteurella multocida subsp. multocida str. Pm70
  CDS (1)..(891): transl_table=11
atgacagcgcaaagtggcgtattattagagcattgcaaagctgcaatttatttagaagcaaacatcacggatctgacggtgattcctgaagcaagtcgtcaattctgtgacaaattagcacaattacaacaaacctatcctgatgctagactcggcgcggttgttgcctttggcgatagggtgtggaaacaattagcaggagagaacagtgcaaaagagctcaaaccttttgtgacattaggtaaaggtgatgcctccgcacctgccacccaatgggatctgttgattcatattcaatctttacgtcctgatgtgaatttttctgtcgccttagccgcgatgaactgctttggtaaagcgattcaggttgagcaagaaattcatggttttcgctgggtagaagaacgtgattttactggttttattgatggtacagaaaatccacaagcagcaaaacgcgcagaagtcgcactcattgcacaaggtgacgatacggatggaagttatgtctttacacaacgctatgagcataatttaaccaaatgggaaaagcttactactgcgaagcaggaaatggtaattgggcggactaagccggacagtattgagttagaaaataaagtggatacctcacatgtagggcgaactgatctaaaagaaaatggcgtgggattaaaaattttacgtcatagtttaccttatggtaaagccagtgagaaacacggtttattctttgttgcttactgtgcaaccctgtataacattgagcaacagttactcaatatgtttggtgaaaaagacggtaaaaccgatcgtttactaggctttactaaagcagtaaccgggagctattattttgcgccgtcgttagagaaattaaaaactctctaa

SEQ ID NO: 2560 - protein, 296 aa, Pasteurella multocida subsp. multocida str. Pm70
MTAQSGVLLEHCKAAIYLEANITDLTVIPEASRQFCDKLAQLQQTYPDARLGAVVAFGDRVWKQLAGENSAKELKPFVTLGKGDASAPATQWDLLIHIQSLRPDVNFSVALAAMNCFGKAIQVEQEIHGFRWVEERDFTGFIDGTENPQAAKRAEVALIAQGDDTDGSYVFTQRYEHNLTKWEKLTTAKQEMVIGRTKPDSIELENKVDTSHVGRTDLKENGVGLKILRHSLPYGKASEKHGLFFVAYCATLYNIEQQLLNMFGEKDGKTDRLLGFTKAVTGSYYFAPSLEKLKTL

SEQ ID NO: 2561 - DNA, 909 bp, Neisseria meningitidis MC58
  CDS (1)..(909): transl_table=11
atgaacacgccccaatccgccatcattcccgaccacgcccaagccggcatctttatcgaagccgacttcgccgccaatcgcctcaacgatattaaagccgcctgccgcgcttcgctcgacgcgttaactgccttgaaagcccgctttccggacgatattttgggtctgaccatcgccttcggcagcaaagcctgggcaacattcggacatacggacgaaggcagtgaaatcaaacccttctccgaaatgggcaacgggcttgcgccgtccacgcagcacgatatgtccatccacatccaatccttccgccaaaacgccgcctacgcgcttgcccaatccgttttgggcgcgttcggcgacagcatatgcgtcgcgtccgaagaacacggtttgcgcctgtatcaggatcgcgggctggacggtttcgtcgacggcacggaaaacccgcagggcgatgaaaatgtccgcgaagtcgccatcatccccgaaggaaaacccgatgcgggcggcagctatgtcctgctgcaaaaatacctgcacgatttgaaaaaatgggatgccgtccccgtcgccgaacaggaggcctcggtcggacgcggcaaggaaaccgacgacgaattcggccgcgatgtccgcctgcccgattcgcacctcggccgcgtcaacctgaaagaaaacggagtcggcctgaaaatcgtccgccgcagcctgcccttcggcaaaatcagcggcgaacacggtttgatgtttaccgcatactgccgcacgctgcacaatatcgaagcgcaattattgagtatgttcggcgatacggacggcaaaaccgacctgctgctccgacatctctccgccgccgtttcgggcggatactactacgcgccgtctgtcgaacgcctgcaaaacctctaa

SEQ ID NO: 2562 - protein, 302 aa, Neisseria meningitidis MC58
MNTPQSAIIPDHAQAGIFIEADFAANRLNDIKAACRASLDALTALKARFPDDILGLTIAFGSKAWATFGHTDEGSEIKPFSEMGNGLAPSTQHDMSIHIQSFRQNAAYALAQSVLGAFGDSICVASEEHGLRLYQDRGLDGFVDGTENPQGDENVREVAIIPEGKPDAGGSYVLLQKYLHDLKKWDAVPVAEQEASVGRGKETDDEFGRDVRLPDSHLGRVNLKENGVGLKIVRRSLPFGKISGEHGLMFTAYCRTLHNIEAQLLSMFGDTDGKTDLLLRHLSAAVSGGYYYAPSVERLQNL

SEQ ID NO: 2563 - DNA, 909 bp, Neisseria meningitidis Z2491
  CDS (1)..(909): transl_table=11
atgaacacgccccaatccgccatcattcccgaccacgcccaagccggcatctttatcgaagccgacttcgccgccaaccgcctcaacgatattaaagccgcctgccgcgcttcgctcgacgcgttatccgccttgaaaacccgctttccggacgatattttgggtctgaccatcgccttcggcagcaaagcctgggcaacattcggacatacggacgaaggcagtgaaatcaaacccttctccgaaatgggcaacgggcttgcgccgtccacgcagcacgatatgtccatccacatccaatctttccgccaaaacgccgcctacgcgcttgcccaatccgttttgggcgcgttcggcgacagcatatgcgtcgcgtccgaagaacacggtttgcgcctgtatcaggatcgcgggctggacggtttcgtcgacggcacggaaaacccgcagggcgatgaaaatgtccgcgaagtcgccatcatccccgaaggaaaacccgatgcgggcggcagctatgtcctgctgcaaaaatacctgcacgatttgaaaaaatgggatgccgtccccgtcgccgaacaggaggcctcggtcggacgcggcaaggaaaccgacgacgaattcggccacgatgtccgcctgcccgattcgcacctcggccgcgtcaacctgaaagaaaacggagtcggcctgaaaatcgtccgccgcagcctgcccttcggcaaaatcagcggcgaacacggtttgatgtttaccgcatactgccgcacgctgcacaatatcgaagcgcaattattgagtatgttcggcgacacggatggcaaaaccgacctgctgctccggcacctctccgccgccgtttcgggcggatactactacgcgccgtctgtcgaacgcctgcaaaacctctaa

SEQ ID NO: 2564 - protein, 302 aa, Neisseria meningitidis Z2491
MNTPQSAIIPDHAQAGIFIEADFAANRLNDIKAACRASLDALSALKTRFPDDILGLTIAFGSKAWATFGHTDEGSEIKPFSEMGNGLAPSTQHDMSIHIQSFRQNAAYALAQSVLGAFGDSICVASEEHGLRLYQDRGLDGFVDGTENPQGDENVREVAIIPEGKPDAGGSYVLLQKYLHDLKKWDAVPVAEQEASVGRGKETDDEFGHDVRLPDSHLGRVNLKENGVGLKIVRRSLPFGKISGEHGLMFTAYCRTLHNIEAQLLSMFGDTDGKTDLLLRHLSAAVSGGYYYAPSVERLQNL

SEQ ID NO: 2565 - DNA, 915 bp, Yersinia pestis KIM
  CDS (1)..(915): transl_table=11
gtgaggaagaaaagcatgactcaagttcagagtggcattctgttggagcactgtcgttttgccatttttatggaagcaaaagtacagggggagttagatgctattcgcctaggatgcaaaaaattctgtcaatcattgcaagagttacagcaacaatttccagatgagcatttaggtgcagtgatcgcctttggctccaatgtctggcacgacttatccaatggacagggcgcaaaagagctaaaaccttttgttccattgggtaaaggcttggctcccgccactcagcgtgacctgctgattcatattcagtcactgcgtcaggatattaactttacgttggcacaagctgcggtagcggcttttggtagcgcgattgcggttgaagaagagacacatggtttccgttgggttgaggagcgtgattttaccggcttcatcgacggtaccgagaacccacaaggcgataagcgcccggaagtggccgtgattgccgatggcgaagaggatgcgggtggcagttatgtgctggttcagcgctatgagcataacctgaacaaatggcagcgcattcctgaaaatgagcaagagaaaattattggccgcaccaaactcgacagccaagagttgccatcagatcagcgcccggatacctctcatgtcagccgtgttgatctgaaagaaaatggcaagggcctgaaaattctgcgccaaagcctgccttatggtctcgccagtggtaaacatgggctgtattttatcgcctattgcgcgcgcttacataatatcgaacagcaattgttgagcatgtttggtgatatagatggtaagcatgatcagttgctgcgttttagcaaaccggttaccggcagctattattttgcaccctcactgacggccttattatctctgtaa

SEQ ID NO: 2566 - protein, 304 aa, Yersinia pestis KIM
MRKKSMTQVQSGILLEHCRFAIFMEAKVQGELDAIRLGCKKFCQSLQELQQQFPDEHLGAVIAFGSNVWHDLSNGQGAKELKPFVPLGKGLAPATQRDLLIHIQSLRQDINFTLAQAAVAAFGSAIAVEEETHGFRWVEERDFTGFIDGTENPQGDKRPEVAVIADGEEDAGGSYVLVQRYEHNLNKWQRIPENEQEKIIGRTKLDSQELPSDQRPDTSHVSRVDLKENGKGLKILRQSLPYGLASGKHGLYFIAYCARLHNIEQQLLSMFGDIDGKHDQLLRFSKPVTGSYYFAPSLTALLSL

SEQ ID NO: 2567 - DNA, 903 bp, Vibrio vulnificus CMCP6
  CDS (1)..(903): transl_table=11
atgtcacttgctcaaacggcgattctgccagaagcgggcccattcgcgttatacactttgcttaaaatcaaccacaatccagcaaaggtattggctcaattacaatcactgccagcattggttgaagagctcaatcaatctcagcctgatgcagagttgacgctttctattgcgtttagcaagtcgttttggcagcaattggatatggcgatgccagcggagctgatcgatttccctgtattgggtgaaggggagattgttgcgccttcaacggatgtggatgtgttactgcattgtcattccaaacgtcatgacctgcatttctacttgctgcgtaaactgctgtcagaggttgcagaagatattactgtcgtcgatgaaacctacgggtatcgttatcttgattcgcgcgatatgaccatgtttgttgatggcactgaaaatccgaaagcagaaaaacgcgcggaagtggcgttgatcccagacggtgaatttgctggtggcagctatgttatggttcagcgatttgagcacaacctacctgcttggaatcgattgaatgtgtctgctcaggagaaagtgattggccgcaccaaaccggattctattgagctggacgatgtccctgctgcctcgcatgttggccgagtggacattaaagaagaaggcaaagggcttaagattgttcgtcacagcttaccgtatggcagtgtgactggttcgcatggcttgctgtttatcgcctactgccacacattgcacaatttcaaagcgatgcttgagagcatgtatggtgtcactgacggtaaaacagaccaattgttgcgtttcaccaaagcggtcaccggtgcgtatttcttcgcgccatcgaaagagatgctgagcgcattagccgtaaaataa

SEQ ID NO: 2568 - protein, 300 aa, Vibrio vulnificus CMCP6
MSLAQTAILPEAGPFALYTLLKINHNPAKVLAQLQSLPALVEELNQSQPDAELTLSIAFSKSFWQQLDMAMPAELIDFPVLGEGEIVAPSTDVDVLLHCHSKRHDLHFYLLRKLLSEVAEDITVVDETYGYRYLDSRDMTMFVDGTENPKAEKRAEVALIPDGEFAGGSYVMVQRFEHNLPAWNRLNVSAQEKVIGRTKPDSIELDDVPAASHVGRVDIKEEGKGLKIVRHSLPYGSVTGSHGLLFIAYCHTLHNFKAMLESMYGVTDGKTDQLLRFTKAVTGAYFFAPSKEMLSALAVK

SEQ ID NO: 2569 - DNA, 903 bp, Vibrio parahaemolyticus RIMD 2210633
  CDS (1)..(903): transl_table=11
atgtcacaagctcaaacggcgatcgtgccagaagcagggccatttgcactgtacactcaactaaaagtgaaccaaaaccgtgaaaacgtattggcgaaactgaaagcgcttcctgagctggttaaagacttaaacaacagtcaaccgggcgctaatctgacgatttccatcgcattcaccaaatcattctggcagcacctaaatattgacgcaccagaagagctgattgatttcccgcaacttggtgaaggcgacattattgcgccaacaacagatgttgatgtgcttattcactgccattctactcgccacgatttgcacttttacgtattgcgcaaattcctaaccgatattgcagaagatgtgacggtcgtggatgaaacgtacggctaccgctacctagatgcacgtgacatgacggactttatcgacggcacagaaaacccgaaaggggacgctcgcgctgacgtagcattggtaaaagatggcccatatgctggtggcagctatgttatggttcagcgttttgagcacaacttgccagcttggaatcgcctaaatatcaaagctcaagagaaagttattggtcgcaccaaaccagattcagtcgagctagaagacgtaccggcagcatctcacgttggtcgagttgatattaaagaagaaggcaaaggtttgaagattgttcgtcatagcttgccatacggcactgtgactggtgcgcacggtctgttgttcatctcttactgcaatacacttcacaatatcaaagtgatgctagagagcatgtacggtgtaaccgacggtaaaacagaccaactgcttcgcttcactaaagcagtaacaggtgcttacttcttcgctccttcacaagaaatgctagcagaactggccattaagtaa

SEQ ID NO: 2570 - protein, 300 aa, Vibrio parahaemolyticus RIMD 2210633
MSQAQTAIVPEAGPFALYTQLKVNQNRENVLAKLKALPELVKDLNNSQPGANLTISIAFTKSFWQHLNIDAPEELIDFPQLGEGDIIAPTTDVDVLIHCHSTRHDLHFYVLRKFLTDIAEDVTVVDETYGYRYLDARDMTDFIDGTENPKGDARADVALVKDGPYAGGSYVMVQRFEHNLPAWNRLNIKAQEKVIGRTKPDSVELEDVPAASHVGRVDIKEEGKGLKIVRHSLPYGTVTGAHGLLFISYCNTLHNIKVMLESMYGVTDGKTDQLLRFTKAVTGAYFFAPSQEMLAELAIK

SEQ ID NO: 2571 - DNA, 903 bp, Vibrio vulnificus YJ016
  CDS (1)..(903): transl_table=11
atgtcacttgctcaaacggcgattctgccagaagcgggcccattcgcgttatacactttgcttaaaatcaaccacaatccagcaaaggtattggctcaattacaatcactgccagcattggttgaagagctcaatcaatctcagcctgatgcagagttgacgctttctattgcgtttagcaagtcgttttggcagcaattggatatggcgatgccagcggagctgatcgatttccctgtattgggtgaaggggagattgttgcgccttcaacggatgtggatgtgttactgcattgtcattccaaacgtcatgacctgcatttctacttgctgcgtaaactgctgtcagaggttgcagaagatattactgtcgtcgatgaaacctacgggtatcgttatcttgattcgcgcgatatgaccatgtttgttgatggcactgaaaatccgaaagcagaaaaacgcgcggaagtggcgttgatcccagacggtgaattcgctggtggcagctatgttatggttcagcgatttgagcacaacctacctgcttggaatcgattgaatgtgtctgctcaggagaaagtgattggccgtactaaaccggattctattgagctggacgatgtccctgctgcttcacacgttggtcgagtggacattaaagaagaaggcaaagggcttaagattgttcgtcacagcttaccgtatggcagtgtgactggttcgcatggcttgctgtttatcgcctactgccacacattgcacaatttcaaagcgatgcttgagagcatgtatggtgtcactgatggtaaaacagaccaattgttgcgtttcaccaaagcagttactggtgcgtatttcttcgcgccatcgaaagagatgctgagtgtattagccgtaaaataa

SEQ ID NO: 2572 - protein, 300 aa, Vibrio vulnificus YJ016
MSLAQTAILPEAGPFALYTLLKINHNPAKVLAQLQSLPALVEELNQSQPDAELTLSIAFSKSFWQQLDMAMPAELIDFPVLGEGEIVAPSTDVDVLLHCHSKRHDLHFYLLRKLLSEVAEDITVVDETYGYRYLDSRDMTMFVDGTENPKAEKRAEVALIPDGEFAGGSYVMVQRFEHNLPAWNRLNVSAQEKVIGRTKPDSIELDDVPAASHVGRVDIKEEGKGLKIVRHSLPYGSVTGSHGLLFIAYCHTLHNFKAMLESMYGVTDGKTDQLLRFTKAVTGAYFFAPSKEMLSVLAVK

SEQ ID NO: 2573 - DNA, 948 bp, Yersinia pestis biovar Microtus str. 91001
  CDS (1)..(948): transl_table=11
atgatattcagcgtaaccaatactgaggttttagtgaggaagaaaagcatgactcaagttcagagtggcattctgttggagcactgtcgttttgccatttttatggaagcaaaagtacagggggagttagatgctattcgcctaggatgcaaaaaattctgtcaatcattgcaagagttacagcaacaatttccagatgagcatttaggtgcagtgatcgcctttggctccaatgtctggcacgacttatccaatggacagggcgcaaaagagctaaaaccttttgttccattgggtaaaggcttggctcccgccactcagcgtgacctgctgattcatattcagtcactgcgtcaggatattaactttacgttggcacaagctgcggtagcggcttttggtagcgcgattgcggttgaagaagagacacatggtttccgttgggttgaggagcgtgattttaccggcttcatcgacggtaccgagaacccacaaggcgataagcgcccggaagtggccgtgattgccgatggcgaagaggatgcgggtggcagttatgtgctggttcagcgctatgagcataacctgaacaaatggcagcgcattcctgaaaatgagcaagagaaaattattggccgcaccaaactcgacagccaagagttgccatcagatcagcgcccggatacctctcatgtcagccgtgttgatctgaaagaaaatggcaagggcctgaaaattctgcgccaaagcctgccttatggtctcgccagtggtaaacatgggctgtattttatcgcctattgcgcgcgcttacataatatcgaacagcaattgttgagcatgtttggtgatatagatggtaagcatgatcagttgctgcgttttagcaaaccggttaccggcagctattattttgcaccctcactgacggccttattatctctgtaa

SEQ ID NO: 2574 - protein, 315 aa, Yersinia pestis biovar Microtus str. 91001
MIFSVTNTEVLVRKKSMTQVQSGILLEHCRFAIFMEAKVQGELDAIRLGCKKFCQSLQELQQQFPDEHLGAVIAFGSNVWHDLSNGQGAKELKPFVPLGKGLAPATQRDLLIHIQSLRQDINFTLAQAAVAAFGSAIAVEEETHGFRWVEERDFTGFIDGTENPQGDKRPEVAVIADGEEDAGGSYVLVQRYEHNLNKWQRIPENEQEKIIGRTKLDSQELPSDQRPDTSHVSRVDLKENGKGLKILRQSLPYGLASGKHGLYFIAYCARLHNIEQQLLSMFGDIDGKHDQLLRFSKPVTGSYYFAPSLTALLSL

SEQ ID NO: 2575 - DNA, 900 bp, Erwinia carotovora subsp. atroseptica SCRI1043
  CDS (1)..(900): transl_table=11
atgacaccaattcaaagcggtattttattggaacaccgccgttttgccatttttatggaagcgatgattcagggagagtttgatgctatccggcagggatgcaaaaaattctgtcagacgttacaagaattacagcagcaatatcccgatgccgggttaggcgccgtgctggcgtttggtaacgatgtttggcgcgatctggactgcaatcactgtgcagcggaactcaagccattcacgcctttgggtaaagggcttgcgcctgccacgcagcgcgatttgttgatccatattcaatcgctccgtcatgatgtcaatttcacgctggcacaggcggcgctcgccgcgtttggtagcgcgattcgtatcgaagaagaaacacacggtttccgttgggtggaagatcgcgatttaagcggctttatcgacggcacggaaaacccgcagggcgatgcccgtcacgccgtggcgattatccctgaaggccagccggatgcgggcggcagctacgtgtttactcaacgctgggaacacaatctgaagcagttacagcgttttagcgtggaacagcaggaacagatgatcggccgtacgaagcaggataatgaagagctatcgtccgatgagcgccctgtcacctcgcacctcagccgcgtggatttaaaggaagatggcaaagggctgaaaatcctgcgtcagagcctgccttatggcaccgccagcgggaagaacgggctttacttcgtcgcttactgcgcgcgtttgcacaacattgagcagcagttgctgagtatgttcggcggtcgtgacggtaaacgtgacgacatgctgcgctttacgcgtgcggtcagcggcagctatttcttcgcgccgtctctggatcagcttttgtccctgtaa

SEQ ID NO: 2576 - protein, 299 aa, Erwinia carotovora subsp. atroseptica SCRI1043
MTPIQSGILLEHRRFAIFMEAMIQGEFDAIRQGCKKFCQTLQELQQQYPDAGLGAVLAFGNDVWRDLDCNHCAAELKPFTPLGKGLAPATQRDLLIHIQSLRHDVNFTLAQAALAAFGSAIRIEEETHGFRWVEDRDLSGFIDGTENPQGDARHAVAIIPEGQPDAGGSYVFTQRWEHNLKQLQRFSVEQQEQMIGRTKQDNEELSSDERPVTSHLSRVDLKEDGKGLKILRQSLPYGTASGKNGLYFVAYCARLHNIEQQLLSMFGGRDGKRDDMLRFTRAVSGSYFFAPSLDQLLSL

SEQ ID NO: 2577 - DNA, 900 bp, Yersinia pseudotuberculosis IP 32953
  CDS (1)..(900): transl_table=11
atgactcaagttcagagtggcattctgttggagcactgtcgttttgccatttttatggaagcaaaagtacagggggagttagatgctattcgcctaggatgcaaaaaattctgtcaatcattgcaagagttacagcaacaatttccagatgagcatttaggtgcagtgatcgcctttggctccaatgtctggcacgacttatccaatggacagggcgcaaaagagctaaaaccttttgttccattgggtaaaggcttggctcccgccactcagcgtgacctgctgattcatattcagtcactgcgtcaggatattaactttacgttggcacaagctgcggtagcggcttttggtagcgcgattgcggttgaagaagagacacatggtttccgttgggttgaggagcgtgattttaccggctttatcgacggtaccgagaacccacaaggcgataagcgcccggaagtggccgtgattgccgatggcgaagaggatgcgggtggcagttatgtgctggttcagcgctatgagcataacctgaacaaatggcagcgcattcctgaaaatgagcaagagaaaattattggccgcaccaaactcgacagccaggagttgccatcagatcagcgcccggagacctctcatgtcagccgtgttgatctgaaagaaaatggcaagggcctgaaaattctgcgccaaagcctgccttatggtctcgccagtggtaaacatgggctgtattttatcgcctattgcgcgcgcttacataatatcgaacagcaattgttgagcatgtttggtgatatagatggtaagcacgatcagttgctgcgttttagcaaaccggttaccggcagctattattttgccccctcactgacggccttattgtcgctgtaa

SEQ ID NO: 2578 - protein, 299 aa, Yersinia pseudotuberculosis IP 32953
MTQVQSGILLEHCRFAIFMEAKVQGELDAIRLGCKKFCQSLQELQQQFPDEHLGAVIAFGSNVWHDLSNGQGAKELKPFVPLGKGLAPATQRDLLIHIQSLRQDINFTLAQAAVAAFGSAIAVEEETHGFRWVEERDFTGFIDGTENPQGDKRPEVAVIADGEEDAGGSYVLVQRYEHNLNKWQRIPENEQEKIIGRTKLDSQELPSDQRPETSHVSRVDLKENGKGLKILRQSLPYGLASGKHGLYFIAYCARLHNIEQQLLSMFGDIDGKHDQLLRFSKPVTGSYYFAPSLTALLSL

SEQ ID NO: 2579 - DNA, 888 bp, Mannheimia succiniciproducens MBEL55E
  CDS (1)..(888): transl_table=11
atgacagttcaaagcggacttttattagaacattgtaaggcggcaatttatctcgaaagtgaaattcataatttatcgctaattcccaaagcctgccgtcaatttaatcaggcgttagagcaattacgcgagcagtatcccgacgccatgttgggagctgtggtggcattcggtgataacgcctggaagcggttatcgcaaaacagtgcgccggagcttaagtcttttgttgctttaggcaaaggtaatctggcggcaccggcgacacagcaggatttattggtacatattcaatctttacggcctgatgtgaattttagtgcggcaaaagcggcaatggatgcgtttggcgaggctattcgggttatgcaggaaattcacggtttccgctgggtggaagaacgtgatttaaccggttttattgacggtacggaaaatccgcaaggtgatgacagacctgtagtcggcaccatagcggaaggtgaagatgccgacggtagttatgtgatgacacaacgctacgaacatgaattagccaaatgggaaaagctttctcagcataagcaggaacaagttatcggcagaactaagccggacagcgaagaattagatgaagtgccggaaacctcccatgtggggcgcacggacttaaaagaagacggcaaaggtttaaaaatcttgcgtcaaagtttaccgtacggtacggcgagcggtacaaacggtttattctttatcgcctattgtgcgactttgcataatatcgaacagcaattgctcagtatgttcggcgagaaagacggcaaaaccgaccgtttgttagggtttaccaaaccggttaccggcagctattattttgcaccgtcactggaaaaattattatcattgtaa

SEQ ID NO: 2580 - protein, 295 aa, Mannheimia succiniciproducens MBEL55E
MTVQSGLLLEHCKAAIYLESEIHNLSLIPKACRQFNQALEQLREQYPDAMLGAVVAFGDNAWKRLSQNSAPELKSFVALGKGNLAAPATQQDLLVHIQSLRPDVNFSAAKAAMDAFGEAIRVMQEIHGFRWVEERDLTGFIDGTENPQGDDRPVVGTIAEGEDADGSYVMTQRYEHELAKWEKLSQHKQEQVIGRTKPDSEELDEVPETSHVGRTDLKEDGKGLKILRQSLPYGTASGTNGLFFIAYCATLHNIEQQLLSMFGEKDGKTDRLLGFTKPVTGSYYFAPSLEKLLSL

SEQ ID NO: 2581 - DNA, 909 bp, Neisseria gonorrhoeae FA 1090
  CDS (1)..(909): transl_table=11
atgaacacgccccaatccgccatcattcccgaccacgcccaagccggcatctttatcgaagccgacttcgccgccaaccgcctcaacgatattaaagccgcctgccgcgcttcgctcgacgcgttatccgccttgaaagcccgctttccggacgatattttgggtctgaccatcgccttcggcagcaaagcctgggcaacattcggacacacggacgaaggcagtgaaatcaaacccttccccgaaatgggcaacgggcttgcgccgtccacgcagcacgatatgtccatccacatccaatccttccgccaaaacgccgcctacgcgcttgcccaatccgttttgggcgcgttcggcgacagcatatgcgtcgcgtccgaagaacacggtttgcgcctgtatcaggatcgcgggctggacggtttcgtcgacggcacggaaaacccgcaaggcgatgaaacaatccgcgaagtcgccatcatccccgaagggctgcccgatgcaggcggcagctatgtcctgctgcaaaaatacctgcacgatttgaaaaaatgggatgccgtccccgtcgccgaacaggaggcctcggtcggacgcagcaaggaaaccgacgacgaattcagccgcgatgtccgcctgcccgattcgcacctcggccgcgtcaacctgaaagaaaacggagtcggcctgaaaatcgtccgccgcagcctgcccttcggcaaaatcagcggcgaacacggtttgatgtttaccgcatactgccgcacgctgcataatatcgaagcgcaattattgagtatgttcggcgacacggacggcaaaaccgacctgctgctccgacacctctccgccgccgtttcgggcggatactactacgcgccgtccgtcgaacgcctgcaaaacctctaa

SEQ ID NO: 2582 - protein, 302 aa, Neisseria gonorrhoeae FA 1090
MNTPQSAIIPDHAQAGIFIEADFAANRLNDIKAACRASLDALSALKARFPDDILGLTIAFGSKAWATFGHTDEGSEIKPFPEMGNGLAPSTQHDMSIHIQSFRQNAAYALAQSVLGAFGDSICVASEEHGLRLYQDRGLDGFVDGTENPQGDETIREVAIIPEGLPDAGGSYVLLQKYLHDLKKWDAVPVAEQEASVGRSKETDDEFSRDVRLPDSHLGRVNLKENGVGLKIVRRSLPFGKISGEHGLMFTAYCRTLHNIEAQLLSMFGDTDGKTDLLLRHLSAAVSGGYYYAPSVERLQNL

SEQ ID NO: 2583 - DNA, 897 bp, Actinobacillus pleuropneumoniae serovar 1 str. 4074
  CDS (1)..(897): transl_table=11
atggcaactccacaatcaggcattacattaacccatcgtaaatcaggcatttttattgaagcgaatgtgctaaatattgaaatgttccgtcctagaattcataacattcagcatcaatttcaagaaattcagcagcagtttgctacagaggcattagggcttaccctggcttttggtaaggcactttggagccagttaaaggctaattccgctaccgaattaaaggattttgtctcactaggaaaagcggaacgagagtatgcgccggcaacccaacgtgattttttagtgcatatccaatctaatcgtccggatattaatttttctatcgctttaatggtggtggaacaattaaaagcggtggcggaaattgtagaggaaacccatggttttcgttgggtggaagagcgtgatttaaccggttttattgatggtacggagaatccgcaaaccgatgaaaaattgcgtgaagtcgctttaattgatgagggtgaagatgccggcggcagttatgtattgagccaacgctatgttcatcaattatcaaaatggcataagatgaacacggagcgtcaggaacaagttatcggcagaacaaaagcggatagcattgagcttgatgatgtgccggaaaattctcatgtagggcgcgtggatttaaaagaaaacggcgaaggtctaaaaattctacgccacagtttgccgtacggtttagcgagtggtgagcatggtttatattttattgcttttgcaaaacgtttacataatatcgaccaacagcttaaaagtatgtttggcgaattagacggtaaaacagaccgcttgttagggtttactaaaccggtttccggtagttactattttgcgccgtcgttagaacaattggctatggtgtaa

SEQ ID NO: 2584 - protein, 298 aa, Actinobacillus pleuropneumoniae serovar 1 str. 4074
MATPQSGITLTHRKSGIFIEANVLNIEMFRPRIHNIQHQFQEIQQQFATEALGLTLAFGKALWSQLKANSATELKDFVSLGKAEREYAPATQRDFLVHIQSNRPDINFSIALMVVEQLKAVAEIVEETHGFRWVEERDLTGFIDGTENPQTDEKLREVALIDEGEDAGGSYVLSQRYVHQLSKWHKMNTERQEQVIGRTKADSIELDDVPENSHVGRVDLKENGEGLKILRHSLPYGLASGEHGLYFIAFAKRLHNIDQQLKSMFGELDGKTDRLLGFTKPVSGSYYFAPSLEQLAMV

SEQ ID NO: 2585 - DNA, 897 bp, Photobacterium sp. SKA34
  CDS (1)..(897): transl_table=11
atgagtattgcccaaccagcaatcgttccagatcgtggcgcctttgccctttatgtggtgatgaatgttgttggtaataagcaaaatgttattgctcaatgccagtcaattcatcagttacttgcggatctcaatattgatcagcaagacgcaaagttacatgcaagtgttgccttcggtaaggcattttgggagtctttaggtcaacaaagccctgcagagttaacagagttccgtcagttaggtgacggtgagactattgcgccagcaacaggtggtgatgtcttactgcatatccattctaatcgtcatgatcttaacttttacgcgtttcgcgttttcttagaaacactgtctcaagacgtagaagtgttagatgaaacttatgggttccaataccttgatcaccgtgatatgactgatttcattgacggaacagaaaacccacaaacatcggaagatcgtgctaacgttggtgtcattgctgaaggtgagtttgcgggtggtagctatgtaatggtacagcgttatattcataacctaccagcatggcatcgcctaaacgtcaaagcacaagaaaaagtgattggtcgtacgaaagctgattctgtagagctagaagatgttccagcggcatcacatgttggccgcgttgatattaaagaaaatggtaaaggcttaaaaatcttacgtcacagcttgccatacggctctgtaacagctgaacacggtttattattcattgcttactgtcagcgtcagtaccactttgatgcacagcttgaaagtatgtttggtgaaacggatggtaagacagatcagatgctacgtttctcaaaacctgttactggggcttacttctttgctccatcaatggcgatgttaaacaacctttaa

SEQ ID NO: 2586 - protein, 298 aa, Photobacterium sp. SKA34
MSIAQPAIVPDRGAFALYVVMNVVGNKQNVIAQCQSIHQLLADLNIDQQDAKLHASVAFGKAFWESLGQQSPAELTEFRQLGDGETIAPATGGDVLLHIHSNRHDLNFYAFRVFLETLSQDVEVLDETYGFQYLDHRDMTDFIDGTENPQTSEDRANVGVIAEGEFAGGSYVMVQRYIHNLPAWHRLNVKAQEKVIGRTKADSVELEDVPAASHVGRVDIKENGKGLKILRHSLPYGSVTAEHGLLFIAYCQRQYHFDAQLESMFGETDGKTDQMLRFSKPVTGAYFFAPSMAMLNNL

SEQ ID NO: 2587 - DNA, 903 bp, Vibrio sp. Ex25
  CDS (1)..(903): transl_table=11
atgtcacaagctcaaacggcgatcgtgccagaagcagggccatttgcactgtacactcaacttaaagtgaaccaaaaccgtgaaaacgtattggataagctgaaagcactaccaaagttagtggaagagttaaatattacccagccaggcgcggcgctgaccctttctatcgcattcacaaaatcgttttggcaacacctcaatgtagacgcgccagaagagcttattgattttactcaacttggcgaaggggacatcgtagcgcctgcaacggatgttgatgtgctgattcactgtcactctactcgtcacgacttgcacttttatgttctgcgtaagttcctagaagagacggcagaagatgtcaccattgtggacgaaacgtatgggtaccgttaccttgatgctcgcgatatgacagactttattgatgggacagaaaacccgaaaggggaggctcgcactgatgtggctctagtaaaagagggcccatttgctggaggtagttatgtcatggctcaacgcttcgaacataaccttgccgcttggaatcgcttgaatgtcaaagcgcaagaaaaagtgattggtcgtaccaaaccagactctatcgagctagaagacgttcctgctgcatcacacgttggtcgcgttgatattaaagaagaaggaaaaggtctcaagattgttcgtcatagcttgccatacgggacggtaacagggcctcatggcctgctgtttatctcttactgtaatacacttcataacattaaagtgatgctagaaagtatgtacggcgtgacagatggtaaaacagaccaaatgcttcgtttcacaaaagcggtaactggtgcgtacttcttcgctccttcacaagaaatgctcgcagagctagccatcaagtaa

SEQ ID NO: 2588 - protein, 300 aa, Vibrio sp. Ex25
MSQAQTAIVPEAGPFALYTQLKVNQNRENVLDKLKALPKLVEELNITQPGAALTLSIAFTKSFWQHLNVDAPEELIDFTQLGEGDIVAPATDVDVLIHCHSTRHDLHFYVLRKFLEETAEDVTIVDETYGYRYLDARDMTDFIDGTENPKGEARTDVALVKEGPFAGGSYVMAQRFEHNLAAWNRLNVKAQEKVIGRTKPDSIELEDVPAASHVGRVDIKEEGKGLKIVRHSLPYGTVTGPHGLLFISYCNTLHNIKVMLESMYGVTDGKTDQMLRFTKAVTGAYFFAPSQEMLAELAIK

SEQ ID NO: 2589 - DNA, 1089 bp, Vibrio cholerae
  CDS (1)..(1089): transl_table=11
atgtttaagtcacagaccgcaatcttgccagaagctggcccgtttgccctgtacacactactgaaagttcgtcagaaccacgcccatgttttgcaagcgcttaaggctttgcctgcgttagttgaggaaatcaatcaaaatcagccgggagccgagctgacggtttctgtcgcgttcagcaaaggtttttggagccattttgagatggcgtcgccaccagaactgattgattttcctgagctgggtgagggcgaaactcacgcgccaagcacggatgtggatgtgttgatccattgtcacgccacgcgccacgatttgctgttttatactctacgtaaagggattagcgacatagctcaagatattgaaatcgtggatgaaacctatggtttccgttatttagacgcacgtgacatgacgggctttattgatggcacagaaaacccgaaagctgagaaacgtgcggaagtcgcgttggtggctgatggcgactttgcgggaggcagttatgtgatggtacaacgctttgtgcataatttgccggcgtggaatcgtctcaacttagcggcgcaagaaaaagtgattggtcgcactaagcctgattccgtcgagctagaaaatgttcctgccgcttcgcatgtaggtcgagtggatattaaagaagaaggtaaaggattgaagattgttcgccacagcttgccgtatggcagcgtgagcggcgatcacggcctactgtttattgcgtactgtcacacgctgcataatttcaaaactatgctggaaagcatgtacggtgtcactgatggcaaaacagaccaactgctacgctttaccaaagaccgtgaccggggcttatttctttgcaccgtcgcaagtgatgttgcaggaactgacactcaagaatcaataatgcaacactgttgcatatgtttcatgccaaagccgagcctagtgctcggttttttgattaaagaaaactcactttacaccgataaaagaacaagtaagcaatcgtgtaaggagtgcagcagccatggccatgacggtaaataccaatgtgtctgcgctggtagcacagcgacatcttaa

SEQ ID NO: 2590 - protein, 362 aa, Vibrio cholerae
MFKSQTAILPEAGPFALYTLLKVRQNHAHVLQALKALPALVEEINQNQPGAELTVSVAFSKGFWSHFEMASPPELIDFPELGEGETHAPSTDVDVLIHCHATRHDLLFYTLRKGISDIAQDIEIVDETYGFRYLDARDMTGFIDGTENPKAEKRAEVALVADGDFAGGSYVMVQRFVHNLPAWNRLNLAAQEKVIGRTKPDSVELENVPAASHVGRVDIKEEGKGLKIVRHSLPYGSVSGDHGLLFIAYCHTLHNFKTMLESMYGVTDGKTDQLLRFTKDRDRGLFLCTVASDVAGTDTQESIMQHCCICFMPKPSLVLGFLIKENSLYTDKRTSKQSCKECSSHGHDGKYQCVCAGSTATS

SEQ ID NO: 2591 - DNA, 26 bp, Artificial sequence
  primer
atggcattattattttcaggaggaac

SEQ ID NO: 2592 - DNA, 23 bp, Artificial sequence
  primer
ttacagcgccatcaacttgtcca

SEQ ID NO: 2593 - protein, 329 aa, Artificial sequence
  consensus sequence
  Variant (2)..(4): Xaa in position 2 to 4 is any amino acid
  Variant (6)..(7): Xaa in position 6 to 7 is any amino acid
  Variant (9)..(47): Xaa in position 9 to 47 is any amino acid
  Variant (48)..(49): Xaa in position 48 to 49 is any or no amino acid
  Variant (51)..(53): Xaa in position 51 to 53 is any amino acid
  Variant (55)..(58): Xaa in position 55 to 58 is any amino acid
  Variant (61)..(64): Xaa in position 61 to 64 is any amino acid
  Variant (66)..(74): Xaa in position 66 to 74 is any amino acid
  Variant (75)..(75): Xaa in position 75 is any or no amino acid
  Variant (78)..(79): Xaa in position 78 to 79 is any amino acid
  Variant (81)..(83): Xaa in position 81 to 83 is any amino acid
  Variant (85)..(85): Xaa in position 85 is any amino acid
  Variant (87)..(87): Xaa in position 87 is any amino acid
  Variant (88)..(90): Xaa in position 88 to 90 is any or no amino acid
  Variant (93)..(93): Xaa in position 93 is any amino acid
  Variant (95)..(96): Xaa in position 95 to 96 is any amino acid
  Variant (98)..(98): Xaa in position 98 is any amino acid
  Variant (100)..(100): Xaa in position 100 is any amino acid
  Variant (102)..(103): Xaa in position 102 to 103 is any amino acid
  Variant (105)..(105): Xaa in position 105 is any amino acid
  Variant (107)..(107): Xaa in position 107 is any amino acid
  Variant (109)..(110): Xaa in position 109 to 110 is any amino acid
  Variant (112)..(124): Xaa in position 112 to 124 is any amino acid
  Variant (126)..(129): Xaa in position 126 to 129 is any amino acid
  Variant (131)..(132): Xaa in position 131 to 132 is any amino acid
  Variant (134)..(134): Xaa in position 134 is any amino acid
  Variant (136)..(139): Xaa in position 136 to 139 is any amino acid
  Variant (142)..(144): Xaa in position 142 to 144 is any amino acid
  Variant (146)..(146): Xaa in position 146 is any amino acid
  Variant (153)..(159): Xaa in position 153 to 159 is any amino acid
  Variant (160)..(160): Xaa in position 160 is any or no amino acid
  Variant (163)..(163): Xaa in position 163 is any amino acid
  Variant (165)..(166): Xaa in position 165 to 166 is any amino acid
  Variant (168)..(169): Xaa in position 168 to 169 is any amino acid
  Variant (170)..(170): Xaa in position 170 is any or no amino acid
  Variant (177)..(178): Xaa in position 177 to 178 is any amino acid
  Variant (181)..(182): Xaa in position 181 to 182 is any amino acid
  Variant (184)..(184): Xaa in position 184 is any amino acid
  Variant (186)..(187): Xaa in position 186 to 187 is any amino acid
  Variant (189)..(195): Xaa in position 189 to 195 is any amino acid
  Variant (198)..(199): Xaa in position 198 to 199 is any amino acid
  Variant (205)..(208): Xaa in position 205 to 208 is any amino acid
  Variant (210)..(216): Xaa in position 210 to 216 is any amino acid
  Variant (217)..(218): Xaa in position 217 to 218 is any or no amino acid
  Variant (221)..(222): Xaa in position 221 to 222 is any amino acid
  Variant (226)..(226): Xaa in position 226 is any amino acid
  Variant (229)..(229): Xaa in position 229 is any amino acid
  Variant (231)..(231): Xaa in position 231 is any amino acid
  Variant (236)..(236): Xaa in position 236 is any amino acid
  Variant (238)..(238): Xaa in position 238 is any amino acid
  Variant (244)..(246): Xaa in position 244 to 246 is any amino acid
  Variant (248)..(248): Xaa in position 248 is any amino acid
  Variant (252)..(252): Xaa in position 252 is any amino acid
  Variant (254)..(254): Xaa in position 254 is any amino acid
  Variant (258)..(259): Xaa in position 258 to 259 is any amino acid
  Variant (263)..(266): Xaa in position 263 to 266 is any amino acid
  Variant (268)..(268): Xaa in position 268 is any amino acid
  Variant (271)..(271): Xaa in position 271 is any amino acid
  Variant (273)..(274): Xaa in position 273 to 274 is any amino acid
  Variant (278)..(278): Xaa in position 278 is any amino acid
  Variant (280)..(281): Xaa in position 280 to 281 is any amino acid
  Variant (284)..(284): Xaa in position 284 is any amino acid
  Variant (286)..(288): Xaa in position 286 to 288 is any amino acid
  Variant (289)..(301): Xaa in position 289 to 301 is any or no amino acid
  Variant (303)..(303): Xaa in position 303 is any amino acid
  Variant (305)..(305): Xaa in position 305 is any amino acid
  Variant (306)..(316): Xaa in position 306 to 316 is any or no amino acid
  Variant (318)..(318): Xaa in position 318 is any amino acid
  Variant (323)..(325): Xaa in position 323 to 325 is any amino acid
  Variant (327)..(328): Xaa in position 327 to 328 is any amino acid
MXXXQXXIXXXXXXXXXXXXXXXXXXXXXXXXXXXXXXXXXXXXXXXXXPXXXLXXXXAFXXXXWXXXXXXXXXXELXXFXXXGXGXXXXAPXTXXDXLXHXXSXRXDXXFXXXXXXXXXXXXXIXXXXEXXGXRXXXXRDXXXFXDGTENPXXXXXXXXVAXIXXGXXXAGGSYVXXQRXXHXLXXWXXXXXXXQEXXIGRTKXXXXEXXXXXXXXXSHXXRVDXKEXGXGLKIXRXSLPYGXXXGXHGLXFXAYCXXLHNXXXXLXSMXGXXDGKXDXXLRXFXXXXXXXXXXXXXXXXVXGXXXXXXXXXXXXYXFAPSXXXLXXL

SEQ ID NO: 2594 - protein, 58 aa, Artificial sequence
  protein pattern
  Variant (2)..(3): Xaa in position 2 to 3 is any amino acid
  Variant (6)..(6): Xaa in position 6 is Asp or Asn
  Variant (7)..(7): Xaa in position 7 is Ile or Leu
  Variant (10)..(10): Xaa in position 10 is Asp, Glu or Asn
  Variant (12)..(12): Xaa in position 12 is any amino acid
  Variant (17)..(17): Xaa in position 17 is Leu or Val
  Variant (19)..(19): Xaa in position 19 is any amino acid
  Variant (23)..(23): Xaa in position 23 is Phe or Tyr
  Variant (25)..(25): Xaa in position 25 is any amino acid
  Variant (26)..(26): Xaa in position 26 is Ala, Ile or Val
  Variant (27)..(27): Xaa in position 27 is Ser or Thr
  Variant (29)..(29): Xaa in position 29 is any amino acid
  Variant (33)..(33): Xaa in position 33 is any amino acid
  Variant (35)..(35): Xaa in position 35 is any amino acid
  Variant (36)..(36): Xaa in position 36 is Ala or Ser
  Variant (37)..(37): Xaa in position 37 is Phe or Tyr
  Variant (38)..(38): Xaa in position 38 is Ala or Cys
  Variant (39)..(40): Xaa in position 39 to 40 is any amino acid
  Variant (44)..(44): Xaa in position 44 is Phe or Ile
  Variant (45)..(45): Xaa in position 45 is Asp, Glu or Lys
  Variant (46)..(47): Xaa in position 46 to 47 is any amino acid
  Variant (49)..(49): Xaa in position 49 is any amino acid
  Variant (52)..(52): Xaa in position 52 is Phe or Tyr
  Variant (54)..(55): Xaa in position 54 to 55 is any amino acid
HXXRVXXKEXGXGLKIXRXSLPXGXXXGXHGLXFXXXXXXLHNXXXXLXSMXGXXDGK

SEQ ID NO: 2595 - protein, 57 aa, Artificial sequence
  protein pattern
  Variant (2)..(2): Xaa in position 2 is any or no amino acid
  Variant (4)..(4): Xaa in position 4 is any amino acid
  Variant (5)..(5): Xaa in position 5 is any or no amino acid
  Variant (7)..(8): Xaa in position 7 to 8 is any amino acid
  Variant (9)..(9): Xaa in position 9 is Ala or Ser
  Variant (10)..(10): Xaa in position 10 is any amino acid
  Variant (12)..(12): Xaa in position 12 is any amino acid
  Variant (14)..(14): Xaa in position 14 is Ile, Leu or Val
  Variant (15)..(15): Xaa in position 15 is any amino acid
  Variant (17)..(22): Xaa in position 17 to 22 is any amino acid
  Variant (23)..(23): Xaa in position 23 is Ile, Leu, Met or Val
  Variant (24)..(24): Xaa in position 24 is Ala, Asp, Glu, Asn, Ser or Thr
  Variant (25)..(28): Xaa in position 25 to 28 is any amino acid
  Variant (29)..(29): Xaa in position 29 is Ala, Cys, Asp or Val
  Variant (30)..(30): Xaa in position 30 is Ala, Ile or Val
  Variant (31)..(31): Xaa in position 31 is any amino acid
  Variant (32)..(32): Xaa in position 32 is Ile or Val
  Variant (33)..(33): Xaa in position 33 is any amino acid
  Variant (34)..(34): Xaa in position 34 is Asp, Glu or Gln
  Variant (36)..(36): Xaa in position 36 is any amino acid
  Variant (37)..(37): Xaa in position 37 is His or Tyr
  Variant (39)..(39): Xaa in position 39 is Phe or Tyr
  Variant (40)..(40): Xaa in position 40 is Gln or Arg
  Variant (41)..(41): Xaa in position 41 is Trp or Tyr
  Variant (42)..(42): Xaa in position 42 is Leu or Val
  Variant (43)..(43): Xaa in position 43 is Asp or Glu
  Variant (44)..(44): Xaa in position 44 is any amino acid
  Variant (47)..(47): Xaa in position 47 is Phe, Leu or Met
  Variant (48)..(48): Xaa in position 48 is Ser or Thr
  Variant (49)..(49): Xaa in position 49 is any amino acid
  Variant (51)..(51): Xaa in position 51 is Ile or Val
DXLXXHXXXXRXDXXFXXXXXXXXXXXXXXXXXXEXXGXXXXXXRDXXXFXDGTENP

SEQ ID NO: 2596 - protein, 39 aa, Artificial sequence
  protein pattern
  Variant (2)..(2): Xaa in position 2 is any or no amino acid
  Variant (6)..(6): Xaa in position 6 is Phe, Leu or Met
  Variant (7)..(7): Xaa in position 7 is Ala, Ser, Thr or Val
  Variant (10)..(10): Xaa in position 10 is Phe, Trp or Tyr
  Variant (11)..(11): Xaa in position 11 is any amino acid
  Variant (13)..(13): Xaa in position 13 is Glu, Asn or Gln
  Variant (15)..(18): Xaa in position 15 to 18 is any amino acid
  Variant (19)..(19): Xaa in position 19 is Lys or Arg
  Variant (20)..(20): Xaa in position 20 is Phe, Ile, Leu or Met
  Variant (21)..(21): Xaa in position 21 is Asn, Pro, Ser or Thr
  Variant (22)..(24): Xaa in position 22 to 24 is any amino acid
  Variant (27)..(27): Xaa in position 27 is any amino acid
  Variant (28)..(28): Xaa in position 28 is Ile, Met or Val
  Variant (34)..(34): Xaa in position 34 is any amino acid
  Variant (35)..(35): Xaa in position 35 is Ala or Asp
  Variant (36)..(36): Xaa in position 36 is Asn or Ser
  Variant (37)..(37): Xaa in position 37 is any amino acid
  Variant (39)..(39): Xaa in position 39 is Ile or Leu
GXSYVXXQRXXHXLXXXXXXXXXXQEXXIGRTKXXXXEX

SEQ ID NO: 2597 - protein, 17 aa, Artificial sequence
  protein pattern
  Variant (3)..(6): Xaa in position 3 to 6 is any amino acid
  Variant (7)..(7): Xaa in position 7 is any or no amino acid
  Variant (9)..(9): Xaa in position 9 is Ser or Thr
  Variant (11)..(11): Xaa in position 11 is Ala, Gly or Ser
  Variant (13)..(14): Xaa in position 13 to 14 is Phe or Tyr
LRXXXXXVXGXYXXAPS

SEQ ID NO: 2598 - protein, 14 aa, Artificial sequence
  protein pattern
  Variant (2)..(2): Xaa in position 2 is Ala, Ser or Thr
  Variant (3)..(3): Xaa in position 3 is Ala or Gly
  Variant (5)..(5): Xaa in position 5 is Phe, Leu or Val
  Variant (6)..(6): Xaa in position 6 is Ile, Leu or Pro
  Variant (8)..(11): Xaa in position 8 to 11 is any or no amino acid
  Variant (13)..(13): Xaa in position 13 is any amino acid
  Variant (14)..(14): Xaa in position 14 is Phe, Trp or Tyr
QXXIXXEXXXXAXX

SEQ ID NO: 2599 - protein, 15 aa, Artificial sequence
  protein pattern
  Variant (2)..(4): Xaa in position 2 to 4 is any or no amino acid
  Variant (7)..(7): Xaa in position 7 is any amino acid
  Variant (8)..(8): Xaa in position 8 is Asp, Glu, Pro or Ser
  Variant (10)..(12): Xaa in position 10 to 12 is any amino acid
  Variant (14)..(14): Xaa in position 14 is Asp, Glu or Lys
  Variant (15)..(15): Xaa in position 15 is Ala or Gly
AXXXELXXFXXXGXX

SEQ ID NO: 2600 - DNA, 1122 bp, Escherichia coli K12
  CDS (1)..(1122)
atggttgctgaattgaccgcattacgcgatcaaattgatgaagtcgataaagcgctgctgaatttattagcgaagcgtctggaactggttgctgaagtgggcgaggtgaaaagccgctttggactgcctatttatgttccggagcgcgaggcatctatgttggcctcgcgtcgtgcagaggcggaagctctgggtgtaccgccagatctgattgaggatgttttgcgtcgggtgatgcgtgaatcttactccagtgaaaacgacaaaggatttaaaacactttgtccgtcactgcgtccggtggttatcgtcggcggtggcggtcagatgggacgcctgttcgagaagatgctgaccctctcgggttatcaggtgcggattctggagcaacatgactgggatcgagcggctgatattgttgccgatgccggaatggtgattgttagtgtgccaatccacgttactgagcaagttattggcaaattaccgcctttaccgaaagattgtattctggtcgatctggcatcagtgaaaaatgggccattacaggccatgctggtggcgcatgatggtccggtgctggggctacacccgatgttcggtccggacagcggtagcctggcaaagcaagttgtggtctggtgtgatggacgtaaaccggaagcataccaatggtttctggagcaaattcaggtctggggcgctcggctgcatcgtattagcgccgtcgagcacgatcagaatatggcgtttattcaggcactgcgccactttgctacttttgcttacgggctgcacctggcagaagaaaatgttcagcttgagcaacttctggcgctctcttcgccgatttaccgccttgagctggcgatggtcgggcgactgtttgctcaggatccgcagctttatgccgacatcattatgtcgtcagagcgtaatctggcgttaatcaaacgttactataagcgtttcggcgaggcgattgagttgctggagcagggcgataagcaggcgtttattgacagtttccgcaaggtggagcactggttcggcgattacgcacagcgttttcagagtgaaagccgcgtgttattgcgtcaggcgaatgacaatcgccagtaa

SEQ ID NO: 2601 - protein, 373 aa, Escherichia coli K12
MVAELTALRDQIDEVDKALLNLLAKRLELVAEVGEVKSRFGLPIYVPEREASMLASRRAEAEALGVPPDLIEDVLRRVMRESYSSENDKGFKTLCPSLRPVVIVGGGGQMGRLFEKMLTLSGYQVRILEQHDWDRAADIVADAGMVIVSVPIHVTEQVIGKLPPLPKDCILVDLASVKNGPLQAMLVAHDGPVLGLHPMFGPDSGSLAKQVVVWCDGRKPEAYQWFLEQIQVWGARLHRISAVEHDQNMAFIQALRHFATFAYGLHLAEENVQLEQLLALSSPIYRLELAMVGRLFAQDPQLYADIIMSSERNLALIKRYYKRFGEAIELLEQGDKQAFIDSFRKVEHWFGDYAQRFQSESRVLLRQANDNRQ

SEQ ID NO: 2602 - DNA, 1125 bp, Proteus mirabilis
  CDS (1)..(1125): transl_table=11
atggctgaagaattacaaaatttgcgagagcaaattgatcaggtggataaaacattgctttctttactcgccaaaagaatgcaattggtagcagaagtgggagaagttaaaaatcgccacgggttacctatctatgcaccagatagagaagccgcaatgcttgcttctcgacgtaatgaagcagaaaaaatgggtatttctgctgatttaattgaagatgttttacgtcgagtaatgagagagtcatatagcaaagaaaatgataaaggctttaaaacacttaatccccaattaggcaaaattgtcattgtgggggggaacggaaaaatggggagacttttttctcgtctctttacactttctggctatcaagtggaaagtcttgaagcggatgagtggcaaagtaaatctccggctatttttgcggatgctggtatggtgataatcagtgtcccaatccatttaacggttgatgttattgagcaattaccgcccttgccagaaaattgtttattggtagatttagcctcaatcaagcaagcgcctttagaggcgatgttaaaagcacataatggccctgttttaggactacatccaatgtttggtccagatgtgccaagtttagcaaaacaagttatcgcttattgtgaagggcgagatttatcacattttgagtggttgcttgagcaacttatggtgtggggagcaagagtagaggctattactgcacaagagcacgataaaaatatgagttttatccaagcattgcgacattttactacttttgcatatgggcaacatttggtgaaagagaatgtcgatttagccagtttattaagattatcttctcccatctatcgtttagagctagcgatgattggtaggctctttgctcaagatccacaattatatgccgatattattttatcttcacaagaaaacattaacttgatccgtagatatcatcattcattaggtgaagctatagccttattagatataaacacaaaagatgaatttattggctcatttaataatgtaagtgattggttcggtgattatgcttcacaatttatgaaagagagtggtgcgttattacaaaaagccaatgatagccggatttag

SEQ ID NO: 2603 - protein, 374 aa, Proteus mirabilis
MAEELQNLREQIDQVDKTLLSLLAKRMQLVAEVGEVKNRHGLPIYAPDREAAMLASRRNEAEKMGISADLIEDVLRRVMRESYSKENDKGFKTLNPQLGKIVIVGGNGKMGRLFSRLFTLSGYQVESLEADEWQSKSPAIFADAGMVIISVPIHLTVDVIEQLPPLPENCLLVDLASIKQAPLEAMLKAHNGPVLGLHPMFGPDVPSLAKQVIAYCEGRDLSHFEWLLEQLMVWGARVEAITAQEHDKNMSFIQALRHFTTFAYGQHLVKENVDLASLLRLSSPIYRLELAMIGRLFAQDPQLYADIILSSQENINLIRRYHHSLGEAIALLDINTKDEFIGSFNNVSDWFGDYASQFMKESGALLQKANDSRI

SEQ ID NO: 2604 - DNA, 1122 bp, Yersinia pestis
  CDS (1)..(1122)
atggtggctgaactgactgctttacgcgatcaaattgatgaagtcgataaagcgttgttggatttgctggctaaacgcctgcatttggtggctgaagtcggtgaagtaaaaagccgttatggcttgccgatatatgttccggatcgtgaggcggcaatgctggcctcacgccggcaagaagccggggcactaggtgttccgccggatttaattgaagatgtgctgcgtcgggtgatgcgggaatcttataccagcgaaaatgataaaggcttcaagacattatgcccggaactgcgtccagtggttatcatcggtggtcaagggcagatgggtcggttatttagccggatgcttaatctgtctggttatcaggtgagaacactggagcaagaagattggtcacaagctgaatctattctggctgatgccgggatggtgattgtgagtgtccccattcatatcactgaagaggtgattaatcggctacccaaattaccagcagattgtattttgctggatttggcctcggtaaaaaataaacccctgcaagctatgctggcagcccatgaagggccagttttggggttgcatccaatgtttggccctgatgtcggcagcttggcgaagcaagtcgtggtgtattgtgatggacgcgatccacaggcgtatcagtggttactggagcagctacaggtctggggagcaagattgcaccgtatcagcgcggtcgaacatgatcaaaacatggcgttcattcaggctctgaggcattttgcgacttttgcgtacggattgcatctggcggaagaaaatgtgcaattggaacaattgctggcactgtcttcaccaatttatcgcctggagctggcaatggttgggcggctatttgcacaagatccacagctttacgctgatatcattatgtcgtcggaagataatctggcgctgattaaacgttactacaaacgctttggtgaggcgctcaccttgttagagcaccatgataaacaagcgtttgttcaaagtttcgagaaagtagaacactggtttggtgattacgcggaacgtttcttggtagagagccgttcattactgcgtcaggcgaacgataatcgtcagtag

SEQ ID NO: 2605 - protein, 373 aa, Yersinia pestis
MVAELTALRDQIDEVDKALLDLLAKRLHLVAEVGEVKSRYGLPIYVPDREAAMLASRRQEAGALGVPPDLIEDVLRRVMRESYTSENDKGFKTLCPELRPVVIIGGQGQMGRLFSRMLNLSGYQVRTLEQEDWSQAESILADAGMVIVSVPIHITEEVINRLPKLPADCILLDLASVKNKPLQAMLAAHEGPVLGLHPMFGPDVGSLAKQVVVYCDGRDPQAYQWLLEQLQVWGARLHRISAVEHDQNMAFIQALRHFATFAYGLHLAEENVQLEQLLALSSPIYRLELAMVGRLFAQDPQLYADIIMSSEDNLALIKRYYKRFGEALTLLEHHDKQAFVQSFEKVEHWFGDYAERFLVESRSLLRQANDNRQ

SEQ ID NO: 2606 - DNA, 1122 bp, Salmonella enterica subsp. enterica serovar Typhi
  CDS (1)..(1122)
atggttgctgaattgaccgcgttacgcgatcaaatagatgatgtcgataaagcgttgttgaatttactggctaagcgcctggaactggttgccaaagtcggcgaggtgaaaagccgttttggcctgcctatttacgtgccggagcgtgaggcctctatgctggcttcacgacgggcggaagcagaagcgatcggtgtcccgcccgatctcattgaagatgtcctgcgccgggtaatgcgtgaatcttactccagcgaaaatgataaggggttcaaaacgctttgtccttctctgcgtccggtcgtcattgtgggcggcggcggacagatggggcgtctgtttgaaaaaatgctcacgctgtcgggctatcaggtccgtattctggaacaacaggactggccgcgcgccagggacattgtcgccgatgccggaatggtgatcgtcagcgtgccgattcatgttactgaacaggtcatagcgcaactgccgcccctgccgtccgactgtattctggtcgatctggcatcggtgaaaagcggtccgttacaggcaatgttggcggcccatgatggccccgtgctgggcttgcacccgatgtttggcccggacagcgggagcctggcgaagcaggtggtggtctggtgtgatgggcgtcaaccggaagcgtatcagtggttccttgagcaaatccaggtgtggggcgcgcggttgcaccgaattagcgctgtcgagcacgatcagaacatggcttttatccaggcgctgcgccactttgctaccttcgcttatgggctgcatctggcggaagagaacgtccagcttgagcagcttctggcgctatcatcgccgatttatcgactggagctggcgatggtcgggcgtctgttcgcccaggacccgcagctgtatgcagacattattatgtcgtcggagcgcaatctggcgcttatcaagcgttactataaacgttttggcgatgcgatcgggttactggaacagggtgataagcaggcttttatcgacagttttcgcaaagttgaacactggtttggcgattatgccagacgcttccagaatgaaagccgtgtgttattacgtcaggcgaatgacagccgaccataa

SEQ ID NO: 2607 - protein, 373 aa, Salmonella enterica subsp. enterica serovar Typhi
MVAELTALRDQIDDVDKALLNLLAKRLELVAKVGEVKSRFGLPIYVPEREASMLASRRAEAEAIGVPPDLIEDVLRRVMRESYSSENDKGFKTLCPSLRPVVIVGGGGQMGRLFEKMLTLSGYQVRILEQQDWPRARDIVADAGMVIVSVPIHVTEQVIAQLPPLPSDCILVDLASVKSGPLQAMLAAHDGPVLGLHPMFGPDSGSLAKQVVVWCDGRQPEAYQWFLEQIQVWGARLHRISAVEHDQNMAFIQALRHFATFAYGLHLAEENVQLEQLLALSSPIYRLELAMVGRLFAQDPQLYADIIMSSERNLALIKRYYKRFGDAIGLLEQGDKQAFIDSFRKVEHWFGDYARRFQNESRVLLRQANDSRP

SEQ ID NO: 2608 - DNA, 1128 bp, Vibrio cholerae
  CDS (1)..(1128)
atggccgtagagttgaatcagttacgcgaccaaatcgatgaagtcgataagcagatggtggagctactggcgcgccgtctggcattggtggagcaggtcgggcaagtgaaaagtcgatatgggttaccgatttatgctcccgatcgtgaagcggcaatgctcgcttcacgtcgagcggaagcggaaagcaaaggtgttccgccccaactgattgaagatattttgcgccgaaccatgcgtgaatcctacgccagtgaaaaggactccggctttaaatgccttaatcctgagttacgttccgtggtgatcgtcggtggtaacggtcagcttgggcgactatttggccgtatgtttaaactctctggctatcaagtcaaagtgctgggcagccaagattgggacaaagcggatgaactgctcagtgatgctggcttagtggtggtcacggtacctatccatttgacgctcggtgttatcgaaaagctgcgccagttaccggacgattgcattttgtgcgatctcacctcaatcaaagccaagccgcttgccgccatgctacaagtgcacaaaggtccagtggttgggctgcaccctatgtttggtccagacgttccaagcttggcgaagcaggtgattgtttactgtgatggtcgaggcaatgaacactaccaatggctcttgcaacagtttgctatttggggcgcaagcttgtgccagattgatgcggatgaacatgatcgtggtatgacacttattcaagcactgcgccacttcacttcctttgcttatggcttgcatctgaccaaagagaacccgaacttggcacaactgctgaaactcagttcaccgatttaccgtttagagcttgccatggtcggacggctatttgggcaagatccccatctgtacggcgatattattctctcatcaccagaaaatattgagatgatccagcgttttcatcgctgcttaagcgatgcggttgagttggtgagcgcgggcgataaggcgagttttgtggctcaatttgaacgagttagccagtggtttggtgattattcacagcagtttatgcatgagagccaaaacttgctcaaacaagcgaatgatgcgatccacagaggttaa

SEQ ID NO: 2609 - protein, 375 aa, Vibrio cholerae
MAVELNQLRDQIDEVDKQMVELLARRLALVEQVGQVKSRYGLPIYAPDREAAMLASRRAEAESKGVPPQLIEDILRRTMRESYASEKDSGFKCLNPELRSVVIVGGNGQLGRLFGRMFKLSGYQVKVLGSQDWDKADELLSDAGLVVVTVPIHLTLGVIEKLRQLPDDCILCDLTSIKAKPLAAMLQVHKGPVVGLHPMFGPDVPSLAKQVIVYCDGRGNEHYQWLLQQFAIWGASLCQIDADEHDRGMTLIQALRHFTSFAYGLHLTKENPNLAQLLKLSSPIYRLELAMVGRLFGQDPHLYGDIILSSPENIEMIQRFHRCLSDAVELVSAGDKASFVAQFERVSQWFGDYSQQFMHESQNLLKQANDAIHRG

SEQ ID NO: 2610 - DNA, 1134 bp, Haemophilus influenzae
  CDS (1)..(1134)
atgagttttatggaagcccttaaagatttacgttctgaaattgattcgcttgatcgcgaacttatccaactttttgctaaacgtcttgagttggtttctcaagtcggtaaagtgaaacatcaacatggattacctatttatgcgccagaacgtgaaatagcaatgctccaagcacgtcgtttagaagctgaaaaagcaggcatttcagccgatttaattgaagatgttctacgccgttttatgcgtgaatcctatgccaatgaaaaccaatttggttttaaaactatcaattctgatattcacaaaattgttattgtgggcggttatggtaaattaggcggcttatttgcccgttatttacgtgcatctggctatccaatttctattttagatcgcgaagattgggcggtggctgaaagtattttagcgaatgctgatgtcgtgatcgtttccgtccctattaatctcaccttagaaacaattgaacgcttaaaaccttatttaacggaaaacatgctacttgcagatttaacctctgttaagcgtgaaccgctagcgaaaatgcttgaagttcatactggtgctgttttaggtttacatccaatgtttggtgcagatattgcaagtatggcaaaacaagtggttgtgcgttgtgatggacgttttcctgaacgttatgaatggttacttgagcaaattcaaatttggggtgcaaaaatttatcaaaccaatgccacagaacacgatcataatatgacttatatacaagccttgcgccatttttcgacttttgcgaatggtttacacctttccaaacagcccattaatctcgctaatttattggcactttcttcccctatttatcggttagaacttgcgatgataggtcgtttatttgcgcaagatgcagagctttacgcagatattattatggataagtcagaaaatttagcggtaattgaaacgctaaaacaaacttacgacgaagccttaactttctttgaaaataatgatcgtcaaggttttattgatgctttccacaaggtgcgtgactggtttggcgattattccgaacaatttttaaaagaaagccgtcagctattgcaacaggcaaatgatttgaaacaagggtag

SEQ ID NO: 2611 - protein, 377 aa, Haemophilus influenzae
MSFMEALKDLRSEIDSLDRELIQLFAKRLELVSQVGKVKHQHGLPIYAPEREIAMLQARRLEAEKAGISADLIEDVLRRFMRESYANENQFGFKTINSDIHKIVIVGGYGKLGGLFARYLRASGYPISILDREDWAVAESILANADVVIVSVPINLTLETIERLKPYLTENMLLADLTSVKREPLAKMLEVHTGAVLGLHPMFGADIASMAKQVVVRCDGRFPERYEWLLEQIQIWGAKIYQTNATEHDHNMTYIQALRHFSTFANGLHLSKQPINLANLLALSSPIYRLELAMIGRLFAQDAELYADIIMDKSENLAVIETLKQTYDEALTFFENNDRQGFIDAFHKVRDWFGDYSEQFLKESRQLLQQANDLKQG

SEQ ID NO: 2612 - DNA, 1122 bp, Erwinia herbicola
  CDS (1)..(1122)
atggtggctgaactgaccgcgttacgcgatcaaattgacagtgtagataaagcgctgctggatctgctggctaagcgactggaactggtggccgaggtaggtgaggtgaagagccgttacggcctgcctatctatgtgcctgagcgtgaggcgtcgatgctggcttcgcgtcgcaaagaggccgaagcgctcggcgtaccaccggatctgattgaggatgtgctgcgtcgcgtgatgcgggaatcctataccagcgagaatgataaaggctttaaaaccctctgtcctgaactgcgcccggtggtgattgtcggtggtaagggccagatgggccggctgtttgaaaaaatgctcgggctatcaggctacacggttaaaacgctggataaagaggactggcctcaggctgagactctgctcagcgatgccggaatggtgatcattagcgtgccgattcacctgaccgagcaggtgattgcccaactgccaccactgccggaagattgtattctggtcgatctggcgtcagtcaaaaaccggcctctgcaggcaatgctggctgcccataacgggcctgtactgggtctgcatccgatgtttggcccggacagcggcagcctggcaaaacaggtggtggtctggtgtgatggaagacaaccggaagcgtatcagtggttcctggagcagattcaggtctggggtgcgcgtctgcatcgtatcagcgctgttgagcatgaccagaacatggcattcattcaggcgctgcgtcactttgctaccttcgcttatggtctgcatttagccgaagagaacgtcaatctggatcagctgctggcgctctcgtcgcccatttaccggcttgaactggcgatggtggggcggttgttcgctcaggatccgcaactctatgcggatatcatcatgtcttcagagagtaatctggcgctgataaaacgctattaccagcggtttggtgaagcgattgcgctgctggagcagggcgacaagcaggcgtttatcgccagctttaaccgggttgaacagtggtttggcgatcacgcaaaacgcttcctggtcgaaagccgaagcctgttgcgatcggccaatgacagccgcccataa

SEQ ID NO: 2613 - protein, 373 aa, Erwinia herbicola
MVAELTALRDQIDSVDKALLDLLAKRLELVAEVGEVKSRYGLPIYVPEREASMLASRRKEAEALGVPPDLIEDVLRRVMRESYTSENDKGFKTLCPELRPVVIVGGKGQMGRLFEKMLGLSGYTVKTLDKEDWPQAETLLSDAGMVIISVPIHLTEQVIAQLPPLPEDCILVDLASVKNRPLQAMLAAHNGPVLGLHPMFGPDSGSLAKQVVVWCDGRQPEAYQWFLEQIQVWGARLHRISAVEHDQNMAFIQALRHFATFAYGLHLAEENVNLDQLLALSSPIYRLELAMVGRLFAQDPQLYADIIMSSESNLALIKRYYQRFGEAIALLEQGDKQAFIASFNRVEQWFGDHAKRFLVESRSLLRSANDSRP

SEQ ID NO: 2614 - DNA, 1125 bp, Haemophilus influenzae 86-028NP
  CDS (1)..(1125): transl_table=11
atggaagtccttaaagatttacgttctgaaattgattcgcttgatcgcgaacttatccaactttttgctaaacgtcttgagttggtttctcaagtcggtaaagtgaaacatcaacatggattacctatttatgcgccagagcgtgaaatagcaatgctccaagcacgtcgtttagaggctgaaaaagcaggcatttcagccgatttaattgaagatgttctacgccgttttatgcgtgaatcctatgccaatgaaaaccaatttggttttaaaactatcaattctgatattcacaaaattgttatcgtgggcggttatggtaaattaggtggcttatttgcccgttatttacgtgcatctggctatccaatttctattttagatcgcgaagattgggcggtggctgaaagtattttagcgaatgctgatgtcgtgatcgtttccgtccccatcaatattactttggaaacgattgagcgactaaaaccttatttaacagaaaatatgttgcttgcagatttaacttctgttaagcgtgaaccgctagcgaaaatgcttgaagttcattctggtgcagttttaggtttacatccaatgtttggtgcagacattgcaagtatggcaaaacaagtggttgtacgttgtgatggacgttttcctgaacgttatgaatggttacttgagcaaattcaaatttggggcgcaaaaatttatcaaaccaatgccacagaacacgatcacaatatgacttatatacaagccttgcgccatttttcgacttttgcgaatggtttacacctttccaaacagcccattaatctcgctaatttattggcgctttcttctcctatttatcgcttagaacttgcgatgatcggtcgcttatttgcgcaagatgcagagctttacgcagatattattatggataagccagaaaatttagcggtaattgaaacgctaaaacaaacttacgacgaagccttaactttctttgaaaagaatgatcgtcaaggttttattgatgctttccacaaggtgcgtgactggtttggcgattattctgaacaattcttaaaagaaagccgtcagctattacagcaggcaaatgatttgaaacaagggtag

SEQ ID NO: 2615 - protein, 374 aa, Haemophilus influenzae 86-028NP
MEVLKDLRSEIDSLDRELIQLFAKRLELVSQVGKVKHQHGLPIYAPEREIAMLQARRLEAEKAGISADLIEDVLRRFMRESYANENQFGFKTINSDIHKIVIVGGYGKLGGLFARYLRASGYPISILDREDWAVAESILANADVVIVSVPINITLETIERLKPYLTENMLLADLTSVKREPLAKMLEVHSGAVLGLHPMFGADIASMAKQVVVRCDGRFPERYEWLLEQIQIWGAKIYQTNATEHDHNMTYIQALRHFSTFANGLHLSKQPINLANLLALSSPIYRLELAMIGRLFAQDAELYADIIMDKPENLAVIETLKQTYDEALTFFEKNDRQGFIDAFHKVRDWFGDYSEQFLKESRQLLQQANDLKQG

SEQ ID NO: 2616 - DNA, 1146 bp, Colwellia psychrerythraea 34H
  CDS (1)..(1146): transl_table=11
atgaaaaattcagatcccgattttgataaaaagttaacaagtttacgtgacgaaattgatgaaattgatagtgatttagtcaaattattgcaaagacgccttgctgttaccagtaaagttggtcaactaaaaagtggtgttggcagacccatttatgatgctaaacgcgaggcgagtttatttgctaaacgtcgccagcaggcaagtgaggctggtctatcacctgacttaattgaagatgttttacgccgtttaatgcgtgactcttatgtcagtcaagatgctagtggttatcgctgcgttaacccagaatgtaaaaaggttgtggtagtgggcggtaaagggcaattaggctctgtttttgtcgacctttttcaacgttctgattaccaagttgctattattgagcaaaatgattggcccaacagtgaagctattttagctgatgcgagcttagtcattgttgctgtgcctattcgcctgacgactatggttattaatcatcttaataacttaccaaaagagtgtattcttgccgatttaaccagtattaaagagtcgcctttgtttgaaatgaaaaaggtacatgctggtcctgttgttggcttacaccctatgtttggtccagatgtcacaggcttaattaaacaaaccattattagttgtgaagggcgtaaccctgaacaatatcaatggctcattgagcagtttgaagtgtggggcgctaaaatttatccggtgcaagcgcatgaacatgaccaagcgatgtcaatggtacaagttatgcgacatttctctactatcgcttacggctatcacttgatgagtgaaggggctgatattgagaacctagtagcgatgagttcacctatctatcgattagagttgattatggtagggcgattatttgctcaagatcctaccctttatgcggatattatttttgctaacaaagataatgtcagcatgatgaaacgctttgcttaccgatttttagaactacttgaagatgtcagccttgatgataaagatgcctttgttgatatgtttaataatgtttcgggttggtttggtgattatgccggagattttctcgaagaaagtaaatcgatgttattaaaagctaatgagctgaaaaaacattaa

SEQ ID NO: 2617 - protein, 381 aa, Colwellia psychrerythraea 34H
MKNSDPDFDKKLTSLRDEIDEIDSDLVKLLQRRLAVTSKVGQLKSGVGRPIYDAKREASLFAKRRQQASEAGLSPDLIEDVLRRLMRDSYVSQDASGYRCVNPECKKVVVVGGKGQLGSVFVDLFQRSDYQVAIIEQNDWPNSEAILADASLVIVAVPIRLTTMVINHLNNLPKECILADLTSIKESPLFEMKKVHAGPVVGLHPMFGPDVTGLIKQTIISCEGRNPEQYQWLIEQFEVWGAKIYPVQAHEHDQAMSMVQVMRHFSTIAYGYHLMSEGADIENLVAMSSPIYRLELIMVGRLFAQDPTLYADIIFANKDNVSMMKRFAYRFLELLEDVSLDDKDAFVDMFNNVSGWFGDYAGDFLEESKSMLLKANELKKH

SEQ ID NO: 2618 - DNA, 1125 bp, Haemophilus somnus 129PT
  CDS (1)..(1125): transl_table=11
atggacgttttaaaaaatttaagaacagaaattgattgcttagatcgtgaattactacaccttttttctcaacgcttagaattagtcagaaaagtaggcaaagtgaaacatcaatatggattaccgatttatgtacctgaacgtgaaaatgaaatgttacaggctcgtcgcaatgaagcggaaaagttaggtgtttcaccggatttaattgaagatgttttgcgtcgtttgatgcgggaatcttatactagagaaaatcaatacggttttaaaacagcaaatcctgaaataaaaaaaatcgtcattgttggaggaaagggaaaattaggggcattatttgctcgttatttgtcttcttctggttatcaaattgctgtcttagagaaacaggattggcaaagtgcggataaaattttacaaaatgcaaatgtagttattgtttgtgtcccaattgcacaaactttaaatgtgattgaccgtctgaagccttatctaaccgaaaatatgctattaacagatttaacctcagtcaaacgtcaaccgttggaaaaaatgttacaagtgcatcaaggtgcggtattgggattacatccaatgtttggtccggatattaccaatatggcaaagcaagttgtagtacgttgtgacggtcgctaccctgaaaaataccaatggtttttggaacaaattcaaatgtggggagcgaaaatttatcaagttgatgcaaccgaacatgataaaagtatgacgtatgtacaagccttacgtcatttttcaacctttgcaaatggtttgcatttatcaaaacaacctattgagttggcacaattgcttgccctatcttcacccatttatcgtcttgaattagccatgatcggacgtttatttgctcaagatgcggaactttatgcagatattattatggacaaatcggagaatttggaagtgattaagagtctaaaacaaagctatgaagaaagtctaaatttctttgaacataataataagcagggatttattgactgttttaatcaagtgcgggaatggtttggtgagtattcagagcaatttttgaaagaaagtcggcaattattacaacaggcaaatgattacaaaagtatttga

SEQ ID NO: 2619 - protein, 374 aa, Haemophilus somnus 129PT
MDVLKNLRTEIDCLDRELLHLFSQRLELVRKVGKVKHQYGLPIYVPERENEMLQARRNEAEKLGVSPDLIEDVLRRLMRESYTRENQYGFKTANPEIKKIVIVGGKGKLGALFARYLSSSGYQIAVLEKQDWQSADKILQNANVVIVCVPIAQTLNVIDRLKPYLTENMLLTDLTSVKRQPLEKMLQVHQGAVLGLHPMFGPDITNMAKQVVVRCDGRYPEKYQWFLEQIQMWGAKIYQVDATEHDKSMTYVQALRHFSTFANGLHLSKQPIELAQLLALSSPIYRLELAMIGRLFAQDAELYADIIMDKSENLEVIKSLKQSYEESLNFFEHNNKQGFIDCFNQVREWFGEYSEQFLKESRQLLQQANDYKSI

SEQ ID NO: 2620 - DNA, 1140 bp, Shewanella sp. MR-4
  CDS (1)..(1140): transl_table=11
atgaacgaaaaaaccacaactgaattagaacaccttcgaggtctcatcgatggtgtcgaccaacaattgctgcatttactacgtaaacgcttagatttagtcgctcaggtgggaacggtaaaacacgccgcaggcctgccaatttatgcgccgcaacgcgaagcggctatgctggcaaaacgccgcgaagaagccaagaacatgggcatagcgccacaactgattgaagatattttgcgccgcttgatgcgtgaatcctatctcaacgagaaggatgtcggctttaagcaagtaaaaaacgatctcggttcagtcgtgattgttggtggtaagggtcagcttggtggactgttccaacaaatgctgacgctctcgggttatcaggttaaagtgcttgataaagacgactggcagcaggcggaaaccttatttgccgacgccggattggtactggtgactgtgcctatcgccatcacctgcgacattatccgtgagaaactgacccaattaccgcaggaatgtatcttagccgacttaacctcaatcaagactgaacctatgaatgccatgttggccgctcacaaggggcctgttgtcggctttcatcccatgtttggcccagatgtcggcagtttggctaagcaggtggtggtggtgtgccatggccgcgaagccgataaataccaatggttgctcgagcaaattggaatttggggcgcacggattgtagaagctgagcctgaacgtcacgacaatgcgatgcaattggtacaggcgatgcgccacttctcgacctttgtgtatggcttgaacctttgcaaagaagaagcggatattgaaaccctgctgcaatttagctcacctatctatcgcttagaactcgccatggtcgggcgcttgtttgcccaaagcccggagctttatgccgatattatttttgcccagcaggatagccagcatgcgattggcgattatttggataactatcgcgaagcattagagctattaaagcggggcgatagggacgcgtttatcagccagttccaaacggtagcaaaatggtttggtgattttgctcctcagtttcagcgtgaaagtcgcatgatgctgcaatcggtcagtgatatgaaaacgaactga

SEQ ID NO: 2621 - protein, 379 aa, Shewanella sp. MR-4
MNEKTTTELEHLRGLIDGVDQQLLHLLRKRLDLVAQVGTVKHAAGLPIYAPQREAAMLAKRREEAKNMGIAPQLIEDILRRLMRESYLNEKDVGFKQVKNDLGSVVIVGGKGQLGGLFQQMLTLSGYQVKVLDKDDWQQAETLFADAGLVLVTVPIAITCDIIREKLTQLPQECILADLTSIKTEPMNAMLAAHKGPVVGFHPMFGPDVGSLAKQVVVVCHGREADKYQWLLEQIGIWGARIVEAEPERHDNAMQLVQAMRHFSTFVYGLNLCKEEADIETLLQFSSPIYRLELAMVGRLFAQSPELYADIIFAQQDSQHAIGDYLDNYREALELLKRGDRDAFISQFQTVAKWFGDFAPQFQRESRMMLQSVSDMKTN

SEQ ID NO: 2622 - DNA, 1140 bp, Shewanella sp. ANA-3
  CDS (1)..(1140): transl_table=11
atgaacgaaaaaaccacaactgaattagaacaccttcgcggactcatcgatggtgtcgaccagcaattgctgcatttactgcgtaaacgcttagatttagtcgcgcaggtgggcacggttaaacacgccgcaggcctgccgatttatgcgccgcaacgtgaagcggcaatgttggcaaaacgccgcgaagaagccaaaaccatgggcattgcgccgcaactgattgaagatattttgcgccgtttgatgcgtgagtcctacctcaatgagaaggatgttggctttaagcaagtgaaaaacgatctcggttcggtcgtgattgttggtggtaagggccagcttggtggattgtttcaacaaatgctgtcgctctcgggttaccaggtcaaagtgctggataaagacgactggcagcaagctgaaaccttatttgccgacgccggattggtattggtgactgtgcctatcgccatcacctgcgacattatccgtgagaaactgacccaattaccgcaggaatgtatcttagccgacttaacctcgatcaagactgaacccatgaatgccatgttggccgctcacaaagggcccgttgtcgggtttcatcccatgtttggcccagatgtcggcagtttggctaagcaggttgtagtggtgtgccatgggcgtggagccgataaataccaatggctgctggaacaaattgggatttggggcgcgcggattgtcgaagcagaacctgaacgtcacgacaatgcgatgcagctggtacaggcgatgcgtcacttctcgacctttgtgtatggcttgaatctttgcaaagaagaagcggatattgaaaccctgctgcaatttagctcacctatctatcgcttagagctcgccatggtagggcgtttgtttgcccaaagccccgaactctatgccgatattatttttgcccagcaggatagccagcatgcaattggcgattatttggataactaccgtgaggcattagagctattaaagcggggcgatagggacgcgtttatcagccagttccaaacggttgcaaaatggtttggtgattttgcaccgcagtttcagcgtgaaagtcgcatgatgctgcaatcggtcagtgatatgaaaacaaactga

SEQ ID NO: 2623 - protein, 379 aa, Shewanella sp. ANA-3
MNEKTTTELEHLRGLIDGVDQQLLHLLRKRLDLVAQVGTVKHAAGLPIYAPQREAAMLAKRREEAKTMGIAPQLIEDILRRLMRESYLNEKDVGFKQVKNDLGSVVIVGGKGQLGGLFQQMLSLSGYQVKVLDKDDWQQAETLFADAGLVLVTVPIAITCDIIREKLTQLPQECILADLTSIKTEPMNAMLAAHKGPVVGFHPMFGPDVGSLAKQVVVVCHGRGADKYQWLLEQIGIWGARIVEAEPERHDNAMQLVQAMRHFSTFVYGLNLCKEEADIETLLQFSSPIYRLELAMVGRLFAQSPELYADIIFAQQDSQHAIGDYLDNYREALELLKRGDRDAFISQFQTVAKWFGDFAPQFQRESRMMLQSVSDMKTN

SEQ ID NO: 2624 - DNA, 1137 bp, Haemophilus somnus 2336
  CDS (1)..(1137): transl_table=11
atgaaaatagctatggacgttttaaaaaatttaagaacagaaattgattgcttagatcgtgaattactacaccttttttctcaacgcttagaattagtcagaaaagtaggcaaagtgaaacatcaatatggattaccgatttatgtacctgaacgtgaaaatgaaatgttacaggctcgtcgcaatgaagcggaaaagttaggtgtttcaccggatttaattgaagatgttttgcgtcgtttgatgcgggaatcttatactagagaaaatcaatacggttttaaaacagcaaatcctgaaataaaaaaaatcgtcattgttggaggaaagggaaaattaggggcattatttgctcgttatttgtcttcttccggttatcaaattgctgtcttagagaaacaggattggcaaagtgcggataaaattttacaaaatgcaaatgtagttattgtttgtgtcccaattgcacaaactttaaatgtgattgaccgtctaaagccttatctaaccgaaaatatgctattaacagatttaacctcagtcaaacgtcaaccgttggaaaaaatgttacaagtgcatcaaggtgcggtattaggattacatccaatgtttggtccggatattaccaatatggcaaagcaagtggtagtacgttgtgacggtcgctaccctgaaaaataccaatggtttttggaacaaattcaaatgtggggagcgaaaatttatcaagttgatgcaaccgaacatgataaaagtatgacgtatgtacaagccttacgtcatttttcaacctttgcaaatggtttgcatttatcaaaacaacctattgagttggcacaattgcttgccctatcttcacccatttatcgtcttgaattagccatgatcggacgtttatttgctcaagatgcggaactttatgcagatattattatggacaaatcggagaatttggaagtgattaagagtctaaaacaaagctatgaagaaagtctaaatttctttgaacataataacaagcaggggtttattgactgttttaatcaagtgcgggaatggtttggtgagtattcagagcaatttttgaaagaaagtcggcaattattacaacaggcgaatgattacagaagcatttga

SEQ ID NO: 2625 - protein, 378 aa, Haemophilus somnus 2336
MKIAMDVLKNLRTEIDCLDRELLHLFSQRLELVRKVGKVKHQYGLPIYVPERENEMLQARRNEAEKLGVSPDLIEDVLRRLMRESYTRENQYGFKTANPEIKKIVIVGGKGKLGALFARYLSSSGYQIAVLEKQDWQSADKILQNANVVIVCVPIAQTLNVIDRLKPYLTENMLLTDLTSVKRQPLEKMLQVHQGAVLGLHPMFGPDITNMAKQVVVRCDGRYPEKYQWFLEQIQMWGAKIYQVDATEHDKSMTYVQALRHFSTFANGLHLSKQPIELAQLLALSSPIYRLELAMIGRLFAQDAELYADIIMDKSENLEVIKSLKQSYEESLNFFEHNNKQGFIDCFNQVREWFGEYSEQFLKESRQLLQQANDYRSI

SEQ ID NO: 2626 - DNA, 1122 bp, Actinobacillus pleuropneumoniae serovar 1 str. 4074
  CDS (1)..(1122): transl_table=11
atgaatccgctcaatcctttacgagaacaaatcgatcaagttgatcaacaattaatccgactgtttgccgaacgtttaaaattagtcgccgaggtgggaaaagttaaatcggaacacggtattcccgtttatgcgccggaacgcgaaacggcgatgatagccgcccgccgtcaagaagcggaaaagcaaggcgttcccgccgacttaatcgaagacgtattaagacgagtaatgcgtgaatcttatgtgaatgaaaacaaacacggttttaaaaccacgaatccgcatattcataaaatcgtaattgtcggcggtaaaggaaaattgggcggattatttgcacgttttctaacactttcgggctatcgagtagaaacgttaggcagtcaagattgggaacaagcggaacacattcttagcgattgtgatttggttattgtttgcgtaccgattgttaaaacgttggaaacgatcgaacgtttacaaccgtttttaaccgaaaatatgatcttagcggatttaacatcggttaaagcgcaaccgcttgaaaaaatgttggaagtgcatagcggcccggtggtcggtttacatccgatgttcggaccggatatcgcttcaatggcaaagcaagtggtagcctgctgccacggacgtttttccgaaaaatacgaatggcttatcgaacaaattaaaatttggggcgcaaaaatcgaggtaatcgatgcgcacgaacacgatcatgcaatgacttacattcaagcattgcgccacttttcaacttttactttcggtttgcacttatctcgacaatcggtcaaattatcgcaacttttggctctgtcttcaccgatttaccggttagaattggcaatgatcgggcgtttatttgcacaagacggcggtttatatgcggatattatttcggataagccggaaaatcttgccgtgatcgaatcgctgaaagagacttttaccagcagcctggatttctttaaaaacaacgataaagcaggctttatccaagcatttgaagacgttcatcattggttcggtgattattcggaacaatttttaaaagaaagccgagtcctactgcaacaagcaaatgacaatcggaaataa

SEQ ID NO: 2627 - protein, 373 aa, Actinobacillus pleuropneumoniae serovar 1 str. 4074
MNPLNPLREQIDQVDQQLIRLFAERLKLVAEVGKVKSEHGIPVYAPERETAMIAARRQEAEKQGVPADLIEDVLRRVMRESYVNENKHGFKTTNPHIHKIVIVGGKGKLGGLFARFLTLSGYRVETLGSQDWEQAEHILSDCDLVIVCVPIVKTLETIERLQPFLTENMILADLTSVKAQPLEKMLEVHSGPVVGLHPMFGPDIASMAKQVVACCHGRFSEKYEWLIEQIKIWGAKIEVIDAHEHDHAMTYIQALRHFSTFTFGLHLSRQSVKLSQLLALSSPIYRLELAMIGRLFAQDGGLYADIISDKPENLAVIESLKETFTSSLDFFKNNDKAGFIQAFEDVHHWFGDYSEQFLKESRVLLQQANDNRK

SEQ ID NO: 2628 - DNA, 1125 bp, Haemophilus influenzae R2846
  CDS (1)..(1125): transl_table=11
atggaagcccttaaagatttacgttctgaaattgattcgcttgatcgcgaacttatccaactttttgctaaacgtcttgagttggtttctcaagtcggtaaagttaaacaccaacatggattacctatttatgcgccagaacgtgaaatagcaatgctccaagcacgtcgtttagaagctgaaaaagcaggcatttcagccgatttgattgaagatgttctacgccgttttatgcgtgaatcctatgccaatgaaaaccaatttggttttaaaactatcaattctgatattcacaaaattgttattgtgggtggctatggtaaattaggtggtttatttgcccgttatttacgtgcatctggctatccaatttctattttagatcgcgaagattgggcggtggctgaaagtattttagcgaatgctgatgtcgtgatcgtttccgtccccatcaatattactttggaaacgattgagcgactaaaaccttatttaacagaaaatatgttgcttgcagatttaacttctgttaagcgtgaaccgctagcgaaaatgcttgaagttcattctggtgcagttttaggtttacatccaatgtttggtgcagatattgcaagtatggcaaaacaagtggttgtacgttgtgatggacgttttcctgaacgttatgaatggttacttgagcaaattcaaatttggggcgcaaaaatttatcaaaccaatgccacagaacacgatcacaatatgacttatatacaagccttgcgccatttttcgacttttgcgaatggtttacacctttccaaacagcccgttaatcttgctaatttattggcgctttcttctcctatttatcgcttagaacttgcgatgatcggtcgcttatttgcgcaagatgcagagctttacgcagatattattatggataagccagaaaatttagcggtaattgaaacgctaaaacaaacttacgacgaagccttaactttctttgaaaagaatgatcgtcaaggttttattgatgctttccacaaggtgcgtgactggtttggcgattattccgaacaattcttaaaagaaagccgtcagctattgcaacaggcaaatgatttgaaacaagggtag

SEQ ID NO: 2629 - protein, 374 aa, Haemophilus influenzae R2846
MEALKDLRSEIDSLDRELIQLFAKRLELVSQVGKVKHQHGLPIYAPEREIAMLQARRLEAEKAGISADLIEDVLRRFMRESYANENQFGFKTINSDIHKIVIVGGYGKLGGLFARYLRASGYPISILDREDWAVAESILANADVVIVSVPINITLETIERLKPYLTENMLLADLTSVKREPLAKMLEVHSGAVLGLHPMFGADIASMAKQVVVRCDGRFPERYEWLLEQIQIWGAKIYQTNATEHDHNMTYIQALRHFSTFANGLHLSKQPVNLANLLALSSPIYRLELAMIGRLFAQDAELYADIIMDKPENLAVIETLKQTYDEALTFFEKNDRQGFIDAFHKVRDWFGDYSEQFLKESRQLLQQANDLKQG

SEQ ID NO: 2630 - DNA, 1125 bp, Haemophilus influenzae R2866
  CDS (1)..(1125): transl_table=11
atggaagcccttaaagatttacgttctgaaattgattcgcttgatcgcgaacttatccaactttttgctaaacgtcttgagttggtttctcaagtcggtaaagtgaaacatcaacatggattacctatttatgcgccagaacgtgaaatagcaatgctccaagcgcgtcgtttagaagctgaaaaagcaggcatttcagccgatttgattgaagatgttctacgtcgttttatgcgcgaatcctatgccaatgaaaatcaatttggttttaaaactatcaattctgatattcacaaaattgttattgtgggcggttatggtaaattaggtggtttatttgcccgttatttacgtgcatctggctatccaatttctattttagatcgcgaagattgggcggtggctgaaagtattttagcgaatgctgatgtcgtgatcgtttctgttcctattaatctcaccttagaaacaattgaacgcttaaaaccttatttaacggaaaatatgttgcttgcagatttaacctctgttaagcgtgaaccgctagcgaaaatgcttgaagttcattctggtgctgttttaggtttacatccaatgtttggtgcagacattgcaagtatggcaaaacaagtggttgtacgttgtgatggacgttttcccgaacgttatgaatggttacttgagcaaattcaaatttggggcgcaaaaatttatcaaaccaatgccacagaacacgatcacaatatgacttatatacaagccttgcgccatttttcaactttcgcgaatggtttacacctttccaaacagcccattaatctcgctaatttattggcactttcttcccctatttatcgcttagaacttgcgatgattggtcgtttatttgcgcaagatgcagagctttacgccgatattattatggataagtcagaaaatttagcggtaattgaaacgctaaaacaaacttacgacgaagccttaactttctttgaaaataatgatcgtcaaggttttattgatgctttccacaaggtgcgtgactggttcggcgattattctgaacaattcttaaaagaaagccgtcagctattgcaacaggcaaatgatttgaaacaagggtag

SEQ ID NO: 2631 - protein, 374 aa, Haemophilus influenzae R2866
MEALKDLRSEIDSLDRELIQLFAKRLELVSQVGKVKHQHGLPIYAPEREIAMLQARRLEAEKAGISADLIEDVLRRFMRESYANENQFGFKTINSDIHKIVIVGGYGKLGGLFARYLRASGYPISILDREDWAVAESILANADVVIVSVPINLTLETIERLKPYLTENMLLADLTSVKREPLAKMLEVHSGAVLGLHPMFGADIASMAKQVVVRCDGRFPERYEWLLEQIQIWGAKIYQTNATEHDHNMTYIQALRHFSTFANGLHLSKQPINLANLLALSSPIYRLELAMIGRLFAQDAELYADIIMDKSENLAVIETLKQTYDEALTFFENNDRQGFIDAFHKVRDWFGDYSEQFLKESRQLLQQANDLKQG

SEQ ID NO: 2632 - DNA, 1140 bp, Pseudoalteromonas tunicata D2
  CDS (1)..(1140): transl_table=11
atgtcatcaccccttcaaatacaactgactgaattacgtgatcaaatcgatcagtgtgatacacaattagttgaaatgcttgcgcgacgcaataaattaacagagcaggtcggtcagttaaaaaaagaatttggttcaccagtttatgtgcctgcccgtgaagcccaactaataactgcgcgcagagagcaagccaatcaatatggtgtgaatcctgatttagttgaagatattttacgtcgtatgatgcgagagtcgtatcaaaatcagcaagccgagctcgcttgtgttgcccctgatatctcaccttgtgtcatcgtgggtggagaaggtgcgatgggcagattatttgctcgccagcttagtcgctcaggcattgaagtgcgcatcttagacaaagcacaacaagcagatcagcaagccattcttgatggtgctaagttagtgttaatttctgtgccaattaatgcagtagttaatgtagttgcaaagctccctaaactagctgcggattgtttgttagttgatattaccagtgtgaaacaaaaaccgcttgaagccatgctcagtcaccatcaaggggaagttttaggcttacatccaatgtttggccctgatattgaacattgggtgaaacaaacgattgttgtatgccaaggacgcggtggcgaaaaaagtactcaattactcaaccagcttgctatctggggcagtcagttagtcgaaatgccagcagacaaacatgatgaagcaatgcaaattgtgcaagtgatgcgccatctaaccacttttgtttatggccaatttttagcaaaacaaccacatagccttgatgaaattaaactgtgctcatcaccaatatatcagttagagcttatgatggttggacgcttatttgctcagtcgccagagctttataccgacattatgatggctcaatttgataatgttgcacctttgctaacatcttaccaagagacttatcaagctacgttagataagcttaaagagggtgataaagagggattaatggctgctttttctgaagctaaaacgtttttctctgattcggcgcagcactttttaactcaaagcaaagcgttacttaataaagcaaatgatgccaaagtgcttgattaa

SEQ ID NO: 2633 - protein, 379 aa, Pseudoalteromonas tunicata D2
MSSPLQIQLTELRDQIDQCDTQLVEMLARRNKLTEQVGQLKKEFGSPVYVPAREAQLITARREQANQYGVNPDLVEDILRRMMRESYQNQQAELACVAPDISPCVIVGGEGAMGRLFARQLSRSGIEVRILDKAQQADQQAILDGAKLVLISVPINAVVNVVAKLPKLAADCLLVDITSVKQKPLEAMLSHHQGEVLGLHPMFGPDIEHWVKQTIVVCQGRGGEKSTQLLNQLAIWGSQLVEMPADKHDEAMQIVQVMRHLTTFVYGQFLAKQPHSLDEIKLCSSPIYQLELMMVGRLFAQSPELYTDIMMAQFDNVAPLLTSYQETYQATLDKLKEGDKEGLMAAFSEAKTFFSDSAQHFLTQSKALLNKANDAKVLD

SEQ ID NO: 2634 - DNA, 1131 bp, Photobacterium sp. SKA34
  CDS (1)..(1131): transl_table=11
atggttgctgagttaagcaaattaagagatcaaattgatgatgtagatcgtcaaatggttgagctattggctcaacgactcgcgttagttgagcaggtcggcgtcgtgaaaagtcagcatggcttacctatttatgccccagatcgtgaagccgcaatgttggcatctcgtcgtgaagaggcggaacgtcaaggggtaccagcggatcttatcgaagatgtacttcgtcgaacgatgcgtgaatcttattcgagcgaaaatgattctggctttaaatgtttaaatccacaattgcgaccaattgttattgttggtggtcatggtcagttagggaaattgttttgtcgtttgtttgaactgtcgggttaccaagttaaaacattaggtagccaagactgggatcgtgccgatgaaatattgcatgatgcaggtatggtcgttgtttctgttcctatccatttaacagagatggtgattgcaaaactcgataatttacctaaagactgtttacttgctgatttaacatcgattaaaagtggtccattacaagcgatgttagaagtgcataaaggacctgtggttgggttacacccaatgtttggtcctgatattccaagtcttgcgaaacaggttattgtgtactgtgatggacgaaatccagaaagttaccaatgggtgttggagcagtttcaaatttggggcgcatcactgaatcgaattagtgcgattgaacatgatcaggggatgaccttgatccaagcattacgtcactttacgtcgtttgtttatggtgttcaccttgctgaagaagatccaaagttagagcaattaatgtcgttaagttcacctatctatcgcttagaactcgcgatggtaggacgtttgtttgctcaagatgcgcaattgtacggtgatattattatgtcagcgccacagaatattgcgatgatcaaacgtttccatcagcgctttggtgaagcaattgaaatgctagatgctcaagataaagatgcgtttaagcaagcttttggtcaagtatcaggatggtttggcgattacgccgaacattttttatcagagagccagggactgcttaggcaggcgaacgattcaactcaccgtaaatcgtag

SEQ ID NO: 2635 - protein, 376 aa, Photobacterium sp. SKA34
MVAELSKLRDQIDDVDRQMVELLAQRLALVEQVGVVKSQHGLPIYAPDREAAMLASRREEAERQGVPADLIEDVLRRTMRESYSSENDSGFKCLNPQLRPIVIVGGHGQLGKLFCRLFELSGYQVKTLGSQDWDRADEILHDAGMVVVSVPIHLTEMVIAKLDNLPKDCLLADLTSIKSGPLQAMLEVHKGPVVGLHPMFGPDIPSLAKQVIVYCDGRNPESYQWVLEQFQIWGASLNRISAIEHDQGMTLIQALRHFTSFVYGVHLAEEDPKLEQLMSLSSPIYRLELAMVGRLFAQDAQLYGDIIMSAPQNIAMIKRFHQRFGEAIEMLDAQDKDAFKQAFGQVSGWFGDYAEHFLSESQGLLRQANDSTHRKS

SEQ ID NO: 2636 - DNA, 1128 bp, Vibrio sp. Ex25
  CDS (1)..(1128): transl_table=11
atggcagttgaacttaacgcattgcgcgatcagattgatgcagtcgacaagcaaatgttggagctattagctcagcgtttggcgctcgtagagaaagttggggaagtaaaaagcgaacatggtttgcctatttatgcccctgatcgtgaagcggcgatgctggcttctcgccgagcagaagctgagaaaatgggaattcctccacagcttattgaagatattctgcgtcgtaccatgcgtgagtcttatgccagtgaaaaagactccggttttaagtgtttgaaccctgaattacgctcagtggtcattattggtggtaatggccagttaggcggcctgtttgggcgtatgtttaagttatctggttatcaagtcaaagtgcttggtagcaaagactgggatcgtgcggatgacatcctaaaagatgcgggcttggtggtggttactgtgccaattcacctaacagaaggtgtgattgaaaagctaggtaatctgccacaagactgtattctgtgtgacctgacttctataaaatctaagccactgcaagcaatgttgaatgtgcaccaaggaccggtggttggtttacacccaatgtttggcccagatgtgccgagccttgccaagcaggtgattgtgtactgtgatgggcgtggaaatgatcaataccaatggttgctgcaacagtttggtatttggggcgcgagcttgtgccagattgatgcgcaagagcacgatcatggcatgacgttaatccaagcgctgcgtcacttcacctcatttgcttacggcatgcatctaagcaaagagaacccgaacattgagcaactgttaaagttgagctcaccgatctaccgcctggagttggcgatggtagggcgtctgtttggtcaggatccaaacctctacggtgacattattctctcatcgcaagaaaacatcgacatgattaagcgattccaccaacgcttcggcgaagcacttgcgattttggatagcaaagataaagccaaatttgtcgaaagctttgagcaggtgagtgagtggtttggtgattattcacaacaatttatgaatgagagccaaaacttactcaaacaggcgaatgataatattcatcgcggttaa

SEQ ID NO: 2637 - protein, 375 aa, Vibrio sp. Ex25
MAVELNALRDQIDAVDKQMLELLAQRLALVEKVGEVKSEHGLPIYAPDREAAMLASRRAEAEKMGIPPQLIEDILRRTMRESYASEKDSGFKCLNPELRSVVIIGGNGQLGGLFGRMFKLSGYQVKVLGSKDWDRADDILKDAGLVVVTVPIHLTEGVIEKLGNLPQDCILCDLTSIKSKPLQAMLNVHQGPVVGLHPMFGPDVPSLAKQVIVYCDGRGNDQYQWLLQQFGIWGASLCQIDAQEHDHGMTLIQALRHFTSFAYGMHLSKENPNIEQLLKLSSPIYRLELAMVGRLFGQDPNLYGDIILSSQENIDMIKRFHQRFGEALAILDSKDKAKFVESFEQVSEWFGDYSQQFMNESQNLLKQANDNIHRG

SEQ ID NO: 2638 - DNA, 1134 bp, Alteromonadales bacterium TW-7
  CDS (1)..(1134): transl_table=11
gtggcaaatataagtgatttggcccaactaagacaaggtatagatgaatgcgatgcgcagcttgttgccttactagctaaacgtaatggtattacccaaaaaattggtgaaatcaaacagcaaacaggtgcgcctttacatgcaccagagcgtgaagctgaattactagcggctaggcgccaagaagcaattaatcaaaatgtaagtcctgatctagttgaagatattctcaggcggatgatgcgtgaagcatatcaaaaccaacaggctaaattagcgtgtgcagcgccatcactttcacctattgttattgtgggcggtcaaggggcgatggggcagttatttgcccaacaatttatgcgctcaggttatgacgtcaaaatattagataaagagcagcaagatgatgcccaaagcattttaaccggtgcaaaactggtaatgataagtgtacctattaatgctttagagtctgtggttgctaaactaccaaaactagatgatgactgtttactcgttgatataacctcggtaaagcaatcgccaattaaagcattaaaagcagctcatagtggtccagttgttggtttacaccctatgtttgggcctgatatttcacattgggtaaaacaaacagtagttgtatgtgagggaagggagcataaggcggcgaaaggtctattagagcagttacaagtatgggggtgtcagcttgtagagctagatgctaaaaagcacgatgaagccatgcaaataattcaggtaatgcgacatttaacaacgtttgtttatgggcagtttttagcaaagcaaagccatactttagcagagttacgaagttgctcgtcgccgatatatcaattagagctaatgatggtagggcgtttgtttgcgcaatcgcctgagctttattccgatataatgttggctcagtttgatgacgttgaaagtttgttagctcaataccaagatacctttgcacaaacgcttgaaaagcttagggtaggtgataaagcagccttaatggaggcatttgcagatgctaaatcatatttttcagactcaactgcgcattttttaacacaaagccgcagtttacttaataaagcgaatgacgctaaagtgctcgactag

SEQ ID NO: 2639 - protein, 377 aa, Alteromonadales bacterium TW-7
MANISDLAQLRQGIDECDAQLVALLAKRNGITQKIGEIKQQTGAPLHAPEREAELLAARRQEAINQNVSPDLVEDILRRMMREAYQNQQAKLACAAPSLSPIVIVGGQGAMGQLFAQQFMRSGYDVKILDKEQQDDAQSILTGAKLVMISVPINALESVVAKLPKLDDDCLLVDITSVKQSPIKALKAAHSGPVVGLHPMFGPDISHWVKQTVVVCEGREHKAAKGLLEQLQVWGCQLVELDAKKHDEAMQIIQVMRHLTTFVYGQFLAKQSHTLAELRSCSSPIYQLELMMVGRLFAQSPELYSDIMLAQFDDVESLLAQYQDTFAQTLEKLRVGDKAALMEAFADAKSYFSDSTAHFLTQSRSLLNKANDAKVLD

SEQ ID NO: 2640 - DNA, 1131 bp, Mannheimia succiniciproducens MBEL55E
  CDS (1)..(1131)
atggaagcactcaaagaaatcagagccgaaatcgatcaattggatcgagagttgttagaagtttttgccaaacgtttagcgttagtcaaaaaggtcggagaaattaaacatcaacaaggtttgccgatttatgtaccggaacgcgaagcagatatgctggcggctcggcgttcagaagcggaaaaaatgggcatacctgcggatttaattgaagatgtgttacgtcgtgttatgcgggagtcttacgctaacgaacatgaacacggttttaaaaccgttaatccggcgattaaaaaaattgttattgtaggcggtaaaggcaaattaggcggcttattcgggcgttttctgacggcttcaggctactttgtggaagcgttgggaagcaaagattgggacaacgcaaaggctattttggccggtgcaaatgcggtaatcgtttgtgtgcctatcgtaaaaaccttggaaaccattgaacgcttaaaaccttatttaacggaagatatgttattgacggatctaacctccgtaaaacgccgcccgttggaaaaaatgctggaaattcatcaaggcgcggtcgtaggcttgcatccgatgtttgggcccgatatcgcaagcatggcaaaacaggtggttgtacgttgcgacgggcgttatccggagcgttatcaatggctgttggaacaaattcaaatgtggggcgcgcgaatttatcaggcggatgccgccgagcatgaccacagcatgacctatattcaagcattacgtcattttgccacctttgccaacggtttacatctttcaagacaaccggtgaaattagctaatttattagccttatcttcaccgatttatcgtctggaacttgcgatgatcgggcgtttgtttgcgcaagacggtagtttatatgccgatattattatggataagccggaaaacctggaagtaatcgaaagtttaaaacaaagctatgaagacagcttaaaattctttgaaaacggtgatagagaaggctttattaaaacctttaacaaagtgagagaatggttcggcgattattcggaacaatttatgaaagaaagccgtcaactgctgcaacaagctaacgattatcgtcataatagtctctga

SEQ ID NO: 2641 - protein, 376 aa, Mannheimia succiniciproducens MBEL55E
MEALKEIRAEIDQLDRELLEVFAKRLALVKKVGEIKHQQGLPIYVPEREADMLAARRSEAEKMGIPADLIEDVLRRVMRESYANEHEHGFKTVNPAIKKIVIVGGKGKLGGLFGRFLTASGYFVEALGSKDWDNAKAILAGANAVIVCVPIVKTLETIERLKPYLTEDMLLTDLTSVKRRPLEKMLEIHQGAVVGLHPMFGPDIASMAKQVVVRCDGRYPERYQWLLEQIQMWGARIYQADAAEHDHSMTYIQALRHFATFANGLHLSRQPVKLANLLALSSPIYRLELAMIGRLFAQDGSLYADIIMDKPENLEVIESLKQSYEDSLKFFENGDREGFIKTFNKVREWFGDYSEQFMKESRQLLQQANDYRHNSL

SEQ ID NO: 2642 - DNA, 1122 bp, Erwinia carotovora
  CDS (1)..(1122)
atggtagctgaactgaccgcattacgtgatcagatagatgaggtagataaggagcttgtcgcgctcttatcacgtcggttgcgtttggtggcggaagtgggtgaagtgaaaagccgctatggtttgcccatttatgcgcccgatcgtgaagcggccatgctcagctcacgtcgtaacgaggcggcgtcgatgggggttccaccggatcttattgaagatatcctgcggcgcaccatgcgcgaatcctattccagcgaaaacgacaaaggttttaaaacgctgtgtccacaattgcgtccggtcgtcatcattggtggccgtggtcaaatgggcaatttgtttgagaagatgctgacgctatcgggatatcaggtgaggatcctggagcaagatgactggccgcgcgctgatgagctgttgtctgatgcaggtatggtgattgtcagcgtgccgattcacgttaccgaacaggttattgccagtctgcctatcttgccggatgactgtattctggtcgatctggcatcggtaaaaaatggcccgcttcaggcgatgctggcggcgcataatggtccggtactcggtttgcaccctatgtttgggccagacagcggcagccttgccaaacaggttgtcgtttattgcgatggccgacagccggaggcctatcagtggttactggaacagattcaggtatggggcgcgcgtctgcatcgcattagcgcagttgaacacgatcagaacatgatgttcattcaagcgctgcgccacttcgctacatttgcctatggcctgcatttagcggaagagaatgtgcagcttgaacagctattagcactgtcatcgccaatctatcgattggaattgatcatggttggtaggttgtttgcgcaggatccgcagctttatgccgacattattatgtcttcagaggataatttggcgttgattaagcgttactacaaacgttttggcgaagccattgagttactggagcaaacagataaagcggaatttattagcagcttcaaaaaagttgaacactggttcggcgattatgccaagcgttttcaggcggagagccgagtgcttttacgtcaggcaaacgacattcgccaataa

SEQ ID NO: 2643 - protein, 373 aa, Erwinia carotovora
MVAELTALRDQIDEVDKELVALLSRRLRLVAEVGEVKSRYGLPIYAPDREAAMLSSRRNEAASMGVPPDLIEDILRRTMRESYSSENDKGFKTLCPQLRPVVIIGGRGQMGNLFEKMLTLSGYQVRILEQDDWPRADELLSDAGMVIVSVPIHVTEQVIASLPILPDDCILVDLASVKNGPLQAMLAAHNGPVLGLHPMFGPDSGSLAKQVVVYCDGRQPEAYQWLLEQIQVWGARLHRISAVEHDQNMMFIQALRHFATFAYGLHLAEENVQLEQLLALSSPIYRLELIMVGRLFAQDPQLYADIIMSSEDNLALIKRYYKRFGEAIELLEQTDKAEFISSFKKVEHWFGDYAKRFQAESRVLLRQANDIRQ

SEQ ID NO: 2644 - DNA, 1128 bp, Photobacterium profundum
  CDS (1)..(1128)
atggttgctgaactgagcaaattaagagatcaaatcgatgatgttgatcagcaaatggtagagcttttagctcgccgtttatcattagtagaagaagtgggtcatgttaaaagcctgcatggtttacctatttatgcgccagaccgtgaagccgcaatgttagcctcacgccgtcatgaagctgagcaaaaaggtgtgccgcctgatctgattgaagacattttgcgccgtaccatgcgtgaatcttattcgagtgaaaatgattcagggtttaaatgcttaaagcctgaacttcgccctattgttgttgtgggtgggcatggtcagctaggtggattgttctgtcgtttatttgaactttcaggttaccaagtacgtcaactaggcagccaagattgggatcgtgcggatgagatccttgcagatgcgggtatggttgtcgtctctgtaccgattaacatcactgagcaaatcattggtaaactttccaacttaccagatgactgtattcttgctgatttaacctcgatcaagagtggcccattacaggcaatgctagaagtgcataatggccccgtgattggtttacatccaatgtttggtcccgatatttctagcttggcgaagcaagtgattgtgtattgcgatgggcgaaaccctgaaaattaccaatggttacttgagcaatttcagatttggggggcaacgctaaatcgtattagtgcgattgaacatgatcaaggtatgacgctgatccaagctttacgccactttacgtcatttgtttatggtgtgcatttggcagaggaagatccgaagatcgagcaactcatgtcgttaagttcaccgatttatcgcttagaacttgcaatggtcggtcgcttgtttgctcaagatgcacaattgtatgccgacattattatgtctgcgccgcaaaacgttgcgatgattaaacgcttccaccaacgttttggtgaggctatcaagatgcttgagacgcaagataaagaggcgttcaaacaagcatttaatcaggtcgagcattggttcggtgattatgcgggacacttccttgctgaaagccaaggtttgttaaggcaagcgaacgattcaacccaccgttcgtaa

SEQ ID NO: 2645 - protein, 375 aa, Photobacterium profundum
MVAELSKLRDQIDDVDQQMVELLARRLSLVEEVGHVKSLHGLPIYAPDREAAMLASRRHEAEQKGVPPDLIEDILRRTMRESYSSENDSGFKCLKPELRPIVVVGGHGQLGGLFCRLFELSGYQVRQLGSQDWDRADEILADAGMVVVSVPINITEQIIGKLSNLPDDCILADLTSIKSGPLQAMLEVHNGPVIGLHPMFGPDISSLAKQVIVYCDGRNPENYQWLLEQFQIWGATLNRISAIEHDQGMTLIQALRHFTSFVYGVHLAEEDPKIEQLMSLSSPIYRLELAMVGRLFAQDAQLYADIIMSAPQNVAMIKRFHQRFGEAIKMLETQDKEAFKQAFNQVEHWFGDYAGHFLAESQGLLRQANDSTHRS

SEQ ID NO: 2646 - DNA, 1128 bp, Vibrio vulnificus
  CDS (1)..(1128)
atggcagttgaactgaacgcattgcgtgaacagattgatgcagtagacaaacagatgttggcgctattggctcagcgcttggcattggtagagcaagttggccatgtgaaaagccaacatggcttaccgatttatgcacccgatagagaagcggcgatgctggcctctcgtcgtgcagaagccgaaaaaatcggcgtacctccacagctcattgaggacattttgcgccgaaccatgcgtgaatcttatgccagtgagaaagattctgggtttaaatgtctcaatccggacttgcgttctgtggtgatcattggtggtcatggccagttgggtggtctgtttgctcgcatgtttaccctctcgggttaccaggtcaaaatcttaggcagtaaggattggcaccgcgctgatgagatattggatggggcaggattggtggtggttaccgtgccgattcatttaacccaaggggtgattgaaaagctgacccaactgccatcggattgcattttgtgtgacctcacttcgatcaagtcgaagccgctgaaaaccatgctcgatgtgcactctgggccggttgttggtttgcaccctatgtttggtcccgatgtgccgagtttagccaagcaagtgattgtctactgtgatggtcgaggtgctgagcaatatcagtggttactgcagcagtttaagatttggggggcaagcttgtgccaaattgaggccagcgaacacgaccacggcatgacgttaattcaagcattaaggcactttacttcctttgcctatggcatgcatttgagtcaggaaaatccaagtctcgataaactgctgaaactgagctcgcccatttaccgtcttgagttagcgatggtagggcgtctgtttgcccaagacccaaacttgtatggcgacattattctttcgtcgcaagagaacatcgacatgatcaagcgtttccatcgccgctttggcgaggcactagagatgttagatcagcacgataaagcgcgttttgttgaacgtttcacgcaagtgagtgattggtttggggggtattcgcagcagtttatggcggaaagccaaaacttactcaaacaagcgaatgacaacttgcatcgtgattaa

SEQ ID NO: 2647 - protein, 375 aa, Vibrio vulnificus
MAVELNALREQIDAVDKQMLALLAQRLALVEQVGHVKSQHGLPIYAPDREAAMLASRRAEAEKIGVPPQLIEDILRRTMRESYASEKDSGFKCLNPDLRSVVIIGGHGQLGGLFARMFTLSGYQVKILGSKDWHRADEILDGAGLVVVTVPIHLTQGVIEKLTQLPSDCILCDLTSIKSKPLKTMLDVHSGPVVGLHPMFGPDVPSLAKQVIVYCDGRGAEQYQWLLQQFKIWGASLCQIEASEHDHGMTLIQALRHFTSFAYGMHLSQENPSLDKLLKLSSPIYRLELAMVGRLFAQDPNLYGDIILSSQENIDMIKRFHRRFGEALEMLDQHDKARFVERFTQVSDWFGGYSQQFMAESQNLLKQANDNLHRD

SEQ ID NO: 2648 - DNA, 1122 bp, Photorhabdus luminescens
  CDS (1)..(1122)
atggcggctgaattatctcaattgcgggataagattgatgaagtggataaagctttgctgggcttgctggcaaagcgtctggaattggttgcagagattggtgaggtaaaaagtcagaatgggctgtcaatttatgcacctgacagagaaatggcgatgcttgcttcacgtcggcaggaggccgaagagtttggtgttccaccggatttaattgaggatattctgcgccgcattatgcgggagtcttataccagtgagaataacaaagggtttaaaacgctttgccctcaattggggccgatagtcattgttggtggcttgggcaaaatggggaaactatttggccgtttgttaactttgtctggttatgaagtcagaaatctggaaccacaagattggcctaacgcggaacaaattctggcgggagtggggatggtgattatcagtgtacctattcatttgacagaagaagttattcgccgtttaccgccattacctgaccattgcattttggtggacttagcgtccgttaaacagcagccattacaggctatgcttgatgtgcataaaggtccagtgttgggattacatcctatgtttgggccggatgtcggtagtttggtaaaacaagttgttgtttactgtgacggacgtcaagaggaagcttatcaatggtttttagaacagttgttaatttggggggcttgcttgcatcaaatgagccctgaacagcatgataaaaacatgagctttattcaggcgttgcgccatttcacgacatttgcttatgggcaacatctcgcacaggaaggggcggatttacaacaactgttatcaatatcttcacctatttaccgtttggaattgatcatggtcgggcgcttatttgcgcaagatccccagctctacgcggatattattatgtcatcaccagagaatattgatcttatacgccgttatcatcaaagttttggacaagcgttagagatattggaaagccaggacaaacgggcttttgtcagcagttttgaagatgttagtgaatggtttggtgattatgcacctcgttttatgagggaaagcagggtattgcttcaacaagcgaatgatagtcgccaataa

SEQ ID NO: 2649 - protein, 373 aa, Photorhabdus luminescens
MAAELSQLRDKIDEVDKALLGLLAKRLELVAEIGEVKSQNGLSIYAPDREMAMLASRRQEAEEFGVPPDLIEDILRRIMRESYTSENNKGFKTLCPQLGPIVIVGGLGKMGKLFGRLLTLSGYEVRNLEPQDWPNAEQILAGVGMVIISVPIHLTEEVIRRLPPLPDHCILVDLASVKQQPLQAMLDVHKGPVLGLHPMFGPDVGSLVKQVVVYCDGRQEEAYQWFLEQLLIWGACLHQMSPEQHDKNMSFIQALRHFTTFAYGQHLAQEGADLQQLLSISSPIYRLELIMVGRLFAQDPQLYADIIMSSPENIDLIRRYHQSFGQALEILESQDKRAFVSSFEDVSEWFGDYAPRFMRESRVLLQQANDSRQ

SEQ ID NO: 2650 - DNA, 1134 bp, Candidatus Blochmannia floridanus
  CDS (1)..(1134)
atgatggatagattaaattttttacgtagtgaaattgataaaatagatcaaagtttgttaaatttattatctaaaagattatcattagtttctcaggtaggtgaaattaaaagtcaacttggtttatttatttatgatccggaaagagaaaagatgattttatctcaaagaaaacaggaagcattaaaattaggtatttctcctaatttggtcagagatatattacgtcgaattatgcgagagtcttattcttatgaaaatgaaaaaggatttaaaaagttatatccaagttctaggccagtggtgattattgggggtaatggccgaatgggacaatttttctttaaaatgttaactttatcaggatatcaagtaagaattttagatcaagatgattggatacatgctaagtctatattaactaatgttggtgtagtgtttattagtgtacctatttattcggtaatcaaagtaattaatcaattacctcatttatcgaatgattgtattatcgtggatttgtcttctgtaaaaaagagttctttaacagctatattaaagattcatactggaccagttttaggattacatccaatgtttagtccggatactactattaccgctagtatgataaaaaaagttgtaatttgttgtgacggtcgttatcctcaagaatatcaatggttattgcagcagttaaaattatggggagcaaaagtatattattgtaattttattgaacatgataagtatatgagttttatacaaagtttatgtcattttacaatttttgttatgggatatcatttgtttaaagaaaatattgatttaaaaaaaattttatctttttcttccccaatgtttcaattggaattaatattaataggccgattatttacacaaaatcctcaattatatgcagatattattatgtcatctaaaaataatattattgtaattaagcgttattataaaagattaggaaaaatgttaatgttattggaacaaaataataaagaagaatttataaatcaatttaaaaaaattaaatgttggttagatagttatgctggtatttttttaaaagatagctcaaatttattaaaatatattaatgatattcaggaatattaa

SEQ ID NO: 2651 - protein, 377 aa, Candidatus Blochmannia floridanus
MMDRLNFLRSEIDKIDQSLLNLLSKRLSLVSQVGEIKSQLGLFIYDPEREKMILSQRKQEALKLGISPNLVRDILRRIMRESYSYENEKGFKKLYPSSRPVVIIGGNGRMGQFFFKMLTLSGYQVRILDQDDWIHAKSILTNVGVVFISVPIYSVIKVINQLPHLSNDCIIVDLSSVKKSSLTAILKIHTGPVLGLHPMFSPDTTITASMIKKVVICCDGRYPQEYQWLLQQLKLWGAKVYYCNFIEHDKYMSFIQSLCHFTIFVMGYHLFKENIDLKKILSFSSPMFQLELILIGRLFTQNPQLYADIIMSSKNNIIVIKRYYKRLGKMLMLLEQNNKEEFINQFKKIKCWLDSYAGIFLKDSSNLLKYINDIQEY

SEQ ID NO: 2652 - DNA, 1128 bp, Vibrio parahaemolyticus
  CDS (1)..(1128)
atggcagttgaacttaacgcattgcgcgatcagattgatgcagtcgacaaacaaatgcttgagcttttggctcagcgtttagagctggtagaaaaagttggggaagtaaaaagtgaacacggtttgcctatttacgcccctgatcgtgaagcggcgatgctggcgtctcgccgagcagaagctgagaaaatgggtgtcccacctcagcttatcgaagacattcttcgtcgtaccatgcgtgagtcttatgccagtgagaaagattccggttttaagtgtttgaacccagaattacgttcagtggtcattattggtggtaatggccagttaggcggtctgtttggccgcatgttcaagctatcaggttaccaagtgaaagttttgggtagcaaagattggggtcgtgcggatgagattctcaaagacgcaggcttagtggttgtcaccgtaccgattcacctgacggaaggggtgattgaaaaactgggcaacttgccacaagactgcattctgtgtgacctgacgtctatcaagtcaaagccgctgcaagcgatgttgaatgtgcacgctggacctgtggttggtttacacccgatgttcggccctgatgttcctagccttgccaagcaggtgattgtttactgtgatggacgtggtaaagagcaataccaatggttgttgcaacagtttggtatttggggcgcgagcttgtgtcagattgatgcgcaagagcacgatcatggcatgacgttaatccaagcgctgcgccacttcacgtcatttgcttacggaatgcaccttagcaaagagaacccgaatattgagcaactgttgaaactgagctcgccaatctaccgtcttgaattggcaatggtggggcgtctgtttggtcaggatccaaatctctacggtgacatcattctcgcatcgcaagagaacatcgatatgatcaagcgtttccatcaacgctttggggaagcgcttgcgattttagacagcaaagacaaggctaaatttgtagaaagttttgagcaggtgagtgattggtttggccaatactctcagcaatttatgaacgagagccaaaacttactgaaacaggcgaatgacaatatccatcgtggataa

SEQ ID NO: 2653 - protein, 375 aa, Vibrio parahaemolyticus
MAVELNALRDQIDAVDKQMLELLAQRLELVEKVGEVKSEHGLPIYAPDREAAMLASRRAEAEKMGVPPQLIEDILRRTMRESYASEKDSGFKCLNPELRSVVIIGGNGQLGGLFGRMFKLSGYQVKVLGSKDWGRADEILKDAGLVVVTVPIHLTEGVIEKLGNLPQDCILCDLTSIKSKPLQAMLNVHAGPVVGLHPMFGPDVPSLAKQVIVYCDGRGKEQYQWLLQQFGIWGASLCQIDAQEHDHGMTLIQALRHFTSFAYGMHLSKENPNIEQLLKLSSPIYRLELAMVGRLFGQDPNLYGDIILASQENIDMIKRFHQRFGEALAILDSKDKAKFVESFEQVSDWFGQYSQQFMNESQNLLKQANDNIHRG

SEQ ID NO: 2654 - DNA, 1140 bp, Shewanella oneidensis
  CDS (1)..(1140)
atgaatgaaaaaaccacatccgaattagaacatcttcgaggactgatcgacggtgtcgatcagcaattgctgcatttactgcgtaaacgcttagatttagtcgcccaagtcggcacggtaaagcacgctgcaggattacccatttatgcaccacagcgtgaagcggcaatgctggcaaaacgccgtgaagaagcccaaaccatgggcattgcgccacaattgattgaagatattttacgtcgcctaatgcgtgaatcctatcttaatgaaaaggatgttggctttaagcaagtcaagaatgatttaggttcggtagttatagtgggcggtaaaggccagcttggcgggctgtttcaacaaatgctgagactgtcaggttatcaagtgaaagtgctcgataaagatgattggcaacaagcggaatgcttatttgccgatgctggattggtattagtgacagtgcctattgccatcacctgcgacattatccgtgaaaagctaactcagttaccacgggactgtattctagccgatttaacctccatcaagacggaacccatgcaggcgatgttggccgctcataaggggcctgttgtcggctttcatccgatgtttggtccagatgtcggtagcttagctaagcaggttgtggtggtgtgtcatgggcgcgaagctgataaataccaatggttactcgaacaaattgccatttggggcgcacggattgtcgaagctgagcctgaatgtcacgataatgcgatgcaactggtgcaggcgatgcgccatttctcaacctttgtctatggcttaaatctttgcaaagaagaggcggatatagagactttattgaaatttagctcgccaatctaccgcttagagttagcgatggtgggccgtttatttgcccaaagcccggagctttacgctgatattatttttgctcagcaggagagccagcatgcgattggcgattatctggataactatcgcgaagccttagaattgctgaaacggggcgatagagaggagtttatcaatcagttccaaatggttgccaagtggtttggtgattttgcaccgcagtttcagcgcgaaagtcgcatgatgctgcaatcggtaagtgatatgaaaacgaactga

SEQ ID NO: 2655 - protein, 379 aa, Shewanella oneidensis
MNEKTTSELEHLRGLIDGVDQQLLHLLRKRLDLVAQVGTVKHAAGLPIYAPQREAAMLAKRREEAQTMGIAPQLIEDILRRLMRESYLNEKDVGFKQVKNDLGSVVIVGGKGQLGGLFQQMLRLSGYQVKVLDKDDWQQAECLFADAGLVLVTVPIAITCDIIREKLTQLPRDCILADLTSIKTEPMQAMLAAHKGPVVGFHPMFGPDVGSLAKQVVVVCHGREADKYQWLLEQIAIWGARIVEAEPECHDNAMQLVQAMRHFSTFVYGLNLCKEEADIETLLKFSSPIYRLELAMVGRLFAQSPELYADIIFAQQESQHAIGDYLDNYREALELLKRGDREEFINQFQMVAKWFGDFAPQFQRESRMMLQSVSDMKTN

SEQ ID NO: 2656 - DNA, 1125 bp, Pasteurella multocida
  CDS (1)..(1125)
atggatacgttaaataagttaagaacacagattgatcaagttgatcgtcagttattacagcttttagcacagcgacttgagttagtgaaacaagtcggtgaagtcaagcatcaacaaggtctgccgatttatgtgccagaacgtgaagcggagatgctcaacgcccgccgtgcggaagctgaaacgttaggggtatctgctgatttaattgaagatgtattacgtcgtatcatgcgagaatcttatgcgcgggaaaaccaatttggttttaaaaccgtgaatccggcgatcaaaaaaatcgtgatcgtaggtgggggagggaaacttggtagcttgtttgcacgttatttcacattgtctggttactatgttgagattttagagcaacaggattggcaaagtgcggacaagattttgaacgaaacagatgtgattgttgtttcggtaccgatcgccaaaaccgtcgaaacaattaaacgtttgaagccttatttgacagataatatgctgttggtggatttaacttcagttaagcgtgcaccattacaagcgatgttagacgtgcacgctggcgcggtattaggtttacatccaatgtttggtccggatatcgccagcatggcaaaacaagtgattgtacgctgtgatggtcgttttgaatcacgttatcaatggctgatcacccaaatacaaatttggggggcaaaattctaccaagttgaggcgactgaacacgatcatagtatgacgtatgtacaagcgttgcgacacttttccacttttgctaatggcttacatttatcaaaacaaccggttcaattagcgaatttattggcactttcttcgccaatttattgcttagaattggcgatgattgggcgtttatttgcgcaagatgcagaactttatgccgatattattttagataagcctgaaaatctcgcggtcattgagagtttaaagcaaagttatgaagaaagtttggcattttttacccatggtgataagcaggcattcattgacagctttgaacaagttaaacaatggtttggtgaatactcggagcagtttctgaaagaaagtcgccagttgctccaacaagcaaatgattatcgacaaatttaa

SEQ ID NO: 2657 - protein, 374 aa, Pasteurella multocida
MDTLNKLRTQIDQVDRQLLQLLAQRLELVKQVGEVKHQQGLPIYVPEREAEMLNARRAEAETLGVSADLIEDVLRRIMRESYARENQFGFKTVNPAIKKIVIVGGGGKLGSLFARYFTLSGYYVEILEQQDWQSADKILNETDVIVVSVPIAKTVETIKRLKPYLTDNMLLVDLTSVKRAPLQAMLDVHAGAVLGLHPMFGPDIASMAKQVIVRCDGRFESRYQWLITQIQIWGAKFYQVEATEHDHSMTYVQALRHFSTFANGLHLSKQPVQLANLLALSSPIYCLELAMIGRLFAQDAELYADIILDKPENLAVIESLKQSYEESLAFFTHGDKQAFIDSFEQVKQWFGEYSEQFLKESRQLLQQANDYRQI

SEQ ID NO: 2658 - DNA, 24 bp, Artificial sequence
  primer
atggttgctgaattgaccgcatta

SEQ ID NO: 2659 - DNA, 23 bp, Artificial sequence
  primer
ttactggcgattgtcattcgcct

SEQ ID NO: 2660 - protein, 372 aa, Artificial sequence
  consensus sequence
  Variant (2)..(3): Xaa in position 2 to 3 is any amino acid
  Variant (6)..(7): Xaa in position 6 to 7 is any amino acid
  Variant (10)..(11): Xaa in position 10 to 11 is any amino acid
  Variant (13)..(17): Xaa in position 13 to 17 is any amino acid
  Variant (19)..(21): Xaa in position 19 to 21 is any amino acid
  Variant (24)..(24): Xaa in position 24 is any amino acid
  Variant (27)..(28): Xaa in position 27 to 28 is any amino acid
  Variant (31)..(31): Xaa in position 31 is any amino acid
  Variant (34)..(36): Xaa in position 34 to 36 is any amino acid
  Variant (42)..(42): Xaa in position 42 is any amino acid
  Variant (44)..(44): Xaa in position 44 is any amino acid
  Variant (47)..(48): Xaa in position 47 to 48 is any amino acid
  Variant (51)..(52): Xaa in position 51 to 52 is any amino acid
  Variant (55)..(55): Xaa in position 55 is any amino acid
  Variant (58)..(60): Xaa in position 58 to 60 is any amino acid
  Variant (62)..(65): Xaa in position 62 to 65 is any amino acid
  Variant (70)..(70): Xaa in position 70 is any amino acid
  Variant (74)..(74): Xaa in position 74 is any amino acid
  Variant (80)..(81): Xaa in position 80 to 81 is any amino acid
  Variant (83)..(84): Xaa in position 83 to 84 is any amino acid
  Variant (85)..(85): Xaa in position 85 is any or no amino acid
  Variant (89)..(97): Xaa in position 89 to 97 is any amino acid
  Variant (100)..(100): Xaa in position 100 is any amino acid
  Variant (103)..(103): Xaa in position 103 is any amino acid
  Variant (105)..(106): Xaa in position 105 to 106 is any amino acid
  Variant (108)..(108): Xaa in position 108 is any amino acid
  Variant (111)..(116): Xaa in position 111 to 116 is any amino acid
  Variant (120)..(123): Xaa in position 120 to 123 is any amino acid
  Variant (125)..(127): Xaa in position 125 to 127 is any amino acid
  Variant (130)..(131): Xaa in position 130 to 131 is any amino acid
  Variant (132)..(132): Xaa in position 132 is any or no amino acid
  Variant (134)..(139): Xaa in position 134 to 139 is any amino acid
  Variant (141)..(142): Xaa in position 141 to 142 is any amino acid
  Variant (144)..(146): Xaa in position 144 to 146 is any amino acid
  Variant (150)..(151): Xaa in position 150 to 151 is any amino acid
  Variant (153)..(155): Xaa in position 153 to 155 is any amino acid
  Variant (157)..(158): Xaa in position 157 to 158 is any amino acid
  Variant (160)..(161): Xaa in position 160 to 161 is any amino acid
  Variant (162)..(162): Xaa in position 162 is any or no amino acid
  Variant (164)..(168): Xaa in position 164 to 168 is any amino acid
  Variant (170)..(170): Xaa in position 170 is any amino acid
  Variant (173)..(173): Xaa in position 173 is any amino acid
  Variant (175)..(175): Xaa in position 175 is any amino acid
  Variant (177)..(178): Xaa in position 177 to 178 is any amino acid
  Variant (181)..(182): Xaa in position 181 to 182 is any amino acid
  Variant (185)..(186): Xaa in position 185 to 186 is any amino acid
  Variant (188)..(188): Xaa in position 188 is any amino acid
  Variant (190)..(190): Xaa in position 190 is any amino acid
  Variant (192)..(192): Xaa in position 192 is any amino acid
  Variant (202)..(203): Xaa in position 202 to 203 is any amino acid
  Variant (204)..(206): Xaa in position 204 to 206 is any or no amino acid
  Variant (208)..(208): Xaa in position 208 is any amino acid
  Variant (213)..(213): Xaa in position 213 is any amino acid
  Variant (215)..(215): Xaa in position 215 is any amino acid
  Variant (217)..(217): Xaa in position 217 is any amino acid
  Variant (220)..(223): Xaa in position 220 to 223 is any amino acid
  Variant (225)..(225): Xaa in position 225 is any amino acid
  Variant (227)..(227): Xaa in position 227 is any amino acid
  Variant (229)..(229): Xaa in position 229 is any amino acid
  Variant (231)..(233): Xaa in position 231 to 233 is any amino acid
  Variant (237)..(242): Xaa in position 237 to 242 is any amino acid
  Variant (244)..(245): Xaa in position 244 to 245 is any amino acid
  Variant (248)..(249): Xaa in position 248 to 249 is any amino acid
  Variant (251)..(253): Xaa in position 251 to 253 is any amino acid
  Variant (256)..(256): Xaa in position 256 is any amino acid
  Variant (260)..(261): Xaa in position 260 to 261 is any amino acid
  Variant (263)..(264): Xaa in position 263 to 264 is any amino acid
  Variant (266)..(266): Xaa in position 266 is any amino acid
  Variant (269)..(277): Xaa in position 269 to 277 is any amino acid
  Variant (280)..(281): Xaa in position 280 to 281 is any amino acid
  Variant (291)..(291): Xaa in position 291 is any amino acid
  Variant (293)..(293): Xaa in position 293 is any amino acid
  Variant (300)..(302): Xaa in position 300 to 302 is any amino acid
  Variant (305)..(305): Xaa in position 305 is any amino acid
  Variant (309)..(313): Xaa in position 309 to 313 is any amino acid
  Variant (315)..(317): Xaa in position 315 to 317 is any amino acid
  Variant (318)..(318): Xaa in position 318 is any or no amino acid
  Variant (320)..(336): Xaa in position 320 to 336 is any amino acid
  Variant (338)..(340): Xaa in position 338 to 340 is any amino acid
  Variant (342)..(344): Xaa in position 342 to 344 is any amino acid
  Variant (346)..(347): Xaa in position 346 to 347 is any amino acid
  Variant (349)..(350): Xaa in position 349 to 350 is any amino acid
  Variant (354)..(358): Xaa in position 354 to 358 is any amino acid
  Variant (360)..(361): Xaa in position 360 to 361 is any amino acid
  Variant (364)..(365): Xaa in position 364 to 365 is any amino acid
  Variant (368)..(369): Xaa in position 368 to 369 is any amino acid
LXXLRXXIDXXDXXXXXLXXXRLXLVXXVGXVKXXXGLPIYXPXREXXMLXXRRXEAXXXGXXXXLIEDXLRRXMRESYXXEXXXGFKXXXXXXXXXVIXGGXGXXGXLFXXXXXXSGYXXXXLXXXDWXXXAXXXXXXAXXVXXXVPIXXTXXXIXXLXXXLXXXXXLXDLXSXKXXPLXXMLXXHXGXVXGLHPMFGPDXXXXXSXAKQVXVXCXGRXXXXYXWXLXQXXXWGAXXXXXXAXXHDXXMXXXQAXRHFXXFXXGXHLXXXXXXXXXLLXXSSPIYRLELXMXGRLFAQXXXLYXDIIXXXXXNXXXXIXXXXXXXXXXXXXXXXXDXXXFXXXFXXVXXWFGXXXXXFXXESXXLLXXAND

SEQ ID NO: 2661 - protein, 60 aa, Artificial sequence
  protein pattern
  Variant (2)..(3): Xaa in position 2 to 3 is any amino acid
  Variant (4)..(4): Xaa in position 4 is Ile or Val
  Variant (7)..(7): Xaa in position 7 is Leu or Met
  Variant (11)..(11): Xaa in position 11 is any or no amino acid
  Variant (13)..(13): Xaa in position 13 is any or no amino acid
  Variant (15)..(15): Xaa in position 15 is Ala, Thr or Val
  Variant (16)..(16): Xaa in position 16 is any amino acid
  Variant (18)..(19): Xaa in position 18 to 19 is any amino acid
  Variant (21)..(21): Xaa in position 21 is Ala, Cys, Ser, Thr or Val
  Variant (22)..(22): Xaa in position 22 is any amino acid
  Variant (23)..(23): Xaa in position 23 is Glu or Gln
  Variant (24)..(24): Xaa in position 24 is any amino acid
  Variant (25)..(25): Xaa in position 25 is Ala, Ile, Pro or Val
  Variant (26)..(26): Xaa in position 26 is any amino acid
  Variant (27)..(27): Xaa in position 27 is Ile or Leu
  Variant (28)..(28): Xaa in position 28 is Ala, Asp, Glu, Gln or Ser
  Variant (29)..(29): Xaa in position 29 is any amino acid
  Variant (31)..(31): Xaa in position 31 is Leu or Met
  Variant (32)..(32): Xaa in position 32 is any amino acid
  Variant (33)..(33): Xaa in position 33 is Phe, Ile or Leu
  Variant (43)..(43): Xaa in position 43 is Ala or Ile
  Variant (45)..(45): Xaa in position 45 is Ile or Val
  Variant (50)..(50): Xaa in position 50 is Ala or Gly
  Variant (52)..(52): Xaa in position 52 is Asp or Ser
  Variant (53)..(53): Xaa in position 53 is Ala, Gly or Pro
  Variant (54)..(54): Xaa in position 54 is any amino acid
  Variant (57)..(57): Xaa in position 57 is Ala or Gly
MXXXQAXRHFXTXFXXGXXLXXXXXXXXXLXXXSSPIYRLELXMXGRLFXQXXXLYXDII

SEQ ID NO: 2662 - protein, 34 aa, Artificial sequence
  protein pattern
  Variant (2)..(2): Xaa in position 2 is any amino acid
  Variant (3)..(3): Xaa in position 3 is any or no amino acid
  Variant (6)..(6): Xaa in position 6 is Ala or Thr
  Variant (8)..(8): Xaa in position 8 is Ile or Val
  Variant (10)..(11): Xaa in position 10 to 11 is any amino acid
  Variant (13)..(13): Xaa in position 13 is Leu or Met
  Variant (14)..(14): Xaa in position 14 is Ala, Glu, Asn or Gln
  Variant (15)..(15): Xaa in position 15 is any amino acid
  Variant (18)..(18): Xaa in position 18 is any amino acid
  Variant (19)..(19): Xaa in position 19 is Ala, Ile or Val
  Variant (21)..(21): Xaa in position 21 is any amino acid
  Variant (23)..(23): Xaa in position 23 is Ala or Pro
  Variant (25)..(25): Xaa in position 25 is Ile, Leu or Val
  Variant (27)..(27): Xaa in position 27 is Phe or Leu
  Variant (33)..(33): Xaa in position 33 is Ala or Pro
LXXDLXSXKXXPXXXMLXXHXGXVXGXHPMFGXD

SEQ ID NO: 2663 - protein, 60 aa, Artificial sequence
  protein pattern
  Variant (2)..(4): Xaa in position 2 to 4 is any or no amino acid
  Variant (6)..(8): Xaa in position 6 to 8 is any amino acid
  Variant (11)..(11): Xaa in position 11 is Pro or Ser
  Variant (14)..(14): Xaa in position 14 is Ala or Val
  Variant (16)..(16): Xaa in position 16 is Asp, Glu or Gln
  Variant (19)..(19): Xaa in position 19 is any amino acid
  Variant (20)..(20): Xaa in position 20 is Ala, Asp, Glu or Ser
  Variant (23)..(23): Xaa in position 23 is Ala, Asn, Gln or Ser
  Variant (24)..(24): Xaa in position 24 is any amino acid
  Variant (27)..(27): Xaa in position 27 is any amino acid
  Variant (30)..(32): Xaa in position 30 to 32 is any amino acid
  Variant (34)..(34): Xaa in position 34 is Ile or Val
  Variant (35)..(35): Xaa in position 35 is Ala, Pro or Ser
  Variant (36)..(36): Xaa in position 36 is Ala or Pro
  Variant (37)..(37): Xaa in position 37 is Asp or Gln
  Variant (42)..(42): Xaa in position 42 is Ile or Val
  Variant (46)..(46): Xaa in position 46 is any amino acid
  Variant (52)..(53): Xaa in position 52 to 53 is any amino acid
  Variant (55)..(55): Xaa in position 55 is any amino acid
  Variant (56)..(56): Xaa in position 56 is Asp, Glu, Asn or Gln
  Variant (57)..(57): Xaa in position 57 is any amino acid
VXXXKXXXGLXIYXPXREXXMLXXRRXEAXXXGXXXXLIEDXLRRXMRESYXXEXXXGFK

SEQ ID NO: 2664 - protein, 39 aa, Artificial sequence
  protein pattern
  Variant (2)..(2): Xaa in position 2 is any or no amino acid
  Variant (4)..(4): Xaa in position 4 is any or no amino acid
  Variant (6)..(6): Xaa in position 6 is any amino acid
  Variant (7)..(7): Xaa in position 7 is any or no amino acid
  Variant (9)..(9): Xaa in position 9 is Asp or His
  Variant (12)..(13): Xaa in position 12 to 13 is any amino acid
  Variant (14)..(14): Xaa in position 14 is Asp, Glu, Gln or Ser
  Variant (15)..(15): Xaa in position 15 is any amino acid
  Variant (17)..(17): Xaa in position 17 is Glu or Gln
  Variant (19)..(19): Xaa in position 19 is Phe, Leu or Val
  Variant (20)..(20): Xaa in position 20 is Ile or Leu
  Variant (21)..(21): Xaa in position 21 is Glu, Gln or Thr
  Variant (23)..(23): Xaa in position 23 is Phe, Ile or Leu
  Variant (24)..(24): Xaa in position 24 is any amino acid
  Variant (25)..(25): Xaa in position 25 is Ile, Met or Val
  Variant (29)..(29): Xaa in position 29 is any amino acid
  Variant (30)..(30): Xaa in position 30 is Phe, Ile or Leu
  Variant (31)..(33): Xaa in position 31 to 33 is any amino acid
  Variant (34)..(34): Xaa in position 34 is Asp, Glu, Asn or Ser
  Variant (35)..(35): Xaa in position 35 is Ala or Pro
  Variant (36)..(37): Xaa in position 36 to 37 is any amino acid
QXVXVXXCXGRXXXXYXWXXXQXXXWGAXXXXXXXXXHD

SEQ ID NO: 2665 - protein, 34 aa, Artificial sequence
  protein pattern
  Variant (2)..(3): Xaa in position 2 to 3 is any or no amino acid
  Variant (5)..(5): Xaa in position 5 is any or no amino acid
  Variant (8)..(8): Xaa in position 8 is any amino acid
  Variant (10)..(10): Xaa in position 10 is any amino acid
  Variant (11)..(11): Xaa in position 11 is Leu or Met
  Variant (13)..(13): Xaa in position 13 is any amino acid
  Variant (16)..(18): Xaa in position 16 to 18 is any amino acid
  Variant (19)..(19): Xaa in position 19 is Phe or Leu
  Variant (20)..(21): Xaa in position 20 to 21 is any amino acid
  Variant (25)..(25): Xaa in position 25 is any amino acid
  Variant (26)..(26): Xaa in position 26 is Ile or Val
  Variant (27)..(28): Xaa in position 27 to 28 is any amino acid
  Variant (30)..(30): Xaa in position 30 is Asp, Glu or Gly
  Variant (31)..(32): Xaa in position 31 to 32 is any amino acid
  Variant (33)..(33): Xaa in position 33 is Asp or Glu
VXXIXGGXGXXGXLFXXXXXXSGYXXXXLXXXXW

SEQ ID NO: 2666 - protein, 56 aa, Artificial sequence
  protein pattern
  Variant (2)..(11): Xaa in position 2 to 11 is any amino acid
  Variant (12)..(13): Xaa in position 12 to 13 is any or no amino acid
  Variant (15)..(22): Xaa in position 15 to 22 is any amino acid
  Variant (23)..(24): Xaa in position 23 to 24 is any or no amino acid
  Variant (26)..(26): Xaa in position 26 is Ile or Val
  Variant (27)..(28): Xaa in position 27 to 28 is any amino acid
  Variant (30)..(31): Xaa in position 30 to 31 is any amino acid
  Variant (32)..(32): Xaa in position 32 is Ile or Val
  Variant (33)..(34): Xaa in position 33 to 34 is any amino acid
  Variant (36)..(36): Xaa in position 36 is Phe or Leu
  Variant (37)..(37): Xaa in position 37 is Asp or Gly
  Variant (38)..(38): Xaa in position 38 is Asp, Glu, Gly, Gln or Ser
  Variant (39)..(39): Xaa in position 39 is Phe, His or Tyr
  Variant (40)..(40): Xaa in position 40 is Ala or Ser
  Variant (41)..(42): Xaa in position 41 to 42 is any amino acid
  Variant (44)..(45): Xaa in position 44 to 45 is any amino acid
  Variant (46)..(46): Xaa in position 46 is Asp or Glu
  Variant (48)..(49): Xaa in position 48 to 49 is any amino acid
  Variant (50)..(50): Xaa in position 50 is Leu or Met
  Variant (52)..(53): Xaa in position 52 to 53 is any amino acid
  Variant (54)..(54): Xaa in position 54 is Ala, Ile or Val
  Variant (55)..(55): Xaa in position 55 is Asn or Ser
IXXXXXXXXXXXXLXXXXXXXXXXFXXXFXXXXXWXXXXXXXFXXXSXXXLXXXXD

SEQ ID NO: 2667 - protein, 23 aa, Artificial sequence
  protein pattern
  Variant (3)..(3): Xaa in position 3 is Asp, Glu, Gly, Ser or Thr
  Variant (4)..(4): Xaa in position 4 is any amino acid
  Variant (7)..(7): Xaa in position 7 is any amino acid
  Variant (8)..(8): Xaa in position 8 is Leu or Val
  Variant (10)..(10): Xaa in position 10 is any amino acid
  Variant (11)..(11): Xaa in position 11 is Ala, Glu, Gln or Thr
  Variant (12)..(12): Xaa in position 12 is Leu or Met
  Variant (13)..(13): Xaa in position 13 is Ile, Leu or Val
  Variant (14)..(14): Xaa in position 14 is any amino acid
  Variant (16)..(17): Xaa in position 16 to 17 is any amino acid
  Variant (18)..(18): Xaa in position 18 is any or no amino acid
  Variant (20)..(20): Xaa in position 20 is Leu or Met
  Variant (21)..(21): Xaa in position 21 is any amino acid
LRXXIDXXDXXXXXLXXXRXXLV

SEQ ID NO: 2668 - DNA, 1302 bp, Escherichia coli
  CDS (1)..(1302): transl_table=11
atgttgtgttctggatatctggggcatgacatggaagacgactgcgacattattattattggtgccggtattgcaggcaccgcttgcgcgttacgctgcgcgcgagcgggtttatccgttttgttactggaacgcgctgaaatccccggcagcaaaaatctttccggcgggcggttatatacccatgcactcgcggaactcctcccgcaatttcatctgaccgcgcctcttgaacgacgcatcactcacgaaagcctttccctgttaacgcccgatggcgtaacgacgttttccagcttacagcccggcggtgaatcctggagtgtattacgtgcacgattcgatccgtggctggttgccgaagccgaaaaagaaggtgtcgaatgcatccccggagcgacggtggatgcactgtatgaagaaaacggcagagtctgtggcgttatttgtggtgacgatattctccgcgcccgttatgtggtgctggcagaaggtgccaacagcgtcctggctgaacgtcacgggttagtgactcgtcctgctggcgaagcgatggcgttggggatcaaagaagtgctgtcgctggaaacatccgctattgaagaacgttttcatctggagaataacgaaggcgcagcgttgctgttcagcggcaggatctgtgatgacttacccggcggcgcatttctttatactaatcaacaaacgctctcgttagggattgtttgcccgctctcttcccttacgcaaagtcgtgttccggcaagcgagctgctgactcgctttaaagcgcatccggcagtgcgcccgcttatcaaaaacacggaatcactggagtatggtgcgcatctggtgccagaaggtggcttgcacagtatgccggtgcaatacgccggtaacggctggctgctggtgggcgatgcgttgcgcagttgcgtcaataccggaatttccgtgcgcggcatggatatggcgctgactggcgcgcaggcggcggcacaaacgctgataagcgcctgccagcaccgcgagccgcaaaatctgtttccgctttatcatcacaacgtagagcgcagcctgctgtgggatgttctacagcgttatcagcatgttccggcgcttttgcaacgcccgggatggtaccgtacgtggcctgcgttaatgcaggatatttcccgcgatttatgggatcagggtgataaacctgttccaccgctgcgccagttattctggcatcatttacgtcgtcacggcctgtggcatctggcgggcgatgttatcaggagtctgcgatgtctgtaa

SEQ ID NO: 2669 - protein, 433 aa, Escherichia coli
MLCSGYLGHDMEDDCDIIIIGAGIAGTACALRCARAGLSVLLLERAEIPGSKNLSGGRLYTHALAELLPQFHLTAPLERRITHESLSLLTPDGVTTFSSLQPGGESWSVLRARFDPWLVAEAEKEGVECIPGATVDALYEENGRVCGVICGDDILRARYVVLAEGANSVLAERHGLVTRPAGEAMALGIKEVLSLETSAIEERFHLENNEGAALLFSGRICDDLPGGAFLYTNQQTLSLGIVCPLSSLTQSRVPASELLTRFKAHPAVRPLIKNTESLEYGAHLVPEGGLHSMPVQYAGNGWLLVGDALRSCVNTGISVRGMDMALTGAQAAAQTLISACQHREPQNLFPLYHHNVERSLLWDVLQRYQHVPALLQRPGWYRTWPALMQDISRDLWDQGDKPVPPLRQLFWHHLRRHGLWHLAGDVIRSLRCL

SEQ ID NO: 2670 - DNA, 1308 bp, Mesorhizobium loti MAFF303099
  CDS (1)..(1308): transl_table=11
atgatcgaggaagaattcgacgccatcgtcgtcggggccggtatgtccggaaacgcggccgcctacaccatggcaagccagggcctgacggtgctgcagttggagcgcggcgagtatccgggctccaagaatgtccagggcgccatcatgtacgccgacatgttggagcaaatcattccggatttccgggatgatgcgcctctcgagcggcatctggtcgagcagcgattctgggtgatggacgacacctcccacaccgggatgcagtatcgatcggacgatttcaacgaggcgaagcccaatcgctacacgatcatccgcgcccaattcgacaagtggttttcgcgcaaggtgcgccaggccggcgcgacggtgctgtgcgagacgacggtgaccgaacttatccgcaatgccagcggcaaggtgatcggcgtgcgcaccgaccgggctggcgggccgatctacgcggacgtcgtcgtgctcgcagaaggtgtcaacggactgctcggtacacgggccggcctgcgcaagatgccgaagccagaaagcgtggcgctcgctgtcaaggaaatgcatttcctacccgatgaggtcattgagcagcggttcggcctccagggcgacgaaggctgcgtgatcgaagcggcgggcacgatttcccgcagcatggccggactggccttcctctacaccaacaaggagtcgatctctctcggcatcggctgcctcgtctccgatttcgcccagacaatggagagcccttacgtcctcctcgacaacttcaaaaaccatccttcgatccggccgctgatcgcgggctcggaagtcaaggagtattccgcgcatctcattcccgaaggtggctacaaggcaattccgcagctcttcggcgacggttgggtggcggtcggtgatgccgcccaactgaacaacgctattcaccgcgagggttcgaaccttgccatgacttccggtcgcatcgcgggcgaggcaatcattgagatcaagggccgcaaccagccgatgatcaggaggaacctcgccctctacaagaccatgctggacaagtccttcgtagtcaaagacctgatgaaatataaggacatgccggccctgatacacaccaattcccgcaatttcttcatgacttacccgcagttgatgtcgcaggccgcgcagaacttcatgcgggtcgacggaaccccgaaaatcgagaaggaaaaggcgaccactgctgccttcatcaaggcgcgttcgcgctgggggctgatcagcgatgtggtccgcctggcactcgcctggcgctga

SEQ ID NO: 2671 - protein, 435 aa, Mesorhizobium loti MAFF303099
MIEEEFDAIVVGAGMSGNAAAYTMASQGLTVLQLERGEYPGSKNVQGAIMYADMLEQIIPDFRDDAPLERHLVEQRFWVMDDTSHTGMQYRSDDFNEAKPNRYTIIRAQFDKWFSRKVRQAGATVLCETTVTELIRNASGKVIGVRTDRAGGPIYADVVVLAEGVNGLLGTRAGLRKMPKPESVALAVKEMHFLPDEVIEQRFGLQGDEGCVIEAAGTISRSMAGLAFLYTNKESISLGIGCLVSDFAQTMESPYVLLDNFKNHPSIRPLIAGSEVKEYSAHLIPEGGYKAIPQLFGDGWVAVGDAAQLNNAIHREGSNLAMTSGRIAGEAIIEIKGRNQPMIRRNLALYKTMLDKSFVVKDLMKYKDMPALIHTNSRNFFMTYPQLMSQAAQNFMRVDGTPKIEKEKATTAAFIKARSRWGLISDVVRLALAWR

SEQ ID NO: 2672 - DNA, 1287 bp, Thermoplasma volcanium GSS1
  CDS (1)..(1287): transl_table=11
atgagtgaatttgacgttgcggtaataggtgcagggccggcaggatcttccgctgccataaggcttgcccaaaacgggatgaatgtcctacttgttgaacgtggtgaccctccaggaacaaagaacgtatcaggtgcagttctctggggcaatgaacttgctaaggttgtcccagattgggagaggagtgcaccagttgaaagatacgttacaagaaaagaagtagccttcctcacggaaaaatccaagattgctattagttttagctcagaggaactccagaatagtaagtctggaaagattattgtcagaggcaagtttgaccagtggcttgcaaaaaaggccaaggatgctggagcgatgcttgtaaccggcgttactgtagatagactcgccatcgacaatggaaaagtaatcggcatacagcaggacaatgacgtaattactgctgatgccgtagtggtagcagaaggggccaatcctagggtacttataaactcaggccttaggccgaaattatccgaccgtgatgttgcgctcggaataaaagaaacaattaaacttcccgaaaatgtcataaacgaaaggtttaacgtcgattcaaaaagcggatttgcatctgagttcgtgcttggtttcctcgatgacggattgctttctggcggttttctctatacaaataaagatacagtctcactcggtatagttgcttcattagatcgccttagggcaaatggagtgacacattcttacgatataatgggaaagttcgaagaacatcctttcataaagaaccttataaaagatggcataccggatgaatatgcggctcatcttgtacccgaaggtggaatttcgagcatgccaaaactctatggaaatggatatcttgtggccggtgatgccgcagcattcacattcagcaatggcatggtgctgcagggaataaattatgccattacatctggcatactagctgccgatacaataatagaaaacagaaataacataaatgaaaatacactggcaaagtacgttgataaactaagggaaagttacgtactcagcgatctctacaacttcaatggcatacagaacgtaacgtggagtgattttgtacaaaaaagcctccctacccttgcggaatcagttatgatgagcctcttcgatgaaaagggaatgccgaaaaagcatcttaggcagattgtcacagacgcaatgaagagcggccacatgaagtacagcgatctcattacaaatgggtaccgtgttataaagaggatgtga

SEQ ID NO: 2673 - protein, 428 aa, Thermoplasma volcanium GSS1
MSEFDVAVIGAGPAGSSAAIRLAQNGMNVLLVERGDPPGTKNVSGAVLWGNELAKVVPDWERSAPVERYVTRKEVAFLTEKSKIAISFSSEELQNSKSGKIIVRGKFDQWLAKKAKDAGAMLVTGVTVDRLAIDNGKVIGIQQDNDVITADAVVVAEGANPRVLINSGLRPKLSDRDVALGIKETIKLPENVINERFNVDSKSGFASEFVLGFLDDGLLSGGFLYTNKDTVSLGIVASLDRLRANGVTHSYDIMGKFEEHPFIKNLIKDGIPDEYAAHLVPEGGISSMPKLYGNGYLVAGDAAAFTFSNGMVLQGINYAITSGILAADTIIENRNNINENTLAKYVDKLRESYVLSDLYNFNGIQNVTWSDFVQKSLPTLAESVMMSLFDEKGMPKKHLRQIVTDAMKSGHMKYSDLITNGYRVIKRM

SEQ ID NO: 2674 - DNA, 1317 bp, Thermotoga maritima MSB8
  CDS (1)..(1317): transl_table=11
atgaagatagaattcgacgttgtcgtcgttggtgctggcccttctggtctgtcctgcgcatacgttcttgccaagaatggtctcaaagttgcggtcgtggagaaaggagaatatccgggttccaaaaacgtgatgggaggggttctctacgtacatcctctgaaagagatcatgccagattttctggaaaaagcggcaaattcgaaagctcttgaaagaaacgttatagagcagaacctttggctcctcggaaatgaaggtgtcatcaagatcggtcacagaaacgtggaatggaaagaaaatccgaatgcattcactgttttgagggcaaactttgacagatggtttgcccaggaggtggaaaaagcaggtgccctgatcataccaaaaaccaaggtggaagacttcctgaggaacgaaaaaggagaaatagcaggcgtggtgacctcgagaccaaagggagaaatacacagcaaggcggttgtgatcgcggagggtgtgaatcccatcctcacgatgaaagctgggctcaggaaggaagatctgaaaccacacatggtggccgttgctgtgaaagaggtgatcagtgttcctgaagatgtggtgaacagggtcttcggtgtggagggaaacgatggagcaacgatagaacttcttggaagctggtctgaaggtatgttcggaatgggatttctttacgccaacagatcttccgtatctctgggttgtggggttctccttgaagatctcagaaaaaagaagatcaagccgtatcaacttcttgagaatttgaaaaatcaccctgtcatttccgatatgctgggagaatacagaaacaacacgatggagtatctggcacatttgatacctgaaggtggatactacgcgatgccgaaggtctatggagacagggttctggtctgtggagatgcggcaatgcttgtgaactctatacatagagaaggatcgaatcacgcgatcacatcgggaagactcgctgctgaaacacttctcgaagcttttgaaaagggagatttttctgaaaaaattctgaaaaattactacctcagattgaaagaatccttcatattgaaagacctggaaaagtacaaagatctcatgcccactatggaaaagaaccaccagttcgtggaaatctatccggatcttgcaaacgatgctttgaagagatttctacaggttgacggaactccaaagtgggacgttcaaaaacagatcgcggacatggtactttccaggagaagtttgattggaatctcccttgatctgctcagattctggagagctgtgaggtga

SEQ ID NO: 2675 - protein, 438 aa, Thermotoga maritima MSB8
MKIEFDVVVVGAGPSGLSCAYVLAKNGLKVAVVEKGEYPGSKNVMGGVLYVHPLKEIMPDFLEKAANSKALERNVIEQNLWLLGNEGVIKIGHRNVEWKENPNAFTVLRANFDRWFAQEVEKAGALIIPKTKVEDFLRNEKGEIAGVVTSRPKGEIHSKAVVIAEGVNPILTMKAGLRKEDLKPHMVAVAVKEVISVPEDVVNRVFGVEGNDGATIELLGSWSEGMFGMGFLYANRSSVSLGCGVLLEDLRKKKIKPYQLLENLKNHPVISDMLGEYRNNTMEYLAHLIPEGGYYAMPKVYGDRVLVCGDAAMLVNSIHREGSNHAITSGRLAAETLLEAFEKGDFSEKILKNYYLRLKESFILKDLEKYKDLMPTMEKNHQFVEIYPDLANDALKRFLQVDGTPKWDVQKQIADMVLSRRSLIGISLDLLRFWRAVR

SEQ ID NO: 2676 - DNA, 1287 bp, Escherichia coli O157:H7 EDL933
  CDS (1)..(1287): transl_table=11
  misc_feature (1216)..(1216): y is t or c
atgtccgaagatatctttgacgccatcatcgtcggtgcagggcttgccggttcggttgccgcactggtgctcgcccgcgaaggggcgcaagtgttagttatcgagcgtggcaattccgcaggtgccaagaacgtcaccggcgggcgtctctatgcccacagcctggaacacattattcctggtttcgccgaatccgccccggtagaacgcctgatcacccatgaaaaactcgcgtttatgacggaaaagtcagcgatgactatggactactgcaacggtgacgaaacctcgccatcccagcgttcttactccgttttgcgcagtaaatttgatgcctggctgatggagcaggccgaagaagcgggcgcgcagttaattaccgggatccgcgtcgataacctcgtacagcgcgatggcaaagtcgtcggtgtagaagccgatggcgatgtgattgaagcgaaaacggtgatccttgctgatggagtgaactccatccttgccgaaaagctggggatggcaaaacgcgttaaaccgacgaatgtggcggttggcgtgaaggaactgatcgagttaccgaagtcggttattgaagaccgttttcagttgcagggtaatcagggggcggcttgcctatttgcgggatcacccaccgatggcctgatgggcggcggttttctttataccaatgaaaacaccctgtcgctggggctggtttgtggtctgcatcatctgcatgacgcgaaaaaatcggtgccgcaaatgctggaagatttcaaacaacatccggccgttgcaccgctgatcgcgggtggcaagctggtggaatattccgctcacgtagtgccggaagcaggcatcaacatgctgccggagctggtcggtgacggcgtattgattgccggtgatgccgccggaatgtgtatgaacctcggttttaccattcgcggtatggatctggcgattgccgccggggaagctgcagcaaaaaccgtgctttcagcgatgaaaagcgacgatttcagtaagcaaaaactcgcggaatatcgtcagcatcttgagagtggcccgctgcgcgatatgcgtatgtaccagaaactaccggccttccttgataacccacgcatgtttagcggctacccggaactggcggtaggcgtggcgcgtgacctgttcaccattgacggcagtgcgccggaactgatgcgcaagaaaatcytccgccacggcaagaaagtgggcttcatcaatctgatcaaggatggcatgaaaggagtgaccgttttatga

SEQ ID NO: 2677 - protein, 428 aa, Escherichia coli O157:H7 EDL933
  misc_feature (406)..(406): The Xaa at location 406 stands for Leu, or Phe.
MSEDIFDAIIVGAGLAGSVAALVLAREGAQVLVIERGNSAGAKNVTGGRLYAHSLEHIIPGFAESAPVERLITHEKLAFMTEKSAMTMDYCNGDETSPSQRSYSVLRSKFDAWLMEQAEEAGAQLITGIRVDNLVQRDGKVVGVEADGDVIEAKTVILADGVNSILAEKLGMAKRVKPTNVAVGVKELIELPKSVIEDRFQLQGNQGAACLFAGSPTDGLMGGGFLYTNENTLSLGLVCGLHHLHDAKKSVPQMLEDFKQHPAVAPLIAGGKLVEYSAHVVPEAGINMLPELVGDGVLIAGDAAGMCMNLGFTIRGMDLAIAAGEAAAKTVLSAMKSDDFSKQKLAEYRQHLESGPLRDMRMYQKLPAFLDNPRMFSGYPELAVGVARDLFTIDGSAPELMRKKIXRHGKKVGFINLIKDGMKGVTVL

SEQ ID NO: 2678 - DNA, 1287 bp, Thermoplasma acidophilum DSM 1728
  CDS (1)..(1287): transl_table=11
atgagtgaatttgatgtcatagttatcggcgctggtccggcaggatcctctgctgcaataaaacttgcgcagggtgggatgaacgtacttctggtggagaggggcgatcctccaggaacaaagaacgtttccggtgcagtcctctggggcgatgagctttcgaaagtcgtaccggattgggagagaagcgcacccatcgaacgttacgttacaagaaaggaggttgcattcctgacagagaaatcaaagatagccataagctatagttcacaggaactcatggagaagaaatctggaaagatcatcgtcaggggcaaattcgatcagtggctggcaaggaaggcaaaagatgcaggtgcaatgctcgtcaccggtataactgttgacaagctagtcatagatgggggcaaagtgataggagtgatgcaggatggcgatgtcataacctctgatgccgtaatcgtggcggagggtgcaaacccaagggttcttatcaactccggtctgaggccaaaactctcagatcatgacgttgcgctgggtataaaggagaccatcaagttgcctgaaaacgtcataaatgaacggttcaacgttgattcgaagggtggatatgcatcagaattcgtgctgggtttcctcgatgatggcctgctgtccggcggtttcctgtacacaaacagggataccatatcgttgggcattgtcacgtcgctagatcggcttagggcaaatggaatgacgcattcctatgatatcatgggcaaattcgaggatcatccgtttataaagaacctgataaaggacggaataccggatgagtacgctgcccatctggtaccagaaggtggactcgccagcatgccaaagctctatggaaatggatatcttgtcgccggagatgccgcgatgtttaccttcagcaacggcatggtgctgcaggggataaactacgcaataacgtcaggaatgctggcagccgaaacgatacttgagaacaagggcaagataagcgaggaaacgctatccacctatgtaagcaagctacgcaacagctacgtgcttagcgatctctacaccttcaatggcatacagaacgtcacctggagcgatttcacccagaagaccatgccaaagatactggacagcgttatgatgtcgatgtttgatgaacgcggtatgccaaaaaagcatctgatgcaggtactgaccgctgcagtcagatccaacggtatgaagtatacggacttgatatcaagcggctaccgcatgatgaggaagatgtga

SEQ ID NO: 2679 - protein, 428 aa, Thermoplasma acidophilum DSM 1728
MSEFDVIVIGAGPAGSSAAIKLAQGGMNVLLVERGDPPGTKNVSGAVLWGDELSKVVPDWERSAPIERYVTRKEVAFLTEKSKIAISYSSQELMEKKSGKIIVRGKFDQWLARKAKDAGAMLVTGITVDKLVIDGGKVIGVMQDGDVITSDAVIVAEGANPRVLINSGLRPKLSDHDVALGIKETIKLPENVINERFNVDSKGGYASEFVLGFLDDGLLSGGFLYTNRDTISLGIVTSLDRLRANGMTHSYDIMGKFEDHPFIKNLIKDGIPDEYAAHLVPEGGLASMPKLYGNGYLVAGDAAMFTFSNGMVLQGINYAITSGMLAAETILENKGKISEETLSTYVSKLRNSYVLSDLYTFNGIQNVTWSDFTQKTMPKILDSVMMSMFDERGMPKKHLMQVLTAAVRSNGMKYTDLISSGYRMMRKM

SEQ ID NO: 2680 - DNA, 1287 bp, Salmonella typhimurium LT2
  CDS (1)..(1287): transl_table=11
atgtcggatgataaatttgacgctattgtggtgggcgcaggcgtagcaggaacggtcgccgcgtatgtgatggcaaaagcgggactggatgtactggttattgaacgcggaaacagcgcgggcagcaaaaatatgaccggtggccggctctacgctcacagtatcgaaagtattatgccgggattcgcaacgtccgcccccatcgaacgcgtcgttacccgtgaaaaaatctcctttttaaccgaagaaagcgccgtcacacttgattttcaccgcgcgccccctactccgccccttacgtcatataccgtactgcgcaacaaactggacccgtggttaatggcgcaggcggaacaggctggcgcgcagtttatcccaggtgtacgggtcgacgctctggtacgtgaaggcaatcgcgtcactggcgttcaggccggggatgatattctggatgcgaatattgtgattctcgcggacggcgtgaattccatgctgggccgttcgctggacatggtgcctgtctcttctgcgcatcactatgcagtcggcgtaaaagagttgattgggctctctccggcacttattgaagagcgctttaatctggcgtcccatgaaggcgccgcctggttattcgctggcgcgccctccaacgggctcatgggcggcgggtttctttataccaaccgcgattcggtttctctggggctggtatgtggcctgggcgacattgctcacgcgaccaaaagcgtaccgcaaatgctggaagattttaaacagcatccggcaatacgccctttgattcaggggggaacactgcttgaatactccgctcatatggtgcccgaaggcggcatagcaatgatgccggagctggcaaatgacggcgtgatgattgtcggcgacgccgccggtctttgtctgaatctcggctataccgtccgcggcatggatttagccatcgcgtccgcgcaagcggccgctcaaaccgccattgacgctaaagcgcggcaagatttttccgccgcgagtcttgccggttacaaacgcgcgctggagaaaaacggcgtgttacgcgatatgcggcatttccgcaaactccccggattaatggaaaacccacggctttttaccgagtacccgcgtatggcggcaaacattgtgggcgatctgttcaccgttgatggcggtccagtcccaccgttgcgtaaaactatcctgtcacatgcgaaaaaaattggactggtgaatctattaaaagacggcataaaaggggctacggcattatga

SEQ ID NO: 2681 - protein, 428 aa, Salmonella typhimurium LT2
MSDDKFDAIVVGAGVAGTVAAYVMAKAGLDVLVIERGNSAGSKNMTGGRLYAHSIESIMPGFATSAPIERVVTREKISFLTEESAVTLDFHRAPPTPPLTSYTVLRNKLDPWLMAQAEQAGAQFIPGVRVDALVREGNRVTGVQAGDDILDANIVILADGVNSMLGRSLDMVPVSSAHHYAVGVKELIGLSPALIEERFNLASHEGAAWLFAGAPSNGLMGGGFLYTNRDSVSLGLVCGLGDIAHATKSVPQMLEDFKQHPAIRPLIQGGTLLEYSAHMVPEGGIAMMPELANDGVMIVGDAAGLCLNLGYTVRGMDLAIASAQAAAQTAIDAKARQDFSAASLAGYKRALEKNGVLRDMRHFRKLPGLMENPRLFTEYPRMAANIVGDLFTVDGGPVPPLRKTILSHAKKIGLVNLLKDGIKGATAL

SEQ ID NO: 2682 - DNA, 1275 bp, Pyrobaculum aerophilum str. IM2
  CDS (1)..(1275): transl_table=11
atgaaattcgacgtagctatcgtaggcgcaggtcctgcgggacttgccgcagcttataaactcgcctcggcgggttttaaagtcgtagtgttagagagggggagagagcccggctcaaaagagctatacggcggccgtatttatgcatattggcttgataggtacttgccggagtttcgcaaagacgcgccagtagatagatgggtgcggagggaaagagtgactttcctcactgaggacaaagcgttgacattggaatcggcggttgtacagaaggagaagactagttttattgttcccctggtatcttttgtatcttggttggctaagctggcacaaggcgccggcgccaagatagttactgaggtgacggtagacgcgttagtaaaagacgagaaaggcagagttgtgggagttcagtccggtccagacgtcttacaagcggattacgtcatagatgcagagggcgttaaccgactgctcttagagcgggctggcattgtgaaaaagcttgagccggagcttgtggctgtaggcgttaaggaggtgttgaagtttgagaataaaaagacgttagaagagaggctgggccttgaggaagacgagggcctagcttgggcaattgctgggtaccccacggagtatctgccgggcggcggttttatctacacctacaaggactcgttggcgcttggcgtagtggtgtatttaaagaactgggagaggctgaaaactcctgtttacgagttggtggaaaaactgaggctacatccctacatagcgcctctcgtgaagggcgccgctcttcaggaatatggaggccatatgactcctgtggctgggataaatatgtctcctccccgcttttattatgacggcttgttaattgtaggcgacgcggccggctttctcttacacacaggcgttttaatacgcggcgttgattttgcaattgcttcgggcgtgctggccgcggaggcggtaaaagaggcgaggagcccctcggcggaggacttgtcagtctacgagaaaaagttgagaagtagctttatcttaccgcaactggaaaagttcagaaaggccgataagttgttaggcgacgagtctttattcagagacttgacgttattttcaacagaggcgtcgtataggtattttaacatcgatgagaaccacaggactttactggaggctttacgcgaagcgtcgaagaaaactggcgttagcatgttaaagataatgataaatataataagaatggtaagaagcctatga

SEQ ID NO: 2683 - protein, 424 aa, Pyrobaculum aerophilum str. IM2
MKFDVAIVGAGPAGLAAAYKLASAGFKVVVLERGREPGSKELYGGRIYAYWLDRYLPEFRKDAPVDRWVRRERVTFLTEDKALTLESAVVQKEKTSFIVPLVSFVSWLAKLAQGAGAKIVTEVTVDALVKDEKGRVVGVQSGPDVLQADYVIDAEGVNRLLLERAGIVKKLEPELVAVGVKEVLKFENKKTLEERLGLEEDEGLAWAIAGYPTEYLPGGGFIYTYKDSLALGVVVYLKNWERLKTPVYELVEKLRLHPYIAPLVKGAALQEYGGHMTPVAGINMSPPRFYYDGLLIVGDAAGFLLHTGVLIRGVDFAIASGVLAAEAVKEARSPSAEDLSVYEKKLRSSFILPQLEKFRKADKLLGDESLFRDLTLFSTEASYRYFNIDENHRTLLEALREASKKTGVSMLKIMINIIRMVRSL

SEQ ID NO: 2684 - DNA, 1296 bp, Fusobacterium nucleatum subsp. nucleatum ATCC 25586
  CDS (1)..(1296): transl_table=11
atgagcgaagaaaaatttgatgccataatcgtaggtggcggtttggcaggttgctctgcagctattgttcttgcaaatgctggacttgcagttcttgtagtggaaagaggcgacttttgtggagcaaaaaatatgacaggtggtcgtctttatggacacagtcttgaaaaaattattccaaactttgcagaggaagctcccattgaaagaaagataacaagagaaaaaatttctttaatgagtgaagatagttctcttgatatagggtttggatctaaaaaattaagttcaaataatgaaaatgcttcttatacagtgcttcgttctacatttgatagatggttagcctcaaaagcagaagaagcaggtgcagaaattattcccggaattttggtagatgaacttattgtagaagatggaaaagtagtaggagtttctgcaacaggggaagaattatatgcagatgtggttattcttgcagatggagtaaactctcttttagcacaaagtttaggtatgaaaaaagagctagaacctcatcaagtagctgttggagcaaaagaagttattaaattaggagaagatgttattaatcagcgttttgctgtaaataatggagaaggggtagcatggctttcttgtggagatcctaccttaggtggatttggaggaggattactttatactaataaagatagtgtttctgttggagttgttgctactttaagtgatattggacatagtgatttatctatcaatcaattattggatagatttaaagaacaccctgctattgctccatatttagaaggaggaacttctattgaatattcaggtcatttagttccagaagaaggacttcatatggttccagaattatatagagatggagttttagtaactggtgatgctgctggtttctgtattaacttaggttttacagttcgtggaatggattttgctattgaatctggtcggcttgctgctgaagcagttatcaaagcacatgaaattggagattttagtgcagctacactatctaattataaaaaattaattgatagtagtttcatcatggaagacttaaatcaatataagggattccctactttacttggaagaagggaaatctttgaaggtcttcctgcaatggttgatgatattgctacaaaagcatttacagtagatggaaaacaaggacaaagtttgatgatgtatgttattcactctgtagcagaacatacaacagcagcaaaacttgtagattttgttactacagtattggaggcgttttaa

SEQ ID NO: 2685 - protein, 431 aa, Fusobacterium nucleatum subsp. nucleatum ATCC 25586
MSEEKFDAIIVGGGLAGCSAAIVLANAGLAVLVVERGDFCGAKNMTGGRLYGHSLEKIIPNFAEEAPIERKITREKISLMSEDSSLDIGFGSKKLSSNNENASYTVLRSTFDRWLASKAEEAGAEIIPGILVDELIVEDGKVVGVSATGEELYADVVILADGVNSLLAQSLGMKKELEPHQVAVGAKEVIKLGEDVINQRFAVNNGEGVAWLSCGDPTLGGFGGGLLYTNKDSVSVGVVATLSDIGHSDLSINQLLDRFKEHPAIAPYLEGGTSIEYSGHLVPEEGLHMVPELYRDGVLVTGDAAGFCINLGFTVRGMDFAIESGRLAAEAVIKAHEIGDFSAATLSNYKKLIDSSFIMEDLNQYKGFPTLLGRREIFEGLPAMVDDIATKAFTVDGKQGQSLMMYVIHSVAEHTTAAKLVDFVTTVLEAF

SEQ ID NO: 2686 - DNA, 1308 bp, Rhizobium etli
  CDS (1)..(1308): transl_table=11
atgactgaggaaaacttcgacgccatagttatcggggccggcatggccggaaacgcagctgcttacacgatgtcgaaccgcggcatgaaggtgctgcagttggagcgtggcgagtatccgggctccaagaatgtgcagggcgccatcatgtacgcggacatgctggagaaaatcctgccggatttccgggatgatgcgcctctggagcggcacttagtcgagcagcgcttctggatgatggacgactcgtcccacatcggtatgcaataccggtcggacgacttcaacgagtcgagacacaatcgctacacggtcattcgcgcccaattcgacaaatggttttcacgcaaggtgcgcgaggccggagcgacgcttctatgcgagacgaccgtgacggaactcgttcgtgatccaaagggcaaggtgattggcgttcgcaccgaccgcgccggcgacgtgattcttgctgacgtggtcgttctcgcagagggcgtcaatgggctgctcggcacgcgtgctggattgcgtgacacgccaaaaccggaaactgtcgcgctcgccgtcaaggaaatgcatttcctggccgaagaggtaattgaccagcggttcggcctccaggccaatgaaggctgcgtcatcgaggcagttggcacgatctctcgcaacatggccgggcttgccttcctctacaccaacaaagaatcgatctcgatcggcattggctgccttgtctccgaattcgcggcaacaatggaaagtccttatgatctgctcgaaaaattcaaaagccatccgtcggtaaagccgctgatcgcaggagcggaagtcaaggaatatgcggcgcatctcattccagaaggtggttacaaggcaattccgcagctttttggtgacggctgggtcgtcgtcggcgacgcggcacaacttaataatgcggtgcaccgcgaggggtccaacctcgccatgacgtcggggcgcatcgccggcgaagcaatcgtccagatcaagaatcgcaaaaagccgatggtcaaggagaacctctccctttacaagtcgatgcttgaaaagtcgttcgttatcaaagacttgcggaaatacaaggacatgcctgccctgctgcacaccaattcccgcaatttcttcacgacttatccaaggttgctgtcgcaggccgcacagaactttgtgcgagtcgatggcaccccgaagatcgacaaggaacgggcgaccacgggcaccttcatcaaggcacgctcccgctgggggctgtttggtgacgcggttcgcttggcgcgcgcgtggcgataa

SEQ ID NO: 2687 - protein, 435 aa, Rhizobium etli
MTEENFDAIVIGAGMAGNAAAYTMSNRGMKVLQLERGEYPGSKNVQGAIMYADMLEKILPDFRDDAPLERHLVEQRFWMMDDSSHIGMQYRSDDFNESRHNRYTVIRAQFDKWFSRKVREAGATLLCETTVTELVRDPKGKVIGVRTDRAGDVILADVVVLAEGVNGLLGTRAGLRDTPKPETVALAVKEMHFLAEEVIDQRFGLQANEGCVIEAVGTISRNMAGLAFLYTNKESISIGIGCLVSEFAATMESPYDLLEKFKSHPSVKPLIAGAEVKEYAAHLIPEGGYKAIPQLFGDGWVVVGDAAQLNNAVHREGSNLAMTSGRIAGEAIVQIKNRKKPMVKENLSLYKSMLEKSFVIKDLRKYKDMPALLHTNSRNFFTTYPRLLSQAAQNFVRVDGTPKIDKERATTGTFIKARSRWGLFGDAVRLARAWR

SEQ ID NO: 2688 - DNA, 1290 bp, Escherichia coli CFT073
  CDS (1)..(1290): transl_table=11
atgtcggatgacaaatttgatgccattgtggtcggtgcgggcgttgccggtagcgttgccgcactggtcatggcgcgagccgggctggatgtcctggtgatagaacgcggcgacagtgccggatgtaaaaacatgaccggcgggcgtctttatgcccacacacttgaagcaattattccaggctttgcagcatcagcgccggtagaacgcaaggtcacacgcgagaaaatctccttcttaaccgaagaaagcgccgttaccctcgattttcaccgcgagcaaccagatgttccgcaacacgcgtcttataccgtattgcgtaatcgtctggacccgtggttgatggaacaagccgagcaggcgggcgcgcagtttatcccgggcgtacgcgtcgatgcgctggttcgtgaaggaaacaaggtcactggcgtccaggccggggatgatattctcgaagcgaatgtggtgattctggctgatggcgttaactcgatgcttggccgctcgctgggaatggtttccgcttccgatccgcatcattacgctgttggtgttaaagaggttataggtctgacaccagaacagatcaacgatcgctttaatgttacgggcgaggaaggtgccgcctggctgtttgccggttccccttctgacggcctgatgggcggcggattcctctataccaacaaagattccgtatcgttggggctggtttgtggattgagtgatatcgcccatgcgcaaaaaagcgtgccgcaaatgctggaagattttaaacaacaccccgccattcgcccgctgattagcggcggcaaactgcttgaatattccgcgcatatggtgccggagggcggtctggcaatggtgccgcagctggttaacgatggcgtgatgatcgttggtgacgccgcaggcttctgcctgaatttgggttttacagttcgcggcatggatttagccattgcatcagctcaggctgccgccacaacggtgatcgccgccaaagaacgcgcggatttctccgccagcagtctggcgcaatacaaacgtgagctggaacaaagttgtgttatgcgcgatatgcagcatttccgcaagatcccggcgctgatggaaaacccgcgcctgtttagccaatacccacgaatggtcgccgacatcatgaacgatatgttcaccattgacggcaaaccaaaccagccggtacgcaaaatgatcatgggacacgcgaagaaaattgggctgatcaacttgctgaaagatggcattaagggagcaaccgcgctatga

SEQ ID NO: 2689 - protein, 429 aa, Escherichia coli CFT073
MSDDKFDAIVVGAGVAGSVAALVMARAGLDVLVIERGDSAGCKNMTGGRLYAHTLEAIIPGFAASAPVERKVTREKISFLTEESAVTLDFHREQPDVPQHASYTVLRNRLDPWLMEQAEQAGAQFIPGVRVDALVREGNKVTGVQAGDDILEANVVILADGVNSMLGRSLGMVSASDPHHYAVGVKEVIGLTPEQINDRFNVTGEEGAAWLFAGSPSDGLMGGGFLYTNKDSVSLGLVCGLSDIAHAQKSVPQMLEDFKQHPAIRPLISGGKLLEYSAHMVPEGGLAMVPQLVNDGVMIVGDAAGFCLNLGFTVRGMDLAIASAQAAATTVIAAKERADFSASSLAQYKRELEQSCVMRDMQHFRKIPALMENPRLFSQYPRMVADIMNDMFTIDGKPNQPVRKMIMGHAKKIGLINLLKDGIKGATAL

SEQ ID NO: 2690 - DNA, 1290 bp, Shigella flexneri 2a str. 2457T
  CDS (1)..(1290): transl_table=11
atgtcggatgacaaatttgatgccattgtggtcggtgcgggcgttgctggtagcgttgccgcactggtcatggcacgagccgggttggatgtcctggtgatagaacgcggcgacagtgccggatgtaaaaacatgaccggcgggcgtctttatgcccacacacttgaagcaatcattccaggctttgcagtatcagcgccggtagaacgcaaggtcacacgcgagaaaatctccttcttaaccgaagaaagcgccgttaccctcgattttcaccgcgggcaaccagatgttcctcaacacgcatcttataccgtattgcgtaatcgtctggacccgtggttgatggaacaagccgagcaggcgggcgcgcagtttatcccaggcgttcgcgtcgacgcgctggttcgtgaaggaaacaaggtcactggcgtgcaggctggggatgatattctcgaagcgaatgtggtgattctggctgatggcgttaactcgatgcttggccgctcgctgggaatggttcccgcttccgatccgcatcattacgctgttggtgttaaagaggttattggcctcacaccagaacagatcaacgatcgctttaatattacgggcgaggaaggtgccgcctggctgtttgccggttccccttctgacggcctgatggccgggggatttctctataccaacaaggattccatatccttggggctggtttgtggattgggtgatatcgcccatgcgcaaaaaagcgtgccgcaaatgctggaagattttaaacaacaccccgccattcgcccgctgattagcggcggcaaactgcttgaatattccgcgcatatggtgccggaaggcggtctggcaatggtgccgcaactggttaacgagggcgtgatgatcgttggtgacgccgcaggcttctgcctgaatttgggttttacggtccgcggcatggatttagccattgcatcggctcaggctgccgccacaacggtgatcgccgccaaagaacgcgcggatttctccgccaacagtctggcgcaatacaaacgtgagctggaacaaagctgcgtcatgcgtgatatgcagcattttcgcaagatcccggcgctgatggaaaacccgcgcctgtttagccaatacccacgaatggtagccgacatcatgaacgagatgttcaccattgacggcaaaccaaaccagccggtacgcaaaatgatcatgggacacgcgaagaaaattgggctgatcaacttgctgaaagatggcattaagggagcaaccgcgctatga

SEQ ID NO: 2691 - protein, 429 aa, Shigella flexneri 2a str. 2457T
MSDDKFDAIVVGAGVAGSVAALVMARAGLDVLVIERGDSAGCKNMTGGRLYAHTLEAIIPGFAVSAPVERKVTREKISFLTEESAVTLDFHRGQPDVPQHASYTVLRNRLDPWLMEQAEQAGAQFIPGVRVDALVREGNKVTGVQAGDDILEANVVILADGVNSMLGRSLGMVPASDPHHYAVGVKEVIGLTPEQINDRFNITGEEGAAWLFAGSPSDGLMAGGFLYTNKDSISLGLVCGLGDIAHAQKSVPQMLEDFKQHPAIRPLISGGKLLEYSAHMVPEGGLAMVPQLVNEGVMIVGDAAGFCLNLGFTVRGMDLAIASAQAAATTVIAAKERADFSANSLAQYKRELEQSCVMRDMQHFRKIPALMENPRLFSQYPRMVADIMNEMFTIDGKPNQPVRKMIMGHAKKIGLINLLKDGIKGATAL

SEQ ID NO: 2692 - DNA, 1308 bp, Rhodopseudomonas palustris CGA009
  CDS (1)..(1308): transl_table=11
atgatcgaagaacgtttcgacgccatcgtcgtcggggccggcatggccggcaacgccgctgcgctgaccatggccaagcgcggcctgaaggtgctgcagatcgagcgaggcgaatacccgggctcgaagaacgtgcagggagcgattctctacgccgacatgctggagaagctggtgcccgacttccgcgaggatgcgccgctcgagcggcacctcgtcgaacagcggttctggatgatggacggcaagtcgcacaccggcctgcatcaccgttcggaagacttcaacgaagagaagccgaatcgctacaccatcatccgcgcccagttcgacaaatggctgtccagcaaggcgcaggaagccggcgcgatcgtgctgtgcgaaaccaccgtcaaggaactggtgcaggacgcttacggcaaggtgatcggcgtgatcaccgatcgtgaaggcggccaggttcatgccgacgtcgtggtactggccgaaggcgtcaacggcctgctcggcaccaaggccgagctgcgtgagcgcccgacgccggagaacgtcgcgctggctgtgaaggaaatgcacttcctgccgcgcgagaccatcgaagcccgcttcaacctgaagggcgacgagggcgtggtgatcgaggcggcgggcaccatctcggccggcatgaccggcatgggcttcatctacaccaacaaggagtcgatctcgatcggcatcggctgtctggtgtcggacttccagaagaccggcgagaccccctacggcctgctcgagcgcttcaagaagcatccgtcggtggcgccgctgatcgaaggctccgaggtgaaggaatacgccggccatctgatcccggaaggcggctacaacgcaatcccgcagctctatggtgacggctgggtcgtggtcggcgatgccgcgcagctcaataacgcgatgcaccgcgagggctccaacttggcgatgacctcgggccggatcgccgccgaggcgatcttccaggtcaagtcgcgcaaggatccgatgaccaaggagaatctggcgctctacaagaagatgctggacgatagcttcgtcatcaaggacctgaagaagtacaaggatatgccggacctgctgcatatccgctcgcagaacttcttcctgacctatccgcagctcgtcaacaaggcgctgcagaacttcgtgcgggtcgacggcacgccgaagatcgagaaggaaaagaccacgatcaagtcgttcgtgtcggcacggtcgtggggcggattgttcggcgacgcgttccgcttcgcgcgggcgtggcgataa

SEQ ID NO: 2693 - protein, 435 aa, Rhodopseudomonas palustris CGA009
MIEERFDAIVVGAGMAGNAAALTMAKRGLKVLQIERGEYPGSKNVQGAILYADMLEKLVPDFREDAPLERHLVEQRFWMMDGKSHTGLHHRSEDFNEEKPNRYTIIRAQFDKWLSSKAQEAGAIVLCETTVKELVQDAYGKVIGVITDREGGQVHADVVVLAEGVNGLLGTKAELRERPTPENVALAVKEMHFLPRETIEARFNLKGDEGVVIEAAGTISAGMTGMGFIYTNKESISIGIGCLVSDFQKTGETPYGLLERFKKHPSVAPLIEGSEVKEYAGHLIPEGGYNAIPQLYGDGWVVVGDAAQLNNAMHREGSNLAMTSGRIAAEAIFQVKSRKDPMTKENLALYKKMLDDSFVIKDLKKYKDMPDLLHIRSQNFFLTYPQLVNKALQNFVRVDGTPKIEKEKTTIKSFVSARSWGGLFGDAFRFARAWR

SEQ ID NO: 2694 - DNA, 1350 bp, Propionibacterium acnes KPA171202
  CDS (1)..(1350): transl_table=11
ttgcggggtgtgggctcccagccttcggagacaccgccgccgttgtgggatgtcccgggcgttgagcctgatttcgatgtcattgtcgtcgggggtggtgtggctggtgccgtcgcggcgtacgagctagctggtgaggggcacgaagtactccttgtcgagcgtggccgagaacctggaagcaaaaatctctcaggaggtgttctttactgtcgggtccttgaggagatatttccgaacttccttcgagatgctccggtcgagcgcaagatcactcgcaaccaactgatgtttctgaatagggattcgtctgttgcagttgattatcgagatgcgcgactcgtggaccccgttaacgctgttaccgtcctccgggcgaaacttgatccgtggctgtcggaaaaatgcgaggaagctggcgtcactgtgatgtcaggtgttcgcgttgactcgttgatcgagcgtgatgggcagttcgtcggggttcgagctggtgacgatgagttgtattcgcgtgtggtcattgctgccgacggtgtgaattcatttctgagtcgtgacgctgggctccgtggaccggagcctaagaacaatcttgccgtcggcgtgaagtcggtaattggccttgacccgaaagtcatcgaagaacggttccaagttaagaacggcgagggggcagcgtacgcggttgtcggtgactgcacgaaaggtgttgggggaggtgggttcctttacacgaatattgacagcgtgtcagccgggatcgtcctacggttggatgatttagaaaggagtggggagtcaagctcgcagctgcacgaccacttcttgacgcacccggttgttgcgccactccttgctggtggcgagctgctggaatacggctgtcatcttgtagctgaaggtggtgccagtatgcagcacgacctggttgcgccagggctcttgatcgtcggcgacgctgccggctttacgctgaacactgggtttacggtacgggggatggacctcgctgcaggttccgccctcgccgctgcgaaatcggttgatctagccttgcgtaaccatgatgtcggtcatgggactctggatggttatatctccacttgcaatgaaagtttcgtgggtcgcgacatgaatacttatcggaacgccccggcattcctggaatctccagaaatgtacgacgatgtcggtcagctcgcggcggacgtgatgtataagatttatggtctcgatatgacccctcgaaaacacttacttccgacggtagcctctgcggtgaggtcatcgaacctgagtttttcccagatcgcctcaatcgggttcagagcaatgagggcattgtga

SEQ ID NO: 2695 - protein, 449 aa, Propionibacterium acnes KPA171202
MRGVGSQPSETPPPLWDVPGVEPDFDVIVVGGGVAGAVAAYELAGEGHEVLLVERGREPGSKNLSGGVLYCRVLEEIFPNFLRDAPVERKITRNQLMFLNRDSSVAVDYRDARLVDPVNAVTVLRAKLDPWLSEKCEEAGVTVMSGVRVDSLIERDGQFVGVRAGDDELYSRVVIAADGVNSFLSRDAGLRGPEPKNNLAVGVKSVIGLDPKVIEERFQVKNGEGAAYAVVGDCTKGVGGGGFLYTNIDSVSAGIVLRLDDLERSGESSSQLHDHFLTHPVVAPLLAGGELLEYGCHLVAEGGASMQHDLVAPGLLIVGDAAGFTLNTGFTVRGMDLAAGSALAAAKSVDLALRNHDVGHGTLDGYISTCNESFVGRDMNTYRNAPAFLESPEMYDDVGQLAADVMYKIYGLDMTPRKHLLPTVASAVRSSNLSFSQIASIGFRAMRAL

SEQ ID NO: 2696 - DNA, 1296 bp, Carboxydothermus hydrogenoformans Z-2901
  CDS (1)..(1296): transl_table=11
atgcccgaaaagtttgacgtagtggtggttggagcaggaccttcgggactggcggcagcctataaactggcggaagcgggactgaaagttattgtaattgaacggggcgaatttcccggcgccaaaaacgttatggggggcattatttataaaaagcccaccgaagctgttttcccggagatttttaaagaagccccggtggagcgaccgataattgaacagcgttattattttttaaccgatactgcaaaaattggattttcctatcgaaatccccggtataaagaagacattagcggatattcggtctttcgggcgaaattcgaccggtttttagccaaaaaagttcaggaaaaaggagcacttttaattaccgaaacggtggtggaagacttaattgtcaaagacggaaaagtaaaaggagttattgccgggcggaaagaaggagaagttctggcggatgtggtggtgctggcggaaggggcccactcccttttagcgcaaaagtatggttttcaaaagcctattccaccgcagaacctggcggtggcggtaaaagaagtaattgggctcccagcttcggtaatcgaggaccggtttaacatcgagcccggggaaggagtggcgattgagcttttcggcaaagcaacggccggtatggtgggaacagcctttatctacaccaaccagaattccctttccattggggttggcgctttaatgtccgaccttattaaaagacggattagccccaatgatttaattgaagcgtttaaaaaccatccggcaattaagcctttgttgcgtgacggcgaggtaaaggagtaccttgcccacttaattccggaagggggctataaagggatacccaaactttacggtgatggtattgtgattgtaggcgatgccggaatgctggtaaactccatccaccgggaaggttccaatttggccataacttccggagcattggcggcaaaggcgataatcagggcggcaagccagggggatttctccgctaatactttaaaggtatatgaagattatttaagagaaagctttgttatgaaagacttggaaaaatataaaaatgccaaagatttcttagaacaaaaccacgacctgatgaccacttatcccgatatgatggatgaggccttttttgaactgtttatggtagatggagtaccgaagcgggacaagtttaaggcaattaaggaaaaagcgctatctaagaggtctttctggcagatggtgaaagatgcttatggtttctggaaggggttgattcgatga

SEQ ID NO: 2697 - protein, 431 aa, Carboxydothermus hydrogenoformans Z-2901
MPEKFDVVVVGAGPSGLAAAYKLAEAGLKVIVIERGEFPGAKNVMGGIIYKKPTEAVFPEIFKEAPVERPIIEQRYYFLTDTAKIGFSYRNPRYKEDISGYSVFRAKFDRFLAKKVQEKGALLITETVVEDLIVKDGKVKGVIAGRKEGEVLADVVVLAEGAHSLLAQKYGFQKPIPPQNLAVAVKEVIGLPASVIEDRFNIEPGEGVAIELFGKATAGMVGTAFIYTNQNSLSIGVGALMSDLIKRRISPNDLIEAFKNHPAIKPLLRDGEVKEYLAHLIPEGGYKGIPKLYGDGIVIVGDAGMLVNSIHREGSNLAITSGALAAKAIIRAASQGDFSANTLKVYEDYLRESFVMKDLEKYKNAKDFLEQNHDLMTTYPDMMDEAFFELFMVDGVPKRDKFKAIKEKALSKRSFWQMVKDAYGFWKGLIR

SEQ ID NO: 2698 - DNA, 1302 bp, Rhodospirillum rubrum ATCC 11170
  CDS (1)..(1302): transl_table=11
atggcagagcatttcgatgtaatcatcgtcggtgcgggcatggcgggcaacgccgcctcctacaccctggccaaggccggcctcaacgtcttgcagatcgagcgcggcgaatatcccgggtcgaagaacgttcagggcgccattctgtacgccaatgcggtcgagcagatcattcccggcttccgcgatgacgcgccgctggaacgccacgtcatcgaacagcgcatgtggatgctcgatgaccgctcctatgtgggcagccatttccgcagcgagaacttcaacgaggaaaagcccaaccgctacaccatcatccgcgcccagttcgacaagtggttcaaccgtcaggcccgcgacgccggggcgatggtgatctgcgagaccaccgtgctcgatctgatccgcaacgatgccggcaaggtggtgggcgtgcgctgcgaccgcgagggcggcgaggtctatgccgaggtggtcatcctctgcgacggcgtcaacgccctggtcggccagcgctcgggcatccgctccgagatcagccccgagcacgccgccctggcggtcaaggagatgcacttcctgccgcgcgaggtcatcaacgagcgcttcaacgtgcgcgatgacgaaggcgtggtcatcgaggccctgggcaccgtgacctcgggcatgttgggcaccggcttcctctataccaatggcgagagcatctcgctgggcatcggctgcatcgtgtccgatttcgtcgagaccaagatcggtccggccaagctgcttgaacgcttcaaggcccatccctcgatcgctccgctgatcaggggctccgaggtcaaggaatacgccgcccatctgatccccgaaggcggctataacgcggtgccccagctttacggcgccggctggctgatctgcggcgatgccgcccacttcctcaacgccgcccaccgcgagggctccaatctggcgctcacctccgggcggctggcggcggaaacgatcatcgcgctgaagtccgaaggcaaggcgatgaccgaggccaatctggcgctctatcgccagaagcttgaggaaagcttcgtgctgaaggacctgaagaagtataaggaccttccccacaccctgtggcgcaacaagcagttcgtgacgacctatcccgaattgatggccaaggcggcggagaatttcttccgcgtcgatggtgtcgataagctgaccaaggaaaaagacatcgtgcggagcttccgcaaggcccggggtgttctcggtctggtgggcgacgccgtcaaggtggcgagggcatggcgatga

SEQ ID NO: 2699 - protein, 433 aa, Rhodospirillum rubrum ATCC 11170
MAEHFDVIIVGAGMAGNAASYTLAKAGLNVLQIERGEYPGSKNVQGAILYANAVEQIIPGFRDDAPLERHVIEQRMWMLDDRSYVGSHFRSENFNEEKPNRYTIIRAQFDKWFNRQARDAGAMVICETTVLDLIRNDAGKVVGVRCDREGGEVYAEVVILCDGVNALVGQRSGIRSEISPEHAALAVKEMHFLPREVINERFNVRDDEGVVIEALGTVTSGMLGTGFLYTNGESISLGIGCIVSDFVETKIGPAKLLERFKAHPSIAPLIRGSEVKEYAAHLIPEGGYNAVPQLYGAGWLICGDAAHFLNAAHREGSNLALTSGRLAAETIIALKSEGKAMTEANLALYRQKLEESFVLKDLKKYKDLPHTLWRNKQFVTTYPELMAKAAENFFRVDGVDKLTKEKDIVRSFRKARGVLGLVGDAVKVARAWR

SEQ ID NO: 2700 - DNA, 1299 bp, Moorella thermoacetica ATCC 39073
  CDS (1)..(1299): transl_table=11
atggctgagcgctttgaggtagtagttgtcggggccggtccggccggcctggcggcggccctgaccctggcccgggccggggtggaagtaattgtctttgagcgtggagaacacccgggcagcaaaaacgttatgggtggcgtcctctaccgccacccgacagaaactgtggtccccgggttttaccaccaggctcccctggaacgaccggtggtggaacagcgcctgtggttgctcaccgaggaggcggccctgaccctgggctataaagatatggtttttgccggcgaacccttcaatgcctttaccgtcctgcgggcccgttttgaccgctggctggccgaccaggccgtagccgccggggcgcttttgatcaacgaaaccgtcgtcgaagacctcctgtgggaaaacgagcgcgtcgtcggggtacggacaggccgggaagggggcgatgtgcgggcggaagtggttatcctggccgagggggccaactccctgttgacccagaaggccgggctgaaacccgacggcattaacaccaaccagctggccgtggccgtgaaggagattattgccctgccccgggaaaaaatcgaggatcgttttaacctggaagagggccagggctgcaccattgaactcctgggggaagccaccaaggggatgctgggcaccgcctttatctataccaataaggactccctctccgtaggtgtgggggtcctcctggcgagcctggtgcgccgccgcctgaaccccaacgacctcctggagcacctgaaatcccaccccatggtacgtcctctcctggccgggggcgagagcaaggagtaccagggacatcttatccccgagggcggttaccaggctgttcctaaactctacggcaacggcgtcctggtagtcggggatgccgccatgctggtcaacgggattcaccgggaaggttccaatctggccctgacctccggcctgctggcagccaggactatcctggccgccagggagaagggtgactacagtgaagccaacctggccccttatcgccaggccctggaggagagctttgtcctgaaggacctgaagaaataccagcgggccccatttttcttcgaccagaacccccaattcttcaccctgtaccccggcctcctctcccgggccgccagggagtttttaaccgttgacaacgtccccaagcgtgagaagcagaagcggattttgcgggagattaccacctcccgcagccgtttccagattgcccgcgatctctataacctctggagggtgatgggctga

SEQ ID NO: 2701 - protein, 432 aa, Moorella thermoacetica ATCC 39073
MAERFEVVVVGAGPAGLAAALTLARAGVEVIVFERGEHPGSKNVMGGVLYRHPTETVVPGFYHQAPLERPVVEQRLWLLTEEAALTLGYKDMVFAGEPFNAFTVLRARFDRWLADQAVAAGALLINETVVEDLLWENERVVGVRTGREGGDVRAEVVILAEGANSLLTQKAGLKPDGINTNQLAVAVKEIIALPREKIEDRFNLEEGQGCTIELLGEATKGMLGTAFIYTNKDSLSVGVGVLLASLVRRRLNPNDLLEHLKSHPMVRPLLAGGESKEYQGHLIPEGGYQAVPKLYGNGVLVVGDAAMLVNGIHREGSNLALTSGLLAARTILAAREKGDYSEANLAPYRQALEESFVLKDLKKYQRAPFFFDQNPQFFTLYPGLLSRAAREFLTVDNVPKREKQKRILREITTSRSRFQIARDLYNLWRVMG

SEQ ID NO: 2702 - DNA, 1293 bp, Desulfitobacterium hafniense Y51
  CDS (1)..(1293): transl_table=11
atgtctgaggatcaatttgatgctgtaatcgtcggcggggggatcgcagggacagtcgccgggtatttgttggccaaagaaggactgcaggtagccgtcgtagagcgggggaattatgcgggcagtaaaaatgtaaccggcgggcgcatctatagtcacagtctggagaaaattatgcctgatttcgcccaggaggctccggttgagcggaagattacccgtgaaaagatcagtttgatgaccgaggagagcaatgttaccttggattactattccgacatgctcggaatccagggcagcgactcgtactccgttttgcgcggagtatttgataagtggctgcaagaaaaggcggaagaagcaggggcgatgtttattaccgggattcgcatcgatgatttaattttcagggaaggtaaagtctgcggcgttattgccggagaagacgaactggaagcccaggttacgattttagctgatggagttaattcactcttggcacagaaattaggattccggagcgaattatgcccggagcatgtggctgtcggggtcaaggaagttattgaattaccggtgccggtgcttgaagaccgttttagctgccggggtaatgaaggaacttcatggctgtttgccgggaccccctcagcagggcgtgtgggcggcggattcctatataccaataaggagagcatttccataggtgtggtcagtacccttagtgaattggttaaaggccataaatccgtgccccaaatgcttgaagattttaaaaagcatccagtgattgaacctttgcttaaaggcgggaaattgatcgagtattccggccaccttgttcccgaagggggcttaaagatgattcctaaaattatcggcaatggggtcttggttgtcggcgacgctgccggattctgcatcaacttaggctatgccgtgcggggtatggactttgccgttgcctcagccgaatgtgcagtaaaagcagttctagcggccaaagaggctgagaattattcggaaagctttctgcaatgttatcagacttttttgagcaatagctttgtcatgaaggatatgatccattaccagaagttcccccacttcctggaagaaacgccgcggatctttgctgcttatccccgaatggcggcagatatgatggcagaattgttcattatgaatggtcaaccggctcagccccttatgaagaacatgatgaaacatgttaaggaggtcgggttgacgactattgccaaagatgcgtggaaaggagttcgatccctatga

SEQ ID NO: 2703 - protein, 430 aa, Desulfitobacterium hafniense Y51
MSEDQFDAVIVGGGIAGTVAGYLLAKEGLQVAVVERGNYAGSKNVTGGRIYSHSLEKIMPDFAQEAPVERKITREKISLMTEESNVTLDYYSDMLGIQGSDSYSVLRGVFDKWLQEKAEEAGAMFITGIRIDDLIFREGKVCGVIAGEDELEAQVTILADGVNSLLAQKLGFRSELCPEHVAVGVKEVIELPVPVLEDRFSCRGNEGTSWLFAGTPSAGRVGGGFLYTNKESISIGVVSTLSELVKGHKSVPQMLEDFKKHPVIEPLLKGGKLIEYSGHLVPEGGLKMIPKIIGNGVLVVGDAAGFCINLGYAVRGMDFAVASAECAVKAVLAAKEAENYSESFLQCYQTFLSNSFVMKDMIHYQKFPHFLEETPRIFAAYPRMAADMMAELFIMNGQPAQPLMKNMMKHVKEVGLTTIAKDAWKGVRSL

SEQ ID NO: 2704 - DNA, 1293 bp, Desulfitobacterium hafniense Y51
  CDS (1)..(1293): transl_table=11
atgagcaataaatttgacgtgatcatcgtcggtgccggtcctgccggttcctctgccgccattatggcggcccaagccggcttgaaggttctcgtcatcgaacggggggaatatgtcggcgcgaaaaacatgaccggcgggatgctgttatcccaggtgctgaatgaggttattccggaattctggaaggaagctcccttgcagcggccggtcgtgtcccagcggatcatgatgacctccggcggccgttccctgacggtggatattgggaaccggaagttttcagaacctccattcaatggattttccgtgctgcgccatgaattcgacgcctggctggcggacaaggcgcgggaggctggggctgtcctggtcaccggtacggttgtggatgatgtcattcacgcgggcaaccggatcgtcggggtcaaaacaaggcgtgatgagggcgatgtttacggggatatcgtgatcctggcggatggagtcaattccctgctggcccgcaaggccggactcagaaagccgtatcaggcccatgatatcggcctgggggtcaaagagttgctggacttgccggctaaaaccatcaatgagcgtttcggcctgaccggcaacaacggagcggcgttgatggccatcggcgattttgcccggggaattcccggcggcggttttctttacaccaataaagaaagtatctcgctggggatggtactccagccgcaggctttgatcgatcaaaagctgacccccgatgaggttctggaacgcttcaaggcggtccctgaagttgcccgcttgcttgaaggagccaagctcattgaatactccgctcatttgattcccgaaggcggctacaattccatgcccaaactatgggctgatgggatcctggtagccggggacgcggcagggttcgttgtcaatacaggcatcacgctccagggaatgaacctggccattgcctccggcaaatgcgccggtgaagctgcggttaaagcttatcaaaagaaagacttttcagcttcttccctgggtgaatatgaaacactgctggcggcaggcgttgctttgaatgcgatgaagatccaccgccgcgccccggaattgatgtcctcttcgcgtatgttcagtgaatatcctgatctggtcaacgaccttctggaacagattgtgacggtcggctccggcccccatgaccctatcatgacaattgccaaaagagaaatgaaaaaaatcggttggaagaatctgatccgtgacggtctgacgggggtgaaatcgttatga

SEQ ID NO: 2705 - protein, 430 aa, Desulfitobacterium hafniense Y51
MSNKFDVIIVGAGPAGSSAAIMAAQAGLKVLVIERGEYVGAKNMTGGMLLSQVLNEVIPEFWKEAPLQRPVVSQRIMMTSGGRSLTVDIGNRKFSEPPFNGFSVLRHEFDAWLADKAREAGAVLVTGTVVDDVIHAGNRIVGVKTRRDEGDVYGDIVILADGVNSLLARKAGLRKPYQAHDIGLGVKELLDLPAKTINERFGLTGNNGAALMAIGDFARGIPGGGFLYTNKESISLGMVLQPQALIDQKLTPDEVLERFKAVPEVARLLEGAKLIEYSAHLIPEGGYNSMPKLWADGILVAGDAAGFVVNTGITLQGMNLAIASGKCAGEAAVKAYQKKDFSASSLGEYETLLAAGVALNAMKIHRRAPELMSSSRMFSEYPDLVNDLLEQIVTVGSGPHDPIMTIAKREMKKIGWKNLIRDGLTGVKSL

SEQ ID NO: 2706 - DNA, 1299 bp, Desulfitobacterium hafniense Y51
  CDS (1)..(1299): transl_table=11
atggctgcagataaatacgaggttattatcatagggggaggtccggcaggactcgctgcagcttacaagctggcagaagcaggaattgaaaccgtagttgtggaacgcggcgagtattccggcagcaaaaacttaagtggcggaattctttatagccgggttcttgagcagctcattcccaactactgggaagaggctccggtggagcgctgtattacgaattatcttacaacactcatgacccaagacgattattttaacctggagtataagggtaaagccttagggaacctaccctataacgccgtatccgttctaagggccaaattcgatcgctggctggcggaaaaggcggaagaagcaggggcaatgatcgtcaccggcatcaaagtggaaaaagtaatcaaagaaggaacccgcatcgttggaattcgcaccggggatgaagaaatgctggctgacgttgtaatcgcagccgatggcatcaattcctttattgcccaggaagcaggactgcggggagccattgaaccgaagcacctggccgtaggagctaaagcgctgatcgaacttccccgggaggtgatcgaggaacgcttcaggcttagcggcaatgaaggagcggcttatgctattttaggcgaggcgacgtatggcgtggccggcggtgcgtttttgtataccaaccttgagagtctctcgattggggttgtcatgcggttggatgatcttgtcaaagaaaaagtcaaaccaggggatgccttggatgacctgctggagcatccgatggttgctccgttggtcaaaggcgggaagatggtcgaatacggagcccatctgacaggtgagggtggactgcacatggtgccgccccaactctatgcagacggtatgctgattatcggtgacgcggcagggtttacgattaatagcggtttagtaatccggggcatggatctggcgattggttcagggatggctgcggcggcagctgtacttgaggccaaaagcaagggggatttcagtgccggttccttaagcgcataccaacgcaacctggatcaaagttttgtcatgaaagacttgcagctttatgtcaaagcgccggactttatggaaagcgatctcttgttcaaaaaatactcccatatggtcaataatttattcggaaaagtatacacccatgatttaaccccgaaagagcatctgctgaaaatggcttttaaagcgataaaagaaagtgaaattccacttatcggtctggcaaaagatgggctcaagggggtgcgtgcattatga

SEQ ID NO: 2707 - protein, 432 aa, Desulfitobacterium hafniense Y51
MAADKYEVIIIGGGPAGLAAAYKLAEAGIETVVVERGEYSGSKNLSGGILYSRVLEQLIPNYWEEAPVERCITNYLTTLMTQDDYFNLEYKGKALGNLPYNAVSVLRAKFDRWLAEKAEEAGAMIVTGIKVEKVIKEGTRIVGIRTGDEEMLADVVIAADGINSFIAQEAGLRGAIEPKHLAVGAKALIELPREVIEERFRLSGNEGAAYAILGEATYGVAGGAFLYTNLESLSIGVVMRLDDLVKEKVKPGDALDDLLEHPMVAPLVKGGKMVEYGAHLTGEGGLHMVPPQLYADGMLIIGDAAGFTINSGLVIRGMDLAIGSGMAAAAAVLEAKSKGDFSAGSLSAYQRNLDQSFVMKDLQLYVKAPDFMESDLLFKKYSHMVNNLFGKVYTHDLTPKEHLLKMAFKAIKESEIPLIGLAKDGLKGVRAL

SEQ ID NO: 2708 - DNA, 1293 bp, Desulfitobacterium hafniense Y51
  CDS (1)..(1293): transl_table=11
atgtcggaggataaattcgatgcaatagtcgtcggaggcgggatcgccggaacagtagccgcttatttgctggctaaggagggcttggaagtcatccttgtggaacggggcaattatgcagggagcaagaatatgacaggcgggcggatctatagccatagcctggagaagatcatgccggattttgcccgggaagcccctgtcgaacgccgaattaccagagaaaagatcagcttaatgaccgatgaaagcaatgtcactttggatttttattcttctaagctgggtgtgcagggcagtgattcttattccattttgagaggggtcttcgatcagtggctggctgaaaaggctgaggaggccggtgtacagattataccggggatccgagtcgatgacctaattattcgggaaggaaaagtctgcggtgtggtggcaggagaggatgagctggaagccaatatcacaattctcgccgatggtgtcaattcgctcctggctcagaaattgggatttaggggagagttggcagcccaccatgtggccgtgggagcgaaagaaatcattgaattgccaccccaagttattgaagaccgttttaactgcaatggcaatgaaggaacggcctggctatttgccgggtatccctctgacgggcgtgtgggaggtggattcctgtatacgaataaatcgagcatttccctgggagtagtcacgaccttaagtgatgtgatcaaaggaaacaaaaccgtacctcagatgttggaagattttaaacaccacccagctgtccagccacttattaaggatggcaagatgattgagtactccggtcatcttgtacctgaagccggattagccatgatccccaagattgtaggcaatggagttttggtcgtcggcgatgccgccggattctgcatcaatttaggctatatggtacgggggatggactttgcggtggcatcggccgaatgtgcggctaaagcagtacttaaagccaaagaagcgcaagatttcagcgagggataccttcattgctaccaggggttattggagcagagcttcgttatgcaggatttaaaacgatataaagatttcccccacttcctggaggaaaccccgagaattttcaatgagtatcctaaaatggcggatgatctgctgacagacatgtttgtggtcaaaggagaaccggcccaacccctaagaaaaacgctcatgcagcatgtaagcaagataggggtgttgaatattgccaaagacggttggaagggggtgcgttcactatga

SEQ ID NO: 2709 - protein, 430 aa, Desulfitobacterium hafniense Y51
MSEDKFDAIVVGGGIAGTVAAYLLAKEGLEVILVERGNYAGSKNMTGGRIYSHSLEKIMPDFAREAPVERRITREKISLMTDESNVTLDFYSSKLGVQGSDSYSILRGVFDQWLAEKAEEAGVQIIPGIRVDDLIIREGKVCGVVAGEDELEANITILADGVNSLLAQKLGFRGELAAHHVAVGAKEIIELPPQVIEDRFNCNGNEGTAWLFAGYPSDGRVGGGFLYTNKSSISLGVVTTLSDVIKGNKTVPQMLEDFKHHPAVQPLIKDGKMIEYSGHLVPEAGLAMIPKIVGNGVLVVGDAAGFCINLGYMVRGMDFAVASAECAAKAVLKAKEAQDFSEGYLHCYQGLLEQSFVMQDLKRYKDFPHFLEETPRIFNEYPKMADDLLTDMFVVKGEPAQPLRKTLMQHVSKIGVLNIAKDGWKGVRSL

SEQ ID NO: 2710 - DNA, 1311 bp, Burkholderia xenovorans LB400
  CDS (1)..(1311): transl_table=11
atgaagaagccttcacagttcgatgcgatcgtggtcggcgccggtccgtccggcaacgccgccgcctatacgatggccagggccggcctgaaagtgctgcagatcgagcgcggcgaatatcccggcagcaagaacgtgcagggcgcgatcctgtacgcgaaggcgctcgaagaaatcatcccggacttccgcgacgacgcgccgctggagcgccacatcatcgaacagcggatatggatgctcgacgacacctcgttcgtcggcacgcacatgcgcagcgaggaatacaacaagccgccctataaccgctacacgatcatccgcgcgcagttcgacaagtggttttcatcgaaagtgcgcgaagccggcgccttgctgatctgcgagaccacggtcaagcaactcatcatggacggcgatcaggtggtgggcgtgcagtgcgatcgcgagcatggcgacgtgtacgcggacgtggtggtgctcgccgacggcgtgaattcgacgctcgcgcgcaaggcgggctttcatggagagatcgaagccggcaacgtcgcgctcgcggtcaaggagattctcttcatgcccgaggagacgatccgccagcgctttaacatcggcgaggacgacggtgtcgtgatcgagatggtcggcaggatcaccgacggcatgacgggcaccggctttctttataccaacaaggaatcgctcaccatcggcgtgggctgcatgctgggcgacttcaagaagaaccccaaccgcacgagcccctacgtgctgctcgaaaagatgaagcagcacccgtcgatcgcaccgctgatcgcgggcggcgagatgaaggaatattgcgcgcatctgattccggaaggcggctttcacgccatcccgcgcgtctacggcaacggctggatgatcgtcggcgactcgggtggtttcgtgaacgccgcgcaccgcgaaggctcgaatctcgcgatgaccaccgggcgcctcgccgccgaaacggtgattcacgcgaaagccgcgggcctcggctatcgcgcggccacgctcaaggcctacaaggccgcgctcgaccagagcttcgtgatgaaagacctgcacaagtaccgcgacatgccggccgtgctgcaccagaatccgcagttcttcacgacctaccccgatctcgtggcacgcgccgcgcgcacgatgctcacggtcgacggcaaggacaagaaaagcaaggagcgcgaaattttttcgagcttccgcaaagcccgttcgcttgccggcatggtgggtgacgcctacaaactcctgagggccttccgatga

SEQ ID NO: 2711 - protein, 436 aa, Burkholderia xenovorans LB400
MKKPSQFDAIVVGAGPSGNAAAYTMARAGLKVLQIERGEYPGSKNVQGAILYAKALEEIIPDFRDDAPLERHIIEQRIWMLDDTSFVGTHMRSEEYNKPPYNRYTIIRAQFDKWFSSKVREAGALLICETTVKQLIMDGDQVVGVQCDREHGDVYADVVVLADGVNSTLARKAGFHGEIEAGNVALAVKEILFMPEETIRQRFNIGEDDGVVIEMVGRITDGMTGTGFLYTNKESLTIGVGCMLGDFKKNPNRTSPYVLLEKMKQHPSIAPLIAGGEMKEYCAHLIPEGGFHAIPRVYGNGWMIVGDSGGFVNAAHREGSNLAMTTGRLAAETVIHAKAAGLGYRAATLKAYKAALDQSFVMKDLHKYRDMPAVLHQNPQFFTTYPDLVARAARTMLTVDGKDKKSKEREIFSSFRKARSLAGMVGDAYKLLRAFR

SEQ ID NO: 2712 - DNA, 1308 bp, Rhizobium leguminosarum bv. viciae 3841
  CDS (1)..(1308): transl_table=11
atgaccaagggtaagttcgacgcgatagtcattggcgccggtatgtccggcaacgccgcagcgtattcgatggctagtcgcggtctaaaagtgctgcagctggagcgcggagaacattcaggctctaaaaatgttcaaggggctatattgtacgccaacatgttggaggcgattatcccaaacttccgcgatgacgctcctcttgaacggcatctggtagagcaacgattctggctaatggatgactcgtcgcacacgggcgtgcactatcgctctgatgactttaacgaactgaagccaaaccggtatacgatcatccgcgcccagtttgacaagtggttctcatccaaggtgcgcgatgccggcggcacaatcctttgtgaaacgacagcgactaggctcgctcggaacctgagaggtaaagtagtaggcgttcacacggaccgggagggcggtgtgatcctcgcggacgtggtcgtcctcgctgagggcgtaaacggactgcttggaactcgagccggcttacgcgatataccgaggccagaaaatgtggccctcgctgtcaaggaaatgcatttcatgccggaagaggtcatcgcagagcgcttcggcctcaacggtagcgaaggctgtgtgatcgaagccggcggcacgatctcacgcggaatggccggactgggcttcctttataccaacaaggagtcgatctcggtggggatcggctgcctcgtctccggtttagcgggaggcatggaaaatccgtaccgccttcttgacgccttcaagcgacatccctcgatccgaccattactggccggatcagagataaaagaatacgccgcgcatcttattcccgaagggggcttcaaggcaatcccgcaactctttggcgacgggtgggtggtcgtgggcgatgcggcgcaactaaacaatgccgtgcatagggagggatcaaacctcgcgatgacatcaggcctcatggccggcgaagcgatctgtcagataaagagccgtggcggcttgatgacgaagcgcaatctctctctatataagggcatgctggataagtcgttcgtcatgaaagatctgataaaacacaaagatcttccaagcctcctccacactgacagtcacaactttttcatgacgtatccaacgcttatatctcaggcagcgcaaaattttgtgcgcgtcgacggtgaacctaaaatcaacagggagaaggccacagccgcctcctttatcaaggcacgatcccgttgggggttgattagcgacgcggtccgctccgccgtatcttggcgttaa

SEQ ID NO: 2713 - protein, 435 aa, Rhizobium leguminosarum bv. viciae 3841
MTKGKFDAIVIGAGMSGNAAAYSMASRGLKVLQLERGEHSGSKNVQGAILYANMLEAIIPNFRDDAPLERHLVEQRFWLMDDSSHTGVHYRSDDFNELKPNRYTIIRAQFDKWFSSKVRDAGGTILCETTATRLARNLRGKVVGVHTDREGGVILADVVVLAEGVNGLLGTRAGLRDIPRPENVALAVKEMHFMPEEVIAERFGLNGSEGCVIEAGGTISRGMAGLGFLYTNKESISVGIGCLVSGLAGGMENPYRLLDAFKRHPSIRPLLAGSEIKEYAAHLIPEGGFKAIPQLFGDGWVVVGDAAQLNNAVHREGSNLAMTSGLMAGEAICQIKSRGGLMTKRNLSLYKGMLDKSFVMKDLIKHKDLPSLLHTDSHNFFMTYPTLISQAAQNFVRVDGEPKINREKATAASFIKARSRWGLISDAVRSAVSWR

SEQ ID NO: 2714 - DNA, 1296 bp, Fusobacterium nucleatum subsp. vincentii ATCC 49256
  CDS (1)..(1296): transl_table=11
atgagcgaagaaaaatttgatgccataatcgtaggtggcggtttggcaggttgctctgcagctattgtccttgcaaatgctggacttgcagttcttgtagtggaaagaggagatttttgtggagcaaaaaatatgacaggtggacgactttatggacacagtcttgaaaaaattattccaaactttgcagaggaagctcccatcgaaagaaagataacaagagaaaaaatttctttaatgagtgaggatagttcttttgatatagggtttggatctaaaaagttaagttcaaataatgaaaatgcttcttatacagtgcttcgttctacatttgatagatggttagcttccaaagcagaagaagcaggagcagaaattattcctggaattttagtagatgaactaattctagaagacggaaaagtagtaggagtttctgcaacaggggaagaattatatgcagatgtagtcattcttgcagatggagtaaattctcttttagcacaaagtttaggtatgaaaaaagaattagaacctcatcaagtagctgttggagcaaaagaagttattaaattaggagaagatgttattaatcaacgttttgctgtaaataatggagaaggagtagcatggctttcttgtggtgatcctaccttaggtggatttggaggaggattactttatactaataaagatagtgtttctgttggagtcgttgctactttaagtgatattggacatagtgatttatctatcaatcaattattggatagatttaaagaacaccctgctattgctccatatttagaaggtggaacttctattgaatattcaggtcatttagtcccagaagaagggcttcatatggttccagaattatatagggatggtgttttagtaactggagatgctgctggtttctgtatcaacttaggttttacagttcgtggaatggattttgctattgaatctggtcggcttgctgctgaaacagttatcaaggcacatgaaattggagattttagtgcagctacactatctgattataagaaagctcttgacagcagttttattatggaagacttaaatcaatataagggattccctactttacttggaagaagagaaatttttgaaggtcttcctgcaatggttgatgatattgctacaaaagcatttacagtagatggaaagcaaggacaaagtttgatgatgtatgttattcactctgtggcagaacatacaacagcagcaaaacttgtagattttgttaccacagtattggaggcgttttaa

SEQ ID NO: 2715 - protein, 431 aa, Fusobacterium nucleatum subsp. vincentii ATCC 49256
MSEEKFDAIIVGGGLAGCSAAIVLANAGLAVLVVERGDFCGAKNMTGGRLYGHSLEKIIPNFAEEAPIERKITREKISLMSEDSSFDIGFGSKKLSSNNENASYTVLRSTFDRWLASKAEEAGAEIIPGILVDELILEDGKVVGVSATGEELYADVVILADGVNSLLAQSLGMKKELEPHQVAVGAKEVIKLGEDVINQRFAVNNGEGVAWLSCGDPTLGGFGGGLLYTNKDSVSVGVVATLSDIGHSDLSINQLLDRFKEHPAIAPYLEGGTSIEYSGHLVPEEGLHMVPELYRDGVLVTGDAAGFCINLGFTVRGMDFAIESGRLAAETVIKAHEIGDFSAATLSDYKKALDSSFIMEDLNQYKGFPTLLGRREIFEGLPAMVDDIATKAFTVDGKQGQSLMMYVIHSVAEHTTAAKLVDFVTTVLEAF

SEQ ID NO: 2716 - DNA, 1311 bp, Burkholderia vietnamiensis G4
  CDS (1)..(1311): transl_table=11
atgaaaaaaccgtcgcaattcgacgcgatcgtcgtcggcgcggggccgtcgggcaatgccgcggcctacacgatggcgaaagccggcctcaaggtgctgcagatcgagcgcggcgagtatccgggcagcaagaacgtgcaaggcgcgatcctctacgcgaaggcgctcgaggagatcatccccgactttcgcgacgacgcgccgctcgagcgtcacatcatcgagcagcgcctgtggatgctcgacgagacgtcgttcgtcggcacgcacgtgcgcagcgacgactacaacaagccgccgtacaaccgctacacgatcatccgcgcgcagttcgacaagtggttctcgtcgaaggtgcgcgaggccggcgcgctggtcatctgcgagacgaccgtcaaccatctgatcctcgacggcgaccaggtggtcggcgtgcagtgcgatcgcgagcagggcgacgtgtacgccgacgtcgtgatcctcgccgacggcgtgaattcgacgcttgcgcgcaaggccggtttccacgacgagatcgacgccggcaacgtcgcgctcgccgtcaaggaaatcctgttcatgccggaggagacgatccgtcagcgcttcaacatcggcgaggacgaaggcgtcgtgatcgagatggtcggccggatcaccgacggcatgatgggcacgggcttcctgtacacgaaccgcgaatcgctgacgatcggcgtcggctgcatgctgtccgatttcaagcagaacgcgaaccgcacgagcccgtacgtgctgatcgagcagatgaagcgccatccggcgatcgcgccgctgatcgagggcggcgagatgaaggagtactgcgcgcacctgatcccggaaggcggcttccacgcggtgccgcgcgtgtacggcaacggctggatgatcgtcggcgactcgggcggcttcgtcaacgccgcgcaccgcgaaggctcgaacctcgcgatgacgaccgggcgcctcgcggccgagacggtgatcgcggcgaaggcggccggccgcggctatcgcgcgggcgagctgaaggcgtacaaggcgaagctcgacgacagcttcgtgatgaaggatctgtacaagtaccgcgacatgccggacacgctgcaccgcaatccgcaattcttcacgacctatccggatctggtcgcgaacgccgcgcgcacgatgatcaccgtcgacggcgtcgacaagaagaccaaggagcgcgcgatcgtgtcgagcttccgcaagagccgttcgttcgccggcctggtcggcgacgcgttcaaaatctggagggcattccgatga

SEQ ID NO: 2717 - protein, 436 aa, Burkholderia vietnamiensis G4
MKKPSQFDAIVVGAGPSGNAAAYTMAKAGLKVLQIERGEYPGSKNVQGAILYAKALEEIIPDFRDDAPLERHIIEQRLWMLDETSFVGTHVRSDDYNKPPYNRYTIIRAQFDKWFSSKVREAGALVICETTVNHLILDGDQVVGVQCDREQGDVYADVVILADGVNSTLARKAGFHDEIDAGNVALAVKEILFMPEETIRQRFNIGEDEGVVIEMVGRITDGMMGTGFLYTNRESLTIGVGCMLSDFKQNANRTSPYVLIEQMKRHPAIAPLIEGGEMKEYCAHLIPEGGFHAVPRVYGNGWMIVGDSGGFVNAAHREGSNLAMTTGRLAAETVIAAKAAGRGYRAGELKAYKAKLDDSFVMKDLYKYRDMPDTLHRNPQFFTTYPDLVANAARTMITVDGVDKKTKERAIVSSFRKSRSFAGLVGDAFKIWRAFR

SEQ ID NO: 2718 - DNA, 1308 bp, Xanthobacter autotrophicus Py2
  CDS (1)..(1308): transl_table=11
atgatcgacgaaaaattcgatgccatcgtcgttggcgccggcatggccggcaatgcggcggcctacaccctggccaagcgcggcctcaaggtgcttcagctggagcgcggcgagtattccggctccaagaacgtccagggcgccatcctctacgctgacatgatggaaaagatcattcccgatttccgggaagacgccccgctggagcgccatctgatcgagcagcgcttctggatgatgacggacaattcgcacaccggcctgcagtaccggtccgacgaattcaacgaggaaagcccgaaccgctacaccatcatccgggcgcagttcgacaagtggttctccagcaaggtgcgcgaggccggtgccctcgtggtctgcgagaccacggtgaccgagctggtccaggacgcctacggcaaggtgatcggcgtgaagaccgatcgcggcggcggccagatccatgcggacgtggtggtgctggcggaaggcgtcaccggcctgctcggcacccgcgccggcttgcgcaagattcccaagcccaccgaggtcgccctcgcggtcaaggaaatgcacttcctgccgcaggaggtgatcgagcagcgcttcaacctcaagggcaatgaaggcgtcgtgatcgaggccgtcggcaccatctccaaggggatgaccggcatgggcttcatctactcgaaccgggagtgcatctcgatcgggctcggctgcctggtgtcggacttccaggcgagcggcgtctcgccctaccaactgctcgagaagttcaagagccacccctccgtcgcaccgctgctggaaggctccgaggtgaaggaatatgccgcccacctcattcccgagggcggctacaaggcgatcccccagctctatggcgacggctgggtggtggtgggcgacgcggcccagctcaacaacgccatccatcgcgagggctccaacctcgccatgacctcggggcgcatcgctgcggagacgatcttccagatcaagtcccgcaaggaccccatgactgcccagaatctgtcgctctacaagaagatgctggacgacagcttcattatgaaggatcttaagaagtacaaggatatgccgaagcttctgcatatccagtcgcagaacttcttcctcacctatccccagctggtcaacaaggccatggagaactatctgcgtgtcgatggcacgccgaagaaggagaagcagaagctgactttgaagtccttcgtttccgcgcggtcgtgggcgggcctgttcggcgacgccttccgcctcgcgcgcgcctggcgctga

SEQ ID NO: 2719 - protein, 435 aa, Xanthobacter autotrophicus Py2
MIDEKFDAIVVGAGMAGNAAAYTLAKRGLKVLQLERGEYSGSKNVQGAILYADMMEKIIPDFREDAPLERHLIEQRFWMMTDNSHTGLQYRSDEFNEESPNRYTIIRAQFDKWFSSKVREAGALVVCETTVTELVQDAYGKVIGVKTDRGGGQIHADVVVLAEGVTGLLGTRAGLRKIPKPTEVALAVKEMHFLPQEVIEQRFNLKGNEGVVIEAVGTISKGMTGMGFIYSNRECISIGLGCLVSDFQASGVSPYQLLEKFKSHPSVAPLLEGSEVKEYAAHLIPEGGYKAIPQLYGDGWVVVGDAAQLNNAIHREGSNLAMTSGRIAAETIFQIKSRKDPMTAQNLSLYKKMLDDSFIMKDLKKYKDMPKLLHIQSQNFFLTYPQLVNKAMENYLRVDGTPKKEKQKLTLKSFVSARSWAGLFGDAFRLARAWR

SEQ ID NO: 2720 - DNA, 1293 bp, Desulfitobacterium hafniense DCB-2
  CDS (1)..(1293): transl_table=11
atgtctgatgatcgatttgatgccattgtggtcggtggcgggatagccggtactgtgaccgcatatctgctggccaaggaaggtctggaagtcatgctggtcgagcgggggaattactccggcagcaagaatgtaaccggcggacgcatttacagccatagcctggaaaagatcatgcccaactttgcccaggaagcgccggtagaacgtaaaattacccgtgaaaaaatcagcctgatgacagaagaaagcaatgtcacccttgatttcagttccaccaaactgggagaacaaggccgtgattcctattccgtcttaagaggcgtttttgaccagtggctggccactaaagcggaagaggcgggggttcagatcatccccggtatccgtgtcgatgatttgatccttagagaaggaaaggtctgcggaatcattgccggtgaggatgaactggaagccaatgtgacgattttagccgatggggtaaactctctgctggctcagaaattaggtttccgagatgagctgcagcctaaccaggttgccgtaggggccaaagaaatcattgaattaccggcacagaccattgaagaccgcttcaactgcaaaaaaggggagggaacctcttggctgtttgccgggaccccttcggcagggaaagttggcgggggattcatttatactaacaaagaaagcatttcactaggggtggtcagtactttaagcgagttgatcaaagccaacaaaacccttccgcaaatgctggaggattttaaagcccatccctccatcgaaccgttaatcaaaggcggcaagatggtggagtattccggccacctggttcccgaagggggactgaccatggtgcccaagatcattggccatggtgtccttgttgtgggagatgcggccggattctgtattaacttaggctacgctgtgcgggggatggactttgcggtgggttctgcggaatgtgcggccaaagcagtgctgaaagccaaagaagcccaggatttcagtgagagttctcttcagtgctatcagcttttcttggatgaaagcttcgtcatgaaggatctgaaacaatacaggaattttcctcatttccttgaggaaacccccaggatttttgatggctatcccaggctggcggcagatatcatgaaagacctatttgtggtgaccgacaatccaccccaaccccttatgaaaatgatgatgaaaaatatcagggaaatcggactgctgaacattgccaaggactgctggaaaggagtgcgttccctatga

SEQ ID NO: 2721 - protein, 430 aa, Desulfitobacterium hafniense DCB-2
MSDDRFDAIVVGGGIAGTVTAYLLAKEGLEVMLVERGNYSGSKNVTGGRIYSHSLEKIMPNFAQEAPVERKITREKISLMTEESNVTLDFSSTKLGEQGRDSYSVLRGVFDQWLATKAEEAGVQIIPGIRVDDLILREGKVCGIIAGEDELEANVTILADGVNSLLAQKLGFRDELQPNQVAVGAKEIIELPAQTIEDRFNCKKGEGTSWLFAGTPSAGKVGGGFIYTNKESISLGVVSTLSELIKANKTLPQMLEDFKAHPSIEPLIKGGKMVEYSGHLVPEGGLTMVPKIIGHGVLVVGDAAGFCINLGYAVRGMDFAVGSAECAAKAVLKAKEAQDFSESSLQCYQLFLDESFVMKDLKQYRNFPHFLEETPRIFDGYPRLAADIMKDLFVVTDNPPQPLMKMMMKNIREIGLLNIAKDCWKGVRSL

SEQ ID NO: 2722 - DNA, 1299 bp, Desulfitobacterium hafniense DCB-2
  CDS (1)..(1299): transl_table=11
atgagcgcagacaaatatgaagtgatcatcatcggcgcgggtctggcggggctgagtgcggcttacaagctggccaaggccggaatggaagttgtggtagtggaacggggagattatcccggaagcaagaatctgagcggaggcgtgctgtacagccggattttggatcagcttattcctgacttctgggaagaagcgcctattgaacgctatattaccaactaccttaccaccctgatgacccccacagattacgttaacatcgaatacaaagatcaggaactggccaagcccccttacaatgcggtcacggttttaagagcaaaatttgaccgctggctggcggaaaaagctgaagaagcgggagccatgatcgtaacaggagttaaagttgacaaggtgctgaaagaagggggcagaattaccggaattaccaccggcgatgaagagatgctggctgacgtggtcatcgcagccgacggcatcaactccttcattgctcaggaggccggtctgcggggagagattgagccggctcacctggcggtgggagccaaggctttgatagagcttcctcagcaagcaattgaagagcgcttcagactggaggggaatgaaggaacggcttatgccatgctgggcgacgccactcatggtgtggccggcggcggcttcttttataccaatcgggaaagcctgtccatcggcgtagtcatgcgcctggatgacttggtcaaagaaaaggtaaagccctttgaagtcctggatgatctgctccggcatcccctggttgcgcccctggtcaaggatggaaccatgacggaatacggggcccatctgacggcagaaggcggtgtgcatatggttccctcccagcttcatacggatgggatgctgattgtgggagatgccgccgggtttaccatcaacagtggtctggtcatcaggggcatggacctggccataggttcgggaatggcggcggcggaagctgtccttgaagccaaagaacgaggagattacagcgccgcagctttaagctcctatcagcgcaaattggatgaaggctttatcatgaaagatttgaaactctacgccaaagccgtggattttatggaaacagaccggctctataaaaactatgctcctctggccaaccacttgttcggcagaatttataaccacgatctcagccccaaagaacatctttggaaatcggtcctgggctctgtgcaggaaagcggaatatcctggctagacctggcccgggacggtatcaagggggtgcgggccctatga

SEQ ID NO: 2723 - protein, 432 aa, Desulfitobacterium hafniense DCB-2
MSADKYEVIIIGAGLAGLSAAYKLAKAGMEVVVVERGDYPGSKNLSGGVLYSRILDQLIPDFWEEAPIERYITNYLTTLMTPTDYVNIEYKDQELAKPPYNAVTVLRAKFDRWLAEKAEEAGAMIVTGVKVDKVLKEGGRITGITTGDEEMLADVVIAADGINSFIAQEAGLRGEIEPAHLAVGAKALIELPQQAIEERFRLEGNEGTAYAMLGDATHGVAGGGFFYTNRESLSIGVVMRLDDLVKEKVKPFEVLDDLLRHPLVAPLVKDGTMTEYGAHLTAEGGVHMVPSQLHTDGMLIVGDAAGFTINSGLVIRGMDLAIGSGMAAAEAVLEAKERGDYSAAALSSYQRKLDEGFIMKDLKLYAKAVDFMETDRLYKNYAPLANHLFGRIYNHDLSPKEHLWKSVLGSVQESGISWLDLARDGIKGVRAL

SEQ ID NO: 2724 - DNA, 1293 bp, Desulfitobacterium hafniense DCB-2
  CDS (1)..(1293): transl_table=11
atgtcggaggataaattcgatgcaatagtcgtcggaggcgggatcgccggaacagtagccgcttatttgctggctaaggagggcttggaagtcatccttgtggaacggggcaattatgcagggagcaagaatatgacaggcgggcggatctatagccatagcctggggaagatcatgccggattttgcccgggaagcccctgtcgaacgccgaattaccagagaaaagatcagcttaatgaccgatgaaagcaatgtcactttggatttttattcttctaagctgggtgtgcagggcagtgattcttattccattttgagaggggtcttcgatcagtggctggctgaaaaggctgaggaggccggtgtacagattataccggggatccgggtcgatgacctaattattcgggaaggaaaagtctgcggtgtggtggcaggagaggatgagctggaagccaatatcacaattctcgccgatggtgtcaattcgctcctggctcagaaattgggatttaggggagagttggcagcccaccatgtggccgtgggagcgaaagaaatcatcgaattgccaccccaggttattgaagaccgttttaactgcaacggcaatgaaggaacggcctggctatttgccgggtatccctcggatgggcgtgtagggggcggattcctgtataccaataaatcgagcatttccctgggagtagtcacgaccttaagtgatgtgatcaaaggaagcaaaaccgtacctcagatgttggaggattttaaacagcatccggctgtccagccgcttattaaggatggcaagatgattgaatactccggtcatcttgtacctgaagccggattagccatgatccccaagattgtaggcaatggagttttggtcgtcggcgatgccgccggattctgcatcaatttaggctatatggtacgggggatggactttgcggtggcatcggccgaatgtgcggctaaagcagtacttaaagccaaagaagcgcaggatttcagcgagggataccttcattgctaccaggggttattggagcagagcttcgttatgcaggatttaaaacgatataaagatttcccccacttcctggaggaaaccccgagaattttcaatgagtatcctaaaatggcagctgatcttctggcagacatgtttgtggtcaagggagaaccggcccagcccttaagaaaaaccatcatgcagcatgtgaacaagataggattgctgaacattatcaaagacggctggaagggggtgcgttcactatga

SEQ ID NO: 2725 - protein, 430 aa, Desulfitobacterium hafniense DCB-2
MSEDKFDAIVVGGGIAGTVAAYLLAKEGLEVILVERGNYAGSKNMTGGRIYSHSLGKIMPDFAREAPVERRITREKISLMTDESNVTLDFYSSKLGVQGSDSYSILRGVFDQWLAEKAEEAGVQIIPGIRVDDLIIREGKVCGVVAGEDELEANITILADGVNSLLAQKLGFRGELAAHHVAVGAKEIIELPPQVIEDRFNCNGNEGTAWLFAGYPSDGRVGGGFLYTNKSSISLGVVTTLSDVIKGSKTVPQMLEDFKQHPAVQPLIKDGKMIEYSGHLVPEAGLAMIPKIVGNGVLVVGDAAGFCINLGYMVRGMDFAVASAECAAKAVLKAKEAQDFSEGYLHCYQGLLEQSFVMQDLKRYKDFPHFLEETPRIFNEYPKMAADLLADMFVVKGEPAQPLRKTIMQHVNKIGLLNIIKDGWKGVRSL

SEQ ID NO: 2726 - DNA, 1308 bp, Rhizobium leguminosarum bv
  CDS (1)..(1308): transl_table=11
atgagggacgagaaattcgacgcgattgtagtcggcgcaggcatgtcgggtaacgcggccgcttatgcgatggccattcgcggcctgaaagtgctgcagttggagcgcggcgagtacccgggatcgaagaacgtccaaggagcgattctgtacgccgatgcaatcgagagaatcattccagacttccgagatgatgcgcctcttgagcgtcatttggtcgagcagcgcttctggataatggacggcacgtcgcacaccggaattcactatcgttcggatgactttaacgaacggaggccaaaccgatacacgattatccgtgctcaattcgatagatggttttcagccaaggtacgtgaggccggatgcaccgttctctgcgagacaatggccacaaaactcatcaaggactcgaacgacaacgtaaagggcgtcttcaccgaccgctccggcgataccattcttgccgacgtcgtggtgcttgctgagggggtgaacggctacctcggaacacgagggcacctgcgtgaaactcccaaaccggacagcgtggcactcgccgtcaaagaaatgcatttcctaccggaagacgttattgcagaacgcttcggcctgactgcagacgaaggctgtgtgattgaggcaggcgggacggtctcacggggaatcgccgggcttggctttctctataccaacaaggagtctatctcgattgggataggatgcctcgtttccggtttagctgcagccatggaaaagccatatgatatccttgaagccttcaagcaccatccttcgatccggccattgatcgctggatcagaggtaaaggaatatgctgcgcacctcattccggaaggcggttttacggctatcccacagctcttcggcaatggctgggtggtagttggagacgcggcccagctgaacaatacggcacatcgcgagggctcgaaccttgcaatgacatcaggttaccttgctggcaaagcgatcgccgaagtaaagaatcgtggcggctcgatggttaagggtaacttgtctctgtacaagagcatgctcgatgattcctttgtcatcaaagacctgatgaagcataaagacatgccgagatttctccacgcgaactgccagagtttatttgtttcatatccaaggttgatatctcaagctgcgcaaagtttcgtccgcgtcgaaggaacatcaaaatttgacaaagaaaaggcgacgtctgccgccttcttcaaagcacgatcccggtggggattaatttcagatgcagtccggctcgcacgcgcgtggcgctaa

SEQ ID NO: 2727 - protein, 435 aa, Rhizobium leguminosarum bv
MRDEKFDAIVVGAGMSGNAAAYAMAIRGLKVLQLERGEYPGSKNVQGAILYADAIERIIPDFRDDAPLERHLVEQRFWIMDGTSHTGIHYRSDDFNERRPNRYTIIRAQFDRWFSAKVREAGCTVLCETMATKLIKDSNDNVKGVFTDRSGDTILADVVVLAEGVNGYLGTRGHLRETPKPDSVALAVKEMHFLPEDVIAERFGLTADEGCVIEAGGTVSRGIAGLGFLYTNKESISIGIGCLVSGLAAAMEKPYDILEAFKHHPSIRPLIAGSEVKEYAAHLIPEGGFTAIPQLFGNGWVVVGDAAQLNNTAHREGSNLAMTSGYLAGKAIAEVKNRGGSMVKGNLSLYKSMLDDSFVIKDLMKHKDMPRFLHANCQSLFVSYPRLISQAAQSFVRVEGTSKFDKEKATSAAFFKARSRWGLISDAVRLARAWR

SEQ ID NO: 2728 - DNA, 1308 bp, Rhizobium leguminosarum bv
  CDS (1)..(1308): transl_table=11
atgaagggcgagaaatttgacgcgattgtcgtcggggcaggtatgtcgggtaacgcggctgcttatgcgatggccatgcgtggtctgaaagtgctgcagttggagcgcggcgagtacccgggttcgaagaacgttcaaggagcgatactgtacgccgacgcgctggaaaagatcattccagacttccgcgatgacgcgcctcttgaacggcatctcgtcgagcagcgcttctggatcatggacggcgcgtcgcacaccggaattcactatcggtcggatgactttaacgaacggaggccaaaccgatacacgatcatccgtgcccaattcgatagatggttctcggccaaggtgcgagaggccggatgcaccgttctctgcgagacattggccacaagacttatccaggattcaagcggcaacgtcacaggcgtatgcaccgaccgccccggcggggccattcttgccgacgtcgtggtgcttgctgagggggtgaacggcttcctaggaacactaggacgtttgcgcgaaacgcccaagccggacagcgtggcacttgccgtgaaagagatgcatttcctaccggaggaagttatcgcagaacgctttggcctgactgcagacgaaggctgtgtgatcgaggcaggtgggacaatttcacggggagtcccggggcttggctttctgtatacgaacaaggaatccatctcgattgggataggatgcctcgtttccggtttggccgcagccatggaaaggccatacgacattcttgaagccttcaagcaccatccttcgatccgaccattgatcgccgggtctgaggtgaaggaatatgctgcgcatctcattccggaaggcggttatacggctatcccacagctcttcggcaatgggtgggtcgtggttggagacgcggcccagttgaacaacaccgcacatcgcgagggctcgaacctcgcaatgacatcagggtatctggcgggtaaagcgattgcagacgtaaaggatcgcggcggctcgatggtgaaaagcaacttggctttgtacaagagcatgctcgactcatccttcgtcatcaaagatctgatgaagcataaagagatgccaaggtttctccatgccaacagccagaacttgtttgtttcatatccaaagttgatatctaaggctgcgcaaagtttcgtccgtgtcgacggaacttcaaaactcgacaaggaaaaggccacgtctgccgccttcttgaaagcacgatcccggtggggattaatttcagacgcagtccggctcgcccgcgcgtggcgctaa

SEQ ID NO: 2729 - protein, 435 aa, Rhizobium leguminosarum bv
MKGEKFDAIVVGAGMSGNAAAYAMAMRGLKVLQLERGEYPGSKNVQGAILYADALEKIIPDFRDDAPLERHLVEQRFWIMDGASHTGIHYRSDDFNERRPNRYTIIRAQFDRWFSAKVREAGCTVLCETLATRLIQDSSGNVTGVCTDRPGGAILADVVVLAEGVNGFLGTLGRLRETPKPDSVALAVKEMHFLPEEVIAERFGLTADEGCVIEAGGTISRGVPGLGFLYTNKESISIGIGCLVSGLAAAMERPYDILEAFKHHPSIRPLIAGSEVKEYAAHLIPEGGYTAIPQLFGNGWVVVGDAAQLNNTAHREGSNLAMTSGYLAGKAIADVKDRGGSMVKSNLALYKSMLDSSFVIKDLMKHKEMPRFLHANSQNLFVSYPKLISKAAQSFVRVDGTSKLDKEKATSAAFLKARSRWGLISDAVRLARAWR

SEQ ID NO: 2730 - DNA, 1671 bp, Heliobacillus mobilis
  CDS (1)..(1671): transl_table=11
ctgctgtcgaatcgggttgggcaccctactctcatcaggttggacaaacaggcctcacagtccgtcctaagctttacatcgccgccgggatttcgggagccattcagcatctggtcggcatgcagaactccgacgtcatcgtggccatcaacaaagaccccgatgcgcccatttttcgtgtcgccacctatggcatcgtcggtgatgctgcaaccctcctgcccgctatcacgcaggaactgggagcacgcatgcacggcgcccctttgggcaccgaacgccagctataagaaccgggaggaatcgttcatgacggttcaagagccgactcaacaacaactgaatcaggaacgctggcgagatgtccctttggaattcgaagcgatcgttgttggggcaggacccgccgggttagccgcggcgtatacattggccaaaggcggcgttaaaaccctgctcatcgaacggggagattttcccggcagcaaaaacgtcatgggcggcattctctacagctatcccacccatcaaatcattccggatttttggaaagaagcccccttagagcggcccatcgtggaacaacgggcttggttgctggccgaagaatcagtcgtctccatcggctttaaagaccctggtttttacgaagaaccctacaacaactttagcgtcttccgctcccgttttgaccgttggatggcgaataaagtcgtcgaagccggagcgaccttaatcacggaaacagtggtcaccgactttttatttgacgaaagagcagaccggcgaagagttgccggggtcgtcacgaaccgggaacagggagagatccgcgcccaggtggtcttaatttgcgagggcgccaacagcattctgacccagcgccttggactgcaagaagatctatcccccggtgacttggccgtgggagtgaaggaagtcatcgccttacccaaaggtgcgattgaagaccgcttcaacgtggaaaaaggacaaggggcaaccatcgagctgatcggtgagtcgacacagggcatgttcggcatgggatggatctacaccaacaaagataccttgtccatcggtgtaggtgtcatgatcaatcagttgtcccgatcgggcatgaatccaaacacggttttagaaaaaatgaaacaacaccccgccgttcgccccttgctggccggtggcgagaccaaggagtatctcgccaaaatcattcccgaaggcggctaccatcaggtgcccaagctctatgctcacggggtcctgatctgcggcgatgccgccatgctggttaacggtgtacaccgggaaggttccaacttagcgatgacctctggcaagttggctgctgaaaccgtcatcgaagcgaaaaaaaagggcgacttctcctcagtcaccttaaaagcctaccatgatcgactccaagacagtttcattctgaaagacttgaagaagtacgaaaacgcctctgctttattacagtctaatcctcatttctttaccctatatccgaagctcgcccggtactcggcaagagaacttttcaccgtcgataacgtaccaaagaaggataaacagaaaaaaatctggcacgaggttacttctcgacggggaatatggaatatcgccggtgacatgtaccgattatggcgaaccctgggttaa

SEQ ID NO: 2731 - protein, 556 aa, Heliobacillus mobilis
MLSNRVGHPTLIRLDKQASQSVLSFTSPPGFREPFSIWSACRTPTSSWPSTKTPMRPFFVSPPMASSVMLQPSCPLSRRNWEHACTAPLWAPNASYKNREESFMTVQEPTQQQLNQERWRDVPLEFEAIVVGAGPAGLAAAYTLAKGGVKTLLIERGDFPGSKNVMGGILYSYPTHQIIPDFWKEAPLERPIVEQRAWLLAEESVVSIGFKDPGFYEEPYNNFSVFRSRFDRWMANKVVEAGATLITETVVTDFLFDERADRRRVAGVVTNREQGEIRAQVVLICEGANSILTQRLGLQEDLSPGDLAVGVKEVIALPKGAIEDRFNVEKGQGATIELIGESTQGMFGMGWIYTNKDTLSIGVGVMINQLSRSGMNPNTVLEKMKQHPAVRPLLAGGETKEYLAKIIPEGGYHQVPKLYAHGVLICGDAAMLVNGVHREGSNLAMTSGKLAAETVIEAKKKGDFSSVTLKAYHDRLQDSFILKDLKKYENASALLQSNPHFFTLYPKLARYSARELFTVDNVPKKDKQKKIWHEVTSRRGIWNIAGDMYRLWRTLG

SEQ ID NO: 2732 - DNA, 1308 bp, Rhizobium loti
  CDS (1)..(1308): transl_table=11
atgatcgagcaagaattcgacgccatcgtcgtcggggccggtatgtccggaaacgcggccgcctacaccatggcaagccagggcctgacggtgctgcagttggagcgcggcgagtatccgggctccaagaatgtccagggcgccatcatgtacgccgacatgttggagcaaatcattccggatttccgggatgatgcgcctctcgagcggcatctggtcgagcagcgattctgggtgatggacgacacctcccacaccgggatgcagtatcgatcggacgatttcaacgaggcgaagcccaatcgctacacgatcatccgcgcccaattcgacaagtggttttcgcgcaaggtgcgccaagccggcgcgacggtgctgtgcgagacgacggtgaccgaacttgtccgcagtgccagcggcaaggtgatcggcgtgcgcaccgaccgggctggcgggccgatctacgcggacgtcgtcgtgctcgcagaaggtgtcaacgggctgctcggtacacgggccggcctgcgcaagatgccgaagccagaaagcgtggcgctcgctgtcaaggaaatgcattttctacccgatgaggtcattgagcagcggttcggcctccagggcgacgaaggctgcgtgatcgaagcggcgggcacgatttcccgcagcatggccggactggccttcctctacaccaacaaggagtcgatctctctcggcatcggctgcctcgtctccgatttcgcccagacaatggagagcccttacgtcctcctcgacaacttcaaaaaccatccttcgatccggccgctgatcgcgggctcggaagtcaaggagtattccgcgcatctcattcccgaaggtggctacaaggcaattccgcagctcttcggcgacggctgggtggcggtcggtgatgccgcccaactgaacaacgctatccaccgcgagggttcgaacctcgccatgacttccggccgcatcgcgggcgaggcaatcattgagatcaagggccgcaaccagccgatgatcaggaggaacctcgccctctacaagaccatgctggacaagtccttcgtagtcaaagacctgatgaaatataaggacatgccggccctgatacacaccaattcccgcaatttcttcatgacatacccgcagttgatgtcgcaggccgcgcagaacttcatgcgggtcgacggcaccccgaaaatcgagaaggaaaaggcgaccactgctgccttcatcaaggcgcgttcgcgctgggggctgatcagcgatgtggtccgcctggcactcgcgtggcgctga

SEQ ID NO: 2733 - protein, 435 aa, Rhizobium loti
MIEQEFDAIVVGAGMSGNAAAYTMASQGLTVLQLERGEYPGSKNVQGAIMYADMLEQIIPDFRDDAPLERHLVEQRFWVMDDTSHTGMQYRSDDFNEAKPNRYTIIRAQFDKWFSRKVRQAGATVLCETTVTELVRSASGKVIGVRTDRAGGPIYADVVVLAEGVNGLLGTRAGLRKMPKPESVALAVKEMHFLPDEVIEQRFGLQGDEGCVIEAAGTISRSMAGLAFLYTNKESISLGIGCLVSDFAQTMESPYVLLDNFKNHPSIRPLIAGSEVKEYSAHLIPEGGYKAIPQLFGDGWVAVGDAAQLNNAIHREGSNLAMTSGRIAGEAIIEIKGRNQPMIRRNLALYKTMLDKSFVVKDLMKYKDMPALIHTNSRNFFMTYPQLMSQAAQNFMRVDGTPKIEKEKATTAAFIKARSRWGLISDVVRLALAWR

SEQ ID NO: 2734 - DNA, 1299 bp, Azospirillum brasilense
  CDS (1)..(1299): transl_table=11
atggtcgaaaagttcgacgccatcgtcatcggtgccggcccgtccggcaacgcggcggcctacactctggccaagcagggcctcaacgttcttcagctcgagcgcggggagtatcccggcgccaagaacgtccagggcggcatcatgtacgccgccgagctggagaagatcatcccggacttccgcgaggattgcccgaccgagcgccacatcatcgaacagcgcgtctggctgctcggcgatgacaactacatcggcaccaactaccggtcggacgccttcaacagcgacaagccgaaccgatacacgatcatccgcgccaacatcgacaagtggttctccgagaagatccgcgaggccggcggcctgcagatctgcgagaccacggtgacggagctgatccgcgacgcctccggcaaggtcatcggcgtgcgcaccgaccgcgagggcggcgagatccacgccgacgtggtcatcatggccgacggcgtgaacgccctgctcgcccgccgcaccggcttccagcaggagctggcgccgcagaacgtcgcgctggcggtcaaggaaatcctgttcatcgatcccgagctgatccagcagcgcttcggcctgaaggacgaagagggcgtggtcatcgagatcatgggcaaggtgaccaagggcatggtcggcacggcgttcctctacaccaacaaggaatcgctgacgatcggcatcggctgcctcatctccgacttcaagcagggtgccattccgccctacaagatgctggaggacctgaagaaccaccccgtcatcaagccactgatcgaaggggcggagatgaaggaatacgccgcccacatgatccccgagggcggctacaaggcggttccgcagctctacggcgacggctggatggtggtcggcgacgccacccacttcaacaacgcgcaccgcgagggctccaacctcgccatggcgtcgggccgcatggcggcggagacggtgatcgagctgaagcaggccggcaagcccttcaacgctgccaacctcgccgcctacaagaagaagctggacgacagcttcatcatgaaggacctgaagaagtaccggaacctgccgggcatcatgcacgagaacaagcagttcttcggcgcctaccccgacacgctgaccgccgccgcccacagctggttcaccgtggacagcgtggacaagaagacgaaggagaaggagatcatgaagtccttcgtcaagaagcgctcgatcatgggtctggtcggcgacgcaatcaagctggtgagggccgtgcgatga

SEQ ID NO: 2735 - protein, 432 aa, Azospirillum brasilense
MVEKFDAIVIGAGPSGNAAAYTLAKQGLNVLQLERGEYPGAKNVQGGIMYAAELEKIIPDFREDCPTERHIIEQRVWLLGDDNYIGTNYRSDAFNSDKPNRYTIIRANIDKWFSEKIREAGGLQICETTVTELIRDASGKVIGVRTDREGGEIHADVVIMADGVNALLARRTGFQQELAPQNVALAVKEILFIDPELIQQRFGLKDEEGVVIEIMGKVTKGMVGTAFLYTNKESLTIGIGCLISDFKQGAIPPYKMLEDLKNHPVIKPLIEGAEMKEYAAHMIPEGGYKAVPQLYGDGWMVVGDATHFNNAHREGSNLAMASGRMAAETVIELKQAGKPFNAANLAAYKKKLDDSFIMKDLKKYRNLPGIMHENKQFFGAYPDTLTAAAHSWFTVDSVDKKTKEKEIMKSFVKKRSIMGLVGDAIKLVRAVR

SEQ ID NO: 2736 - DNA, 1311 bp, Acetobacter diazotrophicus
  CDS (1)..(1311): transl_table=11
atgacacagcaccaattcgacgccatcgtcgtgggggccggcccgtcggggaacgcggcggcctatacgatggcgcagcgcggcctgcgcgtcctgcagatcgagcgcggggaatatgcgggatcgaagaacgtccagggggcgatcctgtattccgacgcgctggaacgcatcattcccgatttccgggaagacgcgccgctggaacgtcacgtgatcgaacagcggatctggatgatggacgatgccgggcataccggcatgcatcatcgcagcgacgattataacgaggaaagccccaaccgttatacgatcatccgcgcccagttcgacaaatggttcaaccgccgcgtgcgggatgccggggtgacggtgctgtatgaaaccaccgtgacccggctgatcaccgatgcgcgcaagcgcgtcgtcggcgtgcagaccgatcgcgacggcaacggcatcttcgccgatgtggtcgtcctggccgaaggcgtgaacggcctggtcggcctgcggtccgggctgcgtgacgaattgcggcccgagaacgtggccctggcggtcaaggaaatgcatttcctgccgcaggaggtgatcgacgcgcgtttcaacctcaagggcgaggaaggcgtggtgatcgaggccatgggcaccgtgaccgacggcatggtgggcacggcgttcctgtataccaaccgcgaatccatctcggtcgggatcggctgcctggtcagcgaattcgccaggagcggcgccgcgacgccgcatggcctgctggaccgcttcaaggcgcaccccagcatccgtcccctgctggaaggatcggaaatcaaggaatacgccgcccacctgatccccgagggcggatatcgcgccgtccccgaactggtgggtgacgggtggatcgtcgcgggcgatgccgggcatttcgtgaatgccgtgcaccgggaaggatcgaatctcgcgatgacgaccggtcgcatggccggcgaggtcgttgccaatatcctgacgagcggcctttcgtgctccgcgacgaacctgggggcctacaagacgctcctgaaggaatccttcgtgatgaaggacctgaagaaataccggaacgtgccgaaaatgctggaagaaggcgggtacaacatcatgaatctgtatccgcgcctggtgaaccgcgcggcacagacgtggttccgcgtggacggcgtggacaagaaggccaaggaatctgaaattctgaagaatgcatggcgcgcgcgcggtgtcgcgggcctgctgggtgacgcattcaaactggcgagggcatggcgatga

SEQ ID NO: 2737 - protein, 436 aa, Acetobacter diazotrophicus
MTQHQFDAIVVGAGPSGNAAAYTMAQRGLRVLQIERGEYAGSKNVQGAILYSDALERIIPDFREDAPLERHVIEQRIWMMDDAGHTGMHHRSDDYNEESPNRYTIIRAQFDKWFNRRVRDAGVTVLYETTVTRLITDARKRVVGVQTDRDGNGIFADVVVLAEGVNGLVGLRSGLRDELRPENVALAVKEMHFLPQEVIDARFNLKGEEGVVIEAMGTVTDGMVGTAFLYTNRESISVGIGCLVSEFARSGAATPHGLLDRFKAHPSIRPLLEGSEIKEYAAHLIPEGGYRAVPELVGDGWIVAGDAGHFVNAVHREGSNLAMTTGRMAGEVVANILTSGLSCSATNLGAYKTLLKESFVMKDLKKYRNVPKMLEEGGYNIMNLYPRLVNRAAQTWFRVDGVDKKAKESEILKNAWRARGVAGLLGDAFKLARAWR

SEQ ID NO: 2738 - DNA, 1308 bp, Azorhizobium caulinodans
  CDS (1)..(1308): transl_table=11
atgattgatgagaagttcgacgccatcgtcgtcggcgcgggcatggcgggcaacgccgccacgctcaccctcgcccggcgcggcctgaaggtgctgcaactggagcggggcgaatattccggctccaagaatgtgcagggcgccattctctatgcggacatgctggagaagctggtccccgatttccgcgagacgcgccgctggagcgcccatctcgtggaacagcgcttctggatgctggacgaccgctcccatgtgggcctccactatcgctcggaggacttcaacgaggagaagccgaaccgctacaccatcatccgcgcccagttcgacaagtggttctcctccaaggtgaaggaggccggcgccacggtgctgtgcgagaccacggtgacggaactggtgcaggatgcctatggcaaggtgatcggggtcaagaccgatcgctccggtggccagatccatgcggatgtggtggtgctggcggaaggcgtgaacggcctgctcggcaccaaggcgcacctgcgcgaacggccgaagcccgagcatgtggcgctggcggtgaaggagatgcatttcctgccccgcgagaccatcgaagcccgcttcaacctccagggcgacgagggggtggtcatcgaggccgccggcaccatctcccgcggcatgacgggcatgggcttcatctatgccaacaaggaatgcatctcgctgggcatcggctgcctcgtctccgatttccagaagaccggcgagacgccctatggcctgctggagcgcttcaagagccacccctccgtcgcgccgctcatcgaggggtcggaagtgaaggaatatgccgcgcacctcattcccgagggtggattcaaggccattccccagctcttcggcgacggctgggtggtggtgggcgatgccgcccagctcaacaatgccgtccatcgcgaggggtcgaacctcgccatgacctcgggccggatcgcggcggaagccatcttccaggtgaaatcccgccgcgagcccatgagcgcgaagaacctctcgctctacaagaccatgctggaagagagcttcgtcctgaaggacatgaagaagtacaaggaccttccggccctgcttcacatcaattcgcagaacttcttcctcacctatccgcagctggtctccaaggccatgcagaacttcgtgcgggtggatggcacgcccaaggtcgagaaggagaagcggagcgtgcgtgccttcgtggaggcccgctcctggttcggcctgttcggcgatgccttccgcttcgcccgcgcgtggcggtga

SEQ ID NO: 2739 - protein, 435 aa, Azorhizobium caulinodans
MIDEKFDAIVVGAGMAGNAATLTLARRGLKVLQLERGEYSGSKNVQGAILYADMLEKLVPDFRETRRWSAHLVEQRFWMLDDRSHVGLHYRSEDFNEEKPNRYTIIRAQFDKWFSSKVKEAGATVLCETTVTELVQDAYGKVIGVKTDRSGGQIHADVVVLAEGVNGLLGTKAHLRERPKPEHVALAVKEMHFLPRETIEARFNLQGDEGVVIEAAGTISRGMTGMGFIYANKECISLGIGCLVSDFQKTGETPYGLLERFKSHPSVAPLIEGSEVKEYAAHLIPEGGFKAIPQLFGDGWVVVGDAAQLNNAVHREGSNLAMTSGRIAAEAIFQVKSRREPMSAKNLSLYKTMLEESFVLKDMKKYKDLPALLHINSQNFFLTYPQLVSKAMQNFVRVDGTPKVEKEKRSVRAFVEARSWFGLFGDAFRFARAWR

SEQ ID NO: 2740 - DNA, 1284 bp, Azotobacter vinelandii
  CDS (1)..(1284): transl_table=11
atggctgaaagattcgacgtgatcgtggtcggcgccggcatggccggtaacgccgccgcatacaccctggccaagggggggctcaaggtgctgcagatcgagcggggcgaaacccccggttcgaagaacgtgcagggcgccatcctctatgccgacgccatcgagaagatcattcccgacttccgcgacgacgcgcccctggagcggcacctgatcgagcagcgcgtgtgggtgatggacgacgcttcctacgggtaccactaccgttcggaggacttcaacaagccgccctacaaccgctacaccatcatccgcgtgcatttcgaccagtggttcaacaagaaggcccgcgaggccggcgtgctgaccatctgcgaaacacgtcacgatctgctgatcgagggtggcaaggtggtgggcgtgcgcaccgatcgccagggcggcgaagtccgtgccgacgcggtgatcctggccgacggggtgaactcgcgcctggcggtgaaggccggcttcagccgagatcagcccgagaactgggccctggcggtgaaggaaatccatttcctgccccaggaaaccatggaggcgcgcttcaacatcggcgaagaggaagctgccatcgagatggccggcaagatcgacgccggcatgatgggcaccggcttcctctacaccaacaaggagtcgatcaccctgggggtcggctgcatgctgtccgacttcaagcagcagaagatctccccctatgagctgctggaccggatgaagacccacccctccatcgcgcccttgatcgccggcagcgacatgaaggagtacgccgcccacctgatccccgaaggcggctacaacgccattccccaggtatacggcgacggctggatgatcgccggcgacgcgccgattcgtcacggcatccatcgcgaaggctccaacctggccatgaccaccggcatgctggcggcccagaccctggtcgagctgcgggccgcggacaagcccttcagcgccgccaacctggccgagtacaagaagaagctggacgacagcttcgtcatgaaggacctgaagaagtaccggcgcatgccggagatcttccacaagaacaagcagttcttcaccacctatccggacctgctctccagggccgcgcagacccttatccgggtcgatggcgtggacaagaaaaccaaggaaaaggaaatcaagaaaagcttcatcggcctacgttcgctgttcgggctgatcggcgatgccttcaagttctggcgtgccgtcgagtaa

SEQ ID NO: 2741 - protein, 427 aa, Azotobacter vinelandii
MAERFDVIVVGAGMAGNAAAYTLAKGGLKVLQIERGETPGSKNVQGAILYADAIEKIIPDFRDDAPLERHLIEQRVWVMDDASYGYHYRSEDFNKPPYNRYTIIRVHFDQWFNKKAREAGVLTICETRHDLLIEGGKVVGVRTDRQGGEVRADAVILADGVNSRLAVKAGFSRDQPENWALAVKEIHFLPQETMEARFNIGEEEAAIEMAGKIDAGMMGTGFLYTNKESITLGVGCMLSDFKQQKISPYELLDRMKTHPSIAPLIAGSDMKEYAAHLIPEGGYNAIPQVYGDGWMIAGDAPIRHGIHREGSNLAMTTGMLAAQTLVELRAADKPFSAANLAEYKKKLDDSFVMKDLKKYRRMPEIFHKNKQFFTTYPDLLSRAAQTLIRVDGVDKKTKEKEIKKSFIGLRSLFGLIGDAFKFWRAVE

SEQ ID NO: 2742 - DNA, 1308 bp, Bradyrhizobium japonicum
  CDS (1)..(1308): transl_table=11
atgattgaagagagattcgatgcgatcgtggtcggagccggtatggccggcaacgcggcggcattgacgatggccaaacagggcatgaaggtgctgcagctcgagcggggcgaatatcccggatcgaaaaatgtgcagggggccatcctctatgccgacatgatggaaaagctgatccccgagtttcgagaggaggcgccactcgaacgccacctgatcgaacagcggttctggatgatggacgatcgctcgcatgtcggcatgcactaccgttcggaggacttcaacgagcagaggccgaaccgctatacgattatacgcgcccagtttgacaaatggttttcttcaaaggtgcgggaagctggcgcgatcgtgctttgcgagaccaccgtcacagagctcgcgcaggacgatcgtaacagggtcgtcggtgttcgtacagatcgccgtgacggcgagatacatgctgacgtcgtcgttctggccgaaggggtcaatggcttgctcggcacgcgtgcgggcctgcgcgcccgtccggcacccgataacgttgcgctcgcggtgaaggaaatgcacttcttgccccgtgaaaccatcgaagcacgcttcaatcttaagggggatgaaggcgtcgtgatagaggctgccggtaccatttcccgcggcatgaccgggatgggtttcatctacgccaacaaagagtgcatttcgcttggcatcggttgtctcgtcgccgacttccaacgcacgggccaaacgccgtatggcctgctcgatgaattcaaaaggcatccctctgtggcgccactgatagcagggtccgaagtaaaggaatattcggcgcatctcattcccgaaggcggttacaaatcgatcccacagctttatggggagggctgggtcgtcgtgggcgatgccgcccaactcaacaatgccgttcatcgtgagggctccaatctcgcgatgacatcgggccgtatcgcggccgaagcgataggtctggtcaaatcgcgcggcgaaccgatgagtgcaacaaatctctcaatctacaaaaagatgttggacgattctttcgtcatcaaagatctcaagaagtacaaggatttgccacccctcatgcatacccactccgaaaatttctttctcacttatccgcagcttatctccaaggcgatgcagaactttgtgcgcgtcgatggtacgcccaaggttgagaaggagaaggcgagcctcaaatcctttgtcaagacgcggtcatggtcaggtctggtcggcgatgcttaccgttttgccagggcctggcggtga

SEQ ID NO: 2743 - protein, 435 aa, Bradyrhizobium japonicum
MIEERFDAIVVGAGMAGNAAALTMAKQGMKVLQLERGEYPGSKNVQGAILYADMMEKLIPEFREEAPLERHLIEQRFWMMDDRSHVGMHYRSEDFNEQRPNRYTIIRAQFDKWFSSKVREAGAIVLCETTVTELAQDDRNRVVGVRTDRRDGEIHADVVVLAEGVNGLLGTRAGLRARPAPDNVALAVKEMHFLPRETIEARFNLKGDEGVVIEAAGTISRGMTGMGFIYANKECISLGIGCLVADFQRTGQTPYGLLDEFKRHPSVAPLIAGSEVKEYSAHLIPEGGYKSIPQLYGEGWVVVGDAAQLNNAVHREGSNLAMTSGRIAAEAIGLVKSRGEPMSATNLSIYKKMLDDSFVIKDLKKYKDLPPLMHTHSENFFLTYPQLISKAMQNFVRVDGTPKVEKEKASLKSFVKTRSWSGLVGDAYRFARAWR

SEQ ID NO: 2744 - DNA, 1287 bp, Escherichia coli O157
  CDS (1)..(1287): transl_table=11
atgtccgaagatatctttgacgccatcatcgtcggtgcagggcttgccggttcggttgccgcactggtgctcgcccgcgaaggggcgcaagtgttagttatcgagcgtggcaattccgcaggtgccaagaacgtcaccggcgggcgtctctatgcccacagcctggaacacattattcctggtttcgccgaatccgccccggtagaacgcctgatcacccatgaaaaactcgcgtttatgacggaaaagtcagcgatgactatggactactgcaacggtgacgaaacctcgccatcccagcgttcttactccgttttgcgcagtaaatttgatgcctggctgatggagcaggccgaagaagcgggcgcgcagttaattaccgggatccgcgtcgataacctcgtacagcgcgatggcaaagtcgtcggtgtagaagccgatggcgatgtgattgaagcgaaaacggtgatccttgctgatggagtgaactccatccttgccgaaaagctggggatggcaaaacgcgttaaaccgacgaatgtggcggttggcgtgaaggaactgatcgagttaccgaagtcggttattgaagaccgttttcagttgcagggtaatcagggggcggcttgcctatttgcgggatcacccaccgatggcctgatgggcggcggttttctttataccaatgaaaacaccctgtcgctggggctggtttgtggtctgcatcatctgcatgacgcgaaaaaatcggtgccgcaaatgctggaagatttcaaacaacatccggccgttgcaccgctgatcgcgggtggcaagctggtggaatattccgctcacgtagtgccggaagcaggcatcaacatgctgccggagctggtcggtgacggcgtattgattgccggtgatgccgccggaatgtgtatgaacctcggttttaccattcgcggtatggatctggcgattgccgccggggaagctgcagcaaaaaccgtgctttcagcgatgaaaagcgacgatttcagtaagcaaaaactcgcggaatatcgtcagcatcttgagagtggcccgctgcgcgatatgcgtatgtaccagaaactaccggccttccttgataacccacgcatgtttagcggctacccggaactggcggtaggcgtggcgcgtgacctgttcaccattgacggcagtgcgccggaactgatgcgcaagaaaatcctccgccacggcaagaaagtgggcttcatcaatctgatcaaggatggcatgaaaggagtgaccgttttatga

SEQ ID NO: 2745 - protein, 428 aa, Escherichia coli O157
MSEDIFDAIIVGAGLAGSVAALVLAREGAQVLVIERGNSAGAKNVTGGRLYAHSLEHIIPGFAESAPVERLITHEKLAFMTEKSAMTMDYCNGDETSPSQRSYSVLRSKFDAWLMEQAEEAGAQLITGIRVDNLVQRDGKVVGVEADGDVIEAKTVILADGVNSILAEKLGMAKRVKPTNVAVGVKELIELPKSVIEDRFQLQGNQGAACLFAGSPTDGLMGGGFLYTNENTLSLGLVCGLHHLHDAKKSVPQMLEDFKQHPAVAPLIAGGKLVEYSAHVVPEAGINMLPELVGDGVLIAGDAAGMCMNLGFTIRGMDLAIAAGEAAAKTVLSAMKSDDFSKQKLAEYRQHLESGPLRDMRMYQKLPAFLDNPRMFSGYPELAVGVARDLFTIDGSAPELMRKKILRHGKKVGFINLIKDGMKGVTVL

SEQ ID NO: 2746 - DNA, 1287 bp, Escherichia coli O6
  CDS (1)..(1287): transl_table=11
atgtccgaagatatctttgacgccatcatcgtcggtgcagggcttgccggttcggttgccgcactagtgctcgcccgcgaaggtgcgcaagtgttagttatcgagcgaggcaattccgcaggtgccaagaacgtcaccggcgggcgtctctatgcccacagtctggaacacattattcctggtttcgctgactccgcccccgtagaacgcctgatcacccatgaaaaactcgcgtttatgacggaaaagtcagcgatgactatggactactgcaatggcgacgaaacctcgccatcccagcgttcttactccgttttgcgcagtaaatttgatgcctggctgatggagcaggctgaagaagcgggcgcgcagttaattaccgggatccgcgtcgataacctcgtacagcgcgatggcaaagtcgtcggtgtagaagccgatggcgatgtgattgaagcgaaaacggtgatccttgctgatggggtgaattccatccttgccgaaaagctggggatggcaaaacgcgttaaaccgacggatgtggcggttggcgtaaaggaactgatcgagttaccgaagtcggttatcgaagaccgttttcagttgcagggtaatcagggcgcggcttgcctgtttgcgggatcacccaccgatggcctgatgggcggtggcttcctttataccaatgaaaataccctgtcgcttgggctggtttgtggtttgcatcatctgcatgacgcaaaaaaatcggtgccgcaaatgctggaagatttcaaacaacatccggccgttgcaccgctgatcgcgggcggcaagctggtggaatattccgctcacgtagtgccggaagcaggtatcaacatgctgccggagttggttggtgacggcgtattgattgccggtgatgctgccggaatgtgtatgaacctcggttttaccattcgcggtatggatctggcgattgccgccggggaagcagcagcaaaaactgtgctttcagcgatgaaaagcgacgatttcagtaagcaaaaactcgcggaatatcgtcagcatcttgagagtggcccgctgcgcgatatgcgcatgtaccagaaactaccggcgttccttgataacccacgcatgtttagcggctacccggaactggcggtgggcgtggcgcgtgacctgttcaccattgacggcagtgcgccggaactgatgcgcaagaaaatcctccgccacggcaagaaagtgggcttcatcaatctgatcaaggatggcatgaaaggagtgaccgttttatga

SEQ ID NO: 2747 - protein, 428 aa, Escherichia coli O6
MSEDIFDAIIVGAGLAGSVAALVLAREGAQVLVIERGNSAGAKNVTGGRLYAHSLEHIIPGFADSAPVERLITHEKLAFMTEKSAMTMDYCNGDETSPSQRSYSVLRSKFDAWLMEQAEEAGAQLITGIRVDNLVQRDGKVVGVEADGDVIEAKTVILADGVNSILAEKLGMAKRVKPTDVAVGVKELIELPKSVIEDRFQLQGNQGAACLFAGSPTDGLMGGGFLYTNENTLSLGLVCGLHHLHDAKKSVPQMLEDFKQHPAVAPLIAGGKLVEYSAHVVPEAGINMLPELVGDGVLIAGDAAGMCMNLGFTIRGMDLAIAAGEAAAKTVLSAMKSDDFSKQKLAEYRQHLESGPLRDMRMYQKLPAFLDNPRMFSGYPELAVGVARDLFTIDGSAPELMRKKILRHGKKVGFINLIKDGMKGVTVL

SEQ ID NO: 2748 - DNA, 1308 bp, Rhizobium meliloti
  CDS (1)..(1308): transl_table=11
atgacaaaggaaaaatttgacgccatcgtcgttggtgccggtatgtccgggaatgcggcggcttacgcgatggctagccgtgggctaaaggtgctgcagttggagcgcggagagtatccgggttcaaagaacgtccaaggcgctataatgtacgccaacatgctggaggcaatcattccagatttccggaatgacgcaccgctcgagcggcatctcgtcgagcagcgattctggataatggacgatacgtctcacaccgggatgcactaccggtcagacgatttcaatgaggtgacgccaaaccgctacacgatcattcgcgctcaattcgataaatggttatcgcgcaaggtgtgcgaggctggcggaacggtcctgtgtgaaacaacggctacaggactggaatgggacagtgccgggaaggcgataggcgtccgcactgaccgcgctggcgacgtcgttcttgcagatgtggtcgtgctcgctgaaggggtcaacggactccttggcacgcgcgccggcttacgtgagatgccgaagtcgaaaaacgtagccctcgcggtaaaggaattgcatttcctccccgaagaggtgatcgcagagcgcttcggactgacaggcgatgaaggatgcgtgattgaggcgggcgggacaatttcgcgcggaatggcaggattgggcttcctctacaccaataaggagtcaatctcactcggcatcggctgcctcatctcgaacttcgccgagaccatggagagaccttacgcgcttctcgacgcctttaaacgccacccttcaatccagccgctaatagcagggtcggaagtaaaggaatatgcggcccatctcattccggagggcggtttcaacgcaataccgcggctctgcggtaacggctgggtcgtcgttggagacgcggcgcaacttaacaatgccgtgcaccgcgaagggtctaaccttgccatggcatctgggaggatggcgggagaggcgatttcaatcataaagagccgcgggggggtaatggataaggcgagcctctctctctacaaaacgatgctagacaagtccttcgttgttgaggacctgagcaaacaaaaggacatgccttccctgctccataccaattccccaaacttcttcacgacgtacccgcagctgatatcgcatgccgcgcagaacttcgtgcgcgtggacggcacgcctaagattgagagggaaattgcgaccaccgccgcctttctcagggcacgatcccgatggggtctcgtcagtgacgcggttcgccttgcctccgcctggcgctaa

SEQ ID NO: 2749 - protein, 435 aa, Rhizobium meliloti
MTKEKFDAIVVGAGMSGNAAAYAMASRGLKVLQLERGEYPGSKNVQGAIMYANMLEAIIPDFRNDAPLERHLVEQRFWIMDDTSHTGMHYRSDDFNEVTPNRYTIIRAQFDKWLSRKVCEAGGTVLCETTATGLEWDSAGKAIGVRTDRAGDVVLADVVVLAEGVNGLLGTRAGLREMPKSKNVALAVKELHFLPEEVIAERFGLTGDEGCVIEAGGTISRGMAGLGFLYTNKESISLGIGCLISNFAETMERPYALLDAFKRHPSIQPLIAGSEVKEYAAHLIPEGGFNAIPRLCGNGWVVVGDAAQLNNAVHREGSNLAMASGRMAGEAISIIKSRGGVMDKASLSLYKTMLDKSFVVEDLSKQKDMPSLLHTNSPNFFTTYPQLISHAAQNFVRVDGTPKIEREIATTAAFLRARSRWGLVSDAVRLASAWR

SEQ ID NO: 2750 - DNA, 1308 bp, Rhizobium sp
  CDS (1)..(1308): transl_table=11
atgaccgaagaaagattcgacgccatcgtcgtcggtgccggtatgtctggaaacgcggctgcatacaccatggcaagtcgcggtctaaaagtgttgcagttggagcgcggagaatatccgggctccaagaacgtccaaggcgccatcttgtacgccaacatgctggagacaatcattcccgatttccgggatgatgcacctcttgagcggcatctggtcgagcagcgattctgggtaacggacgacacgtcacacaccggaatgcactaccggtcggacgacttcaatgagccggcgccaaaccgttacacgatcattcgcgcccagttcgacaagtggttttcgcggaaagtccgagcggcgggcgcgatagttttgtgcgagacgacggtgacggaactggctcttgatgctgccggcaaggtgataggcgtccataccgatcgagcgggcggggtcatccatgcggacgtggtcgtgctcgccgaaggcgtaaacggcctcctcggcacgagagcacgatttcgcaaggtgccgaaacccgaagccgtggcactcgctgtcaaggaaatgcatttcctaccggaagaggtcatcaatgaacgcttcggccttaccggcgatcaaggctgtgttattgaggcggcagggacaatctcgcgcggaatggccggcttgggattcctctacaccaacaaggaatcgatctctcttggcatcggctgccttgtctcccatttcgcagcgaccctggaaagtccttacgcgctacttgacgcattcaagaaccacccatcaatccggccgctacttgcgggctcggagattaaggaatatgcggcgcacctcattccggagggcggattcaaggcaattccgcagctctttggcgatggctgggtcgtggttggcgacgcggcgcagctcaacaacgccgtgcaccgcgagggctcgaacctcgccatgacgtcgggccgcatcgccggcgaggcgatcgccgcaatcaagagccgaaaacacccgatgacgagtgacaatctctcactttacaaggccatgctggacaagtctttcgttctgaaagacctcagaaagtacaaggacatgcccgctctgctccacacgaattcacacaatttcttcacgacttatccgcagttgatgtcgcaggcggcgcaaaacttcgtgcgcgtcgacggcacacccaagatcgagaaggaaagagcgaccacggccgctcttattaaagcgcgttcgcgatggggactggtcagcgacgcagtccgcttggcactggcatggcgctaa

SEQ ID NO: 2751 - protein, 435 aa, Rhizobium sp
MTEERFDAIVVGAGMSGNAAAYTMASRGLKVLQLERGEYPGSKNVQGAILYANMLETIIPDFRDDAPLERHLVEQRFWVTDDTSHTGMHYRSDDFNEPAPNRYTIIRAQFDKWFSRKVRAAGAIVLCETTVTELALDAAGKVIGVHTDRAGGVIHADVVVLAEGVNGLLGTRARFRKVPKPEAVALAVKEMHFLPEEVINERFGLTGDQGCVIEAAGTISRGMAGLGFLYTNKESISLGIGCLVSHFAATLESPYALLDAFKNHPSIRPLLAGSEIKEYAAHLIPEGGFKAIPQLFGDGWVVVGDAAQLNNAVHREGSNLAMTSGRIAGEAIAAIKSRKHPMTSDNLSLYKAMLDKSFVLKDLRKYKDMPALLHTNSHNFFTTYPQLMSQAAQNFVRVDGTPKIEKERATTAALIKARSRWGLVSDAVRLALAWR

SEQ ID NO: 2752 - DNA, 1287 bp, Salmonella typhi
  CDS (1)..(1287): transl_table=11
atgtccgaagatatctttgatgccatcatcgtgggtgcaggtctggccggttcggttgcggcgctggtgcttgctcgcgaaggtgcacaggtgctggttatcgagcgcggcaattctgctggcgcgaagaatgtcaccggtgggcgtttgtatgcacatagcctggaacgcatcattcccggctttgcggatcaggcccccattgaacgcatgatcacccacgaaaaactcgcctttatgaccgacaacggggcgatgactatcgactactgcaatggtgaagatgcttcagcgtcgcaggtttcttattccgttttgcgtagtaaatttgacgcctggctgatggagcaggccgaagaggcgggggcgcaactgatcactggtattcgcgtggataacgttgttcagcgtgatggcaaagtcgtgggcgtggaagccgatggcgatattctggaagccaaagtcgtaatcctcgctgacggggtgaattctctgctggctgaaaagctgggcatggccaagcgtgttgaggcatcgcatgttgccgtcggtgtgaaggaactgatcgaattgccgaagtcggtcattgaagatcgtttccagctacagggcaacgaaggtgccgcctgtctgtttgccggggcgccaaccgatggtctgatgggcggtggcttcctgtatacgaatgaaacaaccctttccctagggctggtctgcggtcttcatcatctgaaagacgcgaaaaaatcggtcccgcaaatgctggaagatttcaaacagcatccggccgttgcgccgctgatcgccggtggcaagctggtggaatatgccgcacacgttgtacccgaggcgggaatgaatatgcagcctgaactggtgggcgatggtgtactgattgccggagacgctgccggcatgtgtatgaacctcggctttaccatccggggtatggatctcgccatatccgcaggcgaagcggcggcgaagacggtgctttcggcgatgaagcgcgacgattttagcaagcagtcgttgggtgaataccgtcagcatctggacgaaggtccgatgcgcgatatgcgcatgtatcagaaactgccagcttttcttgataatccccgcatgtttaccgcctatcccgaaatggcggtcagtatcgcgcgcgacctgttcaccgtggatggctccgcgccggtgcccatgcgtaaaaaaatcctgcgccatgcgaagaaagtgggcttcatcaacctgatgaaagatggcctgaaaggagtgaccgtattatga

SEQ ID NO: 2753 - protein, 428 aa, Salmonella typhi
MSEDIFDAIIVGAGLAGSVAALVLAREGAQVLVIERGNSAGAKNVTGGRLYAHSLERIIPGFADQAPIERMITHEKLAFMTDNGAMTIDYCNGEDASASQVSYSVLRSKFDAWLMEQAEEAGAQLITGIRVDNVVQRDGKVVGVEADGDILEAKVVILADGVNSLLAEKLGMAKRVEASHVAVGVKELIELPKSVIEDRFQLQGNEGAACLFAGAPTDGLMGGGFLYTNETTLSLGLVCGLHHLKDAKKSVPQMLEDFKQHPAVAPLIAGGKLVEYAAHVVPEAGMNMQPELVGDGVLIAGDAAGMCMNLGFTIRGMDLAISAGEAAAKTVLSAMKRDDFSKQSLGEYRQHLDEGPMRDMRMYQKLPAFLDNPRMFTAYPEMAVSIARDLFTVDGSAPVPMRKKILRHAKKVGFINLMKDGLKGVTVL

SEQ ID NO: 2754 - DNA, 1287 bp, Salmonella typhimurium
  CDS (1)..(1287): transl_table=11
atgtccgaagatatctttgatgccatcatcgtgggtgcaggtctggccggttcggttgcggcgctggtgcttgctcgcgaaggtgcacaggtgctggttatcgagcgcggcaattctgctggcgcgaagaatgtcaccggtgggcgcttgtatgcacatagcctggaacgcatcattcccggctttgcggatcaggcccccattgaacgcatgatcacccacgaaaaactcgcctttatgaccgacaacggggcgatgactatcgactactgcaatggtgaagatgcttcagcgtcgcaggtttcctattccgtcttacgcagtaaatttgacgcctggctgatggagcaggccgaagaggcgggggcgcaactgatcaccggtattcgcgtggataacgttgttcagcgtgatggcaaagtcgtgggcgtggaagccgatggcgatattctggaagccaaagtcgtgatcctcgctgacggggtgaattctctgctggctgaaaagctgggcatgaccaagcgtgttgaggcatcgcatgttgctgtcggcgtgaaggaactgatcgaattgccgaagttggtcattgaagatcgtttccagttacagggcaacgaaggtgccgcctgtctgtttgccggagcgccgaccgatggtctgatgggcggtggcttcctgtatacgaatgaaacaaccctttccctggggctggtctgcggtcttcatcatctgaaagacgcgaaaaaatcggtcccgcaaatgctggaagatttcaaacagcatccggcagttgcgccgctgatcgccggtggcaagctggtggaatatgccgcgcacgttgtacccgaggcgggaatgaatatgcagcctgaactggtgggcgatggcgtactgattgccggggatgctgccggcatgtgtatgaacctcggctttaccatccggggtatggatctcgccatatccgcaggcgaagcggcggcgaagacggtgctttcggcgatgaagcgcgacgattttagcaagcagtcgctgggtgaataccgtcagcatctggacgaaggtccgatgcgcgatatgcgcatgtatcagaaactaccggcttttcttgataatccccgcatgtttaccgcttatcccgaaatggcggtcaatatcgcgcgcgacctgttcaccgtggatggctccgctccggtgcccatgcgtaaaaaaatcctgcgccatgcgaagaaagtgggcttcattaatctgatgaaagatggcctgaaaggagtgaccgtattatga

SEQ ID NO: 2755 - protein, 428 aa, Salmonella typhimurium
MSEDIFDAIIVGAGLAGSVAALVLAREGAQVLVIERGNSAGAKNVTGGRLYAHSLERIIPGFADQAPIERMITHEKLAFMTDNGAMTIDYCNGEDASASQVSYSVLRSKFDAWLMEQAEEAGAQLITGIRVDNVVQRDGKVVGVEADGDILEAKVVILADGVNSLLAEKLGMTKRVEASHVAVGVKELIELPKLVIEDRFQLQGNEGAACLFAGAPTDGLMGGGFLYTNETTLSLGLVCGLHHLKDAKKSVPQMLEDFKQHPAVAPLIAGGKLVEYAAHVVPEAGMNMQPELVGDGVLIAGDAAGMCMNLGFTIRGMDLAISAGEAAAKTVLSAMKRDDFSKQSLGEYRQHLDEGPMRDMRMYQKLPAFLDNPRMFTAYPEMAVNIARDLFTVDGSAPVPMRKKILRHAKKVGFINLMKDGLKGVTVL

SEQ ID NO: 2756 - DNA, 1287 bp, Shigella flexneri
  CDS (1)..(1287): transl_table=11
atgtccgaagatatctttgacgccatcatcgtcggtgcagggcttgccggttcggttgccgcactggtgctcgcccgcgaaggggcgcaagtgttagttatcgagcgtggcaattccgcaggtgccaagaacgttactggcgggcgtctctatgcccacagtctggaacacattattccaggtttcgccgattccgcccccgtagaacgcctgatcacccatgaaaaactcgcgtttatgacggaaaagtcagcgatgactatggactactgcaacggtgacgaaacctcgccatcccagcgttcttactccgttttgcgcagtaaatttgatgcctggttgatggagcaggccgaagaagcgggcgcgcagttaattaccgggatccgcgtcgataacctcgtacagcgcgatggcaaagtcgtcggtgtagaagccgatggtgatgtgattgaagcgaaaacggtgctccttgctgatggggtgaactccatccttgccgaaaagttggggatggcaaaacgcgttaaaccgacggatgtggcggttggcgtgaaggaactgatcgagttaccgaagtcggtaatcgaagaccgttttcagttgcagggtaatcagggcgcggcttgtctgtttgcgggatcacccaccgatggcctgatgggcggcggcttcctttataccaatgaaaataccctgtcgctggggctggtttgtggtctgcatcatctgcatgacgcgaaaaaatcggtgccgcaaatgctggaagatttcaaacagcatccggccgttgcaccgctgatcgcgggcggcaagctggtggaatattccgctcacgtagtgccggaagcaggcatcaacatgctgccggagctggtcggtgacggcgtattgattgccggtgatgccgccggaatgtgtatgaacctcggttttaccattcgcggtatggatctggcgattgccgccggggaagctgcagcaaaaaccgtgctttcagcgatgaaaagcgacgatttcagtaagcaaaaactcgcggaatatcgtcagcatctggagagtggcccgctgcgcgatatgcgcatgtaccagaaactaccggcgttccttgataacccacgcatgtttagcggcaacccggaactggcggtgggcgtggcgcgtgacctgttcaccattgacggcagtgcgccggaactgatgcgcaagaaaatcctccgccacggcaagaaagtgggcttcatcaatctgatcaaggatggcatgaaaggagtgaccgttttatga

SEQ ID NO: 2757 - protein, 428 aa, Shigella flexneri
MSEDIFDAIIVGAGLAGSVAALVLAREGAQVLVIERGNSAGAKNVTGGRLYAHSLEHIIPGFADSAPVERLITHEKLAFMTEKSAMTMDYCNGDETSPSQRSYSVLRSKFDAWLMEQAEEAGAQLITGIRVDNLVQRDGKVVGVEADGDVIEAKTVLLADGVNSILAEKLGMAKRVKPTDVAVGVKELIELPKSVIEDRFQLQGNQGAACLFAGSPTDGLMGGGFLYTNENTLSLGLVCGLHHLHDAKKSVPQMLEDFKQHPAVAPLIAGGKLVEYSAHVVPEAGINMLPELVGDGVLIAGDAAGMCMNLGFTIRGMDLAIAAGEAAAKTVLSAMKSDDFSKQKLAEYRQHLESGPLRDMRMYQKLPAFLDNPRMFSGNPELAVGVARDLFTIDGSAPELMRKKILRHGKKVGFINLIKDGMKGVTVL

SEQ ID NO: 2758 - DNA, 1290 bp, Escherichia coli
  CDS (1)..(1290): transl_table=11
atgtcggatgacaaatttgatgccattgtggtcggtgcgggcgttgctggtagcgttgccgcactggtcatggcacgagccgggctggatgtcctggtgatagaacgcggcgacagtgccggatgtaaaaacatgaccggcgggcgtctttatgcccacacacttgaagcaatcattccaggctttgcagtatcagcgccggtagaacgcaaggtcacacgcgagaaaatctccttcttaaccgaagaaagcgccgttaccctcgattttcaccgcgagcagccagatgttccgcaacacgcatcttataccgtattgcgtaatcgtctggacccgtggttgatggaacaagccgagcaggcgggcgcgcagtttatcccaggcgttcgcgtcgacgcgctggttcgtgaaggaaacaaggtcactggcgtgcaggctggggatgatattctcgaagcgaatgtggtgattctggctgatggcgttaactcgatgcttggccgctcgctgggaatggttcccgcttccgatccgcatcattacgctgttggtgttaaagaggttattggcctcacaccagaacagatcaacgatcgctttaatattacgggcgaggaaggtgccgcctggctgtttgccggttccccttctgacggcctgatgggcgggggatttctctataccaacaaggattccatatccttggggctggtttgtggattgggtgatatcgcccatgcgcaaaaaagcgtgccgcaaatgctggaagattttaaacaacaccccgccattcgcccgctgattagcggcggcaaactgcttgaatattccgcgcatatggtgccggaaggcggtctggcaatggtgccgcaactggttaacgagggcgtgatgatcgttggtgacgccgcaggcttctgcctgaatttgggttttacggtccgcggcatggatttagccattgcatcggctcaggctgccgccacaacggtgatcgccgccaaagaacgcgcggatttctccgccagcagtctggcgcaatacaaacgtgagctggaacaaagctgcgtcatgcgtgatatgcagcattttcgcaagatcccggcgctgatggaaaacccgcgcctgtttagccaatacccacgaatggtagccgacatcatgaacgagatgttcaccatcgacggcaaaccaaaccagccggtacgaaaaatgatcatgggacatgcgaagaaaattgggctgatcaacttgctgaaagatggcattaagggagcaaccgcgctatga

SEQ ID NO: 2759 - protein, 429 aa, Escherichia coli
MSDDKFDAIVVGAGVAGSVAALVMARAGLDVLVIERGDSAGCKNMTGGRLYAHTLEAIIPGFAVSAPVERKVTREKISFLTEESAVTLDFHREQPDVPQHASYTVLRNRLDPWLMEQAEQAGAQFIPGVRVDALVREGNKVTGVQAGDDILEANVVILADGVNSMLGRSLGMVPASDPHHYAVGVKEVIGLTPEQINDRFNITGEEGAAWLFAGSPSDGLMGGGFLYTNKDSISLGLVCGLGDIAHAQKSVPQMLEDFKQHPAIRPLISGGKLLEYSAHMVPEGGLAMVPQLVNEGVMIVGDAAGFCLNLGFTVRGMDLAIASAQAAATTVIAAKERADFSASSLAQYKRELEQSCVMRDMQHFRKIPALMENPRLFSQYPRMVADIMNEMFTIDGKPNQPVRKMIMGHAKKIGLINLLKDGIKGATAL

SEQ ID NO: 2760 - DNA, 1902 bp, Arabidopsis thaliana
  CDS (1)..(1902)
atgcatagattccttgtaaagctatcttcttcttcttcaccattctctaatcaattgagaagcttgaagaaccagcgtctgattctccctctattaccttcttcaaaaccttttacctcctcctctgtgtcaccacctccaagtcccttgaacgcttctaatcgatttgggtatccttattccgccgatttgtttcgaaatttgtcacctttaaacccaaattcgaggattttaggagtcaatgggattactagtagtagatgtatcagcagtgaagcggtcagagaatcgattgagtacgatgttctgattgtcggagctggaccggccggtttatctgctgctatacgattgaaacaactgtctcaggagaagaacattgatctatctgtttgtgtcgttgagaaaggagcagaagttggaggacacattatatctggaaatgtttttgaacccctggcacttgatgagcttcttccacattggagacaagaacatgcacccattgagatccctgcttcttctgataaattctggtttttgacgaaagatcgtgcattttcacttccttctccgtttgataacaagggaaactacgttattagtttgagccaactggtgcgttggctaggaggaaaagctgaggagcttggaacagagatatatcctggcttttctgctagtgaggtgttatttgatgcaagtgataaagttgttgggattgcaaccaaagatatgggaatatccaaagatggttccaagaaagagaatttccagccaggtgttgacataaaagggcgagttacactgtttgcagagggatgtagaggatcattgtcagagagaataatcaaaaagtataaattaagagaagaggttaatgcacaacatcaaacatatgctttgggaatcaaggaggtctgggagatagatgaaagcaaacataaccctggagaagttattcacacattgggttggcccttggatcccaagacatatggaggttctttcttgtaccacatgaacgatagacaggttgcacttggcttggttgttgccttgaactaccacaaccctttcttgaatccgtatgaggaatttcagaaactcaaacaccatcctgctattaaaggcatcttggaaggtggtaccgtgcttcagtatggagctcgtactttaaatgaaggtggttttcagtccattccctatccagtttttcctggaggagcaataattggatgttcagctggttttctcaatgtacccaagattaagggaacacacactgcaatgaaatcaggaatgttagcagcagaggctgcatttggtgcacttcatgaaggcttaaacatgaacacgtactgggacaacttgagggattcatgggtgtggaaggagctctacgcagctcgaaactatcgtcctgcattcgagtatgggctacttcctggcttggccattagtgctatggaacactatgtactgaaaggaaaagtccctttcacgctcaagcatgggaaagcagaccacgaagcaacagatcttgctcggaaatggacaccgattgtgtatccaaagccggatggtgttttgtcgtttgatgtgccaacttctttatacaggagtaataccaatcatgatcatgatcaaccatctcatttgcgcttgagggatcctaagattccagaaaaggtaaactttccagagtatgctgcgccagagtcacgttactgcccagcccgtgtttacgaatatatcgaagacgaagagggtaagccaaaactgcagatcaacgctcaaaactgtttgcactgcaaggcatgtgacatcaaagatccaaagcagaacatagagtggacagtgcctgaaggtggtggaggccctgcctattccctcatgtag

SEQ ID NO: 2761 - protein, 633 aa, Arabidopsis thaliana
MHRFLVKLSSSSSPFSNQLRSLKNQRLILPLLPSSKPFTSSSVSPPPSPLNASNRFGYPYSADLFRNLSPLNPNSRILGVNGITSSRCISSEAVRESIEYDVLIVGAGPAGLSAAIRLKQLSQEKNIDLSVCVVEKGAEVGGHIISGNVFEPLALDELLPHWRQEHAPIEIPASSDKFWFLTKDRAFSLPSPFDNKGNYVISLSQLVRWLGGKAEELGTEIYPGFSASEVLFDASDKVVGIATKDMGISKDGSKKENFQPGVDIKGRVTLFAEGCRGSLSERIIKKYKLREEVNAQHQTYALGIKEVWEIDESKHNPGEVIHTLGWPLDPKTYGGSFLYHMNDRQVALGLVVALNYHNPFLNPYEEFQKLKHHPAIKGILEGGTVLQYGARTLNEGGFQSIPYPVFPGGAIIGCSAGFLNVPKIKGTHTAMKSGMLAAEAAFGALHEGLNMNTYWDNLRDSWVWKELYAARNYRPAFEYGLLPGLAISAMEHYVLKGKVPFTLKHGKADHEATDLARKWTPIVYPKPDGVLSFDVPTSLYRSNTNHDHDQPSHLRLRDPKIPEKVNFPEYAAPESRYCPARVYEYIEDEEGKPKLQINAQNCLHCKACDIKDPKQNIEWTVPEGGGGPAYSLM

SEQ ID NO: 2762 - DNA, 1728 bp, Oryza sativa
  CDS (1)..(1728)
atgcaacgagtgctccgcgcggcggcggcggggattggccacgcgtcgggccaccgcgcgccgaggtggggcgcggcggcggcggcggcgaggtggctgagcgggggcagggaggcgatgagctacgacgtggtggtcgtgggggctgggcccgcggggctcgccgcggccatccggctgaagcagctctgccgcgacgccgacaccgacctctccgtctgcgtcctcgagaagggctccgaagtcggtgcgcatgtattgtcggggaacgtgttcgagccacgagcgttggatgaactcatcccgaagtggaggcaagaggataccccaataagagtccccgtctcatctgacaagttctggctgttgacaaagaataaggcatggacacttccatctcctttcgataacaagggaaactatgtgataagcttgagccaaatggtgcgatggatggcctccaaagctgaagaattgggtgttgaagtatatccaggttttgctgcgagtgagatcctttatgatgaaaatcaaatagttacaggcgttgcaaccaatgatgttggtattgctaaagatggttccaaaagggaaacttttcaacctggtgttgaactaagagggcgaatgacactgttggccgagggttgccgaggttcattatcagagaaaataataaggaaccacaagctcagagagagtgggcaaggccagcatcagacatatgctcttggaattaaggaggtttgggagatcgaggaaggaaagcacaagccaggttctgtgattcatactgtagggtggcctttggactcgaaaacatatggaggatcatttatgtatcaccttgatgatagacagttagcgataggtctggttgttgccttgaactatcaaaatcctttcatgagcccatacgatgaattccagaaattcaagcaacaccctgctgtcaggacaattttggatggtggaacagttcttcagtatggtgctcgtacgttgaatgaaggtggttttcaatcaataccaaatccagttttccctggaggtgcaattattggatgctctgcagggttccttaatgttcccaaaataaaaggaactcatacagccatgaagtcaggtatgctggctgcagaagcaactttcaaaactcttgttgaaggatcttcgatggaactctattgggagaatctcaagaagtcatggatatgggaagagctttatagagctcggaattacagaccagcatttgaatatggatttattccaggcattgccttgtctgcactggaacgatacgtattcaaaggaaagtccccctttaccttaaagcacgggatacctgaccatgaagcaacagatatggccagtttgcactcgcctattcaatatccgaaaccagatggtcaaatatcctttgacgtaccaacttctttatacaggagcagcacaaaccatgagcatgatcaacctcctcatctccgtttgagggatcctacagtaccggagagagtaaatcttcctctgtatgctggaccagagtcacattattgtccagctcgagtttacgagtatgtcaccgacgagaaaggtgaccagaagcttcacataaatgctcaaaattgtcttcattgcaaggcttgtgacatcaaagatccaaagcaaaacatcgaatggaccgttccagaaggtggaggcggtccagggtacacagtaatgtag

SEQ ID NO: 2763 - protein, 575 aa, Oryza sativa
MQRVLRAAAAGIGHASGHRAPRWGAAAAAARWLSGGREAMSYDVVVVGAGPAGLAAAIRLKQLCRDADTDLSVCVLEKGSEVGAHVLSGNVFEPRALDELIPKWRQEDTPIRVPVSSDKFWLLTKNKAWTLPSPFDNKGNYVISLSQMVRWMASKAEELGVEVYPGFAASEILYDENQIVTGVATNDVGIAKDGSKRETFQPGVELRGRMTLLAEGCRGSLSEKIIRNHKLRESGQGQHQTYALGIKEVWEIEEGKHKPGSVIHTVGWPLDSKTYGGSFMYHLDDRQLAIGLVVALNYQNPFMSPYDEFQKFKQHPAVRTILDGGTVLQYGARTLNEGGFQSIPNPVFPGGAIIGCSAGFLNVPKIKGTHTAMKSGMLAAEATFKTLVEGSSMELYWENLKKSWIWEELYRARNYRPAFEYGFIPGIALSALERYVFKGKSPFTLKHGIPDHEATDMASLHSPIQYPKPDGQISFDVPTSLYRSSTNHEHDQPPHLRLRDPTVPERVNLPLYAGPESHYCPARVYEYVTDEKGDQKLHINAQNCLHCKACDIKDPKQNIEWTVPEGGGGPGYTVM

SEQ ID NO: 2764 - DNA, 1719 bp, Oryza sativa
  CDS (1)..(1719)
atgcaacgagtgctccgcgcggcggcggcggggattggccacgcgtcgggccaccgcgcgccgaggtggggcgcggcggcggcggcggcgaggtggctgagcgggggcagggaggcgatgagctacgacgtggtggtcgtgggggctgggcccgcggggctcgccgcggccatccggctgaagcagctctgccgcgacgccgacaccgacctctccgtctgcgtcctcgagaagggctccgaagtcggtgcgcatgtattgtcggggaacgtgttcgagccacgagcgttggatgaactcatcccgaagtggaggcaagaggataccccaataagagtccccgtctcatctgacaagttctggctgttgacaaagaataaggcatggacacttccatctcctttcgataacaagggaaactatgtgataagcttgagccaaatggtgcgatggatggcctccaaagctgaagaattgggtgttgaagtatatccaggttttgctgcgattacaggcgttgcaaccaatgatgttggtattgctaaagatggttccaaaagggaaacttttcaacctggtgttgaactaagaggcgactacttagaaaatgcagggcgaatgacactgttggccgagggttgccgaggttcattatcagagaaaataataaggaaccacaagctcagagagagtgggcaaggccagcatcagacatatgctcttggaattaaggaggtttgggagatcgaggaaggaaagcacaagccaggttctgtgattcatactgtagggtggcctttggactcgaaaacatatggaggatcatttatgtatcaccttgatgatagacagttagcgataggtctggttgttgccttgaactatcaaaatcctttcatgagcccatacgatgaattccagaaattcaagcaacaccctgctgtcaggacaattttggatggtggaacagttcttcagtatggtgctcgtacgttgaatgaaggtggttttcaatcaataccaaatccagttttccctggaggtgcaattattggatgctctgcagggttccttaatgttcccaaaataaaaggaactcatacagccatgaagtcaggtatgctggctgcagaagcaactttcaaaactcttgttgaaggatcttcgatggaactctattgggagaatctcaagaagtcatggatatgggaagagctttatagagctcggaattacagaccagcatttgaatatggatttattccaggcattgccttgtctgcactggaacgatacgtattcaaaggaaagtccccctttaccttaaagcacgggatacctgaccatgaagcaacagatatggccagtttgcactcgcctattcaatatccgaaaccagatggtcaaatatcctttgacgtaccaacttctttatacaggagcagcacaaaccatgagcatgatcaacctcctcatctccgtttgagggatcctacagtaccggagagagtaaatcttcctctgtatgctggaccagagtcacattattgtccagctcgagtttacgagtatgtcaccgacgagaaaggtgaccagaagcttcacataaatgctcaaaattgtcttcattgcaaggcttgtgacatcaaagatccaaagcaaaacatcgaatggaccgttccagaaggtggaggcggtccagggtacacagtaatgtag

SEQ ID NO: 2765 - protein, 572 aa, Oryza sativa
MQRVLRAAAAGIGHASGHRAPRWGAAAAAARWLSGGREAMSYDVVVVGAGPAGLAAAIRLKQLCRDADTDLSVCVLEKGSEVGAHVLSGNVFEPRALDELIPKWRQEDTPIRVPVSSDKFWLLTKNKAWTLPSPFDNKGNYVISLSQMVRWMASKAEELGVEVYPGFAAITGVATNDVGIAKDGSKRETFQPGVELRGDYLENAGRMTLLAEGCRGSLSEKIIRNHKLRESGQGQHQTYALGIKEVWEIEEGKHKPGSVIHTVGWPLDSKTYGGSFMYHLDDRQLAIGLVVALNYQNPFMSPYDEFQKFKQHPAVRTILDGGTVLQYGARTLNEGGFQSIPNPVFPGGAIIGCSAGFLNVPKIKGTHTAMKSGMLAAEATFKTLVEGSSMELYWENLKKSWIWEELYRARNYRPAFEYGFIPGIALSALERYVFKGKSPFTLKHGIPDHEATDMASLHSPIQYPKPDGQISFDVPTSLYRSSTNHEHDQPPHLRLRDPTVPERVNLPLYAGPESHYCPARVYEYVTDEKGDQKLHINAQNCLHCKACDIKDPKQNIEWTVPEGGGGPGYTVM

SEQ ID NO: 2766 - DNA, 24 bp, Artificial sequence
  primer
atgttgtgttctggatatctgggg

SEQ ID NO: 2767 - DNA, 24 bp, Artificial sequence
  primer
ttacagacatcgcagactcctgat

SEQ ID NO: 2768 - protein, 532 aa, Artificial sequence
  consensus sequence
  Variant (3)..(3): Xaa in position 3 is any amino acid
  Variant (5)..(5): Xaa in position 5 is any amino acid
  Variant (10)..(11): Xaa in position 10 to 11 is any amino acid
  Variant (13)..(14): Xaa in position 13 to 14 is any amino acid
  Variant (17)..(19): Xaa in position 17 to 19 is any amino acid
  Variant (21)..(22): Xaa in position 21 to 22 is any amino acid
  Variant (23)..(28): Xaa in position 23 to 28 is any or no amino acid
  Variant (30)..(31): Xaa in position 30 to 31 is any amino acid
  Variant (33)..(35): Xaa in position 33 to 35 is any amino acid
  Variant (39)..(41): Xaa in position 39 to 41 is any amino acid
  Variant (43)..(43): Xaa in position 43 is any amino acid
  Variant (46)..(47): Xaa in position 46 to 47 is any amino acid
  Variant (49)..(51): Xaa in position 49 to 51 is any amino acid
  Variant (53)..(55): Xaa in position 53 to 55 is any amino acid
  Variant (57)..(60): Xaa in position 57 to 60 is any amino acid
  Variant (62)..(62): Xaa in position 62 is any amino acid
  Variant (64)..(66): Xaa in position 64 to 66 is any amino acid
  Variant (69)..(69): Xaa in position 69 is any amino acid
  Variant (70)..(73): Xaa in position 70 to 73 is any or no amino acid
  Variant (76)..(106): Xaa in position 76 to 106 is any amino acid
  Variant (107)..(112): Xaa in position 107 to 112 is any or no amino acid
  Variant (114)..(115): Xaa in position 114 to 115 is any amino acid
  Variant (118)..(118): Xaa in position 118 is any amino acid
  Variant (120)..(126): Xaa in position 120 to 126 is any amino acid
  Variant (129)..(136): Xaa in position 129 to 136 is any amino acid
  Variant (138)..(144): Xaa in position 138 to 144 is any amino acid
  Variant (145)..(154): Xaa in position 145 to 154 is any or no amino acid
  Variant (156)..(156): Xaa in position 156 is any amino acid
  Variant (159)..(166): Xaa in position 159 to 166 is any amino acid
  Variant (167)..(168): Xaa in position 167 to 168 is any or no amino acid
  Variant (170)..(171): Xaa in position 170 to 171 is any amino acid
  Variant (172)..(185): Xaa in position 172 to 185 is any or no amino acid
  Variant (187)..(188): Xaa in position 187 to 188 is any amino acid
  Variant (190)..(190): Xaa in position 190 is any amino acid
  Variant (192)..(192): Xaa in position 192 is any amino acid
  Variant (194)..(195): Xaa in position 194 to 195 is any amino acid
  Variant (197)..(200): Xaa in position 197 to 200 is any amino acid
  Variant (202)..(209): Xaa in position 202 to 209 is any amino acid
  Variant (210)..(212): Xaa in position 210 to 212 is any or no amino acid
  Variant (214)..(216): Xaa in position 214 to 216 is any amino acid
  Variant (219)..(221): Xaa in position 219 to 221 is any amino acid
  Variant (223)..(226): Xaa in position 223 to 226 is any amino acid
  Variant (227)..(227): Xaa in position 227 is any or no amino acid
  Variant (229)..(230): Xaa in position 229 to 230 is any amino acid
  Variant (233)..(238): Xaa in position 233 to 238 is any amino acid
  Variant (240)..(245): Xaa in position 240 to 245 is any amino acid
  Variant (246)..(246): Xaa in position 246 is any or no amino acid
  Variant (248)..(251): Xaa in position 248 to 251 is any amino acid
  Variant (253)..(254): Xaa in position 253 to 254 is any amino acid
  Variant (256)..(257): Xaa in position 256 to 257 is any amino acid
  Variant (259)..(259): Xaa in position 259 is any amino acid
  Variant (263)..(266): Xaa in position 263 to 266 is any amino acid
  Variant (267)..(267): Xaa in position 267 is any or no amino acid
  Variant (269)..(269): Xaa in position 269 is any amino acid
  Variant (271)..(287): Xaa in position 271 to 287 is any amino acid
  Variant (288)..(290): Xaa in position 288 to 290 is any or no amino acid
  Variant (292)..(294): Xaa in position 292 to 294 is any amino acid
  Variant (296)..(296): Xaa in position 296 is any amino acid
  Variant (299)..(301): Xaa in position 299 to 301 is any amino acid
  Variant (304)..(305): Xaa in position 304 to 305 is any amino acid
  Variant (307)..(310): Xaa in position 307 to 310 is any amino acid
  Variant (311)..(312): Xaa in position 311 to 312 is any or no amino acid
  Variant (315)..(316): Xaa in position 315 to 316 is any amino acid
  Variant (318)..(319): Xaa in position 318 to 319 is any amino acid
  Variant (322)..(322): Xaa in position 322 is any amino acid
  Variant (324)..(327): Xaa in position 324 to 327 is any amino acid
  Variant (329)..(333): Xaa in position 329 to 333 is any amino acid
  Variant (334)..(334): Xaa in position 334 is any or no amino acid
  Variant (336)..(339): Xaa in position 336 to 339 is any amino acid
  Variant (343)..(351): Xaa in position 343 to 351 is any amino acid
  Variant (352)..(354): Xaa in position 352 to 354 is any or no amino acid
  Variant (356)..(358): Xaa in position 356 to 358 is any amino acid
  Variant (360)..(365): Xaa in position 360 to 365 is any amino acid
  Variant (367)..(379): Xaa in position 367 to 379 is any amino acid
  Variant (380)..(384): Xaa in position 380 to 384 is any or no amino acid
  Variant (386)..(387): Xaa in position 386 to 387 is any amino acid
  Variant (389)..(391): Xaa in position 389 to 391 is any amino acid
  Variant (393)..(393): Xaa in position 393 is any amino acid
  Variant (394)..(394): Xaa in position 394 is any or no amino acid
  Variant (396)..(399): Xaa in position 396 to 399 is any amino acid
  Variant (401)..(407): Xaa in position 401 to 407 is any amino acid
  Variant (408)..(469): Xaa in position 408 to 469 is any or no amino acid
  Variant (471)..(482): Xaa in position 471 to 482 is any amino acid
  Variant (483)..(484): Xaa in position 483 to 484 is any or no amino acid
  Variant (486)..(524): Xaa in position 486 to 524 is any amino acid
  Variant (525)..(531): Xaa in position 525 to 531 is any or no amino acid
FDXIXVGAGXXGXXAAXXXAXXXXXXXXGXXVXXXERGXXXGXKNXXGXXXYXXXLXXXXPXFXXXAPXXXXXERXXXXXXXXXXXXXXXXXXXXXXXXXXXXXXXXXXXXXRXXFDXWXXXXXXXAGXXXXXXXXVXXXXXXXXXXXXXXXXXVXGVXXXXXXXXXXAXXXXXXXXXXXXXXXXVXXAXGXNXXLXXXXGXXXXXXXXXXXAXXXKEXXXLXXXXXIXXRFXXXXXXGXXXXXXXGXXXXGXXGXXFXYTNXXXXXSXGXXXXXXXXXXXXXXXXXXXXLXXXKXHPXXXPLXXGXXXXXXEYXXHXXPEXGXXXXPXXXXXXGXXXXGDAXXXXXXXXXXXXGXXXAXXXXXXAXXXXXXXXXXXXXXXXXXLXXYXXXLXXSXXXXDXXXXXXXXXXXXXXXXXXXXXXXXXXXXXXXXXXXXXXXXXXXXXXXXXXXXXXXXXXXXXXXXXXXXXPXXXXXXXXXXXXXXPXXXXXXXXXXXXXXXXXXXXXXXXXXXXXXXXXXXXXXXXXXXXXXD

SEQ ID NO: 2769 - protein, 15 aa, Artificial sequence
  protein pattern
  Variant (2)..(2): Xaa in position 2 is Ile or Leu
  Variant (4)..(4): Xaa in position 4 is Ala or Thr
  Variant (6)..(7): Xaa in position 6 to 7 is any amino acid
  Variant (8)..(9): Xaa in position 8 to 9 is any or no amino acid
  Variant (11)..(11): Xaa in position 11 is any amino acid
  Variant (12)..(13): Xaa in position 12 to 13 is any or no amino acid
  Variant (15)..(15): Xaa in position 15 is Ile, Leu, Met or Val
FXYXNXXXXSXXXGX

SEQ ID NO: 2770 - protein, 14 aa, Artificial sequence
  protein pattern
  Variant (2)..(3): Xaa in position 2 to 3 is any amino acid
  Variant (4)..(4): Xaa in position 4 is Thr or Val
  Variant (5)..(5): Xaa in position 5 is Ile, Leu or Val
  Variant (6)..(6): Xaa in position 6 is any amino acid
  Variant (7)..(7): Xaa in position 7 is Ala or Cys
  Variant (8)..(8): Xaa in position 8 is Asp or Glu
  Variant (10)..(10): Xaa in position 10 is Ala, Ile or Val
  Variant (12)..(13): Xaa in position 12 to 13 is any amino acid
  Variant (14)..(14): Xaa in position 14 is Ile, Leu or Val
AXXXXXXXGXNXXX

SEQ ID NO: 2771 - protein, 22 aa, Artificial sequence
  protein pattern
  Variant (2)..(2): Xaa in position 2 is any amino acid
  Variant (3)..(5): Xaa in position 3 to 5 is any or no amino acid
  Variant (7)..(10): Xaa in position 7 to 10 is any amino acid
  Variant (11)..(11): Xaa in position 11 is Ile or Leu
  Variant (12)..(12): Xaa in position 12 is Ala, Asp, Glu or Asn
  Variant (13)..(13): Xaa in position 13 is Ala, Asp, Glu or Gln
  Variant (14)..(14): Xaa in position 14 is Asn or Arg
  Variant (15)..(15): Xaa in position 15 is Phe or Leu
  Variant (16)..(20): Xaa in position 16 to 20 is any amino acid
  Variant (21)..(21): Xaa in position 21 is Glu, Gly, Asn, Gln or Ser
KXXXXLXXXXXXXXXXXXXXXG

SEQ ID NO: 2772 - DNA, 2874 bp, Escherichia coli
  CDS (1)..(2874): transl_table=11
atgacacagacgttaagccagcttgaaaacagcggcgcttttattgaacgccatatcggaccggacgccgcgcaacagcaagaaatgctgaatgccgttggtgcacaatcgttaaacgcgctgaccggccagattgtgccgaaagatattcaacttgcgacaccaccgcaggttggcgcaccggcgaccgaatacgccgcactggcagaactcaaggctattgccagtcgcaataaacgcttcacgtcttacatcggcatgggttacaccgccgtgcagctaccgccggttatcctgcgtaacatgctggaaaatccgggctggtataccgcgtacactccgtatcaacctgaagtctcccagggccgccttgaagcactgctcaacttccagcaggtaacgctggatttgactggactggatatggcctctgcttctcttctggacgaggccaccgctgccgccgaagcaatggcgatggcgaaacgcgtcagcaaactgaaaaatgccaaccgcttcttcgtggcttccgatgtgcatccgcaaacgctggatgtggtccgtactcgtgccgaaacctttggttttgaagtgattgtcgatgacgcgcaaaaagtgctcgaccatcaggacgtcttcggcgtgctgttacagcaggtaggcactaccggtgaaattcacgactacactgcgcttattagcgaactgaaatcacgcaaaattgtggtcagcgttgccgccgatattatggcgctggtgctgttaactgcgccgggtaaacagggcgcggatattgtttttggttcggcgcaacgcttcggcgtgccgatgggctacggtggcccacacgcggcattctttgcggcgaaagatgaatacaaacgctcaatgccgggccgtattatcggtgtatcgaaagatgcagctggcaataccgcgctgcgcatggcgatgcagactcgcgagcaacatatccgccgtgagaaagcgaactccaacatttgtacttcccaggtactgctggcaaacatcgccagcctgtatgccgtttatcacggcccggttggcctgaaacgtatcgctaaccgcattcaccgtctgaccgatatcctggcggcgggcctgcaacaaaaaggtctgaaactgcgccatgcgcactatttcgacaccttgtgtgtggaagtggccgacaaagcgggcgtactgacgcgtgccgaagcggctgaaatcaacctgcgtagcgatattctgaacgcggttgggatcacccttgatgaaacaaccacgcgtgaaaacgtaatgcagcttttcaacgtgctgctgggcgataaccacggcctggacatcgacacgctggacaaagacgtggctcacgacagccgctctatccagcctgcgatgctgcgcgacgacgaaatcctcacccatccggtgtttaatcgctaccacagcgaaaccgaaatgatgcgctatatgcactcgctggagcgtaaagatctggcgctgaatcaggcgatgatcccgctgggttcctgcaccatgaaactgaacgccgccgccgagatgatcccaatcacctggccggaatttgccgaactgcacccgttctgcccgccggagcaggccgaaggttatcagcagatgattgcgcagctggctgactggctggtgaaactgaccggttacgacgccgtttgtatgcagccgaactctggcgcacagggcgaatacgcgggcctgctggcgattcgtcattatcatgaaagccgcaacgaagggcatcgcgatatctgcctgatcccggcttctgcgcacggaactaaccccgcttctgcacatatggcaggaatgcaggtggtggttgtggcgtgtgataaaaacggcaacatcgatctgactgatctgcgcgcgaaagcggaacaggcgggcgataacctctcctgtatcatggtgacttatccttctacccacggcgtgtatgaagaaacgatccgtgaagtgtgtgaagtcgtgcatcagttcggcggtcaggtttaccttgatggcgcgaacatgaacgcccaggttggcatcacctcgccgggctttattggtgcggacgtttcacaccttaacctacataaaactttctgcattccgcacggcggtggtggtccgggtatgggaccgatcggcgtgaaagcgcatttggcaccgtttgtaccgggtcatagcgtggtgcaaatcgaaggcatgttaacccgtcagggcgcggtttctgcggcaccgttcggtagcgcctctatcctgccaatcagctggatgtacatccgcatgatgggcgcagaagggctgaaaaaagcaagccaggtggcaatcctcaacgccaactatattgccagccgcctgcaggatgccttcccggtgctgtataccggtcgcgacggtcgcgtggcgcacgaatgtattctcgatattcgcccgctgaaagaagaaaccggcatcagcgagctggatattgccaagcgcctgatcgactacggtttccacgcgccgacgatgtcgttcccggtggcgggtacgctgatggttgaaccgactgaatctgaaagcaaagtggaactggatcgctttatcgacgcgatgctggctatccgcgcagaaattgaccaggtgaaagccggtgtctggccgctggaagataacccgctggtgaacgcgccgcacattcagagcgaactggtcgccgagtgggcgcatccgtacagccgtgaagttgcggtattcccggcaggtgtggcagacaaatactggccgacagtgaaacgtctggatgatgtttacggcgaccgtaacctgttctgctcctgcgtaccgattagcgaataccagtaa

SEQ ID NO: 2773 - protein, 957 aa, Escherichia coli
MTQTLSQLENSGAFIERHIGPDAAQQQEMLNAVGAQSLNALTGQIVPKDIQLATPPQVGAPATEYAALAELKAIASRNKRFTSYIGMGYTAVQLPPVILRNMLENPGWYTAYTPYQPEVSQGRLEALLNFQQVTLDLTGLDMASASLLDEATAAAEAMAMAKRVSKLKNANRFFVASDVHPQTLDVVRTRAETFGFEVIVDDAQKVLDHQDVFGVLLQQVGTTGEIHDYTALISELKSRKIVVSVAADIMALVLLTAPGKQGADIVFGSAQRFGVPMGYGGPHAAFFAAKDEYKRSMPGRIIGVSKDAAGNTALRMAMQTREQHIRREKANSNICTSQVLLANIASLYAVYHGPVGLKRIANRIHRLTDILAAGLQQKGLKLRHAHYFDTLCVEVADKAGVLTRAEAAEINLRSDILNAVGITLDETTTRENVMQLFNVLLGDNHGLDIDTLDKDVAHDSRSIQPAMLRDDEILTHPVFNRYHSETEMMRYMHSLERKDLALNQAMIPLGSCTMKLNAAAEMIPITWPEFAELHPFCPPEQAEGYQQMIAQLADWLVKLTGYDAVCMQPNSGAQGEYAGLLAIRHYHESRNEGHRDICLIPASAHGTNPASAHMAGMQVVVVACDKNGNIDLTDLRAKAEQAGDNLSCIMVTYPSTHGVYEETIREVCEVVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKKASQVAILNANYIASRLQDAFPVLYTGRDGRVAHECILDIRPLKEETGISELDIAKRLIDYGFHAPTMSFPVAGTLMVEPTESESKVELDRFIDAMLAIRAEIDQVKAGVWPLEDNPLVNAPHIQSELVAEWAHPYSREVAVFPAGVADKYWPTVKRLDDVYGDRNLFCSCVPISEYQ

SEQ ID NO: 2774 - DNA, 2964 bp, Glycine max
  CDS (1)..(2964)
atggaacgtgctcgcaggctagcaaaccgcgccattctgaggcgtctggtttcagaggcaaagcagcatcagaagaatgaatccgtgctgcactcttccaccacccccatgctgctctattcttcctccaggtgcatgtcctctgttctgcgaagcaggggatccaaaacagagacccttctgggaaggaacatcaacatgtcacgcggcgttgttgttgctgctgctggtggttttctcggcgttggctcggcccggtccatctcggtcgaagcgcttcgaccgagcgacaccttcccccggcggcacaactctgccaccccggaggagcagagcaagatggcagagtcgtgtggcttcggtagcctcgactccctcgtggacgccaccgtgcctaagtcgatacgccttaaggatatgaagttcgggaaattcgatgcagggcttacagagaaccagatgatagagcacatgaaggacttggcctcaaagaacaaggttttcaagtcctacattggaatggggtactacaacactcatgttccaccagtgatcctgaggaacattatggagaaccctgcttggtacactcagtacacaccttaccaggctgagatatctcaggggaggcttgagtcactgctgaattaccaaaccatgatcactgacctcaccggcttgcctatgtccaatgcttcattgcttgatgagggaactgctgctgctgaagcaatgtccatgtgcaacaacattcagaaagggaagaagaagaccttcatcattgcaagtaactgccaccctcaaaccattgatatttgcaagacaagggctgatggttttgatctgaaggttgttactgcagatcttaaggacattgattacaagtctggggatgtttgtggtgtgcttgtgcagtaccctggcactgagggagaggttttggactatggggagtttgtgaagaaggctcatgctcatgaggtgaaggttgttatggcaagtgatttgttggcactgactgtgttgaagcctcctggtgagttcggggcagatattgttgttggatcagctcagaggtttggggtgccaatggggtatggagggcctcatgcagctttcttggccacttcacaagagtacaagaggatgatgcctgggagaatcattggggtcagtgtcgattcttccggaaagactgctttgaggatggcgatgcaaactagggagcagcatatcaggagggacaaggccaccagcaacatttgcactgctcaggcactgcttgcaaacatggctgccatgtatgctgtgtatcatggacctgaaggcctcaagaacattgcacaccgtgttcatggtcttgctggggcatttgctcttggaataaagaaacttggaactgtggaaattcaggaccttcccttctttgacactgtgaaggttaagacttccaatgcacacgcaattgctgatgctgctctcaaaagtggaataaatttgcgagttgttgatggaaacactatcactgttgcttttgatgaaacaaccacattagaggatgttgataatcttttcaaagtttttgctggtggaaagcccgtctccttcacagctgcatctcttgcaccagaagttcagagtgcgattccttctggattagttaggaagagcccttatctgacgcaccctatctttaacacgtaccaaactgagcatgagttgcttaggtacttgtataggctacaatcaaaagatctctcactatgccacagtatgatcccacttggatcttgtacaatgaagctgaatgcaacaactgaaatgatgcctgtgacatggcccagctttagtgatattcacccttttgcaccagttgaccaggctcaaggttatcaggaaatgttcaacaatttgggtgaactgttgtgcaccatcactgggttcgactccttctctttgcaaccaaatgctggtgctgctggagaatatgctggacttatggttattcgtgcatatcatttggcaaggggagaccaccaccgcaatgtttgcattatacctgtctcagcacacggaacaaatcctgctagtgcagctatgtgtggaatgaaaattgtctctgttggaactgatgccaagggaaacattaatatagaagagctgaggaaggctgctgaaacacacaaggataacttatctgcacttatggtaacatatccttcaacccacggtgtttatgaggaaggtattgacgaaatttgcaatattattcatgataatggaggccaagtatatatggatggtgccaacatgaatgctcaggtgggactcacaagcccgggttggataggagcagatgtttgccatctcaatctccacaagacattttgcatccctcatggaggaggtggccctggcatgggacctattggtgtaaagaaacacttggcaccatttttaccttcacaccctgtgatagaaactggtggaattcctgcccctgacaaacctcaaccacttggtaccatcgctgctgcaccatggggctcagcactcatattgccaatctcttacacttacatagccatgatgggttctaaaggactcaccgatgcatcaaagatagccattttgaatgcaaactacatggcaaaacgattggagaattattacccggttcttttccgtggagtcaatggaacagttgctcatgaattcatcattgacttgagaggctttaagaatactgctggaattgagcctgaagatgttgcaaagcgcctcatggactacggttttcatgcaccaacaatgtcatggcctgtgcctggcacactcatgattgagcctactgagagtgaaagcaaggccgagttagacaggttctgtgatgctcttatttccattagacaagaaattgctgagattgagaaaggaaataagagcatcacagaacctgtctaa

SEQ ID NO: 2775 - protein, 987 aa, Glycine max
MERARRLANRAILRRLVSEAKQHQKNESVLHSSTTPMLLYSSSRCMSSVLRSRGSKTETLLGRNINMSRGVVVAAAGGFLGVGSARSISVEALRPSDTFPRRHNSATPEEQSKMAESCGFGSLDSLVDATVPKSIRLKDMKFGKFDAGLTENQMIEHMKDLASKNKVFKSYIGMGYYNTHVPPVILRNIMENPAWYTQYTPYQAEISQGRLESLLNYQTMITDLTGLPMSNASLLDEGTAAAEAMSMCNNIQKGKKKTFIIASNCHPQTIDICKTRADGFDLKVVTADLKDIDYKSGDVCGVLVQYPGTEGEVLDYGEFVKKAHAHEVKVVMASDLLALTVLKPPGEFGADIVVGSAQRFGVPMGYGGPHAAFLATSQEYKRMMPGRIIGVSVDSSGKTALRMAMQTREQHIRRDKATSNICTAQALLANMAAMYAVYHGPEGLKNIAHRVHGLAGAFALGIKKLGTVEIQDLPFFDTVKVKTSNAHAIADAALKSGINLRVVDGNTITVAFDETTTLEDVDNLFKVFAGGKPVSFTAASLAPEVQSAIPSGLVRKSPYLTHPIFNTYQTEHELLRYLYRLQSKDLSLCHSMIPLGSCTMKLNATTEMMPVTWPSFSDIHPFAPVDQAQGYQEMFNNLGELLCTITGFDSFSLQPNAGAAGEYAGLMVIRAYHLARGDHHRNVCIIPVSAHGTNPASAAMCGMKIVSVGTDAKGNINIEELRKAAETHKDNLSALMVTYPSTHGVYEEGIDEICNIIHDNGGQVYMDGANMNAQVGLTSPGWIGADVCHLNLHKTFCIPHGGGGPGMGPIGVKKHLAPFLPSHPVIETGGIPAPDKPQPLGTIAAAPWGSALILPISYTYIAMMGSKGLTDASKIAILNANYMAKRLENYYPVLFRGVNGTVAHEFIIDLRGFKNTAGIEPEDVAKRLMDYGFHAPTMSWPVPGTLMIEPTESESKAELDRFCDALISIRQEIAEIEKGNKSITEPV

SEQ ID NO: 2776 - DNA, 2907 bp, Prochlorococcus marinus str. NATL1A
  CDS (1)..(2907): transl_table=11
atgtcaaaagcagaattaaaggatttcacttttaagtctcgccatataggtccaactaacgaagatgaagctttaatgcttcaacatcttggttatgagaattcggaagaatttatatcttcggtcattcccaatgaaatatttgattcagaaaacaatgttgtttctatcccagatgggtgtgatcaaaataaagcgttaaaagaaatcaatataatttcaaagaaaaatgttgaacatcgttcgttgattggtctgggttatcattcgactgttatacctccagttatacaaagaaatgttctagaaaatcctaattggtatacagcttatactccttatcaagcagaaatatctcaaggcagattagaagctttatttaattttcagacgttaataagtgaattaacaggcttacccatatctaatgcgtctttacttgatgaagccactgcggcagctgaggcaattagtttgagtttggctgttagaaaaaataaaaatgctaataagtttttagtagatcaagaaattttgcctcaaacatttgatgtattaaaaactcgatgcgaaccgctaggcatttcccttgagatgtttgaaaacaataattttgaaatcgataaaaatatttttggaattcttattcagttacctgggaaaaatggtcgtatttgggacccaaccaaaataattaatgacgcacataaatgtaatgcaatagtgaccattgcaattgatcctttagctcaagtgttgattaaacctatgggcgaatttggtgcagatattgtagttggaagtgcacaaagatttggagttccaattgcttgtggtggaccacatgccgctttttttgcaactaaagaaatatataaaagacaaataccaggaaggatagttgggcaatcagttgacgtagaaggaaatcaagcattgaggcttgctcttcaaactagagagcaacatattcgaagagataaagcaacaagtaatatatgcacagctcaagttttactagctgttctttcttctttttatgcagtacatcacggcccaaaaggtcttaagcaaatagcagaaaatgtggtcaaatatagatcaaattttgaatctatattaatgaatttagaataccctatagaaaaatattcagcatttgatagtgttgatgtttattgttcagaagcatcggaagttattcagttagcgtctgaagaaggatataactttagagttcttcctatcggatcagattttgaaaatgctaaaggttttggtgtgacttttgatgaattaacatgtgatgaagaaatttatacattgcatcaaatacttgcacaagttaaaggaaaaaaagctcatgatctttccaattttcttaatgagaatgcatcactagttgatattccactccgagaaaaatcttggcttgaacaatcggtatttaatcaatatcaaagtgagactgatttaatgagatatatacatagtttagtatcgaaagatttttctttagttcaaggaatgattcctcttggaagttgcacaatgaaattgaattcagctgcggaacttttacccattgaatggagagagttttcctctattcatccttttgctcctcatgctcaattagctggattccacgaaataattaatgaccttgaaaattggctgtctgctttaacaggctttcagggagtttctcttcagccaaatgcaggttctcaaggagaatttgctggtttgcttgtaatacgttcatggcatcagtctctgggagaaggccataggaatatttgcttgattccaacaagtgctcacggtactaatccggctagtgcggtaatgtctggctttaaagttgtttctgttaaatgtgatgaatatggcaatgttgatttagaagacttaaaaaataaatcaaaaattcattcaaagaatttggctgcattgatggttacttacccttcaactcatggagtatttgagccaaatatccgtgagatgtgccaagtaattcatcaagagggtggtcaggtctatttggatggagcaaatttgaatgctcaagtaggtatttgcaggcctggatcttatggcatagatgtatgccatttaaatcttcataaaactttttccattcctcatggtggaggaggccccggagtaggtcctatagctgtagcagatcatttggttccttatctgcctggacattcaattatcaagtgcggaggcgaaaaggctatttcggcagtatctgcagctccatttggtagcgctggaatattgcccatcagttggatgtacatccgaatgatgggtagcgatgggttacgcaaagcgagttctatagcaattctctctgctaattatttagcaaaaagacttgatccttattatccagttttatttaaagatcccaatgggctagtagctcatgaatgcatattagatttacgaccattaaagagtcagttaggcatagaagtagaggatgttgccaagagattgatggattatggatttcatgcaccaacaataagttggcctgttgctggaactttgatggttgaaccaacagagagtgaaagtttgcctgaattagatcgtttttgtgacgcgatgataggaatacgcgaagaaattgaacaaataaaattaggaaagattgatccaataaataatcctttaaaacaatctccacataccttaaaaagagttacctcggatgattgggatagaccttactctcgtaaagaagctgcttatcctttgcctgatcaagaaaaatataaattttggccatcagtttcacgtattaataatgcttatggagacaggaatttgatatgtagttgtccttcagttcaagatttagaagatattaattctgtttga

SEQ ID NO: 2777 - protein, 968 aa, Prochlorococcus marinus str. NATL1A
MSKAELKDFTFKSRHIGPTNEDEALMLQHLGYENSEEFISSVIPNEIFDSENNVVSIPDGCDQNKALKEINIISKKNVEHRSLIGLGYHSTVIPPVIQRNVLENPNWYTAYTPYQAEISQGRLEALFNFQTLISELTGLPISNASLLDEATAAAEAISLSLAVRKNKNANKFLVDQEILPQTFDVLKTRCEPLGISLEMFENNNFEIDKNIFGILIQLPGKNGRIWDPTKIINDAHKCNAIVTIAIDPLAQVLIKPMGEFGADIVVGSAQRFGVPIACGGPHAAFFATKEIYKRQIPGRIVGQSVDVEGNQALRLALQTREQHIRRDKATSNICTAQVLLAVLSSFYAVHHGPKGLKQIAENVVKYRSNFESILMNLEYPIEKYSAFDSVDVYCSEASEVIQLASEEGYNFRVLPIGSDFENAKGFGVTFDELTCDEEIYTLHQILAQVKGKKAHDLSNFLNENASLVDIPLREKSWLEQSVFNQYQSETDLMRYIHSLVSKDFSLVQGMIPLGSCTMKLNSAAELLPIEWREFSSIHPFAPHAQLAGFHEIINDLENWLSALTGFQGVSLQPNAGSQGEFAGLLVIRSWHQSLGEGHRNICLIPTSAHGTNPASAVMSGFKVVSVKCDEYGNVDLEDLKNKSKIHSKNLAALMVTYPSTHGVFEPNIREMCQVIHQEGGQVYLDGANLNAQVGICRPGSYGIDVCHLNLHKTFSIPHGGGGPGVGPIAVADHLVPYLPGHSIIKCGGEKAISAVSAAPFGSAGILPISWMYIRMMGSDGLRKASSIAILSANYLAKRLDPYYPVLFKDPNGLVAHECILDLRPLKSQLGIEVEDVAKRLMDYGFHAPTISWPVAGTLMVEPTESESLPELDRFCDAMIGIREEIEQIKLGKIDPINNPLKQSPHTLKRVTSDDWDRPYSRKEAAYPLPDQEKYKFWPSVSRINNAYGDRNLICSCPSVQDLEDINSV

SEQ ID NO: 2778 - DNA, 2853 bp, Neisseria meningitidis FAM18
  CDS (1)..(2853): transl_table=11
atgaaactatctgaattgttcaacccgaacgaatttgccgcgcgccatttgagtttcggcgacgaagcggcgttgcttgccgctgtcggcgagaaaagcatggacgaatttgtcggcaataccgtgccgcaaagcatccgtatgccgtccgaactcgatttgcccgatgccctgaccgaagcggacgcgttggcgaaattgaaaggcattgcgtcgaaaaacgtgatcaacaagtcctatatcggtttgggctattacccgacccgcgtgccgaacgtgattttgcgcaacgtgttggaaaatccgggttggtacaccgcctacacgccgtatcaggcggaaattgcccagggtcgtttggaagcgttgttaaacttccaacaagtgtgtatcgatttgaccggtttccctgtggcgggcgcgtctttgctggacgaggcaactgctgcggctgaagcgatggcgatggcgcaccgcgtgggcaaggtgaaatccgagcgtttctttgtggatgcgcgcgtgtatccgcaaactttggacgtgatgaaaacccgcgccaaatatttcggcttcgagctggtggtcagcgattttgccaaagcggatgacggcgaatacttcggcgcgctgttccaatacgtcggcaaagacggcgatgtgcaagacttgcaggatgttatcggtcgtctgaaagcaaaaggcacgatcgttgctgttgccgccgacatcatgagcttggttttactgaaatcacctgccgaattgggagcggatattgctttgggcaacacccaacgtttcggcgtgcctatgggcttcggcgggccgcacgccgcttatttcgcgtttaaagacgcgttcaaacgttccgcccctggccgcatcatcggcgtatccaaagacgcatcaggcaaacctgccttgcgcatggcgttgtccacccgcgagcaacacatccgccgcgaaaaagccacgtccaatatttgtaccgcacaagcattgctggcgaatttggcgggtatgtatgccgtttaccacggccctgaaggcgtgaaacgcatcgccaaccgcattcacgcgctggcttctgcttttgccgatgcgctggtttcagacggcattaatgtggttcacaaagtcttcttcgataccgttaccgtcgatttcggcaacaaagagaaagcagaccaagtgtttgccgctgctttggaatcgggctataacctgcgccgcgttaacgatactcaagttgcggctgcattccacgaaacatcggcatgcgaagatttggttgatttgtaccgcgcgtttaccggcaaggatacgttcgcatttgccgatgatgtcaaaggccgtctgaacgccgaactgctgcgtcaagacgacattctgcaacatcccgtgttcaaccgttaccacaccgaacacgaaatgctgcgctacctgaaaaaactcgaagaccgcgacttggcgatgaaccgcagcatgatttcattgggcagctgcaccatgaaactcaacgcgactgcggaaatgttgccgattacttgggcggagttctccgacatccatccttacgctcctgaagcgcaaaccgccggctaccgcgaattgctcgccgatatggaaaacagcctgaaatccatcaccggttttgatgcaatttccttccagcccaactccggcgcgcagggcgaatacagcggtatgcttgccatccgccgctatcaggaagcgcaaggcgaagcgcagcgcaacatctgtctgattcccaaatccgcccacggcaccaaccccgccaccgccgccatgctcggtttgaaagtcgtcgtcgtcgataccgacgaacacggcaacgtcaacatcgacgatttgaaagccaaagccgagcaacaccgcgacgctttgtccgccatcatgattacctatccgtccacccacggcgtgtacgaagaaggcatccgcgacatctgccgcatcgtccatgaaaacggcggacaggtttacatggacggcgccaacctcaacgcccaaatcggcatcatgcagcctgccgaagtcggcgcggacgtgttgcacatgaacctgcacaaaaccttctgtatccctcacggcggcggcggtccgggcatgggtccgattggcttgaaagcccatctggctccgttcgcaccgggacacgctttgaccgacacccacagcgccagtgccgaccaaaccgccgttgctgctgcggccttcggttctgcgtccatactgccgattacttggatgtacctgaccatgatgggcaaacaaggcatggaacaggcgacacgctgggcattgctcaacgccaactacgttgccaaacgcctgagcgaagactatccgattctgtatacaggcaaaaacggccgcgtcgcgcatgaatgtatcgtcgatttgcgtccgctcaaagccgaaagcggcatcactgaaaccgacatcgccaaacgcctgatggactacggcttccacgccccgacggtttccttccccgttgccggtacgctgatgatcgagccgaccgagagcgaaagcaaagccgaactcgaccgcttcatcgccgccctgaaacaaatcaaacaggaagtgctgaaagtcgggcgcggcgaatggccgaaagaggacaatccgctggtcaacgctccgcataccgcatccgatgtaaccggcgaatgggcgcatccgtactcccgtgaagaagccgtctttccgttgccattcgtccgcgaacacaaattctggccgagcgtcaaccgtgtggacgacgtgtacggcgaccgcaatctcgtgtgcagctgcccaccgatggaaaattatgaagactga

SEQ ID NO: 2779 - protein, 950 aa, Neisseria meningitidis FAM18
MKLSELFNPNEFAARHLSFGDEAALLAAVGEKSMDEFVGNTVPQSIRMPSELDLPDALTEADALAKLKGIASKNVINKSYIGLGYYPTRVPNVILRNVLENPGWYTAYTPYQAEIAQGRLEALLNFQQVCIDLTGFPVAGASLLDEATAAAEAMAMAHRVGKVKSERFFVDARVYPQTLDVMKTRAKYFGFELVVSDFAKADDGEYFGALFQYVGKDGDVQDLQDVIGRLKAKGTIVAVAADIMSLVLLKSPAELGADIALGNTQRFGVPMGFGGPHAAYFAFKDAFKRSAPGRIIGVSKDASGKPALRMALSTREQHIRREKATSNICTAQALLANLAGMYAVYHGPEGVKRIANRIHALASAFADALVSDGINVVHKVFFDTVTVDFGNKEKADQVFAAALESGYNLRRVNDTQVAAAFHETSACEDLVDLYRAFTGKDTFAFADDVKGRLNAELLRQDDILQHPVFNRYHTEHEMLRYLKKLEDRDLAMNRSMISLGSCTMKLNATAEMLPITWAEFSDIHPYAPEAQTAGYRELLADMENSLKSITGFDAISFQPNSGAQGEYSGMLAIRRYQEAQGEAQRNICLIPKSAHGTNPATAAMLGLKVVVVDTDEHGNVNIDDLKAKAEQHRDALSAIMITYPSTHGVYEEGIRDICRIVHENGGQVYMDGANLNAQIGIMQPAEVGADVLHMNLHKTFCIPHGGGGPGMGPIGLKAHLAPFAPGHALTDTHSASADQTAVAAAAFGSASILPITWMYLTMMGKQGMEQATRWALLNANYVAKRLSEDYPILYTGKNGRVAHECIVDLRPLKAESGITETDIAKRLMDYGFHAPTVSFPVAGTLMIEPTESESKAELDRFIAALKQIKQEVLKVGRGEWPKEDNPLVNAPHTASDVTGEWAHPYSREEAVFPLPFVREHKFWPSVNRVDDVYGDRNLVCSCPPMENYED

SEQ ID NO: 2780 - DNA, 3102 bp, Oryza sativa (japonica cultivar-group)
  CDS (1)..(3102)
atggagcgcgcacgccgcctcgccaaccgcgccctgctgcgccgcctcctcgcggcggcggcgtccaccacgtccccggccccgtcccgcggcatctcgaccctggccaaggcgcccggggcggggtcgcgcccgcgcgccccgcgcccggcgccccaccagtacaccacggggcggcccgtgtcggcgtcggcgctgcagccgagcgacacgttcccgcggaggcacaactcggccacgccggcggagcaggcggcgatggcgtcggagtgcgggttcaacaccctcgacgcgctcatcgacgccaccgtcccggccgccatccgcgcgccgacgatgcacttctccgggaagttcgacgccgggtttaccgagtcccagatgattgaccacatgcagcgcctggcggccatgaacaaggcctacaagtccttcatcgggatggggtactacaacacccacgtccccgcggtgatactgcgcaacctcatggagaaccccgcgtggtacacgcagtacacgccgtaccaggcggagatcgcgcagggccgtctcgagtcgctgctcaactaccagaccatggtcgccgacctcaccggcctgcccatgtccaacgcctcgctgcttgacgaggccaccgccgccgccgaggccatggccatgtgcaacggcatcctgaaatccaagaagaagaccttcctcatcgcctccaactgccacccgcagaccatcgacgtctgccagacgcgcgccgctgggttcgacctcaacgtcatcgtcgcggacgccaaggacttcgactacagcagcggtgatgtgtgcggagtgctcgtgcagtaccccggcacggagggggaggtgctggactacgcggagttcgtcaaggacgcgcacgcgcacggcgtcaaggtggtcatggccaccgacctgctcgcgctcacctcgctgcgcccgcccggtgagatcggcgccgacatcgccgtcggctccgcgcagcggttcggcgtgcccatggggtacggaggcccgcacgccgcgttcctcgccacttcccaggagtacaagcgcctcatgcccggccgtatcatcggcgtgagcgtcgattccagcggcaagcccgcgctccggatggcgatgcagacccgggagcagcacatccgccgcgacaaggccaccagcaacatctgcactgcccaggccttgctcgccaacatggcagcgatgtatgctgtctaccatggtcccgaggggctaaaggcaattgccgaccgtgtacacggcctggctggtacctttgcccatggactgaagaagctcggaacagtgactgtgcaggaactgccgttctttgacactgtcaaggtcaaggtcgctgatgcgaatgcgattgcccaggaggcctgcaagaacgagatgaaccttcgtgttgttgatgcaaccacgataaccgtggcctttgatgagaccacaaccttagaggatgtcgacaagctgttcaaggtgttcaatggtggcaagccagtgaacttcactgctgaatccctcgcatcagaggtgtcaagctcaattccgagtagccttgtgcgcaagagcccctacttaacacacccgatctttaacatgtaccatacagagcacgagcttctccgatacctgcacaagttgcaatccaaggatctttcactgtgccacagtatgatccctcttggttcttgcactatgaaactaaatgctacagtggagatgatgcccgtcacctaccccagctttgcaaacatgcacccatttgcacctactgaacaagccgcaggatatcatgaaatgtttgatgacttgggcgatctgctgtgcaagatcactggctttgattctttctctttgcaaccaaatgctggtgcatcaggggagtatgccggattgatggttatccgtgcttaccacagggcaagaggagactaccaccgggacgtctgtatcattcctgtgtcagcccatggtacaaatcctgcaagtgctgctatgtgtggaatgaagatcgttgctgttggaactgattccaaaggtaacattaacatcgaggagttgaggaaagctgctgaagcaaacaaggacaacttggctgctcttatggttacctatccttcgacccatggagtctatgaagaaggcattgatgagatatgcaggataattcatgagaacggtgggcaggtatacatggatggggctaacatgaatgctcaggtcggattgacaagccctggctttattggagcagatgtttgccaccttaaccttcacaagacattctgcattccacatggtgggggtggtcctggaatgggtcctattggtgttaagaagcacttagcaccatttttaccatctcatccagtgatcaccactggtggcttccctctccctgagaaaaccgaccctcttggtaccatttctgctgccccatggggatcagcgttgattctgccaatttcctacacatacatagccatgatgggttctaagggtctcactgatgcttcaaagattgcaatcttgaatgcaaactacatggcaaagcgtctggagaaacactacccagttcttttccgtggagtcaatggaactgttgcccatgaattcatcattgatttaagaggatttaagacgactgctggtatagagccagaggatgttgcaaagcgtttgatggactatggattccatgcacctactatgtcatggcctgttccaggcacacttatgattgaacccactgaaagtgaaagcaaggccgaactagacaggttctgtgatgctctaatctcaatcagggaagaaattgcagaaatcgaaagtggcaaagcagatgtgaacaacaatgtcctcaagagtgctcctcacccgccccaacttctgatgagcgactcatggactaagccgtactccagggagtacgctgcgttccctgcagcgtggcttcggggcgccaagttctggccaacaacatgtcgcgtggacaatgtgtatggggatcgcaacctcatctgcactctgcaacagggatcccaagtcgcagaagaagctgcagctgctaccgcatga

SEQ ID NO: 2781 - protein, 1033 aa, Oryza sativa (japonica cultivar-group)
MERARRLANRALLRRLLAAAASTTSPAPSRGISTLAKAPGAGSRPRAPRPAPHQYTTGRPVSASALQPSDTFPRRHNSATPAEQAAMASECGFNTLDALIDATVPAAIRAPTMHFSGKFDAGFTESQMIDHMQRLAAMNKAYKSFIGMGYYNTHVPAVILRNLMENPAWYTQYTPYQAEIAQGRLESLLNYQTMVADLTGLPMSNASLLDEATAAAEAMAMCNGILKSKKKTFLIASNCHPQTIDVCQTRAAGFDLNVIVADAKDFDYSSGDVCGVLVQYPGTEGEVLDYAEFVKDAHAHGVKVVMATDLLALTSLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPEGLKAIADRVHGLAGTFAHGLKKLGTVTVQELPFFDTVKVKVADANAIAQEACKNEMNLRVVDATTITVAFDETTTLEDVDKLFKVFNGGKPVNFTAESLASEVSSSIPSSLVRKSPYLTHPIFNMYHTEHELLRYLHKLQSKDLSLCHSMIPLGSCTMKLNATVEMMPVTYPSFANMHPFAPTEQAAGYHEMFDDLGDLLCKITGFDSFSLQPNAGASGEYAGLMVIRAYHRARGDYHRDVCIIPVSAHGTNPASAAMCGMKIVAVGTDSKGNINIEELRKAAEANKDNLAALMVTYPSTHGVYEEGIDEICRIIHENGGQVYMDGANMNAQVGLTSPGFIGADVCHLNLHKTFCIPHGGGGPGMGPIGVKKHLAPFLPSHPVITTGGFPLPEKTDPLGTISAAPWGSALILPISYTYIAMMGSKGLTDASKIAILNANYMAKRLEKHYPVLFRGVNGTVAHEFIIDLRGFKTTAGIEPEDVAKRLMDYGFHAPTMSWPVPGTLMIEPTESESKAELDRFCDALISIREEIAEIESGKADVNNNVLKSAPHPPQLLMSDSWTKPYSREYAAFPAAWLRGAKFWPTTCRVDNVYGDRNLICTLQQGSQVAEEAAAATA

SEQ ID NO: 2782 - DNA, 2964 bp, Streptomyces avermitilis MA-4680
  CDS (1)..(2964): transl_table=11
atgacagagggggaggccgtcggggtacccgcgcaggggtgcccctcgaaggtcgcgtcagaccaggaggcctccgcaatgaccgcccatcgcattccgctctccgatctcgaacagggaatccccttcgagcagcgccacatcggccccgattccgaagcccgggccaagatgctcgcccaggtcggctacgggtcgctcgacgagctgaccgcgaccgccgtcccggacgtcatcaagaacgccgaggcgctggagctgccgggcgcgcgcaccgaggccgaggtgcttgccgaactgcgctccctcgccgaccgcaaccaggtcctcggttccatgatcggcctcggctactacggcaccttcacaccgccggtgatcctccggaacgtgatggagaacccggcctggtacaccgcgtacacgccgtaccagccggagatctcgcagggccggctggaggcgctgctgaacttccagaccgtcgtcgccgagctgaccgggctgccgacctccggcgcctcgctgctcgacgagggcaccgcggccgcggaggccatggcgctgtcccggcggatgggcaagaacaagaagggcctgttcctggtcgacgcggacgcgctgccgcagaccatcgccgtcatcgagacccgtgccgagccgaccggcgtcgaggtcgtcgtcgccgacctgagcgaaggcatccccgccgggatcgccgagcgcgagatcaacggcgtgctgatccagtacccgggcgcctccggtgccgtacgcgacatcaagccgctcgtcgagcaggcgcacgagctgggcgcggtcgtcaccgtcgccgccgatctgctcgcgctcacgctgctcacctcgccgggtgagctgggtgccgacatcgcggtcggtacgacgcagcggttcggtgtgccgatgggcttcggcgggccgcacgccggttacatggccgtgcgtgagaagttcgcgcgcagcctgcccggccggctcgtgggcgtgtccgtggacgccgacgggcacaaggcgtaccggctcgccctgcagacgcgggagcagcacatccgccgcgagaaggcgaccagcaacatctgtacggcccaggtgctgctcgccgtgatggccggcatgtacgccgtgtaccacgggcccgacggactgaggacgatcgcgcggcgtacgcaccggtacgccacgatcctcgccgaagggctgaaggccggcggcgtcgaggtcgtgcacggcgcgtacttcgacacgctgaccgcgcgggtgccgggccgggccgccgagatcgtcgccgccgcgcgtgagggcggggtcaacctgcacctcgtcgacgcggacctcgtgtcgatctcctgtgacgagaccaccacgcgggcccaactgggcgccgtctggaccgcgttcggcgtcgagggcgacatcgaggcgttggacgcggcggccgaggacacactgccggccgcgctcctgcgtaccgacgactacctgacccacccggtcttccaccagtaccgttccgagaccgcgatgctgcgctacctgcgcaggctctccgaccgcgactacgcgctcgaccgcggcatgatcccgctgggctcctgcaccatgaagctcaacgcgaccaccgagatggagccggtcacctggcccgagttcgggcagctgcaccccttcgcgcccgccgagcaggcgcagggctacctcacgctcatccgggaactggaggagcggctcgccgaggtcaccggctacgacaaggtgtcgctccagccgaacgccggctcccagggcgagctggccgggctgctcgccgtacgtgggtaccaccgcgccaatggcgacgagcagcgcacggtctgcctgatcccgtcctccgcgcacggcacgaacgcggcgagcgccgtgatggccggcatgaaggtcgtcgtggtgaagacggccgacgacggtgagatcgacgtcgaggacctgcgcgccaagatcgagcagtaccgcgacgagctgtcggtgctgatgatcacgtacccctcgacgcacggtgtgttcgaggagcacgtcgccgacatctgcgcccaggtgcacgaggcgggcggccaggtgtacgtcgacggagccaacctcaacgcgctggtcgggctcgccaagccgggccacttcggcggtgacgtctcgcacctcaacctgcacaagacgttctgcatcccgcacggcgggggcggtccgggcgtcgggccggtcggtgtgcgcgcccacctggcgccgtatctgccgaaccacccgctccagcccgaggccggccccgcgacgggcgtcggcccgatctcggccgcgccctggggctccgcgggcatcctgcccatctcctggtcgtacgtccggctgatgggcggcgagggcctcaagcgcgccacgcaggtggcggtgctgtccgccaactacatcgccaagcggctggagccgcactacccggtgctctacaccggtcctggcgggctcgtcgcgcacgagtgcatcatcgatctgcgtccgctgaccaaggcgaccggcgtgagtgtcgacgacatcgccaagcggctgatcgactacggcttccacgcgccgacgatgtcgttcccggtggcggggacgctgatgatcgagccgaccgagtccgaggacctgggcgagctcgaccggttctgcgaggccatgatcgccattcgtgcggaggtcgagaaggtcggctcgggcgagtggccggcggaggacaacccgctgcggaacgcgccgcacaccgcggccgcgctcggcggagagtgggagcacgcctacagccgtgaggaggccgtcttcccggcgggtgtctcggccgcggacaagtactggccgccggtgcgccgtatcgaccaggccttcggcgaccgcaacctggtctgctcctgcccgccgctggacgcttacgacgactga

SEQ ID NO: 2783 - protein, 987 aa, Streptomyces avermitilis MA-4680
MTEGEAVGVPAQGCPSKVASDQEASAMTAHRIPLSDLEQGIPFEQRHIGPDSEARAKMLAQVGYGSLDELTATAVPDVIKNAEALELPGARTEAEVLAELRSLADRNQVLGSMIGLGYYGTFTPPVILRNVMENPAWYTAYTPYQPEISQGRLEALLNFQTVVAELTGLPTSGASLLDEGTAAAEAMALSRRMGKNKKGLFLVDADALPQTIAVIETRAEPTGVEVVVADLSEGIPAGIAEREINGVLIQYPGASGAVRDIKPLVEQAHELGAVVTVAADLLALTLLTSPGELGADIAVGTTQRFGVPMGFGGPHAGYMAVREKFARSLPGRLVGVSVDADGHKAYRLALQTREQHIRREKATSNICTAQVLLAVMAGMYAVYHGPDGLRTIARRTHRYATILAEGLKAGGVEVVHGAYFDTLTARVPGRAAEIVAAAREGGVNLHLVDADLVSISCDETTTRAQLGAVWTAFGVEGDIEALDAAAEDTLPAALLRTDDYLTHPVFHQYRSETAMLRYLRRLSDRDYALDRGMIPLGSCTMKLNATTEMEPVTWPEFGQLHPFAPAEQAQGYLTLIRELEERLAEVTGYDKVSLQPNAGSQGELAGLLAVRGYHRANGDEQRTVCLIPSSAHGTNAASAVMAGMKVVVVKTADDGEIDVEDLRAKIEQYRDELSVLMITYPSTHGVFEEHVADICAQVHEAGGQVYVDGANLNALVGLAKPGHFGGDVSHLNLHKTFCIPHGGGGPGVGPVGVRAHLAPYLPNHPLQPEAGPATGVGPISAAPWGSAGILPISWSYVRLMGGEGLKRATQVAVLSANYIAKRLEPHYPVLYTGPGGLVAHECIIDLRPLTKATGVSVDDIAKRLIDYGFHAPTMSFPVAGTLMIEPTESEDLGELDRFCEAMIAIRAEVEKVGSGEWPAEDNPLRNAPHTAAALGGEWEHAYSREEAVFPAGVSAADKYWPPVRRIDQAFGDRNLVCSCPPLDAYDD

SEQ ID NO: 2784 - DNA, 2868 bp, Porphyromonas gingivalis W83
  CDS (1)..(2868): transl_table=11
atgaatactaacaaattcgaaaaccgccatattggtattgccgagcgcgacctctccgtcatgctccggaccataggcgtagagtcaatggatcagctgatccgcgaaacgatccccggcgacattctgctgcccgagcctctcgatttgcccgaagccatgaccgagcgcgaactgctcgaacatttcatggaactgggatccaagaacaagatcttcacctcctacatcggacaaggctggtatgatacggtcacgccggctcccatccagcgcaacgtattggagaatcctgcgtggtacacctcctatacgccttatcaggcggaagtatcacaggggcgtctggaggctctcttcaatttccagacggtgatcaccgaactgacggggctgcccttgacgaactgctcgctcctcgacgaagccactgccggtgccgaagctgcacgtatgttcttcgatacccgttcgcgcacacaaatcaaggctggtgccaacgttctcttcgtggacaagaaggtattccgctctacgatcgaagtgatccgcacccgtatcatacctcagggtatgcagatcgtggtggatgactacaagacattcagcttcacacccgaagtatttgctgccatcgtacagttccccgatgcagaaggatctgtcaatgattataaatcattcatcgaagcggctcatgctgccaatgccaaagtagccgtagtagccgacctcttgagtatgaccatcctgactcctccgggagaatggggggccgatatcgtattcggatcggcacagcgtttcggtattcccatgtattacggcggcccgtcagcaggatatttggctacgagtatggactacaaacgcaacatccccggccgtattatcggtatgtccaaagatgcttacggacgtccggcttatcgtctggcattgcaaacgcgcgaacagcacatcaaacgagagaaagccacatcgaatatctgtaccgcacaagctttgttggctacgatgagcagcttctatgccgtgtatcacggtgccgatggcttgcgccacatagccggcagggtacatgcttatgcaggatttatcagcgagaagctctccggactcggttataagctgacaaataaggactttttcgacacgcttcgtgtggagctgccggccggtgtcacagcagacaaagtacgcgaactggccgaagaatgcagcgtaaacttcttctaccctgccgatggcagcatcctgatcagtttggacgagactacactgccgtccgacctcggtgttctgctctatatcttctcatccgttttgggcaaagaggagacaatctcggaggacattgccatcgacaaacggtatttcgacggtgcctttgcccgtacctcgaacttcctggactacgacgtattcaacaactaccacaccgagacggagctgatgcgctacatcaaacgcctcgaacgcaaggacatttcactggcacactccatgattccgctgggttcttgtacgatgaagctgaatgccgcatccgagctgttcaacctctcgatgccgcagttcaatgccattcacccgtatgctccgaaagaccagacggaaggctacaacgagatgctcgaaagcctcgaacgttacttggccgttatcaccggtttcgatgccacttcgctccaacctaactccggtgcagcaggcgaatacaccggattgctcactattcgcggctatctgaacagcatcggacagggacaccgccatctggttatcctgccggcttctgcccacggtaccaatccggccagtgccatccagtgcggatacgatacggtgacggtagcttgcgacgagcgaggcaacgtagatatggaggacttcatggccaagaccgaacagcacaaggacgaaatcgctgccatgatgattacctacccgagtacgcacggtatcttcgagacgaacattatcgatctttgccatcgcatccacgagtgtggaggtcaggtgtatatggacggtgccaacatgaacgctcaggtaggactgaccagtccgggcttcatcggagcagacgtgtgccatttgaatctgcacaagacctttgctatcccccacggaggtggaggtccgggtgtaggtcctatctgtgtggccaagcacttgactccattcctgccatcgcacccgctgcgtgaggactacaacggcttggaagtatccgctgctccatacggaagtgcaggggtaacgactatcacctatgcttacattcgtctgatgggatacgaaggtctgcgcagagctacgaaaatcgccatcctgaactccaactacatggctaaccgtctgaaggatactttcggtatcgtctatacgggagccacgggtcgcataggtcatgagctgatcctcgaatgtcgcaagatcaaagaaagcggtatcgacgagaacgatatagccaagcgtctgatggacttcggctatcacgctccgacgctctctttccccgtacatggcactctgatgatagagccgacagagagcgagagcctggccgagctggatcgtttcatcgatgtgatgaactgtatctgggaagagatacaggaagtggctcgtggcgaacaggaagctaccgacaacgtattgaagaatgctccgcatcctcaatacgaggtgacggctaacgactggtcgcatccgtactctcgcgaaaaggcagcttatccgctggaatacctgcgtgagaataagttctggctcaacgtagcccgtatcgacaacggctatggcgaccgcaatttggttccgagcctctgcagcgcatgtgaggttttcaacaatcaatag

SEQ ID NO: 2785 - protein, 955 aa, Porphyromonas gingivalis W83
MNTNKFENRHIGIAERDLSVMLRTIGVESMDQLIRETIPGDILLPEPLDLPEAMTERELLEHFMELGSKNKIFTSYIGQGWYDTVTPAPIQRNVLENPAWYTSYTPYQAEVSQGRLEALFNFQTVITELTGLPLTNCSLLDEATAGAEAARMFFDTRSRTQIKAGANVLFVDKKVFRSTIEVIRTRIIPQGMQIVVDDYKTFSFTPEVFAAIVQFPDAEGSVNDYKSFIEAAHAANAKVAVVADLLSMTILTPPGEWGADIVFGSAQRFGIPMYYGGPSAGYLATSMDYKRNIPGRIIGMSKDAYGRPAYRLALQTREQHIKREKATSNICTAQALLATMSSFYAVYHGADGLRHIAGRVHAYAGFISEKLSGLGYKLTNKDFFDTLRVELPAGVTADKVRELAEECSVNFFYPADGSILISLDETTLPSDLGVLLYIFSSVLGKEETISEDIAIDKRYFDGAFARTSNFLDYDVFNNYHTETELMRYIKRLERKDISLAHSMIPLGSCTMKLNAASELFNLSMPQFNAIHPYAPKDQTEGYNEMLESLERYLAVITGFDATSLQPNSGAAGEYTGLLTIRGYLNSIGQGHRHLVILPASAHGTNPASAIQCGYDTVTVACDERGNVDMEDFMAKTEQHKDEIAAMMITYPSTHGIFETNIIDLCHRIHECGGQVYMDGANMNAQVGLTSPGFIGADVCHLNLHKTFAIPHGGGGPGVGPICVAKHLTPFLPSHPLREDYNGLEVSAAPYGSAGVTTITYAYIRLMGYEGLRRATKIAILNSNYMANRLKDTFGIVYTGATGRIGHELILECRKIKESGIDENDIAKRLMDFGYHAPTLSFPVHGTLMIEPTESESLAELDRFIDVMNCIWEEIQEVARGEQEATDNVLKNAPHPQYEVTANDWSHPYSREKAAYPLEYLRENKFWLNVARIDNGYGDRNLVPSLCSACEVFNNQ

SEQ ID NO: 2786 - DNA, 2997 bp, Gloeobacter violaceus PCC 7421
  CDS (1)..(2997): transl_table=11
atgagcgaaccgaccatcgaccgcgaactggatttgcacaccttctggcaggacgcttccgagccggcgcctgatacaaccatccctgccgtcgccctggccaatggcaaaggacatctcgactacaccgaccgcttcgcggggcgccacatcggcccggacgggcgggaggtggagcgcatgctgtccacattgggctttgagtcgctcgatgcgctcatcgagcgcgccgttcccgcccagatccgcatggaacggcctttgcggctgccgaaaggccttagcgaatacgaggtgctggcgcgcctgagggcgattgccgctcaaaaccgggtattccgctcgttcatcggcatgggctacgccgagtgcatcaccccgctggtcatccagcgcaacattcttgaaaaccccggctggtacacccagtacacgccttaccaggccgagatcgcccagggtcgtctcgaagcgctcctcaactttcagacaatggtgatcgatctcaccggccttgagattgccaacgcttcgctgctcgacgaaggtaccgccgccgccgaggcgatggcgatgagcttcgggatcaaagccaagggcagggctaagcgcttttttgtctccgagcattgccacccccagacgatcgccatcgttcagacccgggctctgcccctagggatcgacgtgatcgtgggcgatcaccgtgcgttcgattttcaagtgcagccttgcttcggtgccctggtgcaatacccggccaccgacggagccctgttcgactaccgcgctttcgtcgaagcggcccaccgcgccggggcgcttgtgaccgtggcagcggacttattgagcctggcgctgctggtgcccccgggcgaattcggcgccgacatcgccgtgggcaacacccagcgcttcggggtgccgatgggctacggcggtccccacgccgcctactttgccacccgcgacgcctacaagcgccagatccccggccggatcgtcggggtctctaccgacgcccacggtcagcgggcgctgcgcctggcgctgcagacgcgcgagcagcacatccgccgcgacaaagccaccagcaacatctgcaccgcccaggtgctgctcgcggtgatggccggcatgtatgcggtctaccacggtccggtgggcctgcgccgcatcgccgcacgcatccaccgcctgacgcgcacgctcgccgccggactcgtgcgccttggccaccttctgggaagcgctccttacttcgacacactgcgcgtcgagttgaacgggatcgatacccggaccatcgtcgagcgcgccgaggcgcggcgcctgaacttgcgggtgctggacgagcggacgatcggcgtcagcctcgatgaggccacctccacccgcgatctcgaagatttgctcgccatttttgccctggagggcgagcccgattttacgatcgccgagctggccgcggaagtgagccaggtgcaggcgccggaagtttttggacgccagagcgcctacctcacccatccggtctttaaccgctaccactccgagacggagctgttgcgctatatgcgtcggctcgaaagccgggatctgtcgctcaccacgtcgatgatcccgctcgggtcgtgcacgatgaagctcaacgccaccgccgagatgctcccggtgagctggcccgaatttgcgaagctccacccgtttgtgccgctgtcgcaggcgcggggctaccagattcttttcgagcaactggaggcggccctggccgaaatcaccggctttaccgccgtctcgctgcagcccaacgccggttcccagggcgagtacagcggtcttctggtcatccgcgcctatcaccacagtcgtggcgaggcgcaccgcgatgtctgcctcatcccccagtctgcccacggcaccaacccggcctcggcggtgatggcggggatgcaggtggtgccggtggcctgcgacgagcagggcaatatcgacgtggccgacctcgaggccaaggcgacgacccacgccgcgcggctcgccgccttgatggtcacctacccctcgacccatggcgtcttcgaggaagcgatcgtccgcatctgcgcgatcgtccacgggcgcggcggccaggtctacatggacggcgccaatctcaacgcccaggtagggctgtgccgcccgggggattttggggccgatgtctgccatctcaacttgcacaagacgttttgcattccccacggcggcggcggtcccggcatgggacccatcggtgtggcaagccacctggccgcctttttgccccgccacccggtggtttcccaggtgggcggccaggcgggcatcggcgcggtggccgccgctccctggggcagtgccagcatcctgaccatctcctgggtgtacatcttcttgatgggagggccagggctcaccgaggcgacgaaagtggcgatcctcaacgccaactacatcgcccaccgcctggcgccccactacccggtgctctacaagggcgcgggcggcctggtggcccacgagtgcatcctggacttgcgcaagctcaaaaccaccgccggcatcgaggtggacgacgtcgccaagcggctgatggactacggctttcatgcgcccacggtctcctggccggtggcgggcacgatcatgatcgagcctaccgagagcgaatcgctcgaagagcttgatcgcttttgcgaggcgctcatcgccatccgccacgaaatcgccgcaatcgagcgcggtgaggccgaccgcgccgacaacccgctcaagaacgccccccatacggcggcggtgctactggccgatagctgggagcacccctacagccgtgcccaggccgcctacccggctccctggctgtaccagcacaagttctggccggtggtaagccgcatcgacaacgtctacggcgaccgcaacctgatctgctcctgcctgccgatggaagcttacgcccaggacggcaagtga

SEQ ID NO: 2787 - protein, 998 aa, Gloeobacter violaceus PCC 7421
MSEPTIDRELDLHTFWQDASEPAPDTTIPAVALANGKGHLDYTDRFAGRHIGPDGREVERMLSTLGFESLDALIERAVPAQIRMERPLRLPKGLSEYEVLARLRAIAAQNRVFRSFIGMGYAECITPLVIQRNILENPGWYTQYTPYQAEIAQGRLEALLNFQTMVIDLTGLEIANASLLDEGTAAAEAMAMSFGIKAKGRAKRFFVSEHCHPQTIAIVQTRALPLGIDVIVGDHRAFDFQVQPCFGALVQYPATDGALFDYRAFVEAAHRAGALVTVAADLLSLALLVPPGEFGADIAVGNTQRFGVPMGYGGPHAAYFATRDAYKRQIPGRIVGVSTDAHGQRALRLALQTREQHIRRDKATSNICTAQVLLAVMAGMYAVYHGPVGLRRIAARIHRLTRTLAAGLVRLGHLLGSAPYFDTLRVELNGIDTRTIVERAEARRLNLRVLDERTIGVSLDEATSTRDLEDLLAIFALEGEPDFTIAELAAEVSQVQAPEVFGRQSAYLTHPVFNRYHSETELLRYMRRLESRDLSLTTSMIPLGSCTMKLNATAEMLPVSWPEFAKLHPFVPLSQARGYQILFEQLEAALAEITGFTAVSLQPNAGSQGEYSGLLVIRAYHHSRGEAHRDVCLIPQSAHGTNPASAVMAGMQVVPVACDEQGNIDVADLEAKATTHAARLAALMVTYPSTHGVFEEAIVRICAIVHGRGGQVYMDGANLNAQVGLCRPGDFGADVCHLNLHKTFCIPHGGGGPGMGPIGVASHLAAFLPRHPVVSQVGGQAGIGAVAAAPWGSASILTISWVYIFLMGGPGLTEATKVAILNANYIAHRLAPHYPVLYKGAGGLVAHECILDLRKLKTTAGIEVDDVAKRLMDYGFHAPTVSWPVAGTIMIEPTESESLEELDRFCEALIAIRHEIAAIERGEADRADNPLKNAPHTAAVLLADSWEHPYSRAQAAYPAPWLYQHKFWPVVSRIDNVYGDRNLICSCLPMEAYAQDGK

SEQ ID NO: 2788 - DNA, 3255 bp, Magnaporthe grisea 70-15
  CDS (1)..(3255)
atgtcgtcacgaacattggctctctcccgccacgtggctaggattggacagtcacattcatctcaggtccggcttttgtcgagctcccggagtcttttgaacaggtccgggctggattcttcaaggcagcaaacatggggaaagtcttcccaagccggtgccgttgcccggcagtcatgtctccgccgctatcagagcacctcggctcaggcatctggaatctggggagaagacgtgctccgccaaaaggacttccccaagatccacagcctgcaagatttcagtgacaggcacattggccccgatgcgcaagaggaggtggaaatgctcaaggctctggacccgccaatggagtcgatggacgcctttgtcggagaggtcattcccgaggatgtgcggttgagcaagccgatgggcgtgtggcggaagcagaccgagcaggagatctcgtcgaacatttcggcacactgccgggactcgccacctccgtgcttcatcggaaagggctactacaacactctgacccccgaggtcatcaagcgcaacatcctcgagagccccgcctggtacaccagctacacgccttaccaggccgaggtgagccagggtcgcctggaatcgctgctcaacttccagaccatggtttcggacctgaccggtctgcccgtggccaacgccagtcttttggacgagggtacggccgcggctgaggccatgaccctgtctatcaactcgcttccgtcgtcccgggtaaagagggccggaaagacgatgcttgtggccagctcgatgaacccgatgaccatcaaggtcatggagggacgcgccgagggtttcggtgtcaagattgagaaggtcgcaatcccttcgcccgagttcaacgaacggttggagcagctcggcgacgacgtcgtgggcgtcatgattcagtaccccgatgacctcggtggacttgccgactaccgggacgtggccaagcgtgtgcacgacaagggagtcctgctcagctgtgctacggagctcctcgccttgactctgttcacgccgcccggcgagtggggagccgacattgcctttggaagctcgcagaggttcggtgttcctctgggtggtggcggcccgcacgctgccttctttgcggtctcggagaagcacaagcgcaagatccccggccgtctcgtcggtgtgtccaaggaccgccggggtgagcgggcgctccgtttggcgctgcagacccgtgagcagcacatccggagagaaaaggcgacgagcaacgtctgcactgctcaggccctgcccgccaacgtggccgccatgtacgctgtctaccacgggcccgagggactgaaggctatcgctgagggcatcgtgcgcaaggccaagtacgtccaggctgccctggcacagctcggcttctctgtcgccgagaccaaggctatcgatggcgtggttgcttgggatactgtcgtcgtcgacatgggttcccgcgagaccctgcagaagttcttggagtcgaccaaggacaaattccaactgcgggagctgaccactcccggtcgcttctccatcaccgtcgacgagtcaacaacacaagaggacatcaactcgctgttgggagagctgtccagctacgcaccgaacaagggcgtcagcccgcagcagttcaccgacagcttcaccaaggctgtgtcggcagagctgcctggacacttcaagcgatcgtccccatacctgcagcaccctgtcttcaactctcaccactcggagacggagcttctgaggtacatctaccacctccagtccaaggacctttcgctggtgcactcgatgattccgttgggatcatgcaccatgaagctcaacggttcagttgagatgaccacgctttcgatgccggcctggtcgcaatcccacccagcatccaacgaccagcctgtgtgggccgacatgctcagctccctcaacgacatgctcaagaaggtgacgggcatgtccgaggtgacgctggagcccaactctggcgctcagggtgaattcgctggactgcgagccatccgggcctaccacaagagccgaggtgacgacaagcgcgacatctgcctgatccccgtgtctgcgcacggcaccaaccctgcatcggcggccatgacgggcatgcgtgtggtccccatcaagtgcgacgtcaagacgggcaacctcgacgtcgaggacctcgaggccaaatgtgagaagcaccgcgacgagctgggcgccatcatggtgacctaccccagcacgtttggtgtcttcgagccgaggatccgcgaggtctgcgacattgtccaccgccacggcggtcaggtgtacatggacggcgccaacatgaacgcccaggtcggcctgtgctcgcctggtgacattggcgccgacgtctgccacttgaacctgcacaagaccttctgcatcccgcacggcggtggcggcccgggctccggtcccgtctgcgccaagagccacttgggacctttcttgcccaacgccgcagtgcgcgaggccgagatcaaggcagtttcgctttccggctccaagtcgggcgaggaggcctcgtcgtttgccgtcagctctgctccccacggtagcgcctccatcctgcctatcagctggtcttacatggctctcatgggtcccgacggactcaaaaaggcaaccgaggttgcgatcctcaacgcaaactacctcctggcgcgcctcaagccgcactacccgattctctacaccaacgacaagggtcgctgcgctcacgagttcatcctggacgcgcggccgttctccaagactgcgggcgtcgaggccatcgacatcgccaagcgtctgcaggactacggcttccacgccccgaccatgagctggcccgtggccaacacgctcatggtcgagccgaccgagagcgagtccaaggccgagctggaccggttcgccgacgcgctcatcagcatccgcgccgagatcagggacatcgaggagggcaggcagcccaagacgggcaacgtcctcaagaacagcccgcacccgctgcacgacatcatcggcggcgacggcaacggtggcgccggctgggacaggccctacacgcgcgagcaggccgcctacccgctcccctggctgcgggagaagaagttttggccgacggtcgctcgtgtcgacgacacctttggtgacctgaacctcttctgcacatgcccgcccgttgtggacactacgggagatgtgaactga

SEQ ID NO: 2789 - protein, 1084 aa, Magnaporthe grisea 70-15
MSSRTLALSRHVARIGQSHSSQVRLLSSSRSLLNRSGLDSSRQQTWGKSSQAGAVARQSCLRRYQSTSAQASGIWGEDVLRQKDFPKIHSLQDFSDRHIGPDAQEEVEMLKALDPPMESMDAFVGEVIPEDVRLSKPMGVWRKQTEQEISSNISAHCRDSPPPCFIGKGYYNTLTPEVIKRNILESPAWYTSYTPYQAEVSQGRLESLLNFQTMVSDLTGLPVANASLLDEGTAAAEAMTLSINSLPSSRVKRAGKTMLVASSMNPMTIKVMEGRAEGFGVKIEKVAIPSPEFNERLEQLGDDVVGVMIQYPDDLGGLADYRDVAKRVHDKGVLLSCATELLALTLFTPPGEWGADIAFGSSQRFGVPLGGGGPHAAFFAVSEKHKRKIPGRLVGVSKDRRGERALRLALQTREQHIRREKATSNVCTAQALPANVAAMYAVYHGPEGLKAIAEGIVRKAKYVQAALAQLGFSVAETKAIDGVVAWDTVVVDMGSRETLQKFLESTKDKFQLRELTTPGRFSITVDESTTQEDINSLLGELSSYAPNKGVSPQQFTDSFTKAVSAELPGHFKRSSPYLQHPVFNSHHSETELLRYIYHLQSKDLSLVHSMIPLGSCTMKLNGSVEMTTLSMPAWSQSHPASNDQPVWADMLSSLNDMLKKVTGMSEVTLEPNSGAQGEFAGLRAIRAYHKSRGDDKRDICLIPVSAHGTNPASAAMTGMRVVPIKCDVKTGNLDVEDLEAKCEKHRDELGAIMVTYPSTFGVFEPRIREVCDIVHRHGGQVYMDGANMNAQVGLCSPGDIGADVCHLNLHKTFCIPHGGGGPGSGPVCAKSHLGPFLPNAAVREAEIKAVSLSGSKSGEEASSFAVSSAPHGSASILPISWSYMALMGPDGLKKATEVAILNANYLLARLKPHYPILYTNDKGRCAHEFILDARPFSKTAGVEAIDIAKRLQDYGFHAPTMSWPVANTLMVEPTESESKAELDRFADALISIRAEIRDIEEGRQPKTGNVLKNSPHPLHDIIGGDGNGGAGWDRPYTREQAAYPLPWLREKKFWPTVARVDDTFGDLNLFCTCPPVVDTTGDVN

SEQ ID NO: 2790 - DNA, 3162 bp, Gibberella zeae PH-1
  CDS (1)..(3162)
atgtctgctactcgtatcggacaacggctcgcccgtcagtctcgtcgctcccccatcacccttcaacctcgcctcacacaaacaattcgtctcaatgccgtctcatcaagggcattctcagtcacagccaccacccaggctcctcgcttcgtcgagtcccagagcagtaccaaactgcatgagcatgagctcttctcaaggaggcacatcggcagcgagtcgagcgagcaaacagaaatgctcaagatgctcgaccctcccgtgagctccatggaggagttcctcgaacagactatccccccgcaggtcaggaggaagcaaaagggtcttaacctcgttgagcagtggtacgagggcggcgccgaaaccgctgtccctgttaatggtcgcaccgagcactacatccagaaggagatgcgcaagctcgcaaagaacaacaaggtttacgagtctttcatcggtgctggttactacggaactcttgttcctgctgttatccagcgcaatgttctcgagaaccctgcttggtataccagctacactccctaccaggctgagatcagccagggtcgccttcagtccctcctcaacttccagactctcatcaccgatttgaccggtcttgacattgccaatgcctctgttctcgacgaggctaccgccgctgccgaggccatgaccatgtcaatggccaacgcccccaagggcaagggccaaaagacctttgtcgtctcagagaactgccacccacagaccatctccgtcctgcagtcccgagctgagggcttcaacatcaagctcgtcattggtgatgttcttgctgataactctaagctcgtccgcgaagtcgagggtgacctcattggcactctgatccagtaccccgatacccacggtggtgtccacgactaccaggccctcgccgatatcgtccacgagaagaaggctctcctcagcgcatctaccgatctgctcgctcttaccatgctcaagccccctggagactttggcgctgacattgccattggtaactctcagcgattcggtgttcctctgggctacggtggtccccacgctgccttctttgccacatctgagaagtacaagcgcaagatccccggtcgtctcgttggtgtttccaaggatcgtctcggaaagcctgctcttcgtcttgctctccagactcgtgagcagcacattcgacgtgaaaaggctaccagcaacatctgcactgcccaggctcttctcgccaacatgtctgctttctacgctgtctatcacggtcccaagggtctcaagactatcgctgaggatatctggagcaagacccgtctcgctcagagcctcatccttgagaagggcgagttcaagctccacactgagggtctccgcgaggatggctctgttcttttcgacactgtcactctcaagggctctcctgaggctattgccaaggtccacgagaaggctgattctcagagcatcaacctccgccgcgtcgccgatgacaaggttggcttctctctccacgagggtgtcacccttgagagcctcggcaaccttgtcaagatctttggcgtttccgagtctgactttaacgccgctctcgagtcagacaaggccaagttcctcaacgatgagatccccgcttctctccagcgaaaatctgcctatctcgagcagcctgtcttcaaccagtaccacaccgagaccgagcttcttcgatacatctaccacctccagtctaaggatgtctctctcgtacactccatgatccctctgggctcttgcaccatgaagctcaacgccaccaccgagatgctccccgtttccgaccccggtatcaacaacatccaccccttcgcccctgtcgagcaggcttccggttaccaggcccttatcagctccctcgccaagaacttgtccgagatcactggtatggacgctacaactctgcagcccaactctggtgctcagggtgagtttgccggtcttcgctgcataaaggcctaccacgaggctcgctctggcgagaagcgaaaggtttgcctgatccccgtttctgcccacggtaccaaccctgcctcggccgctatggctggcatgaaggtcgtcaccgtcaagtgtgacggcaagactggtaacctggacattgaggatctcaaggccaagtgtgtcaagcacgctgatgagctcgctgctatcatggttacctacccctccacctttggtgtctttgagcccgagattaagcaagtctgcgatcttgttcacgagcacggtggtctcgtctacatggacggtgccaacatgaacgcccagatcggtctttgctctcctggtgatatcggcgctgatgtctgccatcttaacctccacaagaccttctgtattccccacggtggtggtggccctggtgtcggtcctattgccgtcaagaagcacctcgctccttacctgcctggtcaccctgagatcgaccctcagcgcattggtgccgagcgtgatagcaccgctgttgctcccatcagtgccgctccttggggtagcgcttccattcttcccatcagccacacttatatcctcatgatgggtggtgatggtcttaccaagcaaactggtaccgctctcctcaacgccaactacatcatgtcccgcctcctcccccactacaaggtcgtctacaccaacgcccagggccgatgcgctcacgagttcatcctggacgtccgacccttcaaggacacagccggtgttgaggttgccgacattgccaaacgattggccgattacggtttccactctcctaccatgagtttccccgtctcaggaaccctcatgatcgagcccaccgagtctgaatctcgagctgagcttgaccgcttctgcgacgccctcatccagatccgcaaggagatcgccgacatcgagtctggcaaggttccccgcaagaacaacatcctcaccaacgcccctcatccccaagaagacctcctctcctccgagtgggaccgcccctacacccgtgaggaggcagcctaccctctcccctggctccgggagaagaagatgtggccctctgtcggccgagtggatgatgcttacggtgacaccaacctgttctgcacatgccctcctgtcgagggatctgaggacttgtaa

SEQ ID NO: 2791 - protein, 1053 aa, Gibberella zeae PH-1
MSATRIGQRLARQSRRSPITLQPRLTQTIRLNAVSSRAFSVTATTQAPRFVESQSSTKLHEHELFSRRHIGSESSEQTEMLKMLDPPVSSMEEFLEQTIPPQVRRKQKGLNLVEQWYEGGAETAVPVNGRTEHYIQKEMRKLAKNNKVYESFIGAGYYGTLVPAVIQRNVLENPAWYTSYTPYQAEISQGRLQSLLNFQTLITDLTGLDIANASVLDEATAAAEAMTMSMANAPKGKGQKTFVVSENCHPQTISVLQSRAEGFNIKLVIGDVLADNSKLVREVEGDLIGTLIQYPDTHGGVHDYQALADIVHEKKALLSASTDLLALTMLKPPGDFGADIAIGNSQRFGVPLGYGGPHAAFFATSEKYKRKIPGRLVGVSKDRLGKPALRLALQTREQHIRREKATSNICTAQALLANMSAFYAVYHGPKGLKTIAEDIWSKTRLAQSLILEKGEFKLHTEGLREDGSVLFDTVTLKGSPEAIAKVHEKADSQSINLRRVADDKVGFSLHEGVTLESLGNLVKIFGVSESDFNAALESDKAKFLNDEIPASLQRKSAYLEQPVFNQYHTETELLRYIYHLQSKDVSLVHSMIPLGSCTMKLNATTEMLPVSDPGINNIHPFAPVEQASGYQALISSLAKNLSEITGMDATTLQPNSGAQGEFAGLRCIKAYHEARSGEKRKVCLIPVSAHGTNPASAAMAGMKVVTVKCDGKTGNLDIEDLKAKCVKHADELAAIMVTYPSTFGVFEPEIKQVCDLVHEHGGLVYMDGANMNAQIGLCSPGDIGADVCHLNLHKTFCIPHGGGGPGVGPIAVKKHLAPYLPGHPEIDPQRIGAERDSTAVAPISAAPWGSASILPISHTYILMMGGDGLTKQTGTALLNANYIMSRLLPHYKVVYTNAQGRCAHEFILDVRPFKDTAGVEVADIAKRLADYGFHSPTMSFPVSGTLMIEPTESESRAELDRFCDALIQIRKEIADIESGKVPRKNNILTNAPHPQEDLLSSEWDRPYTREEAAYPLPWLREKKMWPSVGRVDDAYGDTNLFCTCPPVEGSEDL

SEQ ID NO: 2792 - DNA, 3087 bp, Kluyveromyces lactis NRRL Y-1140
  CDS (1)..(3087)
atgttaaagtatagatcttcggttaccgttgtaagacagtttgccagaactagagttccattggggctaactccagctttaggataccgttttgtttcaacgaaatgcaatgtgtcatcgaatcagtacggtaagatttacgaggctaagaaaaatggaccagacgcttatgagccattggatacgttccagagacgccatttgggaccatctccttccaatgtggatcaaatgttgaaacagttgggttacactgatttagatcagtttatcaacggtgttgtgcctgaaaacattcttgtgaaacgtccgttggaacttaattcgccagagaatgggtttacagaacaacagatgttgaaacatttggaagaacttgccaataagaataaccacaaggtcaggaatttcattgggaaagggtattacggtacagtgttaccaccagtgattcagaggaatctattggaatgtccggaatggtacacttcttatactccgtaccagcctgagatctcacagggcagattggaatcgcttttgaattaccagactgtggtgtcagatttgactgggttaccggtggccaatgcgtcgttgttggatgagggtacagctgctggtgaagcgatgctgttatctttcaacgttgccaagaagaagaaactcacttacgttatagataagagattgcataaacagacgaagtctgtgcttaagacaagaaccgaacctttcgggatcaagttggttgaagttgatccattggatgaatcgacttggtccgttctatcatctgataaagatgtctccggttgtttggttcaatatccagatacagagggtaatatcatccctggtgagacactagccaagttggcagatatagtacaccaatctaagggtttgtttgccgtggcatccgatcttttggctttgactcttttgaaaccccctgctcaatttggtgctgatattgttcttggatcatcgcaaagattcggggtaccattcggttatggtggcccacacgctgcattcttctctgttattgagaagttgaacagaaagatcccagggagaatcgttggtgtttccaaggatcgtttgggtaaacctgctttacgtctcgcattacaaaccagagagcaacacatcaagcgtgataaggctacttcaaatatttgtactgcacaagcgctcttggctaatattgctgcaaactactgtgtttaccatggcccacaaggtctaaaagaaattgctggcagagtttacggattcacaaccgtattggccaatgggttatcatcttcaaaccatactttgttgaacaaatcgtggtttgatactttgactgttgagttaaacggaatctccgcacaagatttcataaagactgcggtcgacaaatatcaaatcaatttataccaagtcaataatgaaaccgtttcattatctcttgacgaaactgtcaccaaagatgatttgatcgccctactcgaattattcggatgcaacgccaatgaattgccagtagcacttccagagttcccgcaagaattgacccgtcaagatgaaatcttgtccaatgaggtgttcaacactcatcattctgagacagcaatgctaagatacttacaccgtctacaatcccgtgatttatctttggcaaactcaatgatcccacttggatcatgtaccatgaagttgaatgcaactgtcgagatgattccaatcacctggccacagtttgccaatatccatccattccaaccaagggatcaagtggaaggatacgaggttttgatcaaaaacttggaaaaagatcttgcatctattaccggattcgatgaagtttcattacaaccaaactctggagctcaaggtgaatacgctggtcttagagtcatcagaagatacttcgaagaccgcggagaaacccaccgtaacatatgtttgatccctgtctctgcacatggtacaaaccccgcctctgctgctatgtgtggtttgaaggtgatcccagttaactgtctgaagaacggatctctggacctcgttgatttgaaggctaaagccgaaaaacacaaagacaatttagccgccattatgattacatatccatcaacttacgggttattcgagcctggtgtcagaaccgccatcgacttggttcatgaaaatggtggacaagtgtatttggatggtgccaacatgaatgctcaggtgggattaacctctcctggtgacttgaacgctgacgtgtgccatttgaacttacataagacattctctatcccacacggtggtggtggtcctggtatgggcccaatttgtgtacaatcacacttggctccatacttgcctgctcacgacgtggtacccatgataaccggtgtcggttctgataaatctatcgcctccgtctcttcggcaccatacggaagtgcatcaattcttccaatttcatatgcctacatcaagatgatgggctccaagggactaccattttcctcagtgattgcgatgttgaacgctaactacatgatgtcccgtttgagaccacactacaatattctattcgttggagaaaagggttctacaactgaaactgaggatctcacacactgcggtcacgagtttatcatcgacctaagagcttacaaggatcaaggcgtcgaagctatcgatgtggccaagagactacaggactacgggttccacgccccaacactagcgttcccagttcctggaacactaatggtagaaccaacagaatcagaaaacttagaagaactggaaaggttcatcgacgcgatgatctcaatcaagaaagagatagatctattcatcaagggcgatccacaaggtcaagtattaaagaattccccacattctttagaagatgtggtttcaagtgatgattggagctccagaggctacacaagagaacaggcagtctatccgttaccatacttgaaatacaacaaattctggccaccagtggctcgtctagacgacacttacggtgacacacacttgatgtgcacatgtccatccgtagaagaagtagccagcgagtga

SEQ ID NO: 2793 - protein, 1028 aa, Kluyveromyces lactis NRRL Y-1140
MLKYRSSVTVVRQFARTRVPLGLTPALGYRFVSTKCNVSSNQYGKIYEAKKNGPDAYEPLDTFQRRHLGPSPSNVDQMLKQLGYTDLDQFINGVVPENILVKRPLELNSPENGFTEQQMLKHLEELANKNNHKVRNFIGKGYYGTVLPPVIQRNLLECPEWYTSYTPYQPEISQGRLESLLNYQTVVSDLTGLPVANASLLDEGTAAGEAMLLSFNVAKKKKLTYVIDKRLHKQTKSVLKTRTEPFGIKLVEVDPLDESTWSVLSSDKDVSGCLVQYPDTEGNIIPGETLAKLADIVHQSKGLFAVASDLLALTLLKPPAQFGADIVLGSSQRFGVPFGYGGPHAAFFSVIEKLNRKIPGRIVGVSKDRLGKPALRLALQTREQHIKRDKATSNICTAQALLANIAANYCVYHGPQGLKEIAGRVYGFTTVLANGLSSSNHTLLNKSWFDTLTVELNGISAQDFIKTAVDKYQINLYQVNNETVSLSLDETVTKDDLIALLELFGCNANELPVALPEFPQELTRQDEILSNEVFNTHHSETAMLRYLHRLQSRDLSLANSMIPLGSCTMKLNATVEMIPITWPQFANIHPFQPRDQVEGYEVLIKNLEKDLASITGFDEVSLQPNSGAQGEYAGLRVIRRYFEDRGETHRNICLIPVSAHGTNPASAAMCGLKVIPVNCLKNGSLDLVDLKAKAEKHKDNLAAIMITYPSTYGLFEPGVRTAIDLVHENGGQVYLDGANMNAQVGLTSPGDLNADVCHLNLHKTFSIPHGGGGPGMGPICVQSHLAPYLPAHDVVPMITGVGSDKSIASVSSAPYGSASILPISYAYIKMMGSKGLPFSSVIAMLNANYMMSRLRPHYNILFVGEKGSTTETEDLTHCGHEFIIDLRAYKDQGVEAIDVAKRLQDYGFHAPTLAFPVPGTLMVEPTESENLEELERFIDAMISIKKEIDLFIKGDPQGQVLKNSPHSLEDVVSSDDWSSRGYTREQAVYPLPYLKYNKFWPPVARLDDTYGDTHLMCTCPSVEEVASE

SEQ ID NO: 2794 - DNA, 2985 bp, Yarrowia lipolytica CLIB122
  CDS (1)..(2985)
atgctacgaaccctcaaccggacaagtcgtatcttgcgactgtcggccacaaaaacccgatttggatccacattttcagcagcaacacgacctctggacacttatcttcgacgacatgttggtagcgaatctgcagatgtgaacaagatgctccgagctctagattacgctactgccgagtcagctatggacagcttcgtgtcagatgtcgttccccccaatgttctgaccaagcgacctcttgctgtcaagcccacacaaggtttctctgaatctgagctgaccagccggttgggagagattgcttccaaaaacaaggtcttcaagtcctatatcggaaagggctatgtcggaactgttgttccacccgtcatccagcgaaatgttctcgagaaccccctctggtacacctcatacacaccctaccagcccgagatcagtcagggtcgtctggagtcactcctgaactaccagaccgttattactgagctcaccggaatggcagttgccaacgcttctcttcttgacgagggtactgcggcatcggaggccgttacaatggcattcaacgctttcaagggcaagcgaggcattttccttgttgacaagaacgttcatccccagaccattgctgttgtccagtctcgaagtgtagctcttgacgtcgacgtcaaggttgtcgacgtgtctgatctctccaacggcaagtctgagagccctattgaccaggtctgcggtgttctagtgcaatacccaaccactgacggttccattgtcgattaccagaagctcagcgacaccctcaagggtgagggcaacggtagcctgctgtgcgttgccgctgaccttctggccctcacccttctcaagcctccttccgatttcggtgccgacattgttctcggtacctcccagcgatttggtgtccccatgggttacggtggacctcatgctgcttactttgctgttgccgatggccagcaccgaaagatgccaggacgacttattggcatgtcccgtgatcgacttggcggcgaggcttatcgactggccctccagactcgtgagcaacacattcgaagagagaaggcgacctctaacatctgcacagcccaggctctccttgccaacatgagcgcattctacgctatctaccatggacctgagggccttcggaagatcgccgagcgtgtcaacctgctcacctccatccttgccactgccgttgaagccaagggcgttaaggtcgagaacaagcacttctttgacactctcaccctgcaggttcaggatgccaacaaggtcatttctgcagctgaggccaaggagatcaacctttacaagcttgacgataagaccgtttctctgactctcgatgagaccgtcactcacggtgatcttgtcaaccttgcatcggtttttggcgtttctgaggctgacttggagtctgctgctgataatgtcaccagcagtattccctctgatatgctgcgaactgataagtacatgcagcacgatgtgttcaacaagtaccattcagagaccgagcttcttcgatatatgaagcatcttcagtcaaaggatctgtctctcgccgatgctatgattcctctgggtagttgcacaatgaagcttaatgccaccactcagatggcacccatcacctggcctgaatttggccagcttcatccctttgttcctctcaaccaggctcagggctacaaggagcttttgatcgagcttgaggatgatcttgcggacattaccggtttcgatcgaatgtctctgcagcccaactctggtgctcagggtgagtacaccggcctacgagtcatccgtgcctaccttgagtctcagggccagggccaccgaaacatctgtctgatccctgtctctgctcacggtaccaacccagcttctgctgtgatgtcaggcatgaaggttgtcgctgtcaagtgtaagaaggatggtgagcttgatctcgtcgatcttgctgccaaggctgagaagcataaggataacctggctgcgttcatggtcacttatccttccactttcggtgttttcgagcctggtgtcaaggaggcgattgatattgttcacaagaatggcggacaggtatacatggacggtgccaacatgaacgctcagatcggtctgacctcccctggtgagatgggtgctgatgtgtgccatctcaacctccacaagaccttctgcatcccccacggcggtggtggacctggcatgggccctattggtgtcaagtctcacctggctcctttcttgcctgctcaccccgttgttgagatgagcgaggttacaggcctttctacagagaagtcaattcagcctgtttctgctgcaccctttggatctgcttctatcctccccatctcctgggcttacattaagctgatgggtgctaccggactgctcaaggccactgaaatcgctctccttaacgccaactacatgaagaagcgacttgagccccattaccctattctctacaccaacaacaaagacaagtgcgctcatgagttcatccttgacatgcgacctttcaaggcatcgtctggaatcgaggctattgatattgctaagcgtctccaggattactctttccacggtcccaccatgtcctggcctgttgccaacactcttatggtcgagcccactgagtctgagtctctagcagagcttgaccgattctgtgatgctctgatttccatccgacaggagatcaaggagattgaggacggcaagattccccgggagaacaacgtcctcaagaactccccccatcctcaacaggaccttttggccgagacttgggatcgaccctacaccagagagcaggctgcttatcccgtagctagccttcgagagaagaagttctggccgtcagttgctagagtagatgatacctttggtgatctcaacttgttctgcacctgtgaacctcccgctctcgaggagtag

SEQ ID NO: 2795 - protein, 994 aa, Yarrowia lipolytica CLIB122
MLRTLNRTSRILRLSATKTRFGSTFSAATRPLDTYLRRHVGSESADVNKMLRALDYATAESAMDSFVSDVVPPNVLTKRPLAVKPTQGFSESELTSRLGEIASKNKVFKSYIGKGYVGTVVPPVIQRNVLENPLWYTSYTPYQPEISQGRLESLLNYQTVITELTGMAVANASLLDEGTAASEAVTMAFNAFKGKRGIFLVDKNVHPQTIAVVQSRSVALDVDVKVVDVSDLSNGKSESPIDQVCGVLVQYPTTDGSIVDYQKLSDTLKGEGNGSLLCVAADLLALTLLKPPSDFGADIVLGTSQRFGVPMGYGGPHAAYFAVADGQHRKMPGRLIGMSRDRLGGEAYRLALQTREQHIRREKATSNICTAQALLANMSAFYAIYHGPEGLRKIAERVNLLTSILATAVEAKGVKVENKHFFDTLTLQVQDANKVISAAEAKEINLYKLDDKTVSLTLDETVTHGDLVNLASVFGVSEADLESAADNVTSSIPSDMLRTDKYMQHDVFNKYHSETELLRYMKHLQSKDLSLADAMIPLGSCTMKLNATTQMAPITWPEFGQLHPFVPLNQAQGYKELLIELEDDLADITGFDRMSLQPNSGAQGEYTGLRVIRAYLESQGQGHRNICLIPVSAHGTNPASAVMSGMKVVAVKCKKDGELDLVDLAAKAEKHKDNLAAFMVTYPSTFGVFEPGVKEAIDIVHKNGGQVYMDGANMNAQIGLTSPGEMGADVCHLNLHKTFCIPHGGGGPGMGPIGVKSHLAPFLPAHPVVEMSEVTGLSTEKSIQPVSAAPFGSASILPISWAYIKLMGATGLLKATEIALLNANYMKKRLEPHYPILYTNNKDKCAHEFILDMRPFKASSGIEAIDIAKRLQDYSFHGPTMSWPVANTLMVEPTESESLAELDRFCDALISIRQEIKEIEDGKIPRENNVLKNSPHPQQDLLAETWDRPYTREQAAYPVASLREKKFWPSVARVDDTFGDLNLFCTCEPPALEE

SEQ ID NO: 2796 - DNA, 4878 bp, Aspergillus nidulans FGSC A4
  CDS (1)..(4878)
atggccgcgtccttgtgcctgcgtggctctcgccagctcgctctgcgctctcaattgcgctcaattcacccctccatcacgcgcagcagactcctcccaacataccgtgccgtgcacagctcatcacaacaatcgcactccgctaggcgccccatctacactagctcagtggcggaccacggagtccctcatcctcgcgatgtttttcagcccgtagatacgtttcctcggcgccacattggcccttcgccagaagccgctgaggagatgctcgccgttcttgaccctccggtcaaatctctcgacgagttcgtcaaacaggtgctcccggctgatatcctctcgaagaaggatctggccgtcacggctccaagcgccgacaatggcctgccgcggagcagtgttcatggtggattgggagagacggacatgctgaagttgttggacaaataccgggaacagattgacgtcagcgggaagacatacattggtgctgggtactaccccacaattgtgcctccagtgatcctccgaaacatcctcgagaacccggcgtggtatactagctacactccttaccaaccggagatcagtcaggggcgtctggagtcgctcttgaacttccagaccttgaccgcggatttgaccgggctcccgttcgccaatgcctcagttttggacgaggccactgcggcggccgaggccatgaccatgtcgttggccacccagccccttgcgaagcagaagaaggccggtaagacctacgttgtctctcatctgtgccaccctcagaccgttgcggtgatgcgctcgcgtgcggaaggatttgggatcaacctagtcattggggacattctggccgacgacttcaagatcgttaaggaccaaggggataacctgatcggtgttctggcacagtatcctgacaccgagggtggaatctacgatttccagggcttgagcgatgccattcacactgctggcggtacctttagcgtggccaccgacctgctcgctttgaccgtcctgaaagcgcccggcgagttcggcgccgacattgcttttggtaacgctcagcgatttggtgttcctatgggctacggtggtcctcatgccgccttctttgcctgcgctgacaaatacaagcgcaaggttcccggccgtgttgtcggtgtgtccaaggaccggctcggtaaccgtgcgctaagactggcgctccaaacccgagagcagcacattcgtcgcgaaaaggcaaccagcaacatctgtacggctcaggccctccttgccaacatgagtgccatgtacgctgtttaccacggcccttctgggctgaagaccatcgcccagcgcatcatgtcgatgactgccgctttgcgggagagacttgcggctttgggctacaacgtccctgccaagtccaacgtctctgacggtgctgcggttttcgatactatcacgatcgaattctcgaacagtgaagaggccgatgctattattgctgctgcccgtcagaactcgatcttcctccggcgcgtctctgctaccaaggtcggaatctctctcgatgagactgctggccgcgaagagctcaaggccattctgcaggtcttttccgctcacgccaaagccgaggctgctcttgaccaggaactcggccttgcttctatcccagcgagcctggagcgtacttccgcctacctcacccaccccgtcttcaacacccatcactcggaaacggagatgctgcggtacatccgccacctggagtccaaggacttgtctctcgcccactctatgatccctcttggctcctgcactatgaagcttaacgctacgaccgagatgattcctgtctcatggcccgagttctcgcagatgcacccgttccttcctgcagatgtcgccaaaggatacacccagatgattgatgacttggagcagcagttggccgacatcactggaatggccgaggttacggtccagccgaactctggcgcccagggcgaattcgcaggtctgcgtgttatcaagaagtaccaggaagcgaccggcagttctaagcgcaatatctgtctgatcccggtttctgcgcacggtactaatcctgctagtgccgctatggcaggtatgaaggttgtaacgatcaagtgtgacaccaagacgggcaatcttgatctggacgatctgaaagccaagtgcgagaagcataaagatgagctagctgctatcatgattacctaccccagcacattcggagtgtacgagcccggcgtcaagaaggcttgcgaccttgtgcaccagtatggtggccaggtgtatatggacggtgccaacatgaacgctcagattggcctctgctctccgggcgaaattggtgccgatgtctgccatctgaacctgcacaagactttctgcattccccacggcggcggtggccccggtgttggtcctattggtgttgcagagcatcttcgtccctaccttccctctcaccccaacagcgaatacctccagtccaaacgaactgagaaatcctcgccgccgatcagcgctgcgccttggggtagcgccagtatccttcctatcaccttcaactacattaacatgatgggctccaaaggcttgacccacgccactaagatcaccctcctcaacgctaactacatcctgtcacgcctcaaagaccactaccccatcctctacaccaacgacaacggccgctgtgcgcacgagttcatcctcgacgtccgcaagttcaaggacacctgcggtattgaagccattgatatcgccaagcgtctacaggactatggcttccacgccccgaccatgtcctggccggtggcaaacactctcatgatcgagcccacggagtcggagaacaaggccgagctcgaccgcttctgcgatgctctcatctcgatccgcaaggagatcgccgccgtggagagcggtgagcagccgcgtgatggcaacgtcctccgaatggcgcctcacacccagcgcgacctcttggcgacagagtgggatcgcccgtacacccgcgagcaggcggcctaccctcttccttaccttctcgagaagaagttctggccctccgtgacgcgagtcgatgatgacgcaatcggaggcagccgtcgtctgccaggaacctcacgaagccaatgcggagttcgccatccgcgctgctccaccctctccgatataaaggcctcgaccttctctggtagcctggaaagtcaccgaagtgctgcccgaagccgcctaggtcctagcccagacctctgccaggatatggaatctaagatcactttgttttacggaacgtttgtggacctccctcgaaccaggtcaggcgagaagcatgagctcgcaatcagacatggtgcgatctgggtatcatcggctaccggccggatccagggattcgactggagtatcgcaaacgaggcagagctgcagtccttgctcaggaagaaaggctggaccggagtcccgataatacgcgcactagagcaagagaatgagttcttttttcccggtttcatcggccttttcggctcgtcaaccctcctcgattggttggagacatatacatttcccctcgagagctctatgagcaaccttgataaagcccgcaccgcatacaacgccgtcatctcccgcactctcgccaacgggactacctgtgcctcctactatgcaaccatccatgtccccgccacaaacctgctagcgagtctctgccacacccgcgggcagcgagccctcatcggccgcgtctgcatggataatccagccttttgtccggactactaccgtgatgaatccgcagaggcgtctattgagcttacaaaagagacgatagcacatatccattctcttccagatagtgataaggaaagtgagagactagtcaagccgattatcacaccacgcttcgccccaacctgttccacctcagcacttacctcgctcggccagctcgctgcatcccacactccacccctgcacatccaaacacacatctccgagaacccgaacgaagtcagtctcgtccagtccttgttcccagaacacccgtcctacgccgctgtctacgacgcgtgttcccttctaacccatcgcacgatcctcgcgcacgcggtccatctcacccagcccgaaaaagaactcattgcgtcgcgaaacgccaaaatcagccactgcccggcttctaactctgcccttggatctgggttagcgccagtaagggacctgattgataatggaatcaccgtaggcctgggtacggatgtttcgggcgggtatagcccaagtatccttgaggctgtgaggcaagcttgtctcgttagtaggctgctcaggcacagcacggcatcgacgtcgtcctcgggaaatagcacccaaaacgagacagaagggagggaggtcctctccgtcgaggaggcgctgtaccttgcaacgcgcggcggggccgcagttatcgacatgcccaatgagctaggaggattcgaggtgggaatgttctgggatgtgcagcttatccgacttggagcaacagtccaggaaacgccgcagactggttctcattccgactcccgctccgttgttgatatcttcggctgggagtcctgggctgagaaggttcataagtgggtttggaccgggaatgatcggaacgtgaggcgggtatgggtggggggtgcggttgttcatgatcttgatgatggtagctgcgttggtgaggagaccatgcttggaagctggtttggaaagagccttcagcgagattggacgcggtgggctgttgcaagtgtcggggtggcaatactagggtttgctatagggaggagaagcctaggttcacgatga

SEQ ID NO: 2797 - protein, 1625 aa, Aspergillus nidulans FGSC A4
MAASLCLRGSRQLALRSQLRSIHPSITRSRLLPTYRAVHSSSQQSHSARRPIYTSSVADHGVPHPRDVFQPVDTFPRRHIGPSPEAAEEMLAVLDPPVKSLDEFVKQVLPADILSKKDLAVTAPSADNGLPRSSVHGGLGETDMLKLLDKYREQIDVSGKTYIGAGYYPTIVPPVILRNILENPAWYTSYTPYQPEISQGRLESLLNFQTLTADLTGLPFANASVLDEATAAAEAMTMSLATQPLAKQKKAGKTYVVSHLCHPQTVAVMRSRAEGFGINLVIGDILADDFKIVKDQGDNLIGVLAQYPDTEGGIYDFQGLSDAIHTAGGTFSVATDLLALTVLKAPGEFGADIAFGNAQRFGVPMGYGGPHAAFFACADKYKRKVPGRVVGVSKDRLGNRALRLALQTREQHIRREKATSNICTAQALLANMSAMYAVYHGPSGLKTIAQRIMSMTAALRERLAALGYNVPAKSNVSDGAAVFDTITIEFSNSEEADAIIAAARQNSIFLRRVSATKVGISLDETAGREELKAILQVFSAHAKAEAALDQELGLASIPASLERTSAYLTHPVFNTHHSETEMLRYIRHLESKDLSLAHSMIPLGSCTMKLNATTEMIPVSWPEFSQMHPFLPADVAKGYTQMIDDLEQQLADITGMAEVTVQPNSGAQGEFAGLRVIKKYQEATGSSKRNICLIPVSAHGTNPASAAMAGMKVVTIKCDTKTGNLDLDDLKAKCEKHKDELAAIMITYPSTFGVYEPGVKKACDLVHQYGGQVYMDGANMNAQIGLCSPGEIGADVCHLNLHKTFCIPHGGGGPGVGPIGVAEHLRPYLPSHPNSEYLQSKRTEKSSPPISAAPWGSASILPITFNYINMMGSKGLTHATKITLLNANYILSRLKDHYPILYTNDNGRCAHEFILDVRKFKDTCGIEAIDIAKRLQDYGFHAPTMSWPVANTLMIEPTESENKAELDRFCDALISIRKEIAAVESGEQPRDGNVLRMAPHTQRDLLATEWDRPYTREQAAYPLPYLLEKKFWPSVTRVDDDAIGGSRRLPGTSRSQCGVRHPRCSTLSDIKASTFSGSLESHRSAARSRLGPSPDLCQDMESKITLFYGTFVDLPRTRSGEKHELAIRHGAIWVSSATGRIQGFDWSIANEAELQSLLRKKGWTGVPIIRALEQENEFFFPGFIGLFGSSTLLDWLETYTFPLESSMSNLDKARTAYNAVISRTLANGTTCASYYATIHVPATNLLASLCHTRGQRALIGRVCMDNPAFCPDYYRDESAEASIELTKETIAHIHSLPDSDKESERLVKPIITPRFAPTCSTSALTSLGQLAASHTPPLHIQTHISENPNEVSLVQSLFPEHPSYAAVYDACSLLTHRTILAHAVHLTQPEKELIASRNAKISHCPASNSALGSGLAPVRDLIDNGITVGLGTDVSGGYSPSILEAVRQACLVSRLLRHSTASTSSSGNSTQNETEGREVLSVEEALYLATRGGAAVIDMPNELGGFEVGMFWDVQLIRLGATVQETPQTGSHSDSRSVVDIFGWESWAEKVHKWVWTGNDRNVRRVWVGGAVVHDLDDGSCVGEETMLGSWFGKSLQRDWTRWAVASVGVAILGFAIGRRSLGSR

SEQ ID NO: 2798 - DNA, 3000 bp, Candida albicans SC5314
  CDS (1)..(3000): transl_table=12
atgtttaccaagtcaacgattaggactgtcttgaggtctttggcaacaaaggcaaacacgtcgtcagaaaactttgctaaagtccttaacccaaaagtgtcgtttgataatctcgatgtatttgctcgaagacatataggaccaacgcccaaagaggtgcaaaaaatgttatcttcattggggtacaatgatttggatgagtttttatcaaacgttgttccggaacatattttgatcaagagaaagttaagtgtgcaaccagaaaagggttttactgaatcagaaatgttggatcatttgcataaattagctaataaaaacaaaataaagaaatcattcattggtaaaggttatgcgggaacacttttgccacccgtaattcaaagaaaccttcttgaatcccctgagtggtacacttcgtatactccttatcaaccagaaatttcccaaggaagattaaactcattattgaattaccaaaccatgatctgttcacttacaggaatggcaatggctaatgcctccttgttagatgaaggtactgctgctggtgaagccatggctttgtcattccacaactcaaaagacaagaaaaagatttacgtggttgatgccaatcttcatcctcaaactgtggatgttataaaatccagagccgaaaatattggtgttgaaattgttgaaatacctttagctactaaacaaggggttgaagaattatctagaattgctgataaagtctgtggtgcattggttcaatatccagataccaatggagaaataactgatttcaccgaaatcggtaatattttgcattctaataaagctcttttcgccatggctactgatttattggctttgactgttctcaaaccaccaagtgaatttggagctgatattgcattgggtacttctcaaagatttggtgttccatttggttatggtggcccacacgctgcatttttcgctacttcatctaaatatgcgagaaagattccaggaagaatagtgggtgtctcaaaagacagattgggtaatccagctttacgtttagcattgcaaactagagagcagcacattaaaagagaaaaagccacttcaaatatttgtactgcccaagccttattggccaatatttctgccaattatgctgtttatcatggtcctcaaggattgaaaaacattgccaacagagtttatggtttcacaacattattagctaatgaaatctccaaaaagcatcaattggtcaacaacaaatggtttgataccttgactgttaagttgaatggtgtttcttcagatgaaattttagctaaagctttgaatgaatacgatatcaacatgtttagagttgatgaatccacggtatcattgcaattagatgaaacagtccaaaagcaggatttgatcaatttagtcaatgttttcactggtcaagaaaactattctccagatgaattgccagctattcctcaagaattattgagatctgatgaaattttaacaaatgaagtttttaatgcccatcattcagaaacagcaatgttaagatacttgcactctttacaaagaatggatttgtcattggctgatagtatgatcccattgggttcttgtactatgaaattaaacgccactgtggaaatgcagactttgtctattcctggattcaattcaattcacccatttgccccaattgaccaagctcaaggttataaggaattaattgatgaatttgaaaaggacttgaatgacatcactggtttcgatggaactacttcgatgcccaactctggtgctcaaggtgaatacacagggttgtctttaattagagaatatcatagatctcgtggtgaacatgaccaaagaaacatttgtttgattccagtcagtgctcatggaaccaacccagcatcagctgctatgtgtggattgaaagttgttccagtcaaatgtttatctaatgggtccattgatttggaagatttagaggcaaaagctgccaaacatgctaaaaatttgtgttcaatcatgattacctacccatctacttatggtttattcgaaccgggtgttaagaaagccattgatattgttcatgccaacggtggtttggtttacttggacggtgccaacatgaatgcccaagttggtttaacttctcctggtgatttgggtgctgatgtttgtcatttgaatattcacaaaacatttgcattaagtcatggtggtggtggtccaggtcaagcaccagtttgtgttaaagaacacttgaaaccattcttaccaaaacatcattttgtcaatactccacattcgaccagtgaatcgatcaaagccgtcaactcagctccatatggtagtgcatcggttattcccgtttcatattcatacatcaagatgttgggagcacaagctttaccatatgtttctgctattgctatgttgaatgccaattatattttaaccaaattagaaccacattataagatcttgtttgttgaccgtgatgcctcatctgaaagtggtaccaagcattgtgcacatgagtttattcttgatttacgtgaattccaaaagattggcattgaagccattgatgtggctaaaagattacaggattacggattccatgcaccaaccatgtctttcccagttgctggaactttgatgattgagcctactgaatctgaaaatttgcgtgagttagacagatttattgattcattgatttcaatcagaaaagaaattgaagcctaccaaaataaggaaccattaggacaagtcttgaaaaatgccccacattcattggaagacattgttagctcagaagattgggatgcaagaggctacactagagaacaagctgcttacccattaccattcttaaagaaaaacaagtgttggccaactgttagtcgtttgaacgatacgtatggtgatttgaatttaatctgtacatgtccttcagttgaagaagttgctgctgaaagttag

SEQ ID NO: 2799 - protein, 999 aa, Candida albicans SC5314
MFTKSTIRTVLRSLATKANTSSENFAKVLNPKVSFDNLDVFARRHIGPTPKEVQKMLSSLGYNDLDEFLSNVVPEHILIKRKLSVQPEKGFTESEMLDHLHKLANKNKIKKSFIGKGYAGTLLPPVIQRNLLESPEWYTSYTPYQPEISQGRLNSLLNYQTMICSLTGMAMANASLLDEGTAAGEAMALSFHNSKDKKKIYVVDANLHPQTVDVIKSRAENIGVEIVEIPLATKQGVEELSRIADKVCGALVQYPDTNGEITDFTEIGNILHSNKALFAMATDLLALTVLKPPSEFGADIALGTSQRFGVPFGYGGPHAAFFATSSKYARKIPGRIVGVSKDRLGNPALRLALQTREQHIKREKATSNICTAQALLANISANYAVYHGPQGLKNIANRVYGFTTLLANEISKKHQLVNNKWFDTLTVKLNGVSSDEILAKALNEYDINMFRVDESTVSLQLDETVQKQDLINLVNVFTGQENYSPDELPAIPQELLRSDEILTNEVFNAHHSETAMLRYLHSLQRMDLSLADSMIPLGSCTMKLNATVEMQTLSIPGFNSIHPFAPIDQAQGYKELIDEFEKDLNDITGFDGTTSMPNSGAQGEYTGLSLIREYHRSRGEHDQRNICLIPVSAHGTNPASAAMCGLKVVPVKCLSNGSIDLEDLEAKAAKHAKNLCSIMITYPSTYGLFEPGVKKAIDIVHANGGLVYLDGANMNAQVGLTSPGDLGADVCHLNIHKTFALSHGGGGPGQAPVCVKEHLKPFLPKHHFVNTPHSTSESIKAVNSAPYGSASVIPVSYSYIKMLGAQALPYVSAIAMLNANYILTKLEPHYKILFVDRDASSESGTKHCAHEFILDLREFQKIGIEAIDVAKRLQDYGFHAPTMSFPVAGTLMIEPTESENLRELDRFIDSLISIRKEIEAYQNKEPLGQVLKNAPHSLEDIVSSEDWDARGYTREQAAYPLPFLKKNKCWPTVSRLNDTYGDLNLICTCPSVEEVAAES

SEQ ID NO: 2800 - DNA, 3000 bp, Candida albicans SC5314
  CDS (1)..(3000): transl_table=12
atgtttaccaagtcaacgattaggactgtcttgaggtctttggcaacaaaggcaaacacgtcgtcagaaaactttgctaaagtccttaacccaaaagtgtcgtttgataatctcgatgtatttgctcgaagacatataggaccaacgcccaaagaggtgcaaaaaatgttatcttcattggggtacaatgatttggatgagtttttatcaaacgttgttccggaacatattttgatcaagagaaagttaagtgtgcaaccagaaaagggttttactgaatcagaaatgttggatcatttgcataaattagctaataaaaacaaaataaagaaatcattcattggtaaaggttatgcgggaacacttttgccacccgtaattcaaagaaaccttcttgaatcccctgagtggtacacttcgtatactccttatcaaccagaaatttcccaaggaagattaaactcattattgaattaccaaaccatgatctgttcacttacaggaatggcaatggctaatgcctccttgttagatgaaggtactgctgctggtgaagccatggctttgtcattccacaactcaaaagacaagaaaaagatttacgtggttgatgccaatcttcatcctcaaactgtggatgttataaaatccagagccgaaaatattggtgttgaaattgttgaaatacctttagctactaaacaaggggttgaagaattatctagaattgctgataaagtctgtggtgcattggttcaatatccagataccaatggagaaataactgatttcaccgaaatcggtaatattttgcattctaataaagctcttttcgccatggctactgatttattggctttgactgttctcaaaccaccaagtgaatttggagctgatattgcattgggtacttctcaaagatttggtgttccatttggttatggtggcccacacgctgcatttttcgctacttcatctaaatatgcgagaaagattccaggaagaatagtgggtgtctcaaaagacagattgggtaatccagctttacgtttagcattgcaaactagagagcagcacattaaaagagaaaaagccacttcaaatatttgtactgcccaagccttattggccaatatttctgccaattatgctgtttatcatggtcctcaaggattgaaaaacattgccaacagagtttatggtttcacaacattattagctaatgaaatctccaaaaagcatcaattggtcaacaacaaatggtttgataccttgactgttaagttgaatggtgtttcttcagatgaaattttagctaaagctttgaatgaatacgatatcaacatgtttagagttgatgaatccacggtatcattgcaattagatgaaacagtccaaaagcaggatttgatcaatttagtcaatgttttcactggtcaagaaaactattctccagatgaattgccagctattcctcaagaattattgagatctgatgaaattttaacaaatgaagtttttaatgcccatcattcagaaacagcaatgttaagatacttgcactctttacaaagaatggatttgtcattggctgatagtatgatcccattgggttcttgtactatgaaattaaacgccactgtggaaatgcagactttgtctattcctggattcaattcaattcacccatttgccccaattgaccaagctcaaggttataaggaattaattgatgaatttgaaaaggacttgaatgacatcactggtttcgatggaactacttcgatgcccaactctggtgctcaaggtgaatacacagggttgtctttaattagagaatatcatagatctcgtggtgaacatgaccaaagaaacatttgtttgattccagtcagtgctcatggaaccaatccagcatcagctgctatgtgtggattgaaagttgttccagtcaaatgtttatctaatgggtccattgatttggaagatttagaggcaaaagctgccaaacatgctaaaaatttgtgttcaatcatgattacctacccatctacttatggtttattcgaaccgggtgttaagaaagccattgatattgttcatgccaacggtggtttggtttacttggacggtgccaacatgaatgcccaagttggtttaacttctccaggtgatttgggtgctgatgtttgtcatttgaatattcacaaaacatttgcattaagtcatggtggtggtggtccaggtcaagcaccagtttgtgttaaagaacacttgaaaccattcttaccaaaacatcattttgtcaatactccacattcgaccagtgaatcgatcaaagccgtcaactcagctccatatggtagtgcatcggttattcccgtttcatattcatacatcaagatgttgggagcacaagctttaccatatgtttctgctattgctatgttgaatgccaattatattttaaccaaattagaaccacattataagatcttgtttgttgaccgtgatgcctcatctgaaagtggtaccaagcattgtgcacatgagtttattcttgatttacgtgaattccaaaagattggcattgaagccattgatgtggctaaaagattacaggattatggattccatgcaccaaccatgtctttcccagttgctggaactttgatgattgagcctactgaatctgaaaatttgggtgagttagacagatttattgattcattgatttcaatcagaaaagaaattgaagcctaccaaaataaggaaccattaggacaagtcttgaaaaatgccccacattcattggaagacattgttagctcagaagattgggatgcaagaggctacactagagaacaagctgcttacccattaccattcttaaagaaaaacaagtgttggccaactgttagtcgtttgaacgatacgtatggtgatttgaatttaatctgtacatgtccttcagttgaagaagttgctgctgaaagttag

SEQ ID NO: 2801 - protein, 999 aa, Candida albicans SC5314
MFTKSTIRTVLRSLATKANTSSENFAKVLNPKVSFDNLDVFARRHIGPTPKEVQKMLSSLGYNDLDEFLSNVVPEHILIKRKLSVQPEKGFTESEMLDHLHKLANKNKIKKSFIGKGYAGTLLPPVIQRNLLESPEWYTSYTPYQPEISQGRLNSLLNYQTMICSLTGMAMANASLLDEGTAAGEAMALSFHNSKDKKKIYVVDANLHPQTVDVIKSRAENIGVEIVEIPLATKQGVEELSRIADKVCGALVQYPDTNGEITDFTEIGNILHSNKALFAMATDLLALTVLKPPSEFGADIALGTSQRFGVPFGYGGPHAAFFATSSKYARKIPGRIVGVSKDRLGNPALRLALQTREQHIKREKATSNICTAQALLANISANYAVYHGPQGLKNIANRVYGFTTLLANEISKKHQLVNNKWFDTLTVKLNGVSSDEILAKALNEYDINMFRVDESTVSLQLDETVQKQDLINLVNVFTGQENYSPDELPAIPQELLRSDEILTNEVFNAHHSETAMLRYLHSLQRMDLSLADSMIPLGSCTMKLNATVEMQTLSIPGFNSIHPFAPIDQAQGYKELIDEFEKDLNDITGFDGTTSMPNSGAQGEYTGLSLIREYHRSRGEHDQRNICLIPVSAHGTNPASAAMCGLKVVPVKCLSNGSIDLEDLEAKAAKHAKNLCSIMITYPSTYGLFEPGVKKAIDIVHANGGLVYLDGANMNAQVGLTSPGDLGADVCHLNIHKTFALSHGGGGPGQAPVCVKEHLKPFLPKHHFVNTPHSTSESIKAVNSAPYGSASVIPVSYSYIKMLGAQALPYVSAIAMLNANYILTKLEPHYKILFVDRDASSESGTKHCAHEFILDLREFQKIGIEAIDVAKRLQDYGFHAPTMSFPVAGTLMIEPTESENLGELDRFIDSLISIRKEIEAYQNKEPLGQVLKNAPHSLEDIVSSEDWDARGYTREQAAYPLPFLKKNKCWPTVSRLNDTYGDLNLICTCPSVEEVAAES

SEQ ID NO: 2802 - DNA, 3240 bp, Ustilago maydis 521
  CDS (1)..(3240)
atggctccttcgctcctcgtccgatcgcgcgtcgtcgcttctcggtctatccgaagcacgccactcgccgcgactttgcgtcttaccctaggctccaacgctcgtctttacacggtcgctgccgctccagcagctgtgcgcgcacaacgccgtggcctcgccacgctgagctctaccgagaatgcgcccgagctgggcgctcgccacgtcgccaagtctatctttgctcctctcgatacctttgagtctcgccatatcggccctcgcgatcacgactcggccaaaatgctcgaggcgctcggttactcggagatggagcagctcatagctgacactgtctcgcctagcgtccgtctcgctcaagacgcttccttctacgaccagatcaagcctctctccgagagcgagctcgctcagcgcgcagagacaatcgcaaagatgaaccgtcccttcaagagcctcatcggtatgggctaccagaacacgctcgtgcctcccgtcatcctccgcaacgtccttgaaaaccccgcctggtacacgagctacactccttaccagcccgaaatctcccagggccgtctggagtcgcttatcaacttccagaccatggtcaagtcactcaccggtctcgacctcgccaacgcctcgcttctcgacgaaggcaccgccgctgccgaggccatgattctcgcttatggtcaaacaaagagcaagagaaagaccttcctcgtcgatcgtggggttctaccccagaccctcgctgtgcttcgtcagcgagccaagggtttcggcatcaatgtggtcgccaccgatctccgtactccagaaggccaccgtctgccccctgccgatcagattccacgcgacgatatcatcggtgcccttgttcagtaccctgacgtcgacggacgcatcaccgactgggaagcgcttgcaaacgagatcaagggtttcggaggtatggtgattgctgccaccgatctgcttgcgcttaccatgatcaagcctcccggtgagtggggcgccgacattgctcttggaaacgctgctcgcttcggagtgcctcctggtttcggtggtcctcacgccgccttctttgcggttcgtgactcgatcaagcgcaagatccccggtcgtctcgtaggtctcagcaaggacgctcgcggtgggcccgcctaccgactcgctcttcagacgcgagagcagcacattcgccgtgagaaggccacctccaacatctgcactgcccaggcgcttctcgccaacatgtcggccatgtacgccgtctaccacggccccgatggactgcgtaagatcgctgctaagacgcatgcgcttacccgtctgctcaagcacgagctcaccgagctcggcgtccgcgttgtcaatcgcgacggtgcctttttcgacacgctcaccatcgacctcagcaaggccggtatcggtgcggtacgcattcatgaggaggccaagaaagccgagatcaacctgcgcaggatcagcgacacccgaatcggcatcacactcgacgagacagtcagcatcgaggagcttaccgacgtgctcaacgtctttgcctatgccctcaagcccgccaagactggcgaggtgccctacaagcctgcggacctgatcgagattgcctctcgtatcggcctggacgctgcctccaccgagacgctgaccatctcgacgcctgtcaaggtccgtcccaacaacgcaactgctgaatcgtcggatctgccgcccgtccccgactttgctcgtacctcgaaattcctccagcagcccgtcttctcggcgcaccgcagcgaaacacagatgctccgctacattcactcacttcaggccaaggatctatcgctcgtacacgccatgatcccgcttggatcgtgcacgatgaagctcaactcgacctctagcatgatgctcatctccaagcccgaattttcgcagcttcacccgtttgctcccgaagaccaagctcagggctatgacgttcttatccgagaacttgagcgtgacctttgcctgatcaccggctttcccgctgtttcgctgcagcccaactcgggtgcacagggtgagtttgccggtctttcggtcatccgtgcctatcacgagtccaagggtcaaggcaagcgcgacgtttgcctgattcccacttcggctcatggtaccaaccccgcatcggcgatcatggctggtatgcgagtcgtgcctgtcaagaccaagcctgacggctcgatcgatcttgaggaccttcgagcgaaagccgaactgcacaaaaacgagctggcggccacgatgatcaccgagccggctaccaccggatgctactttaaggatatccaagaggctttcaaggttgtccacgataacggcggtcaggtgtacttggatggtgccaacctgcaggcgcaagtggcgctcaccaacccggccatcatgggtgccgatgtgacccacttgaacctgcacaagaccttctcaattccacacggtggtggaggacctggtgtgggaccgatctgcgtcgccgagcacctggcacccttcttgcctggtcaccctcttgcctctacgggtggcgagatggcgatcaacccgatctctgctgctccttggggatcggcttcgattctcacgattgcgtgggcttacatcaagatgctcggatggggaggactcaaaaagtcgaccgagacggcgttgctcgccgccaactatgtcgcacaccgactcaaggatcattacaagctcaagtacacaggcgaccgcgggcgtgtcgcgcacgagctgctgatcgacgtggccgaattcgaagacgttgggctcaaggtgatggactttgccaagcgtctgattgactatggcttccatccacccacgtgttcgtggcctatctcgacgggtttgctgatcgagatcaccgagtccgagtcgctgcaggagatcgataggttgatcgaggcgtttatttcgattcgtcatgaggtcgaggagatccgtgcgggcaagcagccaaaggacaacaatttgctcaagaatgctccgcacaccatgcaggcggtcacggaggacaagtgggagcgaccgtacagcagggagcgcgccgtcttcccggtaaacgagctcaggcagaacaagttctggcctcccgtagccaggatcgatgatgcgtttggcgatcgcgtccttgtatgcgagtgtggaggtgtagaagactatgtcaactga

SEQ ID NO: 2803 - protein, 1079 aa, Ustilago maydis 521
MAPSLLVRSRVVASRSIRSTPLAATLRLTLGSNARLYTVAAAPAAVRAQRRGLATLSSTENAPELGARHVAKSIFAPLDTFESRHIGPRDHDSAKMLEALGYSEMEQLIADTVSPSVRLAQDASFYDQIKPLSESELAQRAETIAKMNRPFKSLIGMGYQNTLVPPVILRNVLENPAWYTSYTPYQPEISQGRLESLINFQTMVKSLTGLDLANASLLDEGTAAAEAMILAYGQTKSKRKTFLVDRGVLPQTLAVLRQRAKGFGINVVATDLRTPEGHRLPPADQIPRDDIIGALVQYPDVDGRITDWEALANEIKGFGGMVIAATDLLALTMIKPPGEWGADIALGNAARFGVPPGFGGPHAAFFAVRDSIKRKIPGRLVGLSKDARGGPAYRLALQTREQHIRREKATSNICTAQALLANMSAMYAVYHGPDGLRKIAAKTHALTRLLKHELTELGVRVVNRDGAFFDTLTIDLSKAGIGAVRIHEEAKKAEINLRRISDTRIGITLDETVSIEELTDVLNVFAYALKPAKTGEVPYKPADLIEIASRIGLDAASTETLTISTPVKVRPNNATAESSDLPPVPDFARTSKFLQQPVFSAHRSETQMLRYIHSLQAKDLSLVHAMIPLGSCTMKLNSTSSMMLISKPEFSQLHPFAPEDQAQGYDVLIRELERDLCLITGFPAVSLQPNSGAQGEFAGLSVIRAYHESKGQGKRDVCLIPTSAHGTNPASAIMAGMRVVPVKTKPDGSIDLEDLRAKAELHKNELAATMITEPATTGCYFKDIQEAFKVVHDNGGQVYLDGANLQAQVALTNPAIMGADVTHLNLHKTFSIPHGGGGPGVGPICVAEHLAPFLPGHPLASTGGEMAINPISAAPWGSASILTIAWAYIKMLGWGGLKKSTETALLAANYVAHRLKDHYKLKYTGDRGRVAHELLIDVAEFEDVGLKVMDFAKRLIDYGFHPPTCSWPISTGLLIEITESESLQEIDRLIEAFISIRHEVEEIRAGKQPKDNNLLKNAPHTMQAVTEDKWERPYSRERAVFPVNELRQNKFWPPVARIDDAFGDRVLVCECGGVEDYVN

SEQ ID NO: 2804 - DNA, 2859 bp, Silicibacter pomeroyi DSS-3
  CDS (1)..(2859): transl_table=11
atggccttcaaactcaccgattacgaagcttacgatttcgccaaccgccgccatatcggacccagcccgcgcgagatggccgatatgttgcaggtgatcggcttcaagacgctcgaccagctgatcgacgccaccgtgccgccgtcgatccggcagaaagaggcgctggactggggtccggccatgaccgagcgcgacgcgctctatcacatgaaacaggtcgcctcgaagaacaaggttctgacttcgctgatcggccagggctattacggcaccaccaccccggcgccgatcctgcgcaatatcctggaaaacccggcctggtacaccgcctataccccctatcagcccgagatcagccagggccggcttgaggcgctgttgaacttccagaccatggtcagcgatctgaccgggctcgacgtggccaacgcctcgctgttggacgaggccaccgcggcggccgaggcgatggccatggcgaaacgctccagccggtccaaggccaacaacgcggccttcttcgtcgacaagaactgtcacccccaaaccgtcgcggtgatccgcacccgggccgagcccttgggcgtggatgtgcaggtgggcgacccctccgagctggaggccggcgcggtgtttggcgccatcttccagtatcccggcacctatggccatgtgcgcgattacaccgccgagatcgcggcgctgcacgagcacaacgccatcgccatcgtcgcggccgacatcctgtcgctggcgctgctgaaatcgcccggcgagatgggcgccgatatcgccatcggctcgacccagcgctttggcgtgccgatgggctatggcggcccgcacgcggcctatatggccaccaccgacaagcttaagcgtgccatgccgggccggatcatcggcgtcagcatcgacgcgcgcggcaacaaggcctatcgcctggcgctgcagacccgcgaacagcatatccgccgcgaaaaggccaactcgaacgtctgcaccgcccaggcgctgctggcggtgatggcctcgatgtatgcggtctatcacggtccggacgggatcaaggcgatcgcgcaatccgtgcaccgcaagacctcgcgcctggccgccgggcttgaggagcacgggttcaaagtagcgccagaagtattctttgacaccatcacagtcgatgtcggccccctgcaaaagacggtgatcgaggccgccgtggcgcgtggtgtcaacctgcgcaaggtgggcagtgaccggatcggcatttctctggacgaacagacccgctcggaaaccatcgaggcggtctggggtgccttcggcatcgacaagaaggatgacagcgtcaagaaccgtgcctatcgcctgcccgattacgcgctgcgcgagacgccctatctgacccatcccatcttccacaagaaccgggccgaggccgagatgacccgctatatgcggcgtctggccgaccgcgacctggcgctggaccgggcgatgatcccgctgggcagctgcaccatgaagctgaatgccaccatcgagatgatcccggtgacctggccggaattcgcaaacctgcaccccttcgtgcccgaggatcaggcgcagggctatctcgagatgatcgacgacctgtccgagaaactgtgccagatcaccggctatgacgcgatctcgatgcagcccaattcgggcgcgcagggtgaatatgcgggcctgatgaccatccgcaactatcacgcggctcaggggcagggacaccgcaacatctgcctgatccccacttcggcgcatggcaccaacccggccaccgcgcagatggtgggctatcaggtggtgccggtccgctcggacgatcacggcaatatcgacctggccgatttccgcgccaaggccgagcagcacagcgccaatctggcggcctgcatgatcacctatccctcgacccatggcgtgttcgaggagaccgtgcgtgaggtttgcgacatcacccatgaacatggcggtcaggtctatatcgacggggccaatatgaacgcgatggtgggtctggcgcagccaggcgagatcggcggcgatgtgagccacctgaacctgcacaagaccttctgcattccgcatggcggcggcggccccggcatgggtccgatcggggtcaaggcgcatctggccgaacatctgccgggccatcctgaatatggcacggcggtgggcccggtgtcggcggcgcctttcggctcgccctcgatcctgccggtcagctgggcctatgttctgctgatgggcggcgcaggcctgacccaggcgaccaaggtggcgatcctgaacgccaactacatcgccgcacggctcaaggatgcctatccgatcctctacacctcggcgacggggcgggtggcgcatgaatgcatcctcgacacccggccgctgaacgacgagggcggcgtgagcgtggatgacgtggccaagcggttgatcgacagcgggttccacgcgccgacgatgagctggccggtggcgggcacgctgatggtcgaacccacggaatccgaacccaaggacgagctggaccggttctgcgaggccatgctgtcgatccgcgccgaggcgcaacagatcatcgacggcaagatcgaccccgaaaacaacccgctcaaacacgccccccatacggtgcgtgacctggtgggggactgggaccggccctacagccgtgaacaggcctgcttcccgccgggcaacctgggtgtcgacaagtactggccggtggtgaaccgggtcgacaacgcctatggcgaccgtcaccttgtctgcacctgcccgccgatggatgcctatgaagaggccgccgaatag

SEQ ID NO: 2805 - protein, 952 aa, Silicibacter pomeroyi DSS-3
MAFKLTDYEAYDFANRRHIGPSPREMADMLQVIGFKTLDQLIDATVPPSIRQKEALDWGPAMTERDALYHMKQVASKNKVLTSLIGQGYYGTTTPAPILRNILENPAWYTAYTPYQPEISQGRLEALLNFQTMVSDLTGLDVANASLLDEATAAAEAMAMAKRSSRSKANNAAFFVDKNCHPQTVAVIRTRAEPLGVDVQVGDPSELEAGAVFGAIFQYPGTYGHVRDYTAEIAALHEHNAIAIVAADILSLALLKSPGEMGADIAIGSTQRFGVPMGYGGPHAAYMATTDKLKRAMPGRIIGVSIDARGNKAYRLALQTREQHIRREKANSNVCTAQALLAVMASMYAVYHGPDGIKAIAQSVHRKTSRLAAGLEEHGFKVAPEVFFDTITVDVGPLQKTVIEAAVARGVNLRKVGSDRIGISLDEQTRSETIEAVWGAFGIDKKDDSVKNRAYRLPDYALRETPYLTHPIFHKNRAEAEMTRYMRRLADRDLALDRAMIPLGSCTMKLNATIEMIPVTWPEFANLHPFVPEDQAQGYLEMIDDLSEKLCQITGYDAISMQPNSGAQGEYAGLMTIRNYHAAQGQGHRNICLIPTSAHGTNPATAQMVGYQVVPVRSDDHGNIDLADFRAKAEQHSANLAACMITYPSTHGVFEETVREVCDITHEHGGQVYIDGANMNAMVGLAQPGEIGGDVSHLNLHKTFCIPHGGGGPGMGPIGVKAHLAEHLPGHPEYGTAVGPVSAAPFGSPSILPVSWAYVLLMGGAGLTQATKVAILNANYIAARLKDAYPILYTSATGRVAHECILDTRPLNDEGGVSVDDVAKRLIDSGFHAPTMSWPVAGTLMVEPTESEPKDELDRFCEAMLSIRAEAQQIIDGKIDPENNPLKHAPHTVRDLVGDWDRPYSREQACFPPGNLGVDKYWPVVNRVDNAYGDRHLVCTCPPMDAYEEAAE

SEQ ID NO: 2806 - DNA, 2874 bp, Thermobifida fusca YX
  CDS (1)..(2874): transl_table=11
atgtcggaccgttctgtttcccgtccccctgcgctcacgttcccggaccggcacatcggccctgacccggcggaacgtgccgccatgctggagacggtgggatacgcgtccaccgcagacctcatgaccgcggccctgcccgccgacattctcaccgcccctgatgctcccgcgcctttgcgcctgccggaaccggtgggggaggccgaggtgctcgcggaactgcgggctcttgccgcccgcaaccgcctgctggtctccatgatcggccagggctactacggtacggtcacccctccggtgatccgccgcaacatcctggaaaaccctgcctggtacaccgcctacaccccctaccagccggagatctcccaggggcggcttgaggcgctgctgaacttccagaccatggtcgccgacctgaccgggctgcccattgccggagcctccctgctggacgaggccaccgcggcggccgaggcgatgacgttggctcgccgggtggacaaagggaagcggtcggtgttcgtggtcgacgccgacgtgttcggccacacgctggccgtgctgcggacccgggccgaaccgttggggatcgacctggtcgtcgctgacctgagtgcaggactgccggatgtggacgcgttcggggtcctcgtgcagtatccggcggccagcggccaggtacgggacctgcgcccggtggtggacgccgcccacgaacggggcgcgctcgtcgtcgtggccgctgacctgctggcgttgaccgtgctccgcagccctggagagttcggtgcggacgtggctgtgggctccacccagcggttcggggtgcccatggggttcggcggcccgcacgccgcctacatggcagtccgggacgggctgcagcggcaacttccgggccgcctggtcggggtttccgtggacgcggcagggaaacccgcctaccggttggccctgcaaacccgggaacagcacatccgccgcgagaaagccaccagcaacatttgcaccgcccaggtgctgctcgccgtgatggcgggcatgtacgccgtctaccacggcccgcacgggcttcgcgcgatcgcggagcgggtccaccgccgcaccgcggaactcgccgccgggctgcggaagctcggggtggaggtgctcaccgacgcgttcttcgacacgctgcgggtgcgggtgccgtcccgggccgcggccgtggtgcgcaccgcgcgtgacctcggcatcaacctgttcttcgccgacgaggacacggtcggtgtctcctgcgatgagaccaccacatccgagcatgtggcggctgtgctgcgcgcgttcggggctaccaccccgccgcagaccggggacgtcccgtccgcgctgccggaagggttgcgccgcgacgtcgactacctcacccaccccgtgttccacacctaccgcagcgaaaccgcgatgctgcgctacctgcggcggctcgccgaccgggacctggcgttggaccgcaccatgatcccgttgggctcgtgcacgatgaagctcaacgccaccgcggaaatggaggcgatcacctggcccgagttcgcggaactgcacccgttcgcccccctcgaccaggcggaaggcctggtgcagatcgtgcgggacttggagacgtggctcgcggagatcaccggatacgacgcggtctccctgcaacccaacgcgggctcccaaggcgagttcgcgggcctgctcgctatccgcggctaccaccgcagccgcggtgaagagcagcgcgacatctgtctcatcccgagttccgcgcacggcactaacgcggccagcgccgtcatggcgggcatgcgggtgtctgtggtggcgtgcgacagtggcggcaacatcgacctggcggacctgcgcgccaagatcgacgctgccggggaccggctggccgcgctcatggtcacctacccttccacccacggggtgtacgaggagaccattgccgaagtgtgccggctcgtgcacgaggcgggcggccaggtctacgtggacggcgccaacctcaacgcactcgtcggctgggccaagcccgggaagttcggggcagacgtcagccacctgaacctgcacaagacgttctgcatcccgcacggcggcggtggccccggcgtgggaccggtcgcggtccgcgcccacctcgccccgttcctgccgaaccatccggcgcacaccgaggcggggccgcacacgagcgcgggcccggtggctgcggccccgttcggttccgcgagtatcctgccgatttcgtgggcctacatccggctgatgggggaggaagggctgcgtgccgccaccgaacaggcggtgcttgccgccaactatgtggcccggcggctggccccctactatccggtgctgtacatgggacgcaacggactggtggcccacgaatgcatcatcgacctgcgcggcctgcagaaacgcaccggaatcagcaacgaggacgttgctaaacggctcatcgactacggcttccacgcgcccaccatgtccttcccggtgccgggcacgctgatgatcgaaccgacggagagcgaggacctcgccgaactggaccggttcatcgacgcgatgatcgcgatccgcggcgagatcgaccgggtggcggaaggcagctacgaccgggcagacaacccgttgaagaacgctccgcacacggcagaagaagtcaccgcggacgagtggaagcacgcctactcgcggtcggaagccgcctacccggtgccgagcctgcgcgccagcaaatactgggcgccggtgggccggatcgaccaggcctacggggaccgcaacctcgtgtgcgcctgcccgcccccggaggctttcgcgcagtag

SEQ ID NO: 2807 - protein, 957 aa, Thermobifida fusca YX
MSDRSVSRPPALTFPDRHIGPDPAERAAMLETVGYASTADLMTAALPADILTAPDAPAPLRLPEPVGEAEVLAELRALAARNRLLVSMIGQGYYGTVTPPVIRRNILENPAWYTAYTPYQPEISQGRLEALLNFQTMVADLTGLPIAGASLLDEATAAAEAMTLARRVDKGKRSVFVVDADVFGHTLAVLRTRAEPLGIDLVVADLSAGLPDVDAFGVLVQYPAASGQVRDLRPVVDAAHERGALVVVAADLLALTVLRSPGEFGADVAVGSTQRFGVPMGFGGPHAAYMAVRDGLQRQLPGRLVGVSVDAAGKPAYRLALQTREQHIRREKATSNICTAQVLLAVMAGMYAVYHGPHGLRAIAERVHRRTAELAAGLRKLGVEVLTDAFFDTLRVRVPSRAAAVVRTARDLGINLFFADEDTVGVSCDETTTSEHVAAVLRAFGATTPPQTGDVPSALPEGLRRDVDYLTHPVFHTYRSETAMLRYLRRLADRDLALDRTMIPLGSCTMKLNATAEMEAITWPEFAELHPFAPLDQAEGLVQIVRDLETWLAEITGYDAVSLQPNAGSQGEFAGLLAIRGYHRSRGEEQRDICLIPSSAHGTNAASAVMAGMRVSVVACDSGGNIDLADLRAKIDAAGDRLAALMVTYPSTHGVYEETIAEVCRLVHEAGGQVYVDGANLNALVGWAKPGKFGADVSHLNLHKTFCIPHGGGGPGVGPVAVRAHLAPFLPNHPAHTEAGPHTSAGPVAAAPFGSASILPISWAYIRLMGEEGLRAATEQAVLAANYVARRLAPYYPVLYMGRNGLVAHECIIDLRGLQKRTGISNEDVAKRLIDYGFHAPTMSFPVPGTLMIEPTESEDLAELDRFIDAMIAIRGEIDRVAEGSYDRADNPLKNAPHTAEEVTADEWKHAYSRSEAAYPVPSLRASKYWAPVGRIDQAYGDRNLVCACPPPEAFAQ

SEQ ID NO: 2808 - DNA, 2925 bp, Anabaena variabilis ATCC 29413
  CDS (1)..(2925): transl_table=11
gtggtatcttatgcctctattcgtcagtctagcgatgaagctgactctaccgtggatgctagtcaaaagctagacgcaaggaaacaagatttaaataattttatacaaagacatataggcccatcatcggcagatattcaacatatgcttgatgtgttgggattctctagtctagatgacctgattgagaaaacagtaccaagcacaatcagactgcataaaaaactacagttgccaacagcacagactgagtatgcagccctggcaaagttaaaacaaattgcttctaaaaatcaggtgtttcgctcatacattggtatgggatattacgatacgattactcctccagtaattgggcgtaatatcttagaaaaccctggttggtatactgcttatactccttatcaaccagagattgcccaagggcggctagaagcactgcttaatttccaaaccatgattatcgatttaacagggttggaaattgccaatgcttccctacttgatgaagcgacagccgccgccgaagccatgagtatgagttatggtgtgagcaaaaataaggccaatgcttattttgtctctcatgattgtcatccccaaaccatcgacgttttgcaaacacgggctaaacccttggggattgagattattatcggggatcatcagacattcgatttccaaaaaccaatttttggtgcagtcttacaatatcctgccagtgatggcacaatctacgactaccgagcttttattgaaacagctcatgctcaaggtgcattggtaacggtagccgcagacccattaagcttaactttacttacccctcctggtgaatttggggctgatattgccgtaggtagcactcagcgcttcggtattcccttggggttcggtgggcctcatgcggcgtattttgccactaaagaagagtacaagcggcaagttccagggcgaattgtgggggtatctaaagatgtcaacggtaaaactgccctgcgtctagctttgcaaacccgcgaacaacatatccgccgcgaaaaagctaccagtaatatttgtacagcacaggtattactggcagtgatggcgagtatgtacgctgtgtatcacggcccagaaggactaaagcaaatcgcggagaatattcaccagctaaccgtgactttggcagaaggactaaaacgtctgggttacaaaattagttccgaacatttctttgatactctgcgggtagagttaggaacaaacaatctggaaactattctggcaggttgccaagcccgcaatattaacctgcggatttttgatgagactgctgtaggtatttctttagatgaaactactacaccagaagacctcatcgacctctggcaaatctttgctggtgaagacaacttaccctttaccccagaagaactaatatcttctctcaacctccctctccgcagcagcagctatctgacgcaccccgtcttcaaccgttatcactcagaaacggagttattgcgttatctgcataggctggaaactaaagatttgtctctaactacatcgatgattcccttgggttcctgcacgatgaagttaaacgctacatcggagatgattcccgtaacttgggaagaattcggcagaatacatccctttgcgcccttaacccaaacgcggggttatcaaattctcttccaacaacttgaggcgtggttagcagaaattactggatttgccggggttgctctccagcctaatgctggttctcaaggagaatatacaggacttttggtaattcgtcagtatcacgaaagtcgaggagaaacacaccggaatgtgtgtttaattcctacttccgcacacgggacaaacccagcaagtgcggtgatgtgtgggatgaaggttgtagctgttgcctgtgatgccggaggtaatattgatattgatgacctcaaagctaaggcagaaaaacacagccatgaactggcggcgttgatggtgacttatccctcaactcacggagtgtttgaagcgggaattcaagaaatttgtgctgtgattcatagtcatggtggccaagtttacatggatggggcaaatatgaatgcccaagtgggtatttgtcgtccaggggatattggcgcggatgtttgtcacttgaacttgcacaaaactttttgtattcctcacggtggcggtggccctggtatgggtccaattggcgttgcatcccatcttgtacggtttttacctggacatccggtattggggagtgggaaaaacccgcaaaatattggtgctgtggctgctgcgccttggggaagtgctagtattttggtgatttcatggatgtatattgccatgatgggggcggatggattgacccaagcaactaaggtggcaattctcaacgctaattacatcgctaagagattggaaacttactaccctgtgttgtacaaagggcaaaatggcctcgttgcccatgagtgtattttagatttgcgcgccctcaagaaatccgccaacatcgaaattgatgatatagccaagcgtcttatagactacggtttccatgcccctactgtctcctggcctgtgacaggtacaatcatggtagaacccacagaaagcgaatcgcaagcagaattagaccgtttctgtgatgccttgattgccatccgccaagaaatcgccgccattgaagcaggtaagatggatacccacaataatctcttaaagaatgcaccccatacgattgaaagtttgattgttggggaatggcttcatccttattcccgtgaacaggcggcttatcccgtgtcttggacaagggagtataaattctggcccagtgtgggaagaattgatgcagcttttggggacagaaatttcgtttgttcttgcctgccaatggaagcttataactaa

SEQ ID NO: 2809 - protein, 974 aa, Anabaena variabilis ATCC 29413
MVSYASIRQSSDEADSTVDASQKLDARKQDLNNFIQRHIGPSSADIQHMLDVLGFSSLDDLIEKTVPSTIRLHKKLQLPTAQTEYAALAKLKQIASKNQVFRSYIGMGYYDTITPPVIGRNILENPGWYTAYTPYQPEIAQGRLEALLNFQTMIIDLTGLEIANASLLDEATAAAEAMSMSYGVSKNKANAYFVSHDCHPQTIDVLQTRAKPLGIEIIIGDHQTFDFQKPIFGAVLQYPASDGTIYDYRAFIETAHAQGALVTVAADPLSLTLLTPPGEFGADIAVGSTQRFGIPLGFGGPHAAYFATKEEYKRQVPGRIVGVSKDVNGKTALRLALQTREQHIRREKATSNICTAQVLLAVMASMYAVYHGPEGLKQIAENIHQLTVTLAEGLKRLGYKISSEHFFDTLRVELGTNNLETILAGCQARNINLRIFDETAVGISLDETTTPEDLIDLWQIFAGEDNLPFTPEELISSLNLPLRSSSYLTHPVFNRYHSETELLRYLHRLETKDLSLTTSMIPLGSCTMKLNATSEMIPVTWEEFGRIHPFAPLTQTRGYQILFQQLEAWLAEITGFAGVALQPNAGSQGEYTGLLVIRQYHESRGETHRNVCLIPTSAHGTNPASAVMCGMKVVAVACDAGGNIDIDDLKAKAEKHSHELAALMVTYPSTHGVFEAGIQEICAVIHSHGGQVYMDGANMNAQVGICRPGDIGADVCHLNLHKTFCIPHGGGGPGMGPIGVASHLVRFLPGHPVLGSGKNPQNIGAVAAAPWGSASILVISWMYIAMMGADGLTQATKVAILNANYIAKRLETYYPVLYKGQNGLVAHECILDLRALKKSANIEIDDIAKRLIDYGFHAPTVSWPVTGTIMVEPTESESQAELDRFCDALIAIRQEIAAIEAGKMDTHNNLLKNAPHTIESLIVGEWLHPYSREQAAYPVSWTREYKFWPSVGRIDAAFGDRNFVCSCLPMEAYN

SEQ ID NO: 2810 - DNA, 2883 bp, Synechococcus sp. CC9605
  CDS (1)..(2883): transl_table=11
gtgcattcgacgttgacttctccttttgcgcagcggcatatcggcccgagtgaggcggaacagctccgcatgctcaatgccctgggctacagcgatctgcaggagttcatcgctgatgtcgtgcccgccgacatcctcgattccaagccgccggttgaggccttgcccgaggggtgtggggaggcagaggccctccagcagctgaagcagttgagcgaaaccaacacgctgcgacgctccttgatcgggctgggttattacggcacggcaaccccggccctgatccagcgccacgtttttgagaatccggcctggtacaccgcctacaccccctatcaggcggaaatcgcccagggtcgtctggaggccctgctcaactttcaaaccctgatcagtgagctcacgggcttgccgatcgccaacgcgtcgctgcttgatgaagccaccgccgccgcggaggcgatgagcctcagcttcggggtgtgccgtcgccccgaggcgacacggttcctggtggacgccaatgtgctgccccagacctgggcggtgctgcagacccgcgccgaacccctcggcatcagcctcgagtgcatcgacccggccacagcgccgatcgatgcgtcagtgttcggcgttctgctgcagctgcccggcgccgatggatgcctttgggatccatccgccgtgatccaagcggcccatgccgccggtgccttggccaccgtggccattgaccccttggcgcagaccctaatggcgcccgtgggatccctcggggccgacattgccgtgggcagcgcccaacgcctgggggtgccgatgggattcggtggtcctcacgccgccttcttcgccaccgttgaggcctacaagcgccagatccccggtcgtctggtggggcagtccaaggatgcggagggccgttccgccctgcgcttggcgctgcaaacccgtgagcagcacatccgtcgcgacaaggccaccagcaacatctgcacggcccaggtgctgctggccgtgatggcctccttttatgcggtgcaccatggccctgatggtctgcaggccattgctcagcgcattgttggcttgcgcagccagctggagcagggcctgcgggccctgggttacccgctgcagctggccgaccgtttcgacaccgtcaccgttcactgtgtgttggcaccggctgtgcaccgcgctgccgcagttgctggtttcaatctgcgggtgctgccagatggtgcagcgccggcggacgccaccggattcggcatcagcctcgatgagctctcggatcaacaggagctgcaagccctgctcgccctgctggcggaggcctgcggtcaggtccccccgcagctggaggctgcgcagcccccgtccctctccctgccgcagcgcagccagccctggctgagccagtcggttttccatcagtaccgcagcgaatcggagctgctgcgctatatccagcggttggtgagccgtgatctgtcgctggtgcacgggatgatcccgttgggcagttgcaccatgaagctcaacgccgccgctgagctgcagccggtgagctggcctgcgtttgcggccttgcatcccttttccccagccgatcaggcccagggctatcgccgtctggccgacgatctggagcaatggctggctgcactgacgggctttgctgccgtgtcgttacagcccaatgccgggtcccagggggaatacgccgggctgctggtgatccgcgcctggcaccactcccgcggtgaagcccatcgcgacatctgtctgatccccaccagcgcccacggcaccaaccccgccagtgccgtgatggccggcctcaaggtggtggccgtcgcctgtgatgacgagggcaacatcgaccagcaggatcttgcggcgaaggcggccgagcacgccgaccggctggcggcactgatggtcacctacccctccacccacggcgtgtttgaaaccggcatccgtgagatctgcgcggtggtgcatcggcatgggggccaggtgtacctcgacggggccaacctcaatgcccaggtggggctgtgccgtcctggtgctttcggtgccgatgtctgccacctcaacctgcacaagacattttgcatcccccatgggggcggtggcccaggcgtggggcctattggtgtggcggcgcatctggagcccttcctgccggggcaccccttgcaggccggcgctgcatcggccatcggtccggtgtccgcagctgcgctcggtagcgccagcatcctgccgattagctggatgtacctgcggatgatgggggcggaggccctgcggcaggccagtgccttggcgctgttgtcggctaattacctcgcccatcggctcgatgcctcgtaccccgtgctgtttcgcggcagcaccggccgggtggcccatgaatgcatcctcgacctccgcccgctcaagcgggatgcggggatcgatgtggatgacatcgccaagcgtttgatggactacggcttccatgcgcccaccgtcagctggccggtggccggcacggtgatggtggagcccaccgaaagcgaaagcctggcggagttggatcgtttcgccgatgccctggtggcgatccgcgaggagattcgcgccattgaagccggcaccagcgaccctcagaacaacccgctcaagcgggctccccacaccctcgctgccgtcacagcggatacctgggatcgtccctacagccgtcagcaggccgccttcccgatggaggagcagcaggagagcaagatctggcccgctgtggcacggattgacaacgcctttggtgaccgcaacctggtgtgcacctgtccgtctgtggaatcggtggctgtggcggtttga

SEQ ID NO: 2811 - protein, 960 aa, Synechococcus sp. CC9605
MHSTLTSPFAQRHIGPSEAEQLRMLNALGYSDLQEFIADVVPADILDSKPPVEALPEGCGEAEALQQLKQLSETNTLRRSLIGLGYYGTATPALIQRHVFENPAWYTAYTPYQAEIAQGRLEALLNFQTLISELTGLPIANASLLDEATAAAEAMSLSFGVCRRPEATRFLVDANVLPQTWAVLQTRAEPLGISLECIDPATAPIDASVFGVLLQLPGADGCLWDPSAVIQAAHAAGALATVAIDPLAQTLMAPVGSLGADIAVGSAQRLGVPMGFGGPHAAFFATVEAYKRQIPGRLVGQSKDAEGRSALRLALQTREQHIRRDKATSNICTAQVLLAVMASFYAVHHGPDGLQAIAQRIVGLRSQLEQGLRALGYPLQLADRFDTVTVHCVLAPAVHRAAAVAGFNLRVLPDGAAPADATGFGISLDELSDQQELQALLALLAEACGQVPPQLEAAQPPSLSLPQRSQPWLSQSVFHQYRSESELLRYIQRLVSRDLSLVHGMIPLGSCTMKLNAAAELQPVSWPAFAALHPFSPADQAQGYRRLADDLEQWLAALTGFAAVSLQPNAGSQGEYAGLLVIRAWHHSRGEAHRDICLIPTSAHGTNPASAVMAGLKVVAVACDDEGNIDQQDLAAKAAEHADRLAALMVTYPSTHGVFETGIREICAVVHRHGGQVYLDGANLNAQVGLCRPGAFGADVCHLNLHKTFCIPHGGGGPGVGPIGVAAHLEPFLPGHPLQAGAASAIGPVSAAALGSASILPISWMYLRMMGAEALRQASALALLSANYLAHRLDASYPVLFRGSTGRVAHECILDLRPLKRDAGIDVDDIAKRLMDYGFHAPTVSWPVAGTVMVEPTESESLAELDRFADALVAIREEIRAIEAGTSDPQNNPLKRAPHTLAAVTADTWDRPYSRQQAAFPMEEQQESKIWPAVARIDNAFGDRNLVCTCPSVESVAVAV

SEQ ID NO: 2812 - DNA, 2862 bp, Synechococcus elongatus PCC 7942
  CDS (1)..(2862): transl_table=11
atgtctgcttcgccccacaactttgctcagcggcatctcgggccacggccggccgatgtcgagcagatgttgcagaagttaggttgcgagagcctagaagacttgctggcggcggtagtccctgcagatattcgtttgccacgatcgctgaatttgcctgagccctgcagtgaggccgaagcgctggcggaattgcgagcgatcgcccatcaaaatcagatcctgcgctcctatcttggccaaggctatgccaactgcctgacgccgcctgtaattcagcgtaatattctcgaaaatccgggctggtacaccgcctacacgccctaccaagccgagattgcccaaggacgcttggaagcactgctcaacttccagaccatggtcagcgatctgacggggctggagatcgccaacgcctccctgttggatgaggcaacagcggcagccgaagcgatgaccctcagtttggcagtcgcgaagtcaaagtctcagacctacttcgttgcccacaactgccatccgcaaacgatcgcggtggtacagactcgggctgctgcactggggattgaagtgctcgtcgcagatctgctgcagtttgacttccagacgccgatttttggactgctgctgcaatatcccgccaccgacggcacgatcgcagattaccgctcggtgattgagcaagcccatgctcagggcgcgatcgcaaccgttgcctgcgacttgctagcactaaccctgctgacccctccaggggaatttggcgcggatatcgcggttgggaatagtcagcggttcggcgtgcccctcggttacggcggtcctcatgcggcattctttgccaccaaggaagcctacaaacggcagattccggggcggattgtcggtgtctctaaggatgcccaaggtcaaccagcactgcgcttggcgttgcagacgcgggagcaacatattcgtcgcgacaaggccacgagcaatatctgcacggcgcaggtcttgctggctgtggtggctggcttctacgcggtctaccacggggcagaaggactgaccgcgatcgcgaggcaagtgcgtcgccagactcagatcttggcggaggagttgcagtctctcggattcaagattcctcagcagccgggctttgacacgctgatcgttgaggtcgaagacccgaaagtttggcagtcgcgaactgaagcagcgggttttaatctgcgttgtctgagcgatcgccagcttggtatcagcctcgatgaaacgacgactgacagcgatctcctcgacctgctcactgtttttgctcaagggcgatcgttgccagcttgggaggatctacaagcggctgtgactgacgaagtggatccagccttcgcccgccaaacgcccttcctgacccatcccgtctttcagcagtaccactcggaaaccgagttgctgcgctatatccatcgcctccagagtcgtgatctatcgctgactacagcgatgattccgctcggctcctgcacgatgaagctcaacgccacggcggagatgctaccgatcagttggccggagtttaatcagattcacccctttgcaccgctgagtcaaacccagggttatcaacagctgttccagcagcttgagtcttggctagccgaaattacgggcttcgcagcggtctccctacaacccaatgctggctctcaaggggaatatgcgggtctactcgtcatccagcgctaccaccagagtcgcggcgaagatcaccgccagatttgcctgattccgcagtcggctcacgggactaatcccgccagcgcggtgatggctggcatgaaagtcgtgccgatcgcctgtgacgatcgcggcaacattgatgtcagtgacctgcagcaaaaagctgcccagtatgcggatcagctcgcagcactgatggtcacctatccctctactcacggcgtctttgaggaagcgatcgcggagatctgtgcgatcgttcatcagcagggcggccaagtttatttagatggtgccaatctcaacgcccaagtcggcctctgtcagcccgcccaatttggggcggatgtctgtcatctcaacctccacaagaccttttgcattccccacggcggtggtggccccggcgttggcccgatcggtgttgccgcgcaccttgcgcccttcctgccgagtcatccgctcgtcccagaagcgaatgccgatccgcaagcccttggcccgatcgcagccgccccttgggggagtgccagcatcctgcccatttcttggatgtatatccgcatgatgggtgcagctgggttgacgcaagccagcgcaatcgcaattctcaacgccaactacattgccacacgactagcgccctactatccaatcctctatcggggcgatcgcggctttgttgcccacgaatgtatccttgacctacgaccgctcaaacgcacagccgggattgaagtcgaggatgtcgccaaacggctgatggactacggctttcatgcgccaaccatgtcttggcccgtgctcggcacgttgatggtcgagccaaccgagagtgaatcgctggcagaactcgatcgcttctgtgaagcgatgatcggcatttatcacgaggtggacgcgatcgccagcggtgacttggatcccctcgacaatcccctcaagcatgcgccccacccggcagatgtgctgctccagtctgactggaatcgcgcctacagccgcgagcaggccgcttatcctgccccttggacgcgagaacacaaattctggccagtggtcagccgcatcgataacgcctacggcgatcgcaatctcgtctgctcctgtctacccatgagcgcctacagcgatcgctga

SEQ ID NO: 2813 - protein, 953 aa, Synechococcus elongatus PCC 7942
MSASPHNFAQRHLGPRPADVEQMLQKLGCESLEDLLAAVVPADIRLPRSLNLPEPCSEAEALAELRAIAHQNQILRSYLGQGYANCLTPPVIQRNILENPGWYTAYTPYQAEIAQGRLEALLNFQTMVSDLTGLEIANASLLDEATAAAEAMTLSLAVAKSKSQTYFVAHNCHPQTIAVVQTRAAALGIEVLVADLLQFDFQTPIFGLLLQYPATDGTIADYRSVIEQAHAQGAIATVACDLLALTLLTPPGEFGADIAVGNSQRFGVPLGYGGPHAAFFATKEAYKRQIPGRIVGVSKDAQGQPALRLALQTREQHIRRDKATSNICTAQVLLAVVAGFYAVYHGAEGLTAIARQVRRQTQILAEELQSLGFKIPQQPGFDTLIVEVEDPKVWQSRTEAAGFNLRCLSDRQLGISLDETTTDSDLLDLLTVFAQGRSLPAWEDLQAAVTDEVDPAFARQTPFLTHPVFQQYHSETELLRYIHRLQSRDLSLTTAMIPLGSCTMKLNATAEMLPISWPEFNQIHPFAPLSQTQGYQQLFQQLESWLAEITGFAAVSLQPNAGSQGEYAGLLVIQRYHQSRGEDHRQICLIPQSAHGTNPASAVMAGMKVVPIACDDRGNIDVSDLQQKAAQYADQLAALMVTYPSTHGVFEEAIAEICAIVHQQGGQVYLDGANLNAQVGLCQPAQFGADVCHLNLHKTFCIPHGGGGPGVGPIGVAAHLAPFLPSHPLVPEANADPQALGPIAAAPWGSASILPISWMYIRMMGAAGLTQASAIAILNANYIATRLAPYYPILYRGDRGFVAHECILDLRPLKRTAGIEVEDVAKRLMDYGFHAPTMSWPVLGTLMVEPTESESLAELDRFCEAMIGIYHEVDAIASGDLDPLDNPLKHAPHPADVLLQSDWNRAYSREQAAYPAPWTREHKFWPVVSRIDNAYGDRNLVCSCLPMSAYSDR

SEQ ID NO: 2814 - DNA, 2928 bp, Burkholderia thailandensis E264
  CDS (1)..(2928): transl_table=11
atgaagctcgaacacccggaccgcctgatgaaacgcacgcccctctcgctcgccgcgctcgaaacgcacgacgcgttcgccgaacgccatatcggccccgatgccgccagccagcaggccatgctcgacacgctcggcttcgcgacgcgcgccgcactgatcgacgccgtgatccccgcgtcgatccgccgcgccgaaacgctgccgctcggcccgttcgcgcaaccgttgagcgaggcggaagcgctcgccgcgctgcgcgaactcgcggacaagaaccaggtgttccgctcgtatatcggccagggctactacgacacccacaccccggcggtgatcctgcgcaacgtgctcgaaaacccggcgtggtacaccgcgtacacgccgtaccagcccgaaatctcgcaaggccgcctcgaggcgctgctgaacttccagcagatggtcgccgacctgacgggcctcgagatctcgaacgcgtcgctgctcgacgaagccacggccgcagccgaagcgatgacgctgctgcaacgcgtcggcaagccgcagtcgaacgtgttctatgtcgccgacgacgtgctgccgcaaacgctcgaagtaatcaagacgcgcgcgaaaccgatcggcatcgaagtgaagtcgggcccggccgccgacgccgcggccgcgaacgcgttcggcgtgctgctgcaatatccgggcgtgaacggcgacgtgcgcgactaccgcgcactcgccgacgcaatccacgcggcgggcggccatgtcgtcgtcgcggccgacatcctcgcgctcaccgtgctcacgccgcccggcgaatggggcgcggacgtcgcggtcggcaacacgcagcgcttcggcgtgccgatgggcttcggcggcccgcacgccgcctacatggcggtgcgcgacgaattcaagcggcagatgccgggccgcctcgtgggcgtgaccgtcgacgcgcagggcaagcccgcgctgcgcctcgcgctgcaaacgcgcgagcagcacatccgccgcgaaaaggcgacgtcgaacgtctgcaccgcgcaggcgctcctcgcgatcatggcaagcatgtacgcggtctaccacggcccgcgcggcctgaagacgatcgcgctgcgcgtgaaccgcatcgcggcgctcgtcgccgccggcgtgaagcaactcggcttcgcgaccgtcaacgacacgttcttcgacacgctgacgatcgacaccggcgcgcgcaccgcacagattcatgcgctcgcgaatgcgaagcgcatcaacctgcgccgtgtgagcgacacgcgggtcggcatctctgtcgacgagacgacgacccgcggcgatctcgccgagctgctcggagttttcgcgcaagccgcgggcggcaccgcgcccgacgtcgatgcgctcgacgcaggcctcgccgacacggcggcgctgccggccggcctccagcgcacgagcgcgtacctcacgcaccacgtgttcaaccgccaccattcggaaacggaaatgctgcgctacctgcgcagcctatctgacaaggatctcgcgctcgaccgctcgatgattccgctcggctcgtgcacgatgaagctgaacgcgacctccgagatgctgcccgtcacgtggcccgaattcggccgcatccacccgttcgcgcccgccgagcagaccgtcggctaccgcgagatgatcgaccagctcgagcagatgctcgtcgcggcaacgggctacgcggccgtgtcgctgcagccgaacgccggctcgcagggcgagtacgcgggcctgctcatcatccacgcgtatcacgagtcgcgcggcgagagccaccgcaacgtctgtctgatcccggcgtccgctcacggcacgaacccggcgtccgcgcacatggccggcatgaaggtcgtggtcgtcgcgtgcgacgcgcagggcaacgtcgacatcgacgatctgaaggcgaaggccgagcaacacgcgaacgacctcgcggcgatcatgatcacgtacccgtcgacgcacggcgtgttcgagcagaacgtccgcgagatctgcgagatcgtgcacgcgcacggcggccaggtgtacgtcgacggcgccaacatgaacgcgatggtcggcctgaccgcgccgggccagttcggcggcgacgtgtcgcacctgaacctgcacaagaccttctgcatcccgcacggcggcggcggcccgggcgtcggcccggtcgcggtcggcgcgcacctcgcgaagttcctgccgaaccagcggtcgaccggctacgcgcgcgcggaagacggcatcggcgcggtgtcggcggcgccttacggctcggcgtcgatcctgccgatctcgtggatgtacatcgcgatgatgggcgcgaagaacctgaccgccgcgacggaaaccgcgatcctcaacgcgaactacatcgcgaagcgcctcgcgccgcactatccggtgctgtattcgggcccgggcgggctcgtcgcgcacgagtgcattctcgatctgcgcccgatcaaggattcgagcggcatcaccgtcgacgacgtcgccaagcgcttgatggactatggcttccacgcgccgacgatgagcttcccggtgccgggcacgctgatggtcgagccgaccgagtcggaatcgcaggaggaactggaccgcttcgtcgccgcgatgatcgcgatccgcgacgagatccgcgcggtcgaggaaggccgcgccgaccgcgaggacaacccgctgcgtcacgcgccgcacacggcagccgtcgtcaccgcgaacgaatggccgcacgcgtactcgcgcgagcaggccgcgtacccggtcgcatcgctcgtcgcgaacaagtactggccgcccgtcggccgcgcggacaacgcatatggcgaccgcaatctgttctgctcctgcgtgccggtatcggattacgcgtga

SEQ ID NO: 2815 - protein, 975 aa, Burkholderia thailandensis E264
MKLEHPDRLMKRTPLSLAALETHDAFAERHIGPDAASQQAMLDTLGFATRAALIDAVIPASIRRAETLPLGPFAQPLSEAEALAALRELADKNQVFRSYIGQGYYDTHTPAVILRNVLENPAWYTAYTPYQPEISQGRLEALLNFQQMVADLTGLEISNASLLDEATAAAEAMTLLQRVGKPQSNVFYVADDVLPQTLEVIKTRAKPIGIEVKSGPAADAAAANAFGVLLQYPGVNGDVRDYRALADAIHAAGGHVVVAADILALTVLTPPGEWGADVAVGNTQRFGVPMGFGGPHAAYMAVRDEFKRQMPGRLVGVTVDAQGKPALRLALQTREQHIRREKATSNVCTAQALLAIMASMYAVYHGPRGLKTIALRVNRIAALVAAGVKQLGFATVNDTFFDTLTIDTGARTAQIHALANAKRINLRRVSDTRVGISVDETTTRGDLAELLGVFAQAAGGTAPDVDALDAGLADTAALPAGLQRTSAYLTHHVFNRHHSETEMLRYLRSLSDKDLALDRSMIPLGSCTMKLNATSEMLPVTWPEFGRIHPFAPAEQTVGYREMIDQLEQMLVAATGYAAVSLQPNAGSQGEYAGLLIIHAYHESRGESHRNVCLIPASAHGTNPASAHMAGMKVVVVACDAQGNVDIDDLKAKAEQHANDLAAIMITYPSTHGVFEQNVREICEIVHAHGGQVYVDGANMNAMVGLTAPGQFGGDVSHLNLHKTFCIPHGGGGPGVGPVAVGAHLAKFLPNQRSTGYARAEDGIGAVSAAPYGSASILPISWMYIAMMGAKNLTAATETAILNANYIAKRLAPHYPVLYSGPGGLVAHECILDLRPIKDSSGITVDDVAKRLMDYGFHAPTMSFPVPGTLMVEPTESESQEELDRFVAAMIAIRDEIRAVEEGRADREDNPLRHAPHTAAVVTANEWPHAYSREQAAYPVASLVANKYWPPVGRADNAYGDRNLFCSCVPVSDYA

SEQ ID NO: 2816 - DNA, 3219 bp, Frankia sp. CcI3
  CDS (1)..(3219): transl_table=11
atgcctgacgtcacccagtacgacgacaccccctatgccgatggaccggccacggctgccgatggaccggccacgaccgccacgaccgccaccatcagtcccgcgtcgtcgcacgcgcggtcgggggcgccgcgacagggcagtgccgcggcggtgggcaggaacggtgcgaggcggctgcccgccgcggccatcccgcggttcgccgatcggcacatcggcccggacccgtcatcccaacgggagatgctggatgcgctgcgggtggaatcactggccgcgctcaccgacgcggccgtcccggcaagcatccgtgaccatgatctggatcttcccgcggcgctgagcgagcccgcggtgctcgcggccctacgcgcgttcggtagcaggaaccgaccggtttcctcgatgatcgggctgggattccatcccgcggtgatgccgggagtcatccagcgcaacgtcctggagaaccccgcgtggtatacggcgtacacgccgtaccagccggagatctcccagggccgcctggaagcgttgctcaacttccagacgatgatcactgatttgaccggccttgcggtggccggagcctccctgctggacgagccgaccgcggcggccgaggcgatgcagatcgcgtttcggacggcgaagggttcccgcgcgacgttcctcatcgatgccgacaccctcccgcagaccgtctcggtggtcgcgaccagggcggaggcgctggggatcaatgtggtggtcgcggatctcgcagccggactcacggccgtgggcccggcgcagctggatgcggccttcggcctgctgctgtcctatcccgggccggcgggcgtcctgcgggatgtgcgtgctgtgatcgcatcggcgagggagcgcggcatcgtcgtcacgatcgccgccgatccgctggcgctgaccctgctgcgggcgcctggcgacctcggcgcggacatcgcggtggggagcacgcagcggttcggactaccgctgtccttcggaggcccgcacgccggctacctcgcagtgcgcaaggggctggaacggtccctgccggggcggctcgtcggggtgtcggtcgatgcggacggcgcacccgcgtaccggctcaccctgcagacccgtgagcagcacatccgacgggagaaggcgacgagcaacatctgcacggcccaggtgctgcccgcggtactcgcctccatgtacgcggtctaccacggcccggagggcctggccgggatcgcgcgtcgcatccacgggcacgcggtgcgcctcgccgaaggcctgcgcgccgccggtgtgacggtggtgcacgacgcgttcttcgacaccgtcctcgccgcggtgccgggccgggccacccaggtggttgcggacgcgttggcgcggggcgtgaacctgcggctggtcgacgacgaccacgtgggtatctcctgcaacgagacgacgggccaggccgagctggaggccgtccggtcggccttcggggtgggcccggaggcgacggcgggcatcacttggaccgggaccgggaccgggaccgagatccggaccggggcctggaccgggtccgtcgcggcggcgaacgatcatctcgtggcccgcgcggaccaggcggaccaggcggaccaggcggaccaagcggcggacgagccggtggcgctgcccgccgaactggtgcgtacggatccctacctgcagcatccggtgttccacgaccatcggtcggagaccgcgatgctccgctatctgcgtcgactgtccgatcttgatctggctcttgaccggggcatgatccccctggggtcgtgcacgatgaaactcaacgcgaccactgagatggccgcggtcacctggccggaattcgctgacatccatccatttgccccgttggaccaggccgccggatacctcgcgatgattcaggacctggagcgttggctcgcgcagatcaccggatatgcgggggtctccctccagccgaatgccggcagccagggtgagctcgccgggctgctcgccatccgggcctatcaccgcgatcatgctgttcccggatccgtggtgcgaaacatctgtctcattccctcctcggcgcacgggacgaatgcggcgagcgccgcgatggcgggaatgcgggtggtcgtcgtctcctgtgacgacgacggaaacgtcgacctgaacgatctggcccgcaaggcccgcgcgaacgcggacgccttggccgcgctgatggtcacctacccgtcgacccatggtgtgtacgaggagggcatcgggcaggcgtgcgcgatcgtgcatgaggccggcggtctggtgtacgtcgacggagcgaatctcaacgctctggtggggctcgccaggccggggcagttcggggccgacgtgagccacctgaacctgcacaagacgttctgcatcccgcatgggggcgggggtccgggggtcggcccggtggccgtggtcgagaaactcctgccctatctgccgaaccacccgctgcggccggaggcaggaccggccaccggagtgggcccgatctcgggatccccgtggggctcggccggaattcttatgattccgtgggcctacattcggatgatgggggcggacggcctgcgccgggcaacctcggtggccgtcctgaacgccaactacattgcccaccggctgcatccgtactatccggtgctctacgcgggccgggacgggctggtcgcccatgagtgcattctggacctacggccgttgacgaagctgaccggcgtcaccgtggacgacgtggcgaagcgtctcatcgactacggtttccatgctccgaccatgtcattcccggttgccggaacactgatggtcgagccgacggagagtgaggatctcggcgagatcgatcgtttctgcgacgcaatgatctccattcgggccgaggcggacaaggtcggagacggtatctggccgcggaccgacaatcccctgcataatgctccgcatactgcacagatggttaccgccaacgaatggtcacacgcttatccgcgatcggtggcggcctatcccgtcgcttcgctgcgggccgccaagtactggcccccggtacgtcggatcgacggcgcctatggtgatcgcaacctggtctgcacctgcccaccggtgggatccttcgccgcggagccggtcgacgagcagattctcgccggagcccgctga

SEQ ID NO: 2817 - protein, 1072 aa, Frankia sp. CcI3
MPDVTQYDDTPYADGPATAADGPATTATTATISPASSHARSGAPRQGSAAAVGRNGARRLPAAAIPRFADRHIGPDPSSQREMLDALRVESLAALTDAAVPASIRDHDLDLPAALSEPAVLAALRAFGSRNRPVSSMIGLGFHPAVMPGVIQRNVLENPAWYTAYTPYQPEISQGRLEALLNFQTMITDLTGLAVAGASLLDEPTAAAEAMQIAFRTAKGSRATFLIDADTLPQTVSVVATRAEALGINVVVADLAAGLTAVGPAQLDAAFGLLLSYPGPAGVLRDVRAVIASARERGIVVTIAADPLALTLLRAPGDLGADIAVGSTQRFGLPLSFGGPHAGYLAVRKGLERSLPGRLVGVSVDADGAPAYRLTLQTREQHIRREKATSNICTAQVLPAVLASMYAVYHGPEGLAGIARRIHGHAVRLAEGLRAAGVTVVHDAFFDTVLAAVPGRATQVVADALARGVNLRLVDDDHVGISCNETTGQAELEAVRSAFGVGPEATAGITWTGTGTGTEIRTGAWTGSVAAANDHLVARADQADQADQADQAADEPVALPAELVRTDPYLQHPVFHDHRSETAMLRYLRRLSDLDLALDRGMIPLGSCTMKLNATTEMAAVTWPEFADIHPFAPLDQAAGYLAMIQDLERWLAQITGYAGVSLQPNAGSQGELAGLLAIRAYHRDHAVPGSVVRNICLIPSSAHGTNAASAAMAGMRVVVVSCDDDGNVDLNDLARKARANADALAALMVTYPSTHGVYEEGIGQACAIVHEAGGLVYVDGANLNALVGLARPGQFGADVSHLNLHKTFCIPHGGGGPGVGPVAVVEKLLPYLPNHPLRPEAGPATGVGPISGSPWGSAGILMIPWAYIRMMGADGLRRATSVAVLNANYIAHRLHPYYPVLYAGRDGLVAHECILDLRPLTKLTGVTVDDVAKRLIDYGFHAPTMSFPVAGTLMVEPTESEDLGEIDRFCDAMISIRAEADKVGDGIWPRTDNPLHNAPHTAQMVTANEWSHAYPRSVAAYPVASLRAAKYWPPVRRIDGAYGDRNLVCTCPPVGSFAAEPVDEQILAGAR

SEQ ID NO: 2818 - DNA, 2895 bp, Saccharophagus degradans 2-40
  CDS (1)..(2895): transl_table=11
atgtcacacggcacttctttagacgaacttttcaactcacgcgatttcataggccgccatattggccccaatgcagatcaaacgcgagccatgttggatgccatggggctggatagcatagaccagcttatagaccttaccgtacccgcgtctattcgcggtgaagaaacccgcgccctagccgcaccggtaaacgagcagcaagccttagccgagctaaaaaacattgcaggcaacaaccaacgctttaaaagctatataggcatgggctaccaccctacctatgtaccccccgttatattgcgcaatgtattagagaatccaggctggtacaccgcctatacgccctaccagccagaaattgcacaggggcgattggaaggcttacttaacttccaacaaatgatcattgaattaaccggcatggatatggccaacgcctctatgctagatgaagctaccgccgcagccgaagccatggcaatggccaaacgcgttgcccgtaaaaacaaaagcaacaccttctttgccgataaacactgccatccacaaacccttgccgtattgcaaacccgtgccagtcactttggctttgagcttgttattggcgacataacccaagacctaaacaagcaagaagtatttggcgccatcacccagtaccccggcacctcgggcgaagtaaaagacctgcgcccaatagttaaccaagcccacgagcaagatgcgctattaatcgtagccgccgacattcttagcttggtgttactcgaatcccccggtgcgatgggggccgacatagtagtgggcagcaaccaacgctttggtattcctatgggctttggtggcccacacgctgcgttttttgggtttagagaaaagtacaaacgcgcaacccctggccgcattattggcgtatcggtagatacacgcggcaaacgcgcactgcgtatggccatgcaaacccgcgagcagcacatacgccgcgaaaaagccaactccaacatttgtacatcgcaggttttattggcggtgatgagcgtgttttacgccatgtaccacggcagcgcgggcgttacccgaatagcgcaacgcgtgcacaccctaaccaagatgcttgcccaaggcttaacagcacagggccacaagttggcgtttgataactacttcgacaccttgtgtgtaatagtgaacgatcaacaacaaggcctgtttgatcgcgcccagcaagcgggtgttaacctgcgtaaactcgataaaaacgcgctaactattagcttaaacgaatgcacaagcctagaagatatccaccaattgctggatattttctcactaggcaaacactcgcaagatgttaaaagcttagaaaccaaagccctagccgcagaagtgattcccgctagctgccgccgcgaaggcccagcgcttaaccacccagtgtttgagcaataccactcagaaaccgaaatgctgcgctacttaaagcgtttagagtcgaaagatattgccctaaaccacgcaatgattcccctcggctcttgcaccatgaagctaaacgctacagccgaaatgattcccgtaacttggccagaatttggtgagctacacccctttgcgccaatggagcaagccgctggctacagcactttgtttacgcaactgcaagatatgctaaaagcctgtaccggctacgacgccattagcctgcaacccaatgctggctcgcaaggcgaatacgctggccttgtggcaatacgtaaatacttcgagcacctaggtcaaaccgagcgcaatatttgtttaatacccgcctcggcccacggcaccaacccagcctcggcacaaatggtagaaatgaaagtggtagtcgttgcctgcgataacctcggcaacgtagacctgaacgacctaaaagctaaagtagcccaatacggtgaaaccattgccgcattaatggttacctacccatctacccacggcgtgtttgaagaagaaattaccgccatttgcgacctcatccactcggtcggtgcacaagtgtatatagacggcgccaatatgaacgcccttgtgggcttggcggcaccaggtaaatttggtggcgatgtatcgcacttaaacctgcacaaaaccttctgtattccacacggcggcggcggcccgggcatgggccctattggtgtaaaatctcatcttgcgcccttcttggccggccatccagtacaacccgtgcccaacacattggtagaaaacggcaccatatctgctgcgccgtggggctcggcaagtattttaaccattagctggatgtacattcgcatgatgggtgccgaaggtatgaagcgcgcaaccgagttcgccatattaaacgccaactacatagcgcaccgcctgcaagaccactaccccattttgtacaaaggtaaaaacggctacattgcccacgagtgcctactagacttgcgcccactaaaagaaagcagcggcataaccgaagaagacatagccaaacgcttaatggatttcggcttccacgcacctaccatgtcgttccccgtggctggcacacttatgatcgagccaaccgaatcggaatcacaagcagagctagaccgcttctgcgacgccatgattaaaattcgtcaagaagcctctctagtagaaagcggcgaactaccaagggataacaaccccctagttaacgccccccacaccctagacgacgccctagacgaaacgtggacacgcccctacacccgcgacgaagccacccgcccactaccttacctacacgcacacaagatttggcctacggtgaatcgtattgataatgtgtatggggatagaaatttaatttgtagttgcccaagtattgagagttatacagaagagtaa

SEQ ID NO: 2819 - protein, 964 aa, Saccharophagus degradans 2-40
MSHGTSLDELFNSRDFIGRHIGPNADQTRAMLDAMGLDSIDQLIDLTVPASIRGEETRALAAPVNEQQALAELKNIAGNNQRFKSYIGMGYHPTYVPPVILRNVLENPGWYTAYTPYQPEIAQGRLEGLLNFQQMIIELTGMDMANASMLDEATAAAEAMAMAKRVARKNKSNTFFADKHCHPQTLAVLQTRASHFGFELVIGDITQDLNKQEVFGAITQYPGTSGEVKDLRPIVNQAHEQDALLIVAADILSLVLLESPGAMGADIVVGSNQRFGIPMGFGGPHAAFFGFREKYKRATPGRIIGVSVDTRGKRALRMAMQTREQHIRREKANSNICTSQVLLAVMSVFYAMYHGSAGVTRIAQRVHTLTKMLAQGLTAQGHKLAFDNYFDTLCVIVNDQQQGLFDRAQQAGVNLRKLDKNALTISLNECTSLEDIHQLLDIFSLGKHSQDVKSLETKALAAEVIPASCRREGPALNHPVFEQYHSETEMLRYLKRLESKDIALNHAMIPLGSCTMKLNATAEMIPVTWPEFGELHPFAPMEQAAGYSTLFTQLQDMLKACTGYDAISLQPNAGSQGEYAGLVAIRKYFEHLGQTERNICLIPASAHGTNPASAQMVEMKVVVVACDNLGNVDLNDLKAKVAQYGETIAALMVTYPSTHGVFEEEITAICDLIHSVGAQVYIDGANMNALVGLAAPGKFGGDVSHLNLHKTFCIPHGGGGPGMGPIGVKSHLAPFLAGHPVQPVPNTLVENGTISAAPWGSASILTISWMYIRMMGAEGMKRATEFAILNANYIAHRLQDHYPILYKGKNGYIAHECLLDLRPLKESSGITEEDIAKRLMDFGFHAPTMSFPVAGTLMIEPTESESQAELDRFCDAMIKIRQEASLVESGELPRDNNPLVNAPHTLDDALDETWTRPYTRDEATRPLPYLHAHKIWPTVNRIDNVYGDRNLICSCPSIESYTEE

SEQ ID NO: 2820 - DNA, 2937 bp, Burkholderia xenovorans LB400
  CDS (1)..(2937): transl_table=11
atgaagctcgaacacccggatcgtctgatgaaccgcactcctctctcgctcgccgcgctcgaagtgcatgacgccttcgccgaacggcacatcggcccggattcggccgaccagcaagcgatgctcgaagccctcggcttcgcgtcgcgcgccgcgctgatcgacgccgtcattccgaagacgatccgccgcaccgaaccgctgccgctcggccccttcgcgcaaccgaaaagcgaagccgaagcgctcgccacgctgcgcgagctcgcggacaggaaccaggtgttccgctcgtacatcggccagggctattacaacgcgcacacgccgacggtgatcctgcgtaacgtgctggaaaatccggcgtggtacaccgcgtacacgccgtaccagccagaaatttcgcaaggccgtctggaagcgctactgaacttccagcagatgatcgtcgacctgacgggtctggcgatctcgaatgcgtcgctgctcgacgaagccacggccgcggccgaggcgatgacgctgctgcaacgcatcggcaagccgaagtcgaacgtgttctatgtggccgacgacgtgctgccgcaaaccatcgaagtggtgaagacgcgcgccacgccggtgggcattgaagtgaaagtgggcccggctgcggacgcggcgaacgcgaacgcgttcggcgtactgctgcaatacccgggcgtgaacggcgacgtgcgcgactaccgcgccctggccgaagcgatccacgccgcgggcggccacgtggtggtcgccgccgacctgctcgcgctgaccgtcctcacgccgccgggcgaatggggcgcggacgtggccgtcggcaacacgcagcgcttcggcgtgccggtcggcttcggcggcccgcatgcggcttacctcgccgtgcgcgacgaattcaagcgccagatgccgggccgcctcgtcggcgtgaccgtcgacgcgcaaggcaaccccgcgctgcgtctcgcgctgcaaacgcgcgaacagcatatccgccgcgagaaggccacctcgaacgtatgtaccgcgcaagcattgctcgcgatcatggccagcatgtacgccgtgtatcacggcccgcacggcctgaaaacgatcgcgctgcgcgtgaaccggatcgccgcgctgctggcagaaggtgcgaagcaactcggctacacgctcgtcaacgaaacgttcttcgacacgctcacattcgaaaccggcgcgcgcacgcaagcgctgcatgacgccgcgcttgcgaagcgcatcaacctgcgccgcgtgagcgacacgcaagtgggcctgtcggtcgacgaaaccaccacgcgccgcgatctggccgatctgctcgaagtgttcgcacaagccgcgggcgccaaaatcgtgccgcaagtggacgcgctcgactcgaccatcgccgcatcggatacggcatcggtgccgcccgcgctcgagcgcaccagcgcgtatctcacgcaccacgtattcaaccgccatcattcggaaacggaaatgctgcgctatctgcgcagcctgtcggacaaagacctcgcgctcgaccgctcgatgatcccgctcggctcgtgcacgatgaagctgaacgcgacctcggaaatgctgccggtcacgtggcctgaattcggccagatccatccgttcgcgccggccgagcaaaccgtcggctatcgcgaaatgatcgatcagctcgaagcgatgctggtcgcggccaccggctacgctgccgtgtcgctgcaaccgaatgccggctcgcaaggcgagtacgcgggcctgttgatcattcacgcgtatcacgcgtcgcgtggcgaagcgcatcgcaatgtctgcctgattcccgcttcggcgcacggcacgaacccggcctcggcacacatggccggcatgcaggtgatcgtggtggcgtgcgacgcgcaaggcaacgtcgatatcgaagacctgaagaaaaaggccgaacagcacgccgacaaactcgcggcgatcatgatcacgtatccttccacgcacggcgtgttcgagcagaacgtgcgcgaaatctgcgagatcgtgcatgcgcacggcggtcaggtctacgtggacggcgcgaacatgaacgcgatggtcggcctcactgcgccgggccagttcggcggcgacgtgtcgcacctgaatctgcacaagacgttctgcattccgcacggcggcggcggaccgggcgtcggtccggtcgcggtcggcgcgcatctcgcgcagttcctgccgaatcagatctcgtcgggctacgaacgcgcgccgaacggtatcggcgccgtgtcgggcgcaccgtacggctcggcgtctatcctgccgatctcgtggatgtatatcgcgatgatgggcgcgaagaacctcaccgccgcgaccgaaaccgcgatcctcaacgcgaactacgtcgcgaagaaactcgcgccgcactatccggtgctgtattcgggcccgggcggactggtcgcgcacgagtgcattctcgacctgcgcccgatcaaggaaaccagcggcattaccgtcgacgacgtcgccaagcgtctcgccgactacggcttccatgcgccgaccatgagcttcccggtgccgggcacgctgatggtcgagccgaccgaatcggaatcgaaggaagaactcgaccgtttcatcgaagcgatgatcgcgatccgcgaggaaatccgcgcagtcgaagaaggccgctcggaccgcgaggacaatccgctgaagcatgcaccgcatacggcggcggtggtcatcgcgaatgactggaagcatgcgtatgcgcgcgaaaccgcggcgtatccgctgcccacgctgatcgcgaaaaaatactggccgccggtcggccgcgcggacaacgtgtacggcgaccgcaatctgttctgctcctgcgtgccgatcgccgattacgagtaa

SEQ ID NO: 2821 - protein, 978 aa, Burkholderia xenovorans LB400
MKLEHPDRLMNRTPLSLAALEVHDAFAERHIGPDSADQQAMLEALGFASRAALIDAVIPKTIRRTEPLPLGPFAQPKSEAEALATLRELADRNQVFRSYIGQGYYNAHTPTVILRNVLENPAWYTAYTPYQPEISQGRLEALLNFQQMIVDLTGLAISNASLLDEATAAAEAMTLLQRIGKPKSNVFYVADDVLPQTIEVVKTRATPVGIEVKVGPAADAANANAFGVLLQYPGVNGDVRDYRALAEAIHAAGGHVVVAADLLALTVLTPPGEWGADVAVGNTQRFGVPVGFGGPHAAYLAVRDEFKRQMPGRLVGVTVDAQGNPALRLALQTREQHIRREKATSNVCTAQALLAIMASMYAVYHGPHGLKTIALRVNRIAALLAEGAKQLGYTLVNETFFDTLTFETGARTQALHDAALAKRINLRRVSDTQVGLSVDETTTRRDLADLLEVFAQAAGAKIVPQVDALDSTIAASDTASVPPALERTSAYLTHHVFNRHHSETEMLRYLRSLSDKDLALDRSMIPLGSCTMKLNATSEMLPVTWPEFGQIHPFAPAEQTVGYREMIDQLEAMLVAATGYAAVSLQPNAGSQGEYAGLLIIHAYHASRGEAHRNVCLIPASAHGTNPASAHMAGMQVIVVACDAQGNVDIEDLKKKAEQHADKLAAIMITYPSTHGVFEQNVREICEIVHAHGGQVYVDGANMNAMVGLTAPGQFGGDVSHLNLHKTFCIPHGGGGPGVGPVAVGAHLAQFLPNQISSGYERAPNGIGAVSGAPYGSASILPISWMYIAMMGAKNLTAATETAILNANYVAKKLAPHYPVLYSGPGGLVAHECILDLRPIKETSGITVDDVAKRLADYGFHAPTMSFPVPGTLMVEPTESESKEELDRFIEAMIAIREEIRAVEEGRSDREDNPLKHAPHTAAVVIANDWKHAYARETAAYPLPTLIAKKYWPPVGRADNVYGDRNLFCSCVPIADYE

SEQ ID NO: 2822 - DNA, 2925 bp, Ralstonia metallidurans CH34
  CDS (1)..(2925): transl_table=11
atgaacgccccgctccccatgaacgctgccgcccaaggtgcccggcccacgctggccgaactggaggcgcgcgacgccttcgccgcccgtcatatcggccccgattccgccgaacagcaacacatgctcaaggtgctcggcttcgagagccgcgccgcgctgatcgacgccgtggtgcccgccgcgatccgccgccgtgacggcatgtcgctgggcgaattcaccgcaccgctgaccgaggaggccgcgctcggccgcctgcgcgcgctggcgggcaagaaccgcgtgctcaagagcttcattggccagggctactacaacacgctcacgccgggcgtcatcctgcgcaacatcttcgagaacccggcgtggtacaccgcgtacacgccgtaccagcccgaaatctcgcaaggtcgtctggaagcgatgctgaacttccagcagatgatcactgacctgaccggcctggatatcgccaacgcgtcgatgctcgacgaaggcaccgctgccgccgaggcgatgacgctgctgcagcgcgtgaacaagcacgcctcgaacacgttctacgtggctgaagacgtcctgccgcaaacgctggaagtggttcgcacgcgcgccctgccgctcggcatcgaggtcaaggtcggccccgccgccgacgccgcgcaggcccatgcctttggcgtgctcctgcagtacccgggcgtcaatggcgatgtggccgactaccgcgcgattgccgaagccgtgcacgcctccggtggccgcgtcgtggccgctgccgacctgctggcgctgacgctgatcgccgcgccgggcgaatggggcgccgacgtgaccgtgggcaactcgcagcgctttggcgtgccgctcggcttcggtggcccgcacgcgggctacatggccgtgaaagatgaattcaagcgctcgatgccgggccgtctggtcggcgtgacgatcgacgcgcaaggcaacaaggcctatcgtctggcgctgcagacgcgcgaacagcacatccgccgcgagaaggccacgtcgaacatctgcacggcgcaggtcttgctggccgtgatggcgtcgatgtacgcggtctaccatggtccacagggcctcaagcgcatcgcccagcgcgtgcatcgcctgaccgccacgctggccgccggcctgaagacgctggggcatacgccgctgaacgctacgttcttcgacacgctgacgctggagaccggcttcaacaccgacgcgttccacgcatcggccacggcccgtggcatcaacctgcgccacgtggacgccacccgcatcggcatttcgttcgatgaaaccgcatcgcgcgacgacgtgatcgcgctgtgggaaatcttcgcgcacggcaaggccgtgcccgacttcgacacgatcgaagcctcggtgcaggacggcttcccggcgacgctggcgcgccagagcgcgtacctcacgcacccggtgttcaacacgcaccacgccgaacacgagatgttgcgctacctgcgtgcgctggccgacaaggacctcgcgctcgaccgcacgatgatcccgctgggctcctgcaccatgaagctcaacgccaccagcgagatgatcccggtgacgtggcccgagttcagcaacatccacccgttcgcgccgctcgaccagaccgtcggctatcgcgaaatgatcgaccagcttgaggcgatgctgtgcgccgccaccggctacgccgcggtgagcctgcagccgaacgccggttcgcagggcgagtacgcgggcctgctgattatccatgcctatcacgcgagccgtggcgaaagccatcgcgatatctgcctgatcccgtcgtccgcgcacggcaccaacccggcgtcggcgcagatggccggcatgaaggtggtggtggtggcctgcgacgagaacggcaacgtcgatctggcggatctggccaagaaggccgagcagcacagcaagaacctggccgcgatcatgatcacctacccgtccacgcacggcgtgttcgagcagggcgtgcagcagatctgcgacatcgtgcacaagcacggcgggcaggtctacgttgacggcgcgaacatgaacgcgatggtcggcgtggccgcgccgggccagttcggtggcgacgtgtcccacctgaatctgcacaagacgttctgcattccgcacggcggtggcggcccgggcgtcggcccggtggcggtgggcgcgcatctggcggacttcctgccgaaccaggacagcgtcggctatcgtcgcgacgagaacggcatcggcggtgtctcggccgcgccgttcggctcggccagcatcctgccgatttcgtggatgtatatcgcgatgatgggctcggccggcctgaccgccgccaccgagaacgcgatcctgacggccaactacgtggcccggcgtctgtcgccgcacttcccggtgctctacacgggccagcacggcctggtggcgcacgagtgcattctggatctgcgcccgctgcagaaggccactggcatcagcaacgaggacgtggccaagcgcttgatggactacggcttccacgcgccgaccatgagcttcccggtgccgggcacgctgatgatcgagccgaccgagagcgaggcactgcacgagctcgaccgcttcatcgacgcgatgatcgccatccgtggcgagatcgcgcgtgtcgaggacggcagcttcgatcgcgaagacaacccgctcaagcacgcgccgcacacagcagccgtggtggtcagcgacaagtggaaccacaagtacacgcgcgaggaagccgcctacccggtggcatcgctgcgcacgcagaagtactggccgccggttggccgcgcggacaacgtgtacggcgaccgcaatctgttctgctcgtgcgtaccgctaagcgagtacgctgaagactga

SEQ ID NO: 2823 - protein, 974 aa, Ralstonia metallidurans CH34
MNAPLPMNAAAQGARPTLAELEARDAFAARHIGPDSAEQQHMLKVLGFESRAALIDAVVPAAIRRRDGMSLGEFTAPLTEEAALGRLRALAGKNRVLKSFIGQGYYNTLTPGVILRNIFENPAWYTAYTPYQPEISQGRLEAMLNFQQMITDLTGLDIANASMLDEGTAAAEAMTLLQRVNKHASNTFYVAEDVLPQTLEVVRTRALPLGIEVKVGPAADAAQAHAFGVLLQYPGVNGDVADYRAIAEAVHASGGRVVAAADLLALTLIAAPGEWGADVTVGNSQRFGVPLGFGGPHAGYMAVKDEFKRSMPGRLVGVTIDAQGNKAYRLALQTREQHIRREKATSNICTAQVLLAVMASMYAVYHGPQGLKRIAQRVHRLTATLAAGLKTLGHTPLNATFFDTLTLETGFNTDAFHASATARGINLRHVDATRIGISFDETASRDDVIALWEIFAHGKAVPDFDTIEASVQDGFPATLARQSAYLTHPVFNTHHAEHEMLRYLRALADKDLALDRTMIPLGSCTMKLNATSEMIPVTWPEFSNIHPFAPLDQTVGYREMIDQLEAMLCAATGYAAVSLQPNAGSQGEYAGLLIIHAYHASRGESHRDICLIPSSAHGTNPASAQMAGMKVVVVACDENGNVDLADLAKKAEQHSKNLAAIMITYPSTHGVFEQGVQQICDIVHKHGGQVYVDGANMNAMVGVAAPGQFGGDVSHLNLHKTFCIPHGGGGPGVGPVAVGAHLADFLPNQDSVGYRRDENGIGGVSAAPFGSASILPISWMYIAMMGSAGLTAATENAILTANYVARRLSPHFPVLYTGQHGLVAHECILDLRPLQKATGISNEDVAKRLMDYGFHAPTMSFPVPGTLMIEPTESEALHELDRFIDAMIAIRGEIARVEDGSFDREDNPLKHAPHTAAVVVSDKWNHKYTREEAAYPVASLRTQKYWPPVGRADNVYGDRNLFCSCVPLSEYAED

SEQ ID NO: 2824 - DNA, 2850 bp, Silicibacter sp. TM1040
  CDS (1)..(2850): transl_table=11
atgcctttcgaaccgacagattacctcccgtatgactttgccaatcggcgccacatcggtccctcgcccgaggaaatggccgagatgctcaaggtggtcggcgccgacagcctagatgcgctgatcgatgagaccgtgccgcaatccatccgtcaaaaagcagcgctggactttggccgcccgatgtccgagcgcgagctgctgtttcacatgcgcgaggtcgcaggcaagaacaaggtaatgacctcgctgatcggccaaggctatcacggcaccgtgaccccgcccgcgattcagcgcaacattcttgaaaatcctgcctggtacacggcctacacgccctatcagcccgagatttcgcaggggcgtcttgaggcactcttgaacttccagaccatgatctctgatctgaccggtcttgaaatcgccaacgcttcgcttctggacgaggccaccgcctgcgccgaagccatgaccatggcggagcgtgtctccaagtccaaagccaaggctttctttgtcgaccgcgactgtcacccgcagaacatcgcggtggtgaaaacccgcgccgaaccgctaggtatcgaggtgatcgttggcaaccccgacaagatggatcccgaggctgtctttggtgcattgttccagtatccgggcacctatggccatgtgcgcgactttaccgaccacattgccaagctccacgaacacaagggcatcgctgttgtttctgccgacccgatgtcgctcacgctgctgaaagagccgggtgcgatgggagcagatattgcggtcggctccacccagcgttttggcgtgcctgttggggcaggggggccgcacgcggcctatatggcgaccaaagacgcctacaagcgcaacatgccgggccggatcgtcggtgtgtctgtcgatgcacatggcaacaaagcttaccgtctgtcgctgcagacccgggagcagcacatccgccgtgaaaaagcgacctcgaacgtctgcactgcgcaagcgcttcttgcggtgatggcgtccatgtatgcggtcttccacggtcccaaaggtctgaaggcgatcgcgcaacgcatccaccgcaaggccgtgcgtctggccaaaggcctcgaggaggccggcttcaaagtcgacccgcaggctttctttgataccattaccgtcgatgttggaccgctgcaggcagccgtcatgaaatcggcggtggacgaagggatcaacctgcgtcgcgtgggtgaaacccgtgtggggatctcggtggatgaaaccacccgccccgaaaccatcgaagcggtttggcgtgcctttggcatcgtgcgtgcggatgatgatttcaccccggactaccgcgtgcctgcgaacatgcatcgcaagtcggactacctgacgcacccgatcttccacatgaaccgcgccgagaccgagatgatgcgctacatgcgtcgccttgcggatcgcgatctggcgctggaccgtgcgatgatcccgcttggctcctgcaccatgaagctcaacgcggcagcggaaatgatgccgctcagctggccagagttttcgaccatccacccctttgcacctgcggatcagcaggctggctatggcgagatggttgaagacctttcgaagaagctctgcgacattaccggctatgatgcgatctccatgcagccgaactctggcgcgcagggcgaatatgctggcctcctgaccattgccgcctatcacaaggcgcgcggtgaagggcaccgtaatatctgcctgatcccgatgagcgcccacggcaccaacccggcctccgctcagatggttggctggaaagtggttgtggtcaaatccgacgagcgcggcgacatcgatcttgaggacttccgtgccaaggccgagaaacacgccgacaacctcgcgggctgcatgatcacctacccatcgacccatggcgtgtttgaggaaaccgtgcatgaggtctgcaaaatcacccatgatgcgggtggtcaggtctatatcgatggcgccaacatgaacgccatggtggggctgagccgtccgggcgatctggggggggatgtgagccacctcaacctgcacaaaacctttgccattccgcatggcggtgggggccccggcatgggaccgatcggcgtcaaagcgcatctggtcgaacacctcccggggcatcctgaaaccggtggatccgaagggcctgtctctgcggcgcccctggggtcggcgtcgatcctgacgatctcctgggcctattgcctgatgatgggcggtgcaggtctgacgcaggcgacgaaggttgcgatcctctcggccaactatctggccaaacggctcgaaggtgcgtttgacgtgctctacaaaggaccgacaggtcgggttgcgcatgagtgcattctcgatacgcgtccctttgccgacagcgcagatgtgaccgtggacgatgtggccaagcgtctgatggacagcggtttccacgctcctaccatgagctggcccgttgcgggcactctgatggtggagccaaccgagtccgaaaccaaggcggaactggatcgttttgtcgatgcgatgttgtcgatccgtgacgagatcaaagcggtcgagtccggcgagatgccgcgcgagaacaatgcgctcaagaacgctccgcacacgatggaagatctggtgaaagactgggatcgcccctactcgcgcgagcagggctgcttcccgccgggtgctttccgtgtcgacaaatattggccgcccgtgaaccgcgtcgacaacgtctatggcgaccgtcacctgatctgcacctgcccgccgcttgaggactacgcagaagcggcagagtga

SEQ ID NO: 2825 - protein, 949 aa, Silicibacter sp. TM1040
MPFEPTDYLPYDFANRRHIGPSPEEMAEMLKVVGADSLDALIDETVPQSIRQKAALDFGRPMSERELLFHMREVAGKNKVMTSLIGQGYHGTVTPPAIQRNILENPAWYTAYTPYQPEISQGRLEALLNFQTMISDLTGLEIANASLLDEATACAEAMTMAERVSKSKAKAFFVDRDCHPQNIAVVKTRAEPLGIEVIVGNPDKMDPEAVFGALFQYPGTYGHVRDFTDHIAKLHEHKGIAVVSADPMSLTLLKEPGAMGADIAVGSTQRFGVPVGAGGPHAAYMATKDAYKRNMPGRIVGVSVDAHGNKAYRLSLQTREQHIRREKATSNVCTAQALLAVMASMYAVFHGPKGLKAIAQRIHRKAVRLAKGLEEAGFKVDPQAFFDTITVDVGPLQAAVMKSAVDEGINLRRVGETRVGISVDETTRPETIEAVWRAFGIVRADDDFTPDYRVPANMHRKSDYLTHPIFHMNRAETEMMRYMRRLADRDLALDRAMIPLGSCTMKLNAAAEMMPLSWPEFSTIHPFAPADQQAGYGEMVEDLSKKLCDITGYDAISMQPNSGAQGEYAGLLTIAAYHKARGEGHRNICLIPMSAHGTNPASAQMVGWKVVVVKSDERGDIDLEDFRAKAEKHADNLAGCMITYPSTHGVFEETVHEVCKITHDAGGQVYIDGANMNAMVGLSRPGDLGGDVSHLNLHKTFAIPHGGGGPGMGPIGVKAHLVEHLPGHPETGGSEGPVSAAPLGSASILTISWAYCLMMGGAGLTQATKVAILSANYLAKRLEGAFDVLYKGPTGRVAHECILDTRPFADSADVTVDDVAKRLMDSGFHAPTMSWPVAGTLMVEPTESETKAELDRFVDAMLSIRDEIKAVESGEMPRENNALKNAPHTMEDLVKDWDRPYSREQGCFPPGAFRVDKYWPPVNRVDNVYGDRHLICTCPPLEDYAEAAE

SEQ ID NO: 2826 - DNA, 2916 bp, Myxococcus xanthus DK 1622
  CDS (1)..(2916): transl_table=11
atgtccttgaactggaagtatcaggagccgtttgccggccgtcacaatggtccggatgacaccgagctgaagcagctgctgtccgcgctgggcgtggactcgctcgatgctttcatcgaccaggccgtcccgcccgccatccgcgccaaggagccgctgaagctcgcgaccgcgcgcggcgagcacgaactgctggcggccttggagtccatcgccgcgaagaaccaggtgttccggtccttcatcggcatgggctaccacgacacgcacacgccgaacgtcatcctccgcaacgtcttccagaacccgggctggtacacccagtacacgccctatcaggcggagattgcgcagggccggctggaggcgctgctcaacttccagacgctggtcatggacctgacgggtctggaggtggccaacgcctcgctgctggatgaaggcaccgccgccgccgaggcaatggctctggccctggccgtgcaccagaagggcgaggagtccggcgcggccttcttcgtctccgacggctgccacccgcagacggtggaggtggtgcgcacccgcgcccagccgctgggcgtggaggtggtggtgggcgaccaccgcacggtggatttgagctcgaagaagttcgtgggcgcgctggtgcagtacccgaccaccgacggcgcggtgcatgactaccgggccttcggcgagcaggtgcacgccgcgggcggcctgttcgtggtggccgcggacctgctcagcctgacgctgctgacgccgccgggggagttcggcgcggacgtggcggtgggcagcgcccagcgcttcggcgtgcccatgggctacggcggcccgcacgcgggctacttcgccacgaagaacgcgtacacccgcgtcatgcccggccgcatcatcggcgtgtccgaggacgcgcagggacgccgcgcgctgcgcatggcgctccagacgcgtgagcagcacatccgccgcgagaaggcgacgagcaacatctgcaccgcgcaggtgctgctggccgtcatcgccagcatgtacgccgtctaccacggcccctccgggctgaaggccatcgccgagcgcgtgcacggcctgacggtgctgctggcgcgcgggctggcgaagctgggtctcaagctgaagaacgaccagtacttcgacacgctgcgcgtggagctgtcggccgcgcatgtgcgcgcggtgctgggggccgccgaggcggcgcggatgaacttccgccgcatcgacgagaagacgctgggcgtgtccctggatgagacgacgcggcccgcggacgtggaggacatcctggcggccttcgccaccggtaccggcaagtcctccgcgccggtgttggcggacctggtgggggacggcgtggagagcgccgtgtcgcaggcgctgcgccgctcgagcgcgtacctcacgcacccggtcttcaacagctaccactccgagacggagatgctgcgctacatccggcggctcgaggcgaaggacctgtccctcacgcactcgatgattccgctgggcagctgcaccatgaagctcaacgccaccgcggagatgattccggtgacgtggccccagttcgggcggctgcacccgttcgcgcccacctcgcaggcggctggctacaaggtcatcttcgagcagctggagcagatgctcacgcaggtgacgggcttcgcgggttgctcgctccagcccaacgccggaagccagggggagtacgcgggcctgctcgtcatccgcgcgtaccaccagagccgcggccaggggcaccgggacgtgtgcttgattccgtcctccgcgcacggcaccaacccggcttcggcggtgatggccggctacaaggtcgtcgtcaccaagtgcgatgagaacggcaacatcgacctggatgacctgcgcgcgaaggcggaggcgcacaaggacgcgctcgccgcgctgatggtgacctacccgtccacccacggcgtgttcgaggaggagattcgcgaaatctgcgccatcgtccacgagcgcggcggccaggtgtacatggacggcgccaacctcaacgcgcaggtgggcctcacctcgcccgggttggtgggcgcggacgtgtgccatatcaatctgcacaagacgttctgcatcccgcacggcggcggcggcccgggcatgggccccatctgcgtggccagccacctggtgaagttcctgccggggcaccccgtcatccagacgggcggctcggaggccattggcgccatctccgcggcgccgtggggcagcgcgagcatcctgctcatctcgtggatgtacatcgcgatgatgggcggcgagggcctcacccaggccaccaagctggccatcctcaacgccaactacgtcgccgagcggctcaacgcccactacccggtactgtaccggggcaagcgcggcaaggtggcgcacgagtgcatcgtcgacctgcgcccgctcaagaagacggcgggcgtggaggtggaggacgtggccaagcggctcatggactacggcttccacgcgcccaccgtgtccttcccggtggcgggcacgctcatgattgaaccgacggagagcgagtccaaggcggagctggaccgtttctgcgacgcgatgatcgccatccgtcaggagattcgggacatcgaggagggccgcatgcccaaggacaacaacgtcctcaagcacgctccgcacaccgcgcgtgtcgtcgccgcgccggagtggaaccgtccctactcgcgcgagcaggccgtgttccccacaccgtgggtccgcgacaacaagttctggccctccgtgggccggctcaacagcgtgctcggtgaccggaagctggtctgctcgtgcccgcccatcgaggactacatgacgccggagccgaaggccgccacggcctga

SEQ ID NO: 2827 - protein, 971 aa, Myxococcus xanthus DK 1622
MSLNWKYQEPFAGRHNGPDDTELKQLLSALGVDSLDAFIDQAVPPAIRAKEPLKLATARGEHELLAALESIAAKNQVFRSFIGMGYHDTHTPNVILRNVFQNPGWYTQYTPYQAEIAQGRLEALLNFQTLVMDLTGLEVANASLLDEGTAAAEAMALALAVHQKGEESGAAFFVSDGCHPQTVEVVRTRAQPLGVEVVVGDHRTVDLSSKKFVGALVQYPTTDGAVHDYRAFGEQVHAAGGLFVVAADLLSLTLLTPPGEFGADVAVGSAQRFGVPMGYGGPHAGYFATKNAYTRVMPGRIIGVSEDAQGRRALRMALQTREQHIRREKATSNICTAQVLLAVIASMYAVYHGPSGLKAIAERVHGLTVLLARGLAKLGLKLKNDQYFDTLRVELSAAHVRAVLGAAEAARMNFRRIDEKTLGVSLDETTRPADVEDILAAFATGTGKSSAPVLADLVGDGVESAVSQALRRSSAYLTHPVFNSYHSETEMLRYIRRLEAKDLSLTHSMIPLGSCTMKLNATAEMIPVTWPQFGRLHPFAPTSQAAGYKVIFEQLEQMLTQVTGFAGCSLQPNAGSQGEYAGLLVIRAYHQSRGQGHRDVCLIPSSAHGTNPASAVMAGYKVVVTKCDENGNIDLDDLRAKAEAHKDALAALMVTYPSTHGVFEEEIREICAIVHERGGQVYMDGANLNAQVGLTSPGLVGADVCHINLHKTFCIPHGGGGPGMGPICVASHLVKFLPGHPVIQTGGSEAIGAISAAPWGSASILLISWMYIAMMGGEGLTQATKLAILNANYVAERLNAHYPVLYRGKRGKVAHECIVDLRPLKKTAGVEVEDVAKRLMDYGFHAPTVSFPVAGTLMIEPTESESKAELDRFCDAMIAIRQEIRDIEEGRMPKDNNVLKHAPHTARVVAAPEWNRPYSREQAVFPTPWVRDNKFWPSVGRLNSVLGDRKLVCSCPPIEDYMTPEPKAATA

SEQ ID NO: 2828 - DNA, 2847 bp, Mycobacterium sp. MCS
  CDS (1)..(2847): transl_table=11
gtgctcgactctcatcagccccgtttcgccgaccgacacatcggtccggactccgatgccgtcgcggtcatgctcgacaccatcggcgtggcgaccctcgacgacctcgccgccaaggcgctgcccgcgaacatcctcgacgccctgtcggccgacggggtcgcgcccggcctcgaatgcctgccggcccctgcgtccgagaccgaggcgctcgcggaactccgggcgctcgcggagtcgaacaccgtcgcggtgtcgatgatcgggcagggctacttcgacaccctgaccccgccggtgctgcgccgcaacatcctggagaacccggcctggtacaccgcctacacgccgtaccagcccgagatcagccagggtcggctcgaggcgctgctcaacttccagaccatggtgtccgatctgaccggcctcgaggtcgccaacgcgtcgatgctcgacgaggccaccgccgcggccgaggccatgacgctgatgcagcgcgccggccgcagcaagtcgaaccggttggcagtcgacgccgatctgtaccgccagaccgccgcggtgctcgccacccgggcccggcccctcgggatcgagatcgtcaccgccgacctgcgccacgggctgcccgagggcgacttcttcggcgtcatcgtccaacttcccggtgcgagcggagcactcgtcgactgggcgccgctggtggccgacgcgcacgaccgtggtgccctcgtggcagtcggcgccgatctgctggcactgacgctggtcaccccgccgggtgagttcggcgccgatgtctccttcggcagcacgcagcgattcggtgtgccgatggggttcggcggcccgcatgccggttatctcgcggtgcacaccaaacacgcccggcagctgcccggccgcctcgtcggggtgtccgtggatgcggacggatcgccggcgtaccgattggcgctgcagacccgcgaacagcacatccgccgggacaaggcgaccagcaacatctgcaccgcccaggtgctgctggcggtcatcgcggcgatgtacgcgagctatcacggcgccgaaggtctgacctcgatcgcccgccgcgtgcacgggcacgcccgcgcggtcgccaccggactcgccgaggccggggtcgacgtggtgcacgacgcattcttcgacaccgtgctggtcaaggtgccgggccgggccgccgagatccgcgacgccgcgaagtcgcacggcatcaacatctggctggtcgacgccgatcacgtatcggtgtcctgcgacgaggcgaccaccgccgaccacgtcgccgcggtgctctcggcgttcggcgccacccgcggcggcaagcccttcgccggacccgagatcgccacgcgcacatcggcattcctcacccatccggcgttcacccggtaccgcaccgaaaccgagatgatgcgctacctgcggtcgttggccgataaggacatcgcactggaccgcagcatgatcccgctcggttcctgcaccatgaagctcaacgccgccgcggagatggagccgatcacctggccggagttcgccaggcaacacccgttcgggcccgagagcgatgcgccgggcctgcgcaggctgatcgccgatctgcagacctggctgaccggtatcaccggctacgacgagatctcgctgcagcccaacgccggatcccagggcgagtacgccggcctgctggcgatcaaggccttccacgacgccaacggcgcacccgaacgcgacgtgtgcctgatcccgtcgagcgcccacggcaccaacgcggcctcggcggcgttggccgggatgcgggtcgttgtggtggggtgccggccgaacggtgacgtcgacctggacgacctgcgcgccaaggtcaccgagaacgccgagcgcctggccgcactgatgatcacctatccgtcgacgcacggtgtgtacgagcacgacgtcgccgagatctgcgcggccgtgcacgatgcgggcggtcaggtctatgtagacggcgcgaacctcaatgcgttggtcggactggcccggccgggccgattcggcggcgacgtcagccacctcaacctgcacaagacgttctgcatcccgcacggcggcggcggtccgggtgtcgggcccgtcgcggtgcgcgcccacctggcgccgtacctgccgggccacccgctcgccgacgaactcggtgacgactacaccgtctcggccgcgccctacgggtcggcgtcgatcctgccgatcacgtggatgtacatccgcatgatgggagcgccgggtctgcgggcggcgtccctgacggcgatcgcctcggccaactacgtcgcccgccggctcgacgagtactacccggtgctctacacgggcgagaacgggatggtggcccacgagtgcatcctggacctgcggaccatcaccaaacagaccggcgtcaccgtcgacgacgtggcaaagcggttggcggacttcggcttccacgcaccgacgatgagcttcccagtggcggggacgctgatggtcgagccgaccgaaagcgaatcgctgagcgaggtcgacgcgttctgtgaggcgatgatcgccatccgggccgagatcgaccaggtcgggtcgggcgcctggccggtggacgacaacccgttgcgcggtgcgccgcacaccgcggagtcactgctggtgaccgagtgggagcacccgtacacccgcgagcaggcggcctacccgctgggcaagggcttccggcccaaggtgtggccgccggtacggcggatcgacggggcctacggcgatcgcaacctgatgtgctcgtgcccgccggtcgaggcgttcgcgtaa

SEQ ID NO: 2829 - protein, 948 aa, Mycobacterium sp. MCS
MLDSHQPRFADRHIGPDSDAVAVMLDTIGVATLDDLAAKALPANILDALSADGVAPGLECLPAPASETEALAELRALAESNTVAVSMIGQGYFDTLTPPVLRRNILENPAWYTAYTPYQPEISQGRLEALLNFQTMVSDLTGLEVANASMLDEATAAAEAMTLMQRAGRSKSNRLAVDADLYRQTAAVLATRARPLGIEIVTADLRHGLPEGDFFGVIVQLPGASGALVDWAPLVADAHDRGALVAVGADLLALTLVTPPGEFGADVSFGSTQRFGVPMGFGGPHAGYLAVHTKHARQLPGRLVGVSVDADGSPAYRLALQTREQHIRRDKATSNICTAQVLLAVIAAMYASYHGAEGLTSIARRVHGHARAVATGLAEAGVDVVHDAFFDTVLVKVPGRAAEIRDAAKSHGINIWLVDADHVSVSCDEATTADHVAAVLSAFGATRGGKPFAGPEIATRTSAFLTHPAFTRYRTETEMMRYLRSLADKDIALDRSMIPLGSCTMKLNAAAEMEPITWPEFARQHPFGPESDAPGLRRLIADLQTWLTGITGYDEISLQPNAGSQGEYAGLLAIKAFHDANGAPERDVCLIPSSAHGTNAASAALAGMRVVVVGCRPNGDVDLDDLRAKVTENAERLAALMITYPSTHGVYEHDVAEICAAVHDAGGQVYVDGANLNALVGLARPGRFGGDVSHLNLHKTFCIPHGGGGPGVGPVAVRAHLAPYLPGHPLADELGDDYTVSAAPYGSASILPITWMYIRMMGAPGLRAASLTAIASANYVARRLDEYYPVLYTGENGMVAHECILDLRTITKQTGVTVDDVAKRLADFGFHAPTMSFPVAGTLMVEPTESESLSEVDAFCEAMIAIRAEIDQVGSGAWPVDDNPLRGAPHTAESLLVTEWEHPYTREQAAYPLGKGFRPKVWPPVRRIDGAYGDRNLMCSCPPVEAFA

SEQ ID NO: 2830 - DNA, 2847 bp, Mesorhizobium sp. BNC1
  CDS (1)..(2847): transl_table=11
atgagctacaccccgacaggctacgcaccgtacgacttcgcaaaccgccgccacatcggcccctccccgcgcgaaatggcggagatgctggaaactgtcggagccgaaagcctcgatgccttcatcgacgcaatcgttcccgcagacatccggcagacgcgcccgctcgcctggggcaaggccctttccgagcgcggcgttctggaacggctgcgcaacgtggccaagaagaacaagcccaatgccagcttcatcggacagggctaccacggcaccttcaccccgccggcgatccagcgcaacatcttcgagaacccggcctggtacaccgcctacacgccctatcagcccgagatcagccagggccggcttgaggcgctgctcaattatcagaccatgatgaccaatctgaccgggctcgacatcgccaatgcgtcgttgctcgatgaaggcaccgccgccgccgaagccatggccctgtgcgaacgtgcgtcgcgcaccaaggcccgcgccttctttgtcgaccatcattgccatccgcagacaatcgccgtggttgcgacccgggcggagccgcttggatgggaagtgatcgtcggcgatcccttcacctatctcgatccgtcgcgcgttttcggcgccctgtttcagtatcccggcacctatggccatgtgcatgacttcaccgctccgatcgcagcgctcaaggacgctggcgcccttgccgtggtggccgccgacccgctggcgctgaccctgttgaagccaccgggcgagatgggcgccgacatcgccatcggctccagccagcgtttcggcgtgcccctgggctatggcggtccgcacgccgcctacatgaccgtgcgtgccaacctcgcgcggtcgatgccgggccggatcgtcggcgtctccatcgacgcccgcggcaatcgcgcctatcggctgtcgctgcagacgcgcgaacagcatatccgccgcgagaaggcgacatccaatgtctgcaccgcgcaggcgctactggccgtcatggcctcgatgtacggcgtcttccacggacccgacggattgcgggcgatcgccgagcgcatccaccgcaagatcgtgcggctggtcaagggactggaaacccttggcttcccaatcgaaccggtaagtttcttcgacacggtgacagtggaatgcggcccccgccgcgacgccatcctggcatccgccctgcgcgaagggatcaaccttcgcccgatcggcgagacgcggatcggcatcactttcgacgagactgtccggcgcagccacaccgaggcgatctggcgtgcttttggcggcggcatggccgacgacgacatgacgcctgactaccgcctgcccgaggctctgctacgaacctcgagcttcatgacccacccggtcttccacatgaaccgcgccgaagccgagatgacgcgctacatgcgccgcctcgccgaccgcgaccttgcgcttgaccgggcaatgatcccgctcggcagctgcaccatgaagctcaatgccaccgccgaaatgatggcgttgagctggccggaattcgcgaacatgcacccctatgcccccgccgatcaggcacagggttatgccgagatgctgagcgacctcgaggcgaaattgtgccagatcaccggctatgacgcattttcgatgcagccgaattcgggtgcccagggcgaatatgccggtctattgacgatccgccgctatcacgaggtgcagggcgacgggcatcgcaacatttgcctgatcccgacctcggcgcatggcaccaatccggcttccgcacagatggctggcatgaaggtggtggtggtcggcgtggccgccgacggcaacatcgacgtcgccgacttccgcgccaaggccgaagcccatgccgaaaacctcgcggcttgcatgatcacctacccctcgacccacggcgtgttcgagacgaccgttcgcgagatctgcgacatcacccatgcgaatggcggacaggtctatatcgacggcgccaacatgaacgccatggtcggcctggcgcgccccggcgatatcggcggcgacgtaagccatctcaacctgcacaagaccttcgccatcccgcatggcggcggcggaccaggcatgggaccgatcggcgtcaaggcgcatcttgtgccgcatctgccaggcaacccgcctgccggcaagttcgccatctcggccgcaccgttcggctccgcctcgatcctgctcatttcttgggcctattgcctgctgatgggtggtgagggcctgacccaggcgaccaagaccgcgatcctgagcgccaactacatcgcgcggcgactggcatccgcctacccgatcctctacagctcagccgccggccacgtcgcgcatgaatgcattctcgatacgcgagtgctgaaggagcgcgccggggtgaccgtcgacgacatcgccaagcgtcttgtcgactgcggcttccacgcgccgacgatgagctggccagtggccggcacactgatggtagagccgacggaaagcgagcccaaggccgagctcgatcgcttcatcgaggccatgctgggcatcgccgccgaagcggaagcgattgccgccggcaccctggacgcccaggacaacccgctgaagcgcgcgccccataccgtcgaggatctcgtcggcgaatgggaccggctctacagccgcgaggccgcctgcttcccggcaggctcgttccgcaccgacaaatattggccgcccgtcaaccggatcgacaatgtccatggcgaccgcaaccttgtctgcacctgcccgccgctcgaaagctacgcggaagctgccgagtga

SEQ ID NO: 2831 - protein, 948 aa, Mesorhizobium sp. BNC1
MSYTPTGYAPYDFANRRHIGPSPREMAEMLETVGAESLDAFIDAIVPADIRQTRPLAWGKALSERGVLERLRNVAKKNKPNASFIGQGYHGTFTPPAIQRNIFENPAWYTAYTPYQPEISQGRLEALLNYQTMMTNLTGLDIANASLLDEGTAAAEAMALCERASRTKARAFFVDHHCHPQTIAVVATRAEPLGWEVIVGDPFTYLDPSRVFGALFQYPGTYGHVHDFTAPIAALKDAGALAVVAADPLALTLLKPPGEMGADIAIGSSQRFGVPLGYGGPHAAYMTVRANLARSMPGRIVGVSIDARGNRAYRLSLQTREQHIRREKATSNVCTAQALLAVMASMYGVFHGPDGLRAIAERIHRKIVRLVKGLETLGFPIEPVSFFDTVTVECGPRRDAILASALREGINLRPIGETRIGITFDETVRRSHTEAIWRAFGGGMADDDMTPDYRLPEALLRTSSFMTHPVFHMNRAEAEMTRYMRRLADRDLALDRAMIPLGSCTMKLNATAEMMALSWPEFANMHPYAPADQAQGYAEMLSDLEAKLCQITGYDAFSMQPNSGAQGEYAGLLTIRRYHEVQGDGHRNICLIPTSAHGTNPASAQMAGMKVVVVGVAADGNIDVADFRAKAEAHAENLAACMITYPSTHGVFETTVREICDITHANGGQVYIDGANMNAMVGLARPGDIGGDVSHLNLHKTFAIPHGGGGPGMGPIGVKAHLVPHLPGNPPAGKFAISAAPFGSASILLISWAYCLLMGGEGLTQATKTAILSANYIARRLASAYPILYSSAAGHVAHECILDTRVLKERAGVTVDDIAKRLVDCGFHAPTMSWPVAGTLMVEPTESEPKAELDRFIEAMLGIAAEAEAIAAGTLDAQDNPLKRAPHTVEDLVGEWDRLYSREAACFPAGSFRTDKYWPPVNRIDNVHGDRNLVCTCPPLESYAEAAE

SEQ ID NO: 2832 - DNA, 2796 bp, Mesorhizobium sp. BNC1
  CDS (1)..(2796): transl_table=11
atgactgcaactttctccacccgccatatcggcccgcgcagcgacgagaccaaggcgatgctcgcctttctcggtctcccctcgctcgagacgctgatcagccaggcggtgccgaaatcaatccgcctcgaccgccctctcaacctcccggaagcggcgagcgaggccgaagccctggcagagctgcaggcttatatgcgggagaataaggttctgaagagctttatcggcgccggatatcatggctgccatgtcccgccggtcatccagcggaacctgttcgagaacccggcctggtacacggcctatacgccttatcagtccgagataagccagggccgcctggaaatgctcttccacttccagacgctggtgacggagcttaccggcttgcccgttgcctccgcctcccttttggatgaggcgtcggctgtcgccgaggctgtcggaatcgcctggcggcatcacaagagcaagcgcaacagaatagtgatcgccggcgcgctcaatccgcagacgcgcgatgtcgtggaaacacgcgcggagcctctcggtatcgagattgcaacgaatattgagctcgatggcgacacctttgcccttatcgttccgtggggcgacacctacggtgcctacgaggatcactcggccctcatcggcgaggcaaaagcgaaggacgcgatcgtcatcttcgtggccgatccgctcggtcttctgctcagcgacacgccggccgcgcttggcgcggagattgccgtcggcccgatgcagcgcttcggcgttcccatgggctttggcggcccgcatgcggcttattgcgcggtttccgaccggctgacccgcctgatgccgggccggctcgtcggccagtcggtcgatgcccatggccgcccgggctatcgcctggcgctacagacgcgcgagcagcacatccgccgcgacaaggccacctcaaatatctgcaccgcccaggcgttgctcgccaatatggcggcggcttatgcaatctggcacgggcctgaggggctgaaggccatcgcaacgcatgtgcatggccttgccgcgcgcctccatgcgggtctcaaggcggcgggcctggagcttgccggcgagaagattttcgacacggtgacggtcaccgttcccggcaaggccgcggcgattgcggctgaggccgagaaaaccggcagcctgctgcgtgtcattgatgcggaccgtgtcgggatcaccttcgacgagatatcgaccgaggccgatctggaatcgatcgccaaactcttcggcatcaccgtgcccgccgcagccccggcaatcgcgccgtcgcagcctcgcggcgagcacttcctcacgcagcctgtcttccacgagcaccgctcggaaacggagatgatgcgcttcctgcggcggctctccgacaaggatctggcgcttgaccgggcgatgatcccgctcggctcctgcaccatgaagctcaatgcggcggccgaaatgatgccggtgagctggccggaggtaaacggcctccaccccttcgcgccggatgcccatacggtgggctatcgccgcatggtcggcgagcttgaaggctggcttgccgagatcaccggctttgatgccgtgtcgctgcagcccaatgccggcagccagggcgaatatgccgggcttctcgctatccgccgctatttccgcgagcgcggcgaggaccatcgcgatgtctgccttatcccctcctcggcccatggcaccaatccggcgtccgctgcgatggccggcatgcgcgtggtggtcgtgcgctgccttgagcaaggcgatatcgatcctgaggacctgaaggccaaggccgaggagcactcgagccgccttgccgcccttatgatcacctatccctccacgcatggggtgttcgaggaaggcgtgcgcgacatgtgcgccctcatccatgagcatggcggacaggtctatctcgacggcgccaacctcaatgcgctcgttggcctcgcgcgtccgggcgatctcggcgccgatgtatgccacatgaacctgcacaagaccttctgcattccgcatggcggcggcgggccgggcatcggcccgattggcgtgaaggcgcacctgcagcccttcctgcccggccacgtggagttgggctcggcccacgccgtggcggctgcccccttcggcagtgcgtccattctgcccatcacctggatgtatatccgcatgatgggcgcggcggggctgaagcgcgcgacggaaatggcgatccttaacgccaactacatcgccggcaggcttgaggcgtactatccggtactctaccggggccgcaacggccgggtcgcgcacgaatgcattctcgacacccgcgtcttcaaggaacgggcaggcataggcgtcgaggacatcgccaagcgcctcatcgactatggcttccatgcgccgaccatgtcctggccggtggccggcacgctcatggtcgagccgaccgagtcggagcccaagagcgaactcgaccgcttttgcgacgcgatgatctccattgcgggagaagcgggacgcgtggaaaaaggcgagtggccgaaagacgacaatccgcttgtcaacgcgccccacaccgccgcggagctgatggccgatacctggtcgcatccctattcccgcgcggaagcggccttcccgtcgggaagcatggattgggcggcgaaatactggccgcccgtctcccgcgtcgacaatgtggcgggcgaccgcaaccttgtctgcgcctgcccgcctatcgaggcgctcgcaagctga

SEQ ID NO: 2833 - protein, 931 aa, Mesorhizobium sp. BNC1
MTATFSTRHIGPRSDETKAMLAFLGLPSLETLISQAVPKSIRLDRPLNLPEAASEAEALAELQAYMRENKVLKSFIGAGYHGCHVPPVIQRNLFENPAWYTAYTPYQSEISQGRLEMLFHFQTLVTELTGLPVASASLLDEASAVAEAVGIAWRHHKSKRNRIVIAGALNPQTRDVVETRAEPLGIEIATNIELDGDTFALIVPWGDTYGAYEDHSALIGEAKAKDAIVIFVADPLGLLLSDTPAALGAEIAVGPMQRFGVPMGFGGPHAAYCAVSDRLTRLMPGRLVGQSVDAHGRPGYRLALQTREQHIRRDKATSNICTAQALLANMAAAYAIWHGPEGLKAIATHVHGLAARLHAGLKAAGLELAGEKIFDTVTVTVPGKAAAIAAEAEKTGSLLRVIDADRVGITFDEISTEADLESIAKLFGITVPAAAPAIAPSQPRGEHFLTQPVFHEHRSETEMMRFLRRLSDKDLALDRAMIPLGSCTMKLNAAAEMMPVSWPEVNGLHPFAPDAHTVGYRRMVGELEGWLAEITGFDAVSLQPNAGSQGEYAGLLAIRRYFRERGEDHRDVCLIPSSAHGTNPASAAMAGMRVVVVRCLEQGDIDPEDLKAKAEEHSSRLAALMITYPSTHGVFEEGVRDMCALIHEHGGQVYLDGANLNALVGLARPGDLGADVCHMNLHKTFCIPHGGGGPGIGPIGVKAHLQPFLPGHVELGSAHAVAAAPFGSASILPITWMYIRMMGAAGLKRATEMAILNANYIAGRLEAYYPVLYRGRNGRVAHECILDTRVFKERAGIGVEDIAKRLIDYGFHAPTMSWPVAGTLMVEPTESEPKSELDRFCDAMISIAGEAGRVEKGEWPKDDNPLVNAPHTAAELMADTWSHPYSRAEAAFPSGSMDWAAKYWPPVSRVDNVAGDRNLVCACPPIEALAS

SEQ ID NO: 2834 - DNA, 2901 bp, Cytophaga hutchinsonii ATCC 33406
  CDS (1)..(2901): transl_table=11
atgaaaatagatttaacccaaagaggttccttccaggaaagacacatcggtacgtcactttcagaaaaagaaacgatgctgaaagctatcggtgtcggttcgcttgatcagttgattgatgaaactgttccggcaaacattcgcctggcaaaccctctgcaattgccgaaggcattgagtgaagaagaatttctggttgaattcaaaaaagttgtttctcaaaatgaaatttttaaaacatatatcggtttggggtattacaatacccttacgccaacggttattcttcgtaatatattagaaaatccgggttggtataccgcttatacaccgtatcaggcagagattgctcaaggccgtctggaagccctgatcaattaccagacaatggtttgtgaattaacaggtatggagattgcaaatgcttcgttgctggatgaagctactgcagcggctgaagcaatgacgcttatctacagtttgcgtaaaggaacgaaaaagaatgcaacggtttttgttgtttcaaaatatacctttcctcaaaccatagacgtattgttaacgcgttcagaaccgctgggcattaaattagagatggtagatcctgcaaccgcagactttacacgtacagacatatttggcgcattggtacagtctccggattgtaacggaaatgttgcggattatacagcacttatttcagccgctcatgcgaacgataccttagttgcattcggttcggatctgttgagcctgacacttattaaatcgccgggtgaaatgggcgcagatgttgtgttcggttcttcacagcgttttggcgtgccaatgggttttggtggtccgcatgcaggtttttttgctaccaaggaagaatacaaacgccagctgccgggccgtatcatcggtgtgtccattgatgcagaaggcaagaaagcatatcgtatgtctctacagacccgcgagcagcatatccgtagagaaaaagcaacctcaaacatttgtactgcccaggtattattatctgtaattgcagcttcgtatgctgtataccacggaccggaaggcctgaagcagatcgctaaccgtgtacatggctttgctgcagcgttaagcgcaattgttacagaatttggttttgaacaaaccaatgcagcattttttgatacgatttcaataaaagctccgggcaaaggattagctataaaatctgcggcagagaaacgtaagatcaacctgcgttatgaaggtgattcagtttttgtagcgctggatgagtcggttactgtagcagatctggatcagctgattgaagtgtttgcagaagctgcagataaaaaagtagtagctattgatatttcaaataagtacctgcgtgttgaaggtgcactttcaggcgcgttgctgcgtacgtctgcgtacatgacacacccggtattcaatacgtaccatacagagcatgaaatgcttcgttatctgaagcatttagaaaacaaagatctttcgttaacgcattccatgatttcattgggttcttgtaccatgaagctgaatgcaacaactgaaatgattccggtaacctggccggaagtagggcagatccatccgtttgtacccgcttctcaggtaaaagggtatcatcagttattcaacaatattgaattgtggttgtctgagatcacaggttttgcaggcgtttctgtacagcccaactcaggtgctcagggtgaatatgccggtttgttagtgatccgcgcataccatgaaagcagaggcgatacacaccgtaatattgcattgataccgacatcggcgcacggtaccaatcccgcaagtgctgtaatggcagctatgcaggtagtgcttgttaaatgcgatgacgcaggcaatattgatgttgccgatctgaaactaaaagctgaacagcacagcaaaaacctatcgtgtctgatggttacgtatccttctacacacggtgtattcgaagaaagtatcatagaaatctgtgaagtaattcaccgtcacggcggacaggtttatatggatggtgcaaacatgaatgcacaggttgggttaacctctccgggcagcatcggagcggacgtttgtcacctgaacttacataaaaccttctgcatcccgcacggcggaggtggtccgggtgttggtccgattggtgtggcagcgcatttgacaccgttcttaccgggccatgctgttgtaaaagcaggtggtgaaaaagcgatctcggctgtttctgcagcgccatggggcagtgcaagcatccttccgatctcctatgcatatattgctatgatgggtagtgaaggactaacgaatgcaactaaaaatgcgatcttaaacgcaaactatattaaatcccgtttagagaaattctatccgattttatataccggtacacacggacattgcgcacatgaatttattctggattgcagagcctttaaaacaactatcggtattgaagttgaagatattgcaaaacgtttgatggattatggtttccacgcgccgaccgtttcattcccggtagccggaacattaatgattgaaccaacggaaagcgaatctaaacatgaactggatcgtttctgtgatgcgatgattgccatccgtgcagaaattgcagaaattgaaaatggtacagcggataaactggataatgtattgaaacatgcaccgcatacagcaagtgttattactgctgatgcctggacacgttcatattctagacagaaagctgcgtatccgttgccttatttaaaaacaacgaagttctggccttctgtaagccgtatagacagtgcatacggtgaccgtaacctgttttgcagctgtatacctacagaggaatttgcagaagcggagctggcaaattaa

SEQ ID NO: 2835 - protein, 966 aa, Cytophaga hutchinsonii ATCC 33406
MKIDLTQRGSFQERHIGTSLSEKETMLKAIGVGSLDQLIDETVPANIRLANPLQLPKALSEEEFLVEFKKVVSQNEIFKTYIGLGYYNTLTPTVILRNILENPGWYTAYTPYQAEIAQGRLEALINYQTMVCELTGMEIANASLLDEATAAAEAMTLIYSLRKGTKKNATVFVVSKYTFPQTIDVLLTRSEPLGIKLEMVDPATADFTRTDIFGALVQSPDCNGNVADYTALISAAHANDTLVAFGSDLLSLTLIKSPGEMGADVVFGSSQRFGVPMGFGGPHAGFFATKEEYKRQLPGRIIGVSIDAEGKKAYRMSLQTREQHIRREKATSNICTAQVLLSVIAASYAVYHGPEGLKQIANRVHGFAAALSAIVTEFGFEQTNAAFFDTISIKAPGKGLAIKSAAEKRKINLRYEGDSVFVALDESVTVADLDQLIEVFAEAADKKVVAIDISNKYLRVEGALSGALLRTSAYMTHPVFNTYHTEHEMLRYLKHLENKDLSLTHSMISLGSCTMKLNATTEMIPVTWPEVGQIHPFVPASQVKGYHQLFNNIELWLSEITGFAGVSVQPNSGAQGEYAGLLVIRAYHESRGDTHRNIALIPTSAHGTNPASAVMAAMQVVLVKCDDAGNIDVADLKLKAEQHSKNLSCLMVTYPSTHGVFEESIIEICEVIHRHGGQVYMDGANMNAQVGLTSPGSIGADVCHLNLHKTFCIPHGGGGPGVGPIGVAAHLTPFLPGHAVVKAGGEKAISAVSAAPWGSASILPISYAYIAMMGSEGLTNATKNAILNANYIKSRLEKFYPILYTGTHGHCAHEFILDCRAFKTTIGIEVEDIAKRLMDYGFHAPTVSFPVAGTLMIEPTESESKHELDRFCDAMIAIRAEIAEIENGTADKLDNVLKHAPHTASVITADAWTRSYSRQKAAYPLPYLKTTKFWPSVSRIDSAYGDRNLFCSCIPTEEFAEAELAN

SEQ ID NO: 2836 - DNA, 2853 bp, Rhodococcus sp. RHA1
  CDS (1)..(2853): transl_table=11
gtgatcgacgctggaagccgtacattcgccgatcgtcatgtcggcccgaacgctgcggaactcgcgcacattctcgaactggtcggagccgattcgctcgacgacctcgcgtcgaaggccgtccccgccgtcatcctggacggggtcacggccggcatcgccgacggcctcgacgcactgcccgcgccggtgtccgagcacgaagcgctcgccgaactgtccacactcgccgcgcagaacaccgtggcgacgtccatgatcggtctcggctactacgacaccctcaccccgccggtcctgatccggaacatcatcgagaacccggcctggtacacggcctacacgccgtaccagcccgagatcagccagggccggctcgaagcgctcctcaacttccagacgatggtcgccgacctgaccggcatggaggtcgccaactcgtcgatgctcgatgaggccaccgccgccgccgaggcgatgacgctgttgcgccgggcgagcaagagcaagtccccgcggttcgtcgtcgacgccgacctgttcccgcagacgctggccgtcgtcgagacccgggccgagccgctcggcatcgagatcgtcgtggccgacctgtccgtcggccttccggacggtgacttcttcggcgtcctcgcccagatgcccggcgggtccggccgtatcgtcgactacaccgacgtgatcgccgccgcccacgagcgcggcgcactggtcgcggtcggggcggatctgctggcactcaccctcctcaccccgcccggcgagatcggggccgacgcctgcttcggcaccacccagcggttcggtgtccccatgggcttcggtggcccgcacgccggctacctcgccgtgcacaccaagcacgcacgtcaactccccggccgtctggtgggcgtctccgtcgacgccgacggcgacaaggcgtaccggctggcgctgcagacccgcgagcagcacattcgccgcgagaaggcgacgtcgaacatctgcaccgctcaggtgttgctggcgattctggcggccatgtacgccagctaccacggcgccgagggcttgaaggcgatcgccctgcgcgtggcgaacacggcgcactcgctggccgccgcgctccgcaagaccggggccgtcgtcgtccacgaacactacttcgacacgatcctcgttcgagtggacggccgagccgcggacgtggtggcgaaggcgaaggacgccggcatcaacctgcggctcgtcgacgccgatcacgtcgccatcgcgtgcgacgaggccaccaccgccgacgacgtcacccaggttctggcggcgttcggcggcgaaggcgccgtgaccgaggaggtgggcacgtccgtccccgacgcgcagctccgcggatccgactacctgcagcacgaggccttcacccggtatcgcaccgagacggcgatgctgcgctacctgcgggcgttgtccgacaaggacatcgcactcgaccgaagcatgatcccactcggttcctgcacgatgaagctcaatgccaccgccgagatggaagcgatcacctggcccgcgttcgccggactgcacccgttcgcgccgaccggggacacaccgggaattctccgcatcatcaaggacctcgagaactggctcgtggccgtcaccggctacgacgcagtcagcctgcagccgaatgccggtagccagggcgagtacgcggggctgctcgcgatccgcaactaccacctcagccgcggagacgaccaccgcgacacctgcctcatcccgtcgagcgcccacggcaccaacgccgcatccgcggtcatggccgggatgcgcgtcgaggtcgtggcgtgccgccccaacggtgacgtggacctggacgatctgcgcgcgaagatcgccgaccatgccgagcgcctcgcggcgatcatgatcacctacccgtccacacacggtgtgtacgagcacgagatcgccgacatctgcgccgccgtccacgacgccggcggccaggtgtacgtcgacggcgccaacctcaacgcccttgtcggcctggcccgtcccggccggttcggcggcgacgtgagccacctcaacctgcacaagacgttctgcatcccgcacggtggcggtggccccggcgtcggtccgatcggtgtgcggtcccacctcacgccgttcctgcccgggcatccgctcgcaccggaactcggcacggccggaccgatctccgcggccccctacggcagtgcgtcgatcctcccgatcacgtgggcgtacatccggatgatgggcgccgtcgggctgcgccgcgcaagcctgaccgccatcgcctcggccaactacatcgcgcgccgcctggacgagtacttccccgtcctctacaccggcgagggcggaatggtggcccacgagtgcatcctcgacctccggccgatcaccaaggacaccggtgtgaccgtcgacgacgtcgcaaagcgcctcgccgactacggattccacgcaccgacgatgagcttcccggtggcgggcaccctcatggtggagcccaccgagagcgagaacctcgaagagatcgacgccttctgcgaggcgatgatcgcgatccgcgccgagatcgaccgcgtgggcgcgggggagtggccggtggacgacaacccgctgcgcggtgccccgcacacgtccggttgcctcgtcgcggagtggaaccacccctacacccgtgagacggcggtgttcccccggggcaaggcacggccgaaggtgtggccggcggtgcggcgcatcgacggtgcacacggcgaccgcaacctcgtgtgctcctgcccgccgatctccgcattcgaaggcgcctga

SEQ ID NO: 2837 - protein, 950 aa, Rhodococcus sp. RHA1
MIDAGSRTFADRHVGPNAAELAHILELVGADSLDDLASKAVPAVILDGVTAGIADGLDALPAPVSEHEALAELSTLAAQNTVATSMIGLGYYDTLTPPVLIRNIIENPAWYTAYTPYQPEISQGRLEALLNFQTMVADLTGMEVANSSMLDEATAAAEAMTLLRRASKSKSPRFVVDADLFPQTLAVVETRAEPLGIEIVVADLSVGLPDGDFFGVLAQMPGGSGRIVDYTDVIAAAHERGALVAVGADLLALTLLTPPGEIGADACFGTTQRFGVPMGFGGPHAGYLAVHTKHARQLPGRLVGVSVDADGDKAYRLALQTREQHIRREKATSNICTAQVLLAILAAMYASYHGAEGLKAIALRVANTAHSLAAALRKTGAVVVHEHYFDTILVRVDGRAADVVAKAKDAGINLRLVDADHVAIACDEATTADDVTQVLAAFGGEGAVTEEVGTSVPDAQLRGSDYLQHEAFTRYRTETAMLRYLRALSDKDIALDRSMIPLGSCTMKLNATAEMEAITWPAFAGLHPFAPTGDTPGILRIIKDLENWLVAVTGYDAVSLQPNAGSQGEYAGLLAIRNYHLSRGDDHRDTCLIPSSAHGTNAASAVMAGMRVEVVACRPNGDVDLDDLRAKIADHAERLAAIMITYPSTHGVYEHEIADICAAVHDAGGQVYVDGANLNALVGLARPGRFGGDVSHLNLHKTFCIPHGGGGPGVGPIGVRSHLTPFLPGHPLAPELGTAGPISAAPYGSASILPITWAYIRMMGAVGLRRASLTAIASANYIARRLDEYFPVLYTGEGGMVAHECILDLRPITKDTGVTVDDVAKRLADYGFHAPTMSFPVAGTLMVEPTESENLEEIDAFCEAMIAIRAEIDRVGAGEWPVDDNPLRGAPHTSGCLVAEWNHPYTRETAVFPRGKARPKVWPAVRRIDGAHGDRNLVCSCPPISAFEGA

SEQ ID NO: 2838 - DNA, 2955 bp, Rhodococcus sp. RHA1
  CDS (1)..(2955): transl_table=11
atgtccggtgcggtccggactcaacgaaaccggagtcacctcgtgccagcagaaccccgcaccgccatccgcggcgtgcccctcaccagcgactttccgtcccgccacatcggtcctgatgccgccgcgtcacggcggatgctcgacgccctcggttacgacagtctcgcgaacctgatcgacagcgcggtgccggaccagatccgcagctcacagcccttgaatctgcccgcggcgaggtccgagcagcaggttctcgccgatctgcgggcgctgtcggagcgcaacgagacccgcgtccagatgatcggcctcgggtactccgacaccatcactcccgcggtgttgcgacggaacatgctcgagtcccccgcctggtacacggcctacaccccgtaccaaccggagatctcccagggcaggctggaggcgctgctgacgttccagaccgtcatcgaggatctgaccgcccttcccctggccggcgcgtcgctgctcgacgaggcgaccgccgtgatggaggcggtactgctgatgcggcgcgcgaacaagtcgaagtccgccaccaaccgcgtcgtcctcgacgcggactgcctgccacagacactggccgtcgtccggggacgggcgaaagcagtgggcatcgaggtggtggtcgcggaactgtccggggaactgcccgacggtgacatgttcggggtggtcttccaggcgcccggtgcgagcggcgcggtgcgcgacctggctccgatgatcgccgcggcgaaggcgcgcggcgccctgaccaccgtcgcggcggacctgctgtcgctgacgattctgacaccgcccggcgagcagggcgccgacatcgccgtcgggtcggcgcagcgattcggtgtgcccctgttcttcggcggaccgcacgccggctacatggccgtgcgcagcgggctcgagcgcatgctgcccggccgtctcgtcggagtgtccgtcgacgtcgacgggaagaccgcctaccggctggctctgcagacccgcgaacagcacatccggcgcgacaaggcgaccagcaacatctgcacggcgcaggcgctgctcgcgaacgtcgccgcgatgtacgccgcctaccacggtccggaggggttgcgcgccatcgcgaatcgggtgcacacccacgcgacgaccatcgcaggaagcctgcgcgccgccggtcacacgatcgtgcacgacagcttcttcgacacggttctcgtgcgggtcccggcgggtgccggggcgatcgtggagtcggccgatcgggacggcatcaacctccgtctcgtcgactccgatcacgtcgcgatcgcctgcgacgagtgcaccaccgacgacatcgtccggcgggtggtcgccgtgttcggtgcgcagccgacgaccgtcgcggtgcccgaactgccgtcggcactcgccaggacgtcgaactacttgcagcaccccgtgttccacgatcaccgctccgaaaccgcgatgctccgcttcctgcgcacgctgtcggacaaggacctcgcgctcgaccgcaccatgatcccgctcggatcgtgcacgatgaaattgaactccgccgtcgagatggaaccgatcagctggcccggattcgcgtccatccacccgtacgccccggtcgcgcagacggcgggctacctcgaactcgtcgccgacctggaacgctggctcggcgagatcaccggctacgatcgggtgtcgttgcagcccaatgccggatcccagggcgagctggccggcctgctcgcgatccacggctatcacgaatcccgcggcgacttcgaacgcaacgtctgcctcatcccccagtccgcgcacggcaccaacgccgcatccgcggttctcgcgggcatgaaggtcgtcgtcgtcgcgaccgcggagaacggcaacatcgacgtgggcgacctgcgcgcgaagatcgcggcgcacgagggcgcgatcgccgcgatcatgttgacctacccgtccactcacggcgtgtacgagaacgacgtgcggacggtctgcgatctggtgcacgaggccggcgggcaggtgtacgtcgacggcgcgaacctcaatgcgttggtcggcctcgcacagccaggcaagttcggcggcgacgtctcacacctgaacctgcacaagacgttctgcatcccacacggcggcggcggtcccggtgtcgggcctgtcgcggtgcgcaagcatctggcgccgttcctgcccggtaacccgttgggcggcgacgacctcggcaccccggtgtcggcggccaactacggatcggccggcatcctgcccatcacgtgggcgtacatcgcgctgatgggtccggacgggctgacgagcgccaccgaaaccgcggtgctcgcagccaattacgtcgcccagtcactggatcggcatttcccggtcctctacaccggcccgtccggtctggtggcacacgagtgcatcctcgacctccggcacgtcaccaaggcgaccggcgtcaccgccgaggatgtcgcgaagcggttgatcgactacggcttccacgcgcccaccctgtcgttccctgtcaacggcaccctgatggtcgaaccgaccgagtccgaggacctggccgaactcgaccgcttcatcgaggcgatggtgtccatccgccgcgagatcgacctggtcggcgacggcgtgtggccgctcgagcgcagcccgctgcgtcaggccccgcacaccgccgaacaggtgaccgcggacgaatgggatctgccctacccgcgccacctcgccgcctaccccgtcgcatcgcttcgcgccgccaaatactggcccccggtgcgtcgcatcgacggcgtccacggcgaccgcaacctcgtctgctcgtgcccggcacccgaggccttcgagaacaccaccgacatcgacacttcggccatcgccgagacccccgaggaggccttcgcatga

SEQ ID NO: 2839 - protein, 984 aa, Rhodococcus sp. RHA1
MSGAVRTQRNRSHLVPAEPRTAIRGVPLTSDFPSRHIGPDAAASRRMLDALGYDSLANLIDSAVPDQIRSSQPLNLPAARSEQQVLADLRALSERNETRVQMIGLGYSDTITPAVLRRNMLESPAWYTAYTPYQPEISQGRLEALLTFQTVIEDLTALPLAGASLLDEATAVMEAVLLMRRANKSKSATNRVVLDADCLPQTLAVVRGRAKAVGIEVVVAELSGELPDGDMFGVVFQAPGASGAVRDLAPMIAAAKARGALTTVAADLLSLTILTPPGEQGADIAVGSAQRFGVPLFFGGPHAGYMAVRSGLERMLPGRLVGVSVDVDGKTAYRLALQTREQHIRRDKATSNICTAQALLANVAAMYAAYHGPEGLRAIANRVHTHATTIAGSLRAAGHTIVHDSFFDTVLVRVPAGAGAIVESADRDGINLRLVDSDHVAIACDECTTDDIVRRVVAVFGAQPTTVAVPELPSALARTSNYLQHPVFHDHRSETAMLRFLRTLSDKDLALDRTMIPLGSCTMKLNSAVEMEPISWPGFASIHPYAPVAQTAGYLELVADLERWLGEITGYDRVSLQPNAGSQGELAGLLAIHGYHESRGDFERNVCLIPQSAHGTNAASAVLAGMKVVVVATAENGNIDVGDLRAKIAAHEGAIAAIMLTYPSTHGVYENDVRTVCDLVHEAGGQVYVDGANLNALVGLAQPGKFGGDVSHLNLHKTFCIPHGGGGPGVGPVAVRKHLAPFLPGNPLGGDDLGTPVSAANYGSAGILPITWAYIALMGPDGLTSATETAVLAANYVAQSLDRHFPVLYTGPSGLVAHECILDLRHVTKATGVTAEDVAKRLIDYGFHAPTLSFPVNGTLMVEPTESEDLAELDRFIEAMVSIRREIDLVGDGVWPLERSPLRQAPHTAEQVTADEWDLPYPRHLAAYPVASLRAAKYWPPVRRIDGVHGDRNLVCSCPAPEAFENTTDIDTSAIAETPEEAFA

SEQ ID NO: 2840 - DNA, 2925 bp, Trichodesmium erythraeum IMS101
  CDS (1)..(2925): transl_table=11
atggtagcaacatataaatctaatatacagtcaagttatcaaatacaactggccaaccaaaaccaaggtcagaggccaatagacttttcccaacgacatattggtcttacctcatcagaaatccaacaaatgctggaagtattaggtatttcctccctagaagacttaattgacaaaacagttcccgaaaaaattcgattccagaaaccactcaatttgcccaagtctctgagtgaaaatgcggcacttgctcaaattaaagaaataatctctaaaaatcagatatttcgttcctttattggaatgggttattatgactgcattaccccaccagttatccttcgcaatatactagaaaaccctggttggtacacagcttatactccctatcaagcagaaatagctcaaggccggatggaggcgttgctgaattttcaaaccatgattacagacttaacaggtttagaaatagctaatgcttcactacttgatgaagctacagcagcagcggaagcgatgagcatgacttatggtttatgtaaaactaaagccgaagttttctttgttgactctgcctgccatcctcagaatattgaagttgtcaaaactagggcacaaccattgggaatagaagtaatagtcggggacttccgaaccttcacttttgacaaaccaatttttggtgcactcctgcaatatcccgccactaatggagcaatttatgactatcgcgaatttgtggaaaaagttcacaaggtaggaggtttagtaactgttgctgctgaattactaagtttaaccttactcacaccccctggagaatttggtgctgatattgctgtaggtaatactcaacgttttggcgtgtctcttggatacggaggcccccatgctgcttactttgctactaaagaagcttataaacgacaaactcctggacgtattgttggggtttctcaagatgctaatggtaacccagccttacgtttagcactacaaaccagggaacagcatattcgccgggaaaaggcaactagcaatatttgtactgctcaagttttattggcagtaatagcaggtatgtacgcagtctatcacggtccgggtggtttaaaacaaattgcagaaaatatccataatttgacttttaagttggcaacaggtttaaaacagcttggttatcaaattggtgcagagttattttttgatactattgagatcaaattgggtgctgactctcctgtgaaaagtgcaaaagaaattattgatgcggctgaaaatttaggtattaatctccgaacttttgatgaacaaacggttggtatttctctagatgaaactaccactgaagtagatgtacaaaatctgtggcaaatttttgctagtggagaaaagttcccaaacatcgaaaatgaaaatatttctaccctttctcaaagttattatgctcgcactagcaattatctaactcacccagtatttaaaagttatcattctgaaaccaatcttttgcgttatattcatcgtttgcagtctaaagatttatctttgacaacatcaatgatacctttgggttcctgtacaatgaaacttaatgctacagcagaaatgatacctgtaacttggcctgaatttgccaatattcaccctttttctcccatttctcaaactcagggttatcaaataatatttcagcaattagaagaatggttggcagaaatcacaggttttgcagaaatttctctacaaccaaacgcaggttcacaaggagaatatacgggtttattagtaattcgcgaatatcatgctcaccgtggggaagcacatcgtgatatttgtttgatccctgaatctgcccacggtacaaaccctgcttctgcagtaatgagtgggttaaaggttgtggttgttaaatgtgatgcccaaggcaatatagatattgcagatttacagacaaaggcagaaaagcataaagataatttagctgcaataatgattacatacccctctactcacggtgtctttgaggaagaaattcttgatatttgtgaaattatccatgctcatggtgggcaagtttatatggatggggcaaatatgaatgctcaagtaggattatgtcgtcccgcggaaataggtgctgatgtttgtcatttgaatttacataaaaccttttgtattcctcatggtggcggaggtccaggaatgggtccgataggggttaagtctcacttggcaccgtttttaccagggcattctgttattaatttgggaggggaaaattctagtggagctgtatctgctgcaccctggggtagcgctagtattctgcctatttcttggatgtatattgcgatgatggggacggatggtttgactgaagcaactaagatagcgattttgaatgctaattatattgcccaacgtttgggaagttattattcagttttgtacaagggtaagtatgggtttattgctcacgagtgcattttggatttgcgtcctttgaaaaagttggctggtattgaggtggaggatattgctaaacgtttgatggactatggttttcatgcgccgactgtctcttggcctgtggcgggtacaattatggtggaaccgacagagagtgagtctaaggatgagttagaccgtttttgtgacgcgatgatttctattcgtcaggaaatagaggagatcgaaactggtaaggcagataaaaatgataatttgttgaaaaatgcgcctcatactgctgagagtttgatggtggatgagtggaagcatggttattctcgacaacgtgctgcttatcctgcgccttggacgcgagagcataaattttggcctgctgtaggacgggttgataatgcttttggggatcgcaattttgtttgttcttgtttgccgatagaggcttacagttaa

SEQ ID NO: 2841 - protein, 974 aa, Trichodesmium erythraeum IMS101
MVATYKSNIQSSYQIQLANQNQGQRPIDFSQRHIGLTSSEIQQMLEVLGISSLEDLIDKTVPEKIRFQKPLNLPKSLSENAALAQIKEIISKNQIFRSFIGMGYYDCITPPVILRNILENPGWYTAYTPYQAEIAQGRMEALLNFQTMITDLTGLEIANASLLDEATAAAEAMSMTYGLCKTKAEVFFVDSACHPQNIEVVKTRAQPLGIEVIVGDFRTFTFDKPIFGALLQYPATNGAIYDYREFVEKVHKVGGLVTVAAELLSLTLLTPPGEFGADIAVGNTQRFGVSLGYGGPHAAYFATKEAYKRQTPGRIVGVSQDANGNPALRLALQTREQHIRREKATSNICTAQVLLAVIAGMYAVYHGPGGLKQIAENIHNLTFKLATGLKQLGYQIGAELFFDTIEIKLGADSPVKSAKEIIDAAENLGINLRTFDEQTVGISLDETTTEVDVQNLWQIFASGEKFPNIENENISTLSQSYYARTSNYLTHPVFKSYHSETNLLRYIHRLQSKDLSLTTSMIPLGSCTMKLNATAEMIPVTWPEFANIHPFSPISQTQGYQIIFQQLEEWLAEITGFAEISLQPNAGSQGEYTGLLVIREYHAHRGEAHRDICLIPESAHGTNPASAVMSGLKVVVVKCDAQGNIDIADLQTKAEKHKDNLAAIMITYPSTHGVFEEEILDICEIIHAHGGQVYMDGANMNAQVGLCRPAEIGADVCHLNLHKTFCIPHGGGGPGMGPIGVKSHLAPFLPGHSVINLGGENSSGAVSAAPWGSASILPISWMYIAMMGTDGLTEATKIAILNANYIAQRLGSYYSVLYKGKYGFIAHECILDLRPLKKLAGIEVEDIAKRLMDYGFHAPTVSWPVAGTIMVEPTESESKDELDRFCDAMISIRQEIEEIETGKADKNDNLLKNAPHTAESLMVDEWKHGYSRQRAAYPAPWTREHKFWPAVGRVDNAFGDRNFVCSCLPIEAYS

SEQ ID NO: 2842 - DNA, 2901 bp, Synechococcus sp. CC9311
  CDS (1)..(2901): transl_table=11
gtggctgagccactgtctcctttcgtaagcaggcatatcggaccgggagagcaggcgcaacagcggatgttgaaagcgcttgggtttaaagatctcgattcctttttgcgcgcggttgtccccgcaaatattttcgatgcattgccccctgttgaggctcttccccgtggttgcactgaagccagtgctctagctgaactgcgtggcttggctgacgccaatcaggtccgacgatcgctgattggcttgggttactacgacacggtgacaccagcggtgatccagcgtcaggtgctggaaaatccctcttggtacaccgcttacacgccttatcaagctgagatcgcacagggtcgcctggaagctctgttcaattttcagaccctgatcagcgagctcactggtttaccgatcgctaacgcctcgctgctcgatgaaggcactgccgcagcagaagcgatggccatgagcttgtccacctgtcgccggcaggaggccaagcgctttttggtggacgccgctgtgttgccccagacattggccgttttgcaaaccagggccttacctattggagtggagctggaggtggtggagccggaggcgttccggtggggtgacgatgtctttggggttttgctccaactaccaggccgttgtgggcgcctttgggatccgtccgcctgcatctctgctgcccatgacagcggtgcccttgtcaccgtggcggtggacccccttgcccaggtgctgctcgcaccggttggtgagctcggtgccgacatcgctgttggaagcacccagcgttttggtgtgccgatgggcgggggcggtccccatgccgcgttttttgccacccgcgatgcatttcgccgccaggttcctggccggattgtcggccagtcacgcgatgctgatggtcagccagcgtttcggctggctttgcagacgcgcgagcagcacatccgacgcgacaaagctacgagcaacatttgtacggcccaagtgctgctggctgtgatggcgtcgttttatgccatccatcacggaccagaagggctggaggccatggctcaaaagcttgtggcgcttcgacttcagctcgaacaggcggtgcgtcagttgggttattcgcttgaggcgaagcctcgttttgacagttttgatgtctatggatcgatggctccgcaggtccatcgcctggcagcagttgaaggcatcaatcttcgtgttttgcctgatggcgcctcagtcgagacggctcagggatttggaatcagcctggatgaactctcggacttggacgagatcacccgtctcattgcggttttggcccaagcggttgatgctcctgtcccctcgactctcggtgagctgagcagcgacccacttttgaatgttgttccttgtcgccgagagtcctggcttcaacagtcggtgtttcaccgataccgcagtgaaaccgagctgatgcgctacatccagcgattggtgagtaaggatctttctttggtgcacggaatgatccccctagggagttgcacgatgaagctcaatgcggcttcagaacttgttcctgtgagttggcgcgagtttgctgggatgcatccctttgctcctttggatcagcagagggggtctcagcgaatggttgaggacctcgaaacgtggttggctgcactcactggttttgcaggtgtgtcgctccagcccaatgctggatcgcagggggaatatgcagggctgctcgtgattcgtgcctggcatcactcccgtggcgagacctccagaaatgtttgcctgatcccaacgagtgcccacggcaccaatccagccagcgctgtgatggcgggcatgcgcgttgtgccggtggcctgcgatgacgaaggcaatgtggatgtggaagatctgcgcgccaaagcggagcagcacagcgcatccctagcggccttgatggtcacctacccctcaacgcacggagtgtttgaggtgcgtattcgcgaaatctgtgcgcttgtgcatgagcacggtgggcaggtgtatctcgatggagccaatctgaatgcgcaggtgggtctttgcaggcctggctcgtttggggctgatgtctgccacctgaatttgcacaagaccttctgcatccctcacggtggtggtgggcctggtgtcggtccgattggggtggcatcgcatctgctgccgtttttgccaggacatcccttcatggattgtggtggagagcaggcaactcagcccgtgtccgctgctccttggggaagtgcaggcatcttgccaattagttggatgtatttgcgtttgatgggcccttatggtctgcgtcaggccactgccatcgcacttctctccgccaactatttagccagtcgcttggatgcgcactacccagtgctgtttcgaggggagagtgggctagtggcccatgaatgcatccttgacctgcggggcctgaagcgaaccgcaggattggaagtggatgatctggcgaaacgtttgatggactttggctttcacgcccccacggtgagttggcctgtggcgggcacggtgatggtggaacccactgaaagcgagagtttggaagagctggatcgcttctgcgacgcgatgattgcgatccgcgctgaagctgcagcaatcgaagatggatccagtgatcgggagaacaaccctctgcgccgtgcaccgcacaccttggctgcggtcaccgctgacagctgggatcgtccctatagccggcagcaggctgcatttccgcttcctgagcaagccagcaacaagttttggccttcagtggcacgcatcgacaacgcctttggcgatcgaaatctaatttgcacgtgtccaagcgttgaagagatggccgaacccgttgcaatgcggtaa

SEQ ID NO: 2843 - protein, 966 aa, Synechococcus sp. CC9311
MAEPLSPFVSRHIGPGEQAQQRMLKALGFKDLDSFLRAVVPANIFDALPPVEALPRGCTEASALAELRGLADANQVRRSLIGLGYYDTVTPAVIQRQVLENPSWYTAYTPYQAEIAQGRLEALFNFQTLISELTGLPIANASLLDEGTAAAEAMAMSLSTCRRQEAKRFLVDAAVLPQTLAVLQTRALPIGVELEVVEPEAFRWGDDVFGVLLQLPGRCGRLWDPSACISAAHDSGALVTVAVDPLAQVLLAPVGELGADIAVGSTQRFGVPMGGGGPHAAFFATRDAFRRQVPGRIVGQSRDADGQPAFRLALQTREQHIRRDKATSNICTAQVLLAVMASFYAIHHGPEGLEAMAQKLVALRLQLEQAVRQLGYSLEAKPRFDSFDVYGSMAPQVHRLAAVEGINLRVLPDGASVETAQGFGISLDELSDLDEITRLIAVLAQAVDAPVPSTLGELSSDPLLNVVPCRRESWLQQSVFHRYRSETELMRYIQRLVSKDLSLVHGMIPLGSCTMKLNAASELVPVSWREFAGMHPFAPLDQQRGSQRMVEDLETWLAALTGFAGVSLQPNAGSQGEYAGLLVIRAWHHSRGETSRNVCLIPTSAHGTNPASAVMAGMRVVPVACDDEGNVDVEDLRAKAEQHSASLAALMVTYPSTHGVFEVRIREICALVHEHGGQVYLDGANLNAQVGLCRPGSFGADVCHLNLHKTFCIPHGGGGPGVGPIGVASHLLPFLPGHPFMDCGGEQATQPVSAAPWGSAGILPISWMYLRLMGPYGLRQATAIALLSANYLASRLDAHYPVLFRGESGLVAHECILDLRGLKRTAGLEVDDLAKRLMDFGFHAPTVSWPVAGTVMVEPTESESLEELDRFCDAMIAIRAEAAAIEDGSSDRENNPLRRAPHTLAAVTADSWDRPYSRQQAAFPLPEQASNKFWPSVARIDNAFGDRNLICTCPSVEEMAEPVAMR

SEQ ID NO: 2844 - DNA, 2889 bp, Shewanella sp. MR-4
  CDS (1)..(2889): transl_table=11
atgaccaagcaaaccctcactcagttagaacagcacgatttattcttacgtcgccatatcggcccggatagcagccaacaacaagaaatgttgaactacgttggtgctgagtctctggacgatctgactgcgcaaatcgtgcctgagtcgatccgtttaagccaagagttgagcattggtgattcctgcggcgaagccgaaggcattgcttacattcgtggtttagccaaacaaaaccaagtcttcaaaagctatattggtatgggttactacggtacccaagtacctaatgtgattttacgtaacgtcttcgaaaatccaggttggtacacggcgtacacgccctatcagccagagatcgcccaaggccgtttagaagccattctaaacttccaacaagtgtctatggatttaaccggtttagatttagcctctgcttcactgctggacgaagcgactgccgccgccgaagcgatggcgctggctaagcgtgtgtctaaagccaaaaaagccaacatcttcttcgtagccgatgacgtattcccacaaaccttagacgtagtgaagactcgcgctgagtgttttggttttgaagtggtggtaggtcctgcccatgaagcagtaaaccacgaactgtttggtgccctgttccagtattcaaaccgtttcggtcaaatcactgacttcactgacttatttgccgaattacgcgcgaaaaacgtgattgtgacagtggctgccgacatcatggcattagtgttactcaagtcaccgggtgccatgggcgccgatgtggtcttcggtagcgcgcagcgtttcggtgtgccgatgggctttggtggtccacacgcggccttcttcgtggcccgtgacgagcacaaacgctctatgccaggccgtatcatcggtgtgtcaaaggacacccgtggtaaccgcgcactgcgtatggcgatgcaaactcgtgagcaacatattcgccgcgaaaaagccaactcaaacatctgtaccgcgcaaattctgttagcgaacatggcgtctttctacgccgtattccacggcccacaaggcctgaaaaccatcgcatcacgcatcaaccgcttcaccgatatcttagccgctggcttacaagctaaaggcgtgagcttagtgaacaacacttggttcgataccatcagcatcaaaggcttagacgttgcagctgtgaatgctcgcgcgctggccgctgaaatgaacctgcgtttcgatgctgacggcatcgttggcgtgagcttagatgaaaccactctccgcaccgatatcgacgccctgttcgatgtgattttaggtgctggtcatggcttagacgttgccgcattagatgcgcaaattgtggcgcaaggtagccaatcgattcctgaggctttagtgcgtcaggatgcgattctgactcacccaaccttcaatcgctaccaaagcgaaaccgagatgatgcgttatatcaagcgtctcgaaagcaaagacttagcactgaactactcaatgatttcattgggttcatgcaccatgaagttaaacgctgcggttgaaatgctgccggtgagctggccagaatttgctaacatgcacccattctgcccactggatcaagccaagggttacactcaactgattgaagaattatcttcatggttagtgaatgtcacaggttacgatgcagtttgtatccaacctaactctggcgcacagggtgaatacgcaggtctgctggcgattcgtaaataccacgagtctcgcgggcaggcccacagaaacatctgcttaatcccacaatctgcccacggtactaaccctgcatcggcgcaattagccggtatgcaagtggttgtgactgcctgtgacaagcaaggtaacgtggatttagaagatctgaaggccaaagcggctgaagtggcagaaaacctgtcatgtatcatgatcacttacccatcgactcacggtgtgtacgaagaatctatccgcgaaatctgcaacatagtgcatcagcacggtggtcaagtgtacttggacggcgccaacatgaacgcccaagttggcttaacctcaccaggctttatcggtgccgacgtgtcgcaccttaacctgcacaaaaccttcgcgattccacacggcggcggtggtccaggtatgggcccaatcggtgtgaaagcacacttagcaccgttcgtagcgggtcacgttgtggtgaaaccaggccgcgaaagcgataacaacggtgcggtatcagcagcgccatacggcagtgctggcattctgccaatcagctggatgtacattaagctgctcggttcaaacggcctgaaaaagtcgactcaaaccgcgctgttaaacgctaactacgtgatgaagaagctgtctgaacactacccagtactgttccgtggccgtaacgatcgcgtcgcgcacgaatgtattatcgacctgcgtccaattaaagaagcctctggcgtgaccgaaatggatatcgctaagcgtctgaacgactacggtttccacgcgccaaccatgagcttccctgttgcgggcacgctgatgattgagccaaccgaatctgagtctaaggttgaactggaccgctttatcgacgctatggtgtcaatccgcgctgaaatcgctaaggttgaagcgggcgagtggccagcggacaacaacccgctgcacaacgcgccacacactatggccgatattatggacagcgcgtttgattcacgcccatatagccgtgaagttgccgtgttcccaagtgccgcggtgcgtactaacaagttctggccaaccgtgaatcgtattgatgacgtgtacggcgaccgtaatttgttctgtgcgtgtgtgccgttatcagactacgaataa

SEQ ID NO: 2845 - protein, 962 aa, Shewanella sp. MR-4
MTKQTLTQLEQHDLFLRRHIGPDSSQQQEMLNYVGAESLDDLTAQIVPESIRLSQELSIGDSCGEAEGIAYIRGLAKQNQVFKSYIGMGYYGTQVPNVILRNVFENPGWYTAYTPYQPEIAQGRLEAILNFQQVSMDLTGLDLASASLLDEATAAAEAMALAKRVSKAKKANIFFVADDVFPQTLDVVKTRAECFGFEVVVGPAHEAVNHELFGALFQYSNRFGQITDFTDLFAELRAKNVIVTVAADIMALVLLKSPGAMGADVVFGSAQRFGVPMGFGGPHAAFFVARDEHKRSMPGRIIGVSKDTRGNRALRMAMQTREQHIRREKANSNICTAQILLANMASFYAVFHGPQGLKTIASRINRFTDILAAGLQAKGVSLVNNTWFDTISIKGLDVAAVNARALAAEMNLRFDADGIVGVSLDETTLRTDIDALFDVILGAGHGLDVAALDAQIVAQGSQSIPEALVRQDAILTHPTFNRYQSETEMMRYIKRLESKDLALNYSMISLGSCTMKLNAAVEMLPVSWPEFANMHPFCPLDQAKGYTQLIEELSSWLVNVTGYDAVCIQPNSGAQGEYAGLLAIRKYHESRGQAHRNICLIPQSAHGTNPASAQLAGMQVVVTACDKQGNVDLEDLKAKAAEVAENLSCIMITYPSTHGVYEESIREICNIVHQHGGQVYLDGANMNAQVGLTSPGFIGADVSHLNLHKTFAIPHGGGGPGMGPIGVKAHLAPFVAGHVVVKPGRESDNNGAVSAAPYGSAGILPISWMYIKLLGSNGLKKSTQTALLNANYVMKKLSEHYPVLFRGRNDRVAHECIIDLRPIKEASGVTEMDIAKRLNDYGFHAPTMSFPVAGTLMIEPTESESKVELDRFIDAMVSIRAEIAKVEAGEWPADNNPLHNAPHTMADIMDSAFDSRPYSREVAVFPSAAVRTNKFWPTVNRIDDVYGDRNLFCACVPLSDYE

SEQ ID NO: 2846 - DNA, 2889 bp, Shewanella sp. MR-7
  CDS (1)..(2889): transl_table=11
atgaccaagcaaaccctcactcagttagaacagcacgatttattcttacgtcgccatatcggcccggatagcagccaacaacaagaaatgttgaactacgttggtgctgagtctctggacgatctgactgcgcaaatcgtgcctgagtcgatccgtttaaaccaagagttgagcattggtgattcctgcggcgaagccgaaggcattgcttacattcgtggtttagccaaacaaaaccaagtcttcaaaagctacattggtatgggttactacggtacccaagtacctaatgtgattttgcgtaacgtcttcgaaaatccaggttggtacacggcgtacacgccatatcagccagagatcgcccaaggccgtttagaagccattctaaacttccaacaagtgtctatggatttaaccggtttagatttagcctctgcttcactgctggatgaagcgactgccgccgccgaagcgatggcgctggctaagcgtgtgtctaaagccaaaaaagcgaacatcttcttcgtcgccgatgacgtattcccacaaaccttagacgtagtgaagactcgcgctgagtgttttggttttgaagtcgtggtaggtcctgcccatgaagcagtcaaccacgaactgtttggtgccctgttccagtattcaaaccgtttcggtcaaatcactgacttcactgacttattcgccgaattgcgtgcgaagaacgtagttgtgaccgtggctgccgacatcatgtcactggtattactgaaatcaccgggtgccatgggcgccgacgtggtcttcggtagcgcgcagcgtttcggtgtgccgatgggctttggtggtccacacgcagccttcttcgtggcccgtgacgagcacaaacgctctatgcctggccgtatcatcggtgtgtcaaaggacacccgtggtaaccgcgcactgcgtatggcgatgcaaactcgtgagcaacatatccgccgcgaaaaagccaactcaaacatttgtaccgcgcaaattctgttagcgaacatggcgtctttctacgccgtattccacggcccacaaggcctgaaaaccatcgcatcacgcatcaaccgcttcaccgatatcttagccgctggcttacaagctaaaggcgtgagcttagtgaacaacacttggttcgataccatcagcatcaaaggcttagacgttgcagcagtgaatgctcgcgcgctggccgctgaaatgaacctgcgtttcgatgctgacggcatcgtcggcgtgagcttagacgaaaccactctccgcaccgatatcgaagccctgttcgatgtgattttaggtgctggtcatggcttagacgttgccgcattagatgcgcaaattgtggcgcaaggtagccaatcgattcctgaggctttagtgcgtcaggatgccatcctgagccacccaaccttcaatcgctaccaaagcgaaaccgagatgatgcgttatatcaagcgtctcgaaagcaaagacttagcactgaactactcaatgatttcactcggttcatgcaccatgaagttaaacgctgcggttgaaatgctcccagtcagctggccagaatttgccaacatgcacccattctgcccactggaccaagccaagggttacactcaactgattgaagaactgtcttcatggttagtgaatgtcacaggttacgatgccgtgtgtatccaacctaactctggcgcacagggtgaatacgcgggtctgctggcgattcgtaagtaccacgagtctcgcggcgaagcccacagaaacatctgcttaatcccacaatctgcccacggcactaacccagcatcggcgcaattagcgggtatgcaagtggttgtgactgcctgtgacaagcaaggtaacgtggatttagaagatctgaaggccaaagcggctgaagtggcagaaaacctgtcatgtatcatgatcacttacccatcgacccacggtgtgtacgaagaatctatccgcgaaatctgcaacattgtgcaccagcacggtggtcaagtgtacttggacggcgccaacatgaacgcccaagttggcttaacctctccaggctttatcggtgccgacgtatcgcaccttaacctgcacaaaaccttcgcaattccacacggcggcggtggtccaggtatgggcccaatcggcgtgaaagcgcacttagcaccgttcgtagcgggtcacgtagtggtgaaaccaggccgcgaaagcgataacaacggtgcagtttctgcagcgccatacggcagtgctggcattctgccaatcagctggatgtacattaagctgctcggttcaaacggcctgaaaaaatcgactcaaaccgcgctgttaaacgctaactacgtgatgaagaagctgtctgaacactacccagtactgttccgtggccgtaacgatcgcgtcgcgcacgaatgtattatcgacctgcgtccaatcaaagaagcctctggcgtgaccgaaatggatatcgctaagcgtctgaacgactacggtttccacgcaccaaccatgagcttccctgttgcgggcacgctgatgattgagccaaccgaatctgagtctaaggttgaactggaccgctttatcgacgctatggtgtccatccgcgccgaaatcgcgaaagttgaagcaggcgagtggccagcggacaacaacccgctgcacaatgcgccacacactatggccgatattatggacccagcgttcgattcacgcccatacagccgtgaagtggccgtgttcccaagtgccgcagtgcgtactaacaagttctggccaaccgtgaatcgtattgatgacgtgtacggcgaccgtaatttgttctgtgcgtgtgtgccgttatcagactatgaataa

SEQ ID NO: 2847 - protein, 962 aa, Shewanella sp. MR-7
MTKQTLTQLEQHDLFLRRHIGPDSSQQQEMLNYVGAESLDDLTAQIVPESIRLNQELSIGDSCGEAEGIAYIRGLAKQNQVFKSYIGMGYYGTQVPNVILRNVFENPGWYTAYTPYQPEIAQGRLEAILNFQQVSMDLTGLDLASASLLDEATAAAEAMALAKRVSKAKKANIFFVADDVFPQTLDVVKTRAECFGFEVVVGPAHEAVNHELFGALFQYSNRFGQITDFTDLFAELRAKNVVVTVAADIMSLVLLKSPGAMGADVVFGSAQRFGVPMGFGGPHAAFFVARDEHKRSMPGRIIGVSKDTRGNRALRMAMQTREQHIRREKANSNICTAQILLANMASFYAVFHGPQGLKTIASRINRFTDILAAGLQAKGVSLVNNTWFDTISIKGLDVAAVNARALAAEMNLRFDADGIVGVSLDETTLRTDIEALFDVILGAGHGLDVAALDAQIVAQGSQSIPEALVRQDAILSHPTFNRYQSETEMMRYIKRLESKDLALNYSMISLGSCTMKLNAAVEMLPVSWPEFANMHPFCPLDQAKGYTQLIEELSSWLVNVTGYDAVCIQPNSGAQGEYAGLLAIRKYHESRGEAHRNICLIPQSAHGTNPASAQLAGMQVVVTACDKQGNVDLEDLKAKAAEVAENLSCIMITYPSTHGVYEESIREICNIVHQHGGQVYLDGANMNAQVGLTSPGFIGADVSHLNLHKTFAIPHGGGGPGMGPIGVKAHLAPFVAGHVVVKPGRESDNNGAVSAAPYGSAGILPISWMYIKLLGSNGLKKSTQTALLNANYVMKKLSEHYPVLFRGRNDRVAHECIIDLRPIKEASGVTEMDIAKRLNDYGFHAPTMSFPVAGTLMIEPTESESKVELDRFIDAMVSIRAEIAKVEAGEWPADNNPLHNAPHTMADIMDPAFDSRPYSREVAVFPSAAVRTNKFWPTVNRIDDVYGDRNLFCACVPLSDYE

SEQ ID NO: 2848 - DNA, 2865 bp, Rhizobium leguminosarum bv. viciae 3841
  CDS (1)..(2865): transl_table=11
atgacgacgccgacagaattccagttcaccgactatcagccctacgatttcgccaatcgccgccatatcggcccctcgccggctgagatgaccgatatgctgaaggtgatcggctataacagcctcgacggcctgatcgacgcgacgctgccgccctcgatccgccagaaggcgccgctcgtctggggcgcgccgatgaccgagcgcgaggcactcgacaagctgcgcgagaccgccaataagaacaaggtgctggtctcgctgatcggccagggctactacggcaccatcacgccgcctgtcatccagcgcaacatcctggaaaacccggcctggtacaccgcctatacgccctaccagccggagatcagccagggccgcctggaagcgctgctgaactatcagacgatgatctgcgacctcaccggcctcgacgttgccaacgcctcgctgctcgacgaggcgaccgccgccgccgaaggcatggcgatcgccgagcgcgtcgccaagtcgaaggcgaaggccttcttcgtcgatgccgactgccatccgcagaccattgccctgatccgcacccgcgccgagccgctcggctggagcgtcatcgtcggcaatcccgtcaccgatctcgatcccgtcgacgtctttggcgcgatcttccagtatcccggcacgcacggtcacgtgcatgattttaccggcctgatctcgcgcctgcatcagaccggcgccatagcgatcgtcgccgccgatatcctggcgctgacgctgctgaaatcgcccggcgaaatgggtgcagatatcgccgtcggctcctcgcagcgcttcggcgtcccggtcggctacggcggcccgcatgcagcctatatgtcggtcaaggatgccatcaagcgctccatgcccggccgcctcgtcggcgtttccgtcgatgcccgcggcaaccgcgcctatcgcctgtcgttgcagacccgcgaacagcatatccgccgcgaaaaggcgacgtcgaacatctgcaccgcgcaggtgctgctggccgtcatggcctccatgtacgccgtcttccacggcccgaagggcatcaaggcgatcgcccagcaggtgcaccagaaggccgtgctgatggccaagggcctggaaaagctcggctataaggtcgaacccgagaccttcttcgacacgatcaccgtcgatgtcggccatatgcagggtctcatcctgcgtgccgccgtcgccgaaggcgtcaatctgcgcaaggtcggcgaaaccaaaatcggcatgagcctcgacgaacgcacccgaccggcgacgctcgaagccgtctggcgcgccttcggcggcaatttcaccattgccgatttcgagccttcctaccgcctgccgaagggcctgctcaggaccagcgattacctcacccatccgattttccacatgaaccgcgccgaaagcgagatgacgcgttacatccgccggctttccgaccgggatctggcgctcgaccgctcgatgatcccgctcggctcctgcacgatgaaactcaacgcgacggcggaaatgctgccgatcacctggccggagttttccgacatccatcccttcgtgccggccgaccaggcgctcggctaccgcgagatgatcgacgacctgatcgaaaagctctgcgccgtcaccggctacgacgccttctccatgcagccgaattccggtgctcagggcgaatatgccggcctgctgacgatccgcaactatcatatcgccaatggcgacggccatcgcgacgtctgcctgatcccgacctcggcgcacggtaccaatccggcttcggcccagatggtcggcatgaaggtcgtcgtcgtcaaggtgcgtgaaaacggcgatatcgatctcgacgatttccgtgccaaggcggagcagcatgcagcaaacctcgcctgctgcatgatcacctacccttcgacgcacggcgtcttcgaggagaccgtcaaggaaatctgcgatctcgtgcatgagcatggcggccaggtctatctcgacggcgccaacatgaatgccatggtcggcctgtcccgccccggagacatcggctccgacgtttcgcacttgaaccttcacaagaccttctgcattccgcatggcggcggcggacccggcatgggcccgattggcgtcaaggcgcatctggctccctatctgcccggccatcccgaaaccgacggccgtccgggtgcggtctcggccgccgccttcggctcggcctcgatcctgccgatctcctggagctattgcctgatgatgggcggcgaaggcctgacgcaggcgaccaaggtggcgatcctcaatgccaactatatcgccgctcggctgaggggcgcctacgacgtgctctacaagtcggagaccggccgtgtcgcgcatgaatgcatcatcgacacccgtccgctggtcgacagctcaggcgtcaccgtcgacgacgtcgccaagcgcctgatcgactgcggcttccatgcgccgaccatgagctggccggtcgccggcacgctgatgatcgagccgacggaaagcgagaccaaggccgaactcgaccgtttctgcgaggcgattctggcgatccgcgaggaagcccgcgccatcgaggatggccgcatggacaaggtgaacaacccgctgaagaacgccccgcacacggtggaagatctcgtcggcgaatgggacaggccctactcgcgcgaacaggcctgcttcccgcccggcgcgttccgcgtcgacaaatactggtcgccggtcaaccgcgtcgataacgtctatggcgaccgcaacctgatctgcacctgcccgccggtggaaagctacgccgaggcggcagaatag

SEQ ID NO: 2849 - protein, 954 aa, Rhizobium leguminosarum bv. viciae 3841
MTTPTEFQFTDYQPYDFANRRHIGPSPAEMTDMLKVIGYNSLDGLIDATLPPSIRQKAPLVWGAPMTEREALDKLRETANKNKVLVSLIGQGYYGTITPPVIQRNILENPAWYTAYTPYQPEISQGRLEALLNYQTMICDLTGLDVANASLLDEATAAAEGMAIAERVAKSKAKAFFVDADCHPQTIALIRTRAEPLGWSVIVGNPVTDLDPVDVFGAIFQYPGTHGHVHDFTGLISRLHQTGAIAIVAADILALTLLKSPGEMGADIAVGSSQRFGVPVGYGGPHAAYMSVKDAIKRSMPGRLVGVSVDARGNRAYRLSLQTREQHIRREKATSNICTAQVLLAVMASMYAVFHGPKGIKAIAQQVHQKAVLMAKGLEKLGYKVEPETFFDTITVDVGHMQGLILRAAVAEGVNLRKVGETKIGMSLDERTRPATLEAVWRAFGGNFTIADFEPSYRLPKGLLRTSDYLTHPIFHMNRAESEMTRYIRRLSDRDLALDRSMIPLGSCTMKLNATAEMLPITWPEFSDIHPFVPADQALGYREMIDDLIEKLCAVTGYDAFSMQPNSGAQGEYAGLLTIRNYHIANGDGHRDVCLIPTSAHGTNPASAQMVGMKVVVVKVRENGDIDLDDFRAKAEQHAANLACCMITYPSTHGVFEETVKEICDLVHEHGGQVYLDGANMNAMVGLSRPGDIGSDVSHLNLHKTFCIPHGGGGPGMGPIGVKAHLAPYLPGHPETDGRPGAVSAAAFGSASILPISWSYCLMMGGEGLTQATKVAILNANYIAARLRGAYDVLYKSETGRVAHECIIDTRPLVDSSGVTVDDVAKRLIDCGFHAPTMSWPVAGTLMIEPTESETKAELDRFCEAILAIREEARAIEDGRMDKVNNPLKNAPHTVEDLVGEWDRPYSREQACFPPGAFRVDKYWSPVNRVDNVYGDRNLICTCPPVESYAEAAE

SEQ ID NO: 2850 - DNA, 2880 bp, Pseudomonas aeruginosa UCBPP-PA14
  CDS (1)..(2880): transl_table=11
atgaccgataacctgaacctcggcaccatcgacctgggcaccgacgacgaattcatcgcccgccatatcggcccgcgcgccgccgacacccaggccatgctccagcgcctgggctacgactcgctggacacgctgatcggcaacgtgatcccggacagcatcaagggcagcagcgtgctcgacctgccggccggcatgggcgaggccgaggcgctggccagcctgaaggcgatcgccgcgcgcaatcgcgcgttgcgttccttcatcggccagggctactacaactgccacaccccggcaccgatcctgcgcaacctcctggagaacccggcctggtacaccgcctacacgccgtaccagccggaaatctcccagggccgcctggaggcgctgctgaacttccagaccctggtcagcgacctgtccggcctgccgatcgccaacgcctcgatgctcgacgaggcgaccgccgccgccgaggccatgaccttctgcaagcgcctgtcgaagaaccgcaccagccaggcattcttcgcctcccgccattgccacccgcagaccctcgacgtgctgcgcacccgtgctgagccgctgggcatcgaggtggtggtcggcgacgagagcgccatcgaagacttctccgcctacttcggcgcgttgctgcaataccccacctgcgacggcgagatcgtcgactatcgcgaactggtcagccgcttccatgcggtcgatgcgctggtcgcggtggccgccgacctgctggcgctgaccctgctgaccccgccgggcgagttcggcgccgacgtggccatcggcagcgcccagcgcttcggcgtgccgctcggcttcggcggcccgcacgcggcctatttcgccacccgcgacgccttcaagcgggacatgccgggacgcctggtcggcgtctccatcgaccgccacggcaagccggcctaccgcctggccatgcagacccgcgagcagcacatccgccgcgagaaagccaccagcaacatctgcaccgcccaggtgctgctggccaacatcgccagcatgttcgccgtctaccacggcccgcagggcctgctgcgcatcgcccggcgcacccaccggctgaccgcgatcctcgccgccggcctggagcgcctgggcgtggccgtcgagcagaagcatttcttcgacaccctgagcctggccaccggcgcgcgtaccgcggcgatccatgccaaggcccgcgccgccgggatcaacctgcgcgagatcgatgccggccgtctcggcctgtcgctcgacgagaccgtccgccaggccgatgtggagaccctctggggcctgctggccgaagagggccaggcgctcccggacttcgccgcccttgccgccagcagcggggaccgcctgccggtcgagctgctgcgccagtcggcgatcctcagccacccgatcttcaaccgccatcactcggaaaccgagctgatgcgctacctgcgcaagctggcggacaaggacctggcgctggaccgcacgatgatcccgctgggctcctgcaccatgaagctgaacgccgccagcgagatgatcccggtgacctgggccgaattcggcaacctgcacccgttcgccccggccgagcagagcgaaggctaccgccagctcaccgacgaactggaggcgatgctctgttccgccaccggctacgacgccgtgtcgttgcagcccaacgccggctcccagggcgagtacgccggcctgctggcgatccgtgcctaccaccagagccgcggcgacagccagcgcgacatctgtctgatcccgtcctccgcccacggtaccaacccggctaccgccagcatggtcggcatgcgcgtggtggtggtggcctgcgacgcgcgcggcaacgtcgacgtcgaggacctgcgcaacaaggccagcgagcacaaggaacgcctggccgcgctgatgatcacctatccgtccacccatggcgtgttcgaggaagcgatccgcgagatctgcgccatcgtccacgactgcggcggccaggtgtacatcgacggcgccaacatgaacgccatggtcggcctgtgcgccccgggcaagttcggtggcgacgtttcccacctgaacctgcacaagaccttctgcatcccccacggcggcggcggcccgggcgtcggcccgatcggcgtgcgcgcgcacctggcgccgttcctccccggccacgctcgcggcgagcgcaaggaaggcgcggtgagcgcggcgccgtacggcagcgcgagcatcctgccgatcacctggatgtacatccgcatgatgggcggcgaaggcctcaagcgcgcctcggaaatggccatcctcaatgccaactacatcgcccaccggctggaggagcactacccggtgctctacgccggcggcaacggcctggtcgcccacgaatgcatcctcgacctgcgtccgctcaaggacagcagcgggatcagcgtcgacgacgtggccaagcgcctgatggacttcggcttccatgcgccgaccatgtccttcccggtggccggcacgctgatgatcgagcccaccgagagcgagtcgaaggccgagctggaccgcttctgcgacgcgatgatccgcatccgcgaggaaatccgcgcggtggaacgcggcgagctggacaaggaagacaacccgctgaagaacgcgccgcacaccgccgccgaactgctcggcgaatggaaccatgcctacagccgcgagcaggccgcctatccgctggccagcctggtggaggccaagtactggccgccggtgggccgcgtcgacaacgtctacggcgaccgcaacctgacctgctcctgcccgccgatcgaggcgtacagcgaggagtga

SEQ ID NO: 2851 - protein, 959 aa, Pseudomonas aeruginosa UCBPP-PA14
MTDNLNLGTIDLGTDDEFIARHIGPRAADTQAMLQRLGYDSLDTLIGNVIPDSIKGSSVLDLPAGMGEAEALASLKAIAARNRALRSFIGQGYYNCHTPAPILRNLLENPAWYTAYTPYQPEISQGRLEALLNFQTLVSDLSGLPIANASMLDEATAAAEAMTFCKRLSKNRTSQAFFASRHCHPQTLDVLRTRAEPLGIEVVVGDESAIEDFSAYFGALLQYPTCDGEIVDYRELVSRFHAVDALVAVAADLLALTLLTPPGEFGADVAIGSAQRFGVPLGFGGPHAAYFATRDAFKRDMPGRLVGVSIDRHGKPAYRLAMQTREQHIRREKATSNICTAQVLLANIASMFAVYHGPQGLLRIARRTHRLTAILAAGLERLGVAVEQKHFFDTLSLATGARTAAIHAKARAAGINLREIDAGRLGLSLDETVRQADVETLWGLLAEEGQALPDFAALAASSGDRLPVELLRQSAILSHPIFNRHHSETELMRYLRKLADKDLALDRTMIPLGSCTMKLNAASEMIPVTWAEFGNLHPFAPAEQSEGYRQLTDELEAMLCSATGYDAVSLQPNAGSQGEYAGLLAIRAYHQSRGDSQRDICLIPSSAHGTNPATASMVGMRVVVVACDARGNVDVEDLRNKASEHKERLAALMITYPSTHGVFEEAIREICAIVHDCGGQVYIDGANMNAMVGLCAPGKFGGDVSHLNLHKTFCIPHGGGGPGVGPIGVRAHLAPFLPGHARGERKEGAVSAAPYGSASILPITWMYIRMMGGEGLKRASEMAILNANYIAHRLEEHYPVLYAGGNGLVAHECILDLRPLKDSSGISVDDVAKRLMDFGFHAPTMSFPVAGTLMIEPTESESKAELDRFCDAMIRIREEIRAVERGELDKEDNPLKNAPHTAAELLGEWNHAYSREQAAYPLASLVEAKYWPPVGRVDNVYGDRNLTCSCPPIEAYSEE

SEQ ID NO: 2852 - DNA, 2877 bp, Pseudomonas aeruginosa UCBPP-PA14
  CDS (1)..(2877): transl_table=11
atgtcgcagacgccgtccctcgcccagctccagcccgccgatgccttcctgcgccgccacctcggccccgatccggcggaacagcaggccatgctggatttcctcggagtttccactcgcgccgaactgatcgtgcagacggtgccgccggcgatccgcctcaaccggccgctggaactgcccgccgcgctcgacgaacaggccgccctggcgcgcctgcgcggctacgccggactcaaccagcgctggaccagcctgatcggcatgggctactacggcaccgtgacgccgccggtgatcctccgcaacgtgctggagaatcccggctggtacaccgcctatacgccctaccagccggaaatcgcccagggccgcctggaagcgctgctgaatttccagcaactgaccatcgacctcaccggactcgacctggccagcgcctcgctgctcgacgaagccaccgccgccgccgaggccatggccctggccaggcgggtggcgaaggccaggagcaaccggttcttcgtcgatgcgcattgccatccgcagaccgtttcggtgttgcgtacccgcgccgaggcgttcggtttcgagctggtcgtcgacgagccggacaatcttgccgcccacgcggtgttcggcgccttgctgcaatacccggacagtcgcggcgagatccgcgacctgcgcccgcttatcgaggcgttgcacggccaacaggcgctggcttgcgtcgccagcgacctgctcgccctgttggtgctgaccccgccgggggaactcggtgccgacgtggtgctcggcagcgcccagcgctttggcgtaccgatgggctacggcgggccgcacgcggcgttcttcgccacccgcgaagggtacaagcgggcaatgccggggcggatcatcggcgtttcccgcgacgcccgcggcaacccggcgttgcgcatggccctgcaaacccgcgagcagcacatccgtcgggaaaaggccaactcgaacatctgcaccgcccaggtgttgctggccaacattgcttcgctgtatgccgtctaccatgggccgcaggagctgaaacgcatcgcccaacgcgtccagcgcctgaccgcgctgctggcggcgggcctggaaagcaagggactgcggcggctcaaccggcacttcttcgacaccctgacctacgaggtcggcgagcgtcaggcggcgatcctcgaacgggcgcgggcggcacgggtcaacctgcgcgtggtcgacgaccggcggctggccctgagcctcgacgaaacctgtgacgcggcgaccctggcgaccctgttcgagatcttcctcggcgccggccacgggctggatgtcgcgcacctggatggcggggcggtggccgacggcatcccggcggtcctgcaacgcacttcggcctacctgcagcatccggtgttcaacgcccaccacagcgagaccgagatgcttcgctacctgcgccagctggaaggcaaggacctggcgctgaaccaggcgatgatcccgctcggctcctgcaccatgaagctcaacgccagcagcgaaatgatccccatcacctggccggaattcgccgaactgcatccgttcgtgccgcgcgagcaggccgagggctatcgccggatgatcgacgaactggaagcctggctgcgggcgatcaccggcttcgacgccatctgcatgcagccgaactcgggagcacagggcgaatatgccgggttgctggcgatccgccgctatcaccagagccgcggcgatagccagcgcgacatctgcctgatccccgcatcggcgcatggcaccaacccggcctcggcgatcatggccagcatgcgggtggtgatcgtcgagtgcgatccctgcggcaacgtcgacctcgacgacctgcgcctcaaggcggccgaggcgggcgaccggctgtcctgcctgatgatcacctatccctcgacccacggcgtctacgaagaggggataggcgagatctgcgaagtggtccaccgccacggcggccaggtctacatggacggcgccaacctcaacgcccaggtcggcctggcgcgaccggcggacatcggcgcggacgtctcgcacatgaacctacacaagaccttctgcatcccccatggtggtggcgggccgggcatggggccgatcggggtcaagcggcacctggcgccgttcgtcgccaaccatccggtgatccgcgtcgaagggccgaacccgctgaacgacgcggtcagcgcggcgccctggggcagcgccagcatcctgccgatcagttggatgtacatcgccatgatgggcccgcagctggccgacgccagcgaggtggcgatcctctccgccaactacctggcgaaccgcctggacggggcgttcccggtgctctaccgcgggcgcaacgagcgcgtcgcccacgaatgcatcctcgacctgcgaccgctcaaggcgcagaccgggataaccgaggaagacgtggccaagcgcctgatggactacggcttccacgccccgaccatgtccttcccggtgccgggcacgctgatggtggagccgaccgagagcgagtcgaaggcggagctggatcgcttcgtcgaggcgatgctgagcatcagggccgagatcggcaaggtggagagcggcgcctggccggcggaggacaacccgctgaaacgggcgccgcataccctggccgacgtcaccgggatctggcagagaccctacgagatcgccgaggcagtgaccccgagcgaacatgcgcgggcgttcaagtactggccggcggttaaccgggtggacaacgtctacggcgaccgcaacctgttctgcgcctgcgtgccgctggacgactaccgcgagtga

SEQ ID NO: 2853 - protein, 958 aa, Pseudomonas aeruginosa UCBPP-PA14
MSQTPSLAQLQPADAFLRRHLGPDPAEQQAMLDFLGVSTRAELIVQTVPPAIRLNRPLELPAALDEQAALARLRGYAGLNQRWTSLIGMGYYGTVTPPVILRNVLENPGWYTAYTPYQPEIAQGRLEALLNFQQLTIDLTGLDLASASLLDEATAAAEAMALARRVAKARSNRFFVDAHCHPQTVSVLRTRAEAFGFELVVDEPDNLAAHAVFGALLQYPDSRGEIRDLRPLIEALHGQQALACVASDLLALLVLTPPGELGADVVLGSAQRFGVPMGYGGPHAAFFATREGYKRAMPGRIIGVSRDARGNPALRMALQTREQHIRREKANSNICTAQVLLANIASLYAVYHGPQELKRIAQRVQRLTALLAAGLESKGLRRLNRHFFDTLTYEVGERQAAILERARAARVNLRVVDDRRLALSLDETCDAATLATLFEIFLGAGHGLDVAHLDGGAVADGIPAVLQRTSAYLQHPVFNAHHSETEMLRYLRQLEGKDLALNQAMIPLGSCTMKLNASSEMIPITWPEFAELHPFVPREQAEGYRRMIDELEAWLRAITGFDAICMQPNSGAQGEYAGLLAIRRYHQSRGDSQRDICLIPASAHGTNPASAIMASMRVVIVECDPCGNVDLDDLRLKAAEAGDRLSCLMITYPSTHGVYEEGIGEICEVVHRHGGQVYMDGANLNAQVGLARPADIGADVSHMNLHKTFCIPHGGGGPGMGPIGVKRHLAPFVANHPVIRVEGPNPLNDAVSAAPWGSASILPISWMYIAMMGPQLADASEVAILSANYLANRLDGAFPVLYRGRNERVAHECILDLRPLKAQTGITEEDVAKRLMDYGFHAPTMSFPVPGTLMVEPTESESKAELDRFVEAMLSIRAEIGKVESGAWPAEDNPLKRAPHTLADVTGIWQRPYEIAEAVTPSEHARAFKYWPAVNRVDNVYGDRNLFCACVPLDDYRE

SEQ ID NO: 2854 - DNA, 2889 bp, Shewanella sp. ANA-3
  CDS (1)..(2889): transl_table=11
atgaccaagcaaaccctcactcagttagaacagcacgatttattcttacgtcgccatatcggcccggatagcagccaacaacaagaaatgttgaactacgttggtgctgagtctctggacgatctgacggcgcaaatcgtgcctgagtcgatccgtttaagccaagagttgagcattggtgattcctgcggcgaagccgaaggcattgcttacattcgtggtttagccaaacaaaaccaagtcttcaaaagctacattggtatgggttactacggtacccaagtgcctaatgtgattttacgtaacgtcttcgaaaatccaggttggtacacggcgtacacgccttatcagccagagatcgcccaaggccgtttagaagccattctaaacttccaacaagtgtcgatggatttaaccggtttagatttagcgtcagcgtcactgctggacgaagcgactgccgctgccgaagcaatggcgctggctaagcgtgtgtctaaagccaaaaaagccaacatcttcttcgtagccgatgacgtattcccacaaaccttagacgtagtgaagactcgcgctgagtgttttggttttgaagtagtggtaggtcctgcccatgaagccgtaaaccacgaactgtttggtgccctgttccagtattcaaaccgtttcggtcaaatcactgacttcactgacttattcgccgaattacgcgcgaaaaacgtcattgtgactgtcgctgccgacatcatggcattagtgttactcaagtcacctggtgccatgggcgccgacgtggtcttcggtagcgcacaacgtttcggtgtgccgatgggctttggtggtccacacgcggccttcttcgtggcccgtgacgagcacaaacgttctatgccaggccgtatcatcggtgtgtcaaaggacacccgtggtaaccgcgcactgcgtatggcgatgcaaactcgcgagcaacatatccgccgcgaaaaagccaactcaaacatttgtaccgcacaaattctgttagcgaacatggcgtctttctacgccgtattccacggcccacaaggcctgaaaaccatcgcatcacgtatcaaccgcttcaccgatatcttagccgctggcttacaagctaaaggcgtgagcttagtgaacaacacttggttcgataccatcagtatcaaaggcttagacgttgcagcagtgaatgcgcgcgcgctggccgctgaaatgaacctgcgtttcgatgctgacggcatcgttggcgtgagcttagatgaaaccactatccgcaccgatatcgaagccctgttcgatgtgattttaggggctggccatggcttagacgttgctgcgttagacgcgcaaatcgtggctcaaggtagccaatcgattccagcttctttagtgcgtcaagatgccatcctgagccacccaaccttcaatcgctaccaaagcgaaaccgagatgatgcgttatatcaagcgtctcgaaagcaaagacttagcactgaactactcaatgatttcattgggttcatgcaccatgaagttaaacgctgcggttgaaatgatcccagtaagctggccagaatttgctaacatgcacccattctgcccactggatcaagccaagggttacactcaactgattgaagaactgtcttcatggttagtgaatgtcacaggttacgatgccgtatgtatccaacctaactctggtgcacagggtgaatacgcgggtctgctggcgattcgtaaataccacgagtctcgcggcgaagcccacagaaacatctgcttaatcccacaatctgcccacggcactaaccctgcatcggcgcaattagccggtatgcaagtggttgtgactgcctgtgacaagcaaggtaacgtggatttagaagatctgaaggccaaagcggccgaagtggcagaaaacctgtcatgtatcatgatcacttacccatcgacccacggtgtgtacgaagaatctatccgcgaaatctgcaacattgtgcaccagcacggtggtcaagtttacttggacggcgccaacatgaacgcccaagttggcttaacctcaccaggctttatcggtgccgacgtatcgcaccttaacctgcacaaaaccttcgcgattccacacggcggcggtggtccaggtatgggcccaatcggcgtgaaagcgcacttagcgccgttcgtagcgggtcacgttgtggtgaaaccaggccgcgaaagcgataacaacggtgcagtatcggcagcgccatacggcagtgcgggcattctgccaatcagctggatgtacattaagctgctcggttcaaacggcctgaaaaagtcgactcaaaccgcgctgttaaacgctaactacgtgatgaagaagctgtctgaacactacccagtactgttccgtggccgtaacgatcgcgtcgcgcacgaatgtattatcgacctgcgtccaattaaagaagcctctggcgtgaccgaaatggatatcgctaagcgtctgaacgactacggtttccacgcgccaaccatgagcttccctgttgcgggcacgctgatgattgagccaactgaatctgagtctaaggttgaactggaccgctttatcgacgctatggtgtcaatccgcgccgaaatcgctaaggttgaagcaggcgagtggccagcggataacaacccgctgcacaacgcgccacacactatggccgatattatggacccagcgttcgattctcgcccatacagccgtgaagtggccgtgttcccaagtgctgcagtgcgtactaacaagttctggccaaccgtgaaccgtattgatgacgtttacggtgatcgcaacttgttctgtgcttgtgtgccgttatcagactacgaataa

SEQ ID NO: 2855 - protein, 962 aa, Shewanella sp. ANA-3
MTKQTLTQLEQHDLFLRRHIGPDSSQQQEMLNYVGAESLDDLTAQIVPESIRLSQELSIGDSCGEAEGIAYIRGLAKQNQVFKSYIGMGYYGTQVPNVILRNVFENPGWYTAYTPYQPEIAQGRLEAILNFQQVSMDLTGLDLASASLLDEATAAAEAMALAKRVSKAKKANIFFVADDVFPQTLDVVKTRAECFGFEVVVGPAHEAVNHELFGALFQYSNRFGQITDFTDLFAELRAKNVIVTVAADIMALVLLKSPGAMGADVVFGSAQRFGVPMGFGGPHAAFFVARDEHKRSMPGRIIGVSKDTRGNRALRMAMQTREQHIRREKANSNICTAQILLANMASFYAVFHGPQGLKTIASRINRFTDILAAGLQAKGVSLVNNTWFDTISIKGLDVAAVNARALAAEMNLRFDADGIVGVSLDETTIRTDIEALFDVILGAGHGLDVAALDAQIVAQGSQSIPASLVRQDAILSHPTFNRYQSETEMMRYIKRLESKDLALNYSMISLGSCTMKLNAAVEMIPVSWPEFANMHPFCPLDQAKGYTQLIEELSSWLVNVTGYDAVCIQPNSGAQGEYAGLLAIRKYHESRGEAHRNICLIPQSAHGTNPASAQLAGMQVVVTACDKQGNVDLEDLKAKAAEVAENLSCIMITYPSTHGVYEESIREICNIVHQHGGQVYLDGANMNAQVGLTSPGFIGADVSHLNLHKTFAIPHGGGGPGMGPIGVKAHLAPFVAGHVVVKPGRESDNNGAVSAAPYGSAGILPISWMYIKLLGSNGLKKSTQTALLNANYVMKKLSEHYPVLFRGRNDRVAHECIIDLRPIKEASGVTEMDIAKRLNDYGFHAPTMSFPVAGTLMIEPTESESKVELDRFIDAMVSIRAEIAKVEAGEWPADNNPLHNAPHTMADIMDPAFDSRPYSREVAVFPSAAVRTNKFWPTVNRIDDVYGDRNLFCACVPLSDYE

SEQ ID NO: 2856 - DNA, 2826 bp, Mycobacterium avium 104
  CDS (1)..(2826): transl_table=11
gtgcccgaccacaccactttcgccgcccggcacatcggcccggaccctcaggccgtcgcggccatgctcgacgtcatcggtgtcggctcgttggacgagctggccgccaaggccgttccggccggcatccgcgaccggctctcggccgacgggatcgcgccgggcctggaccggctgccgccgccggccagcgaaaccgaggcgctggccgagctgcgcggcctggccgaggccaacaccgtcgccgtgtccatgatcgggcagggctactacgacacgctgaccccgccggtgttgctgcgcaacatcctggagaaccccgcctggtacaccgcctacacgccgtatcagccggagatcagccagggccggctggaggcgctgctgaacttccagaccatggtggccgatttgaccggcctcgagatcgccaacgcctcgatgctcgacgagggcacagcggccgccgaggcgatgaccctgatgcaccgcgcatctcgcggcaagtccaaccggctggcggtggacgtcgacgtgttcgcccagaccgcggccatcgtggccacccgggcccggccgctgggtatcgagatcgtcaccgccgacctgcgcgacggactgcccgacggcgacttcttcggcgtcatcgcccagctgcccggcgccagcggcgcgatcaccgactgggccgccctggtggcgcaggcgcacgagcgcggcgcgctggtggcgctcggcgccgacctgctggccttgaccctgatcaccccgcccggcgagatcggcgccgacgtggccttcggcaccacccaaagattcggtgtgccaatgggattcggcggcccgcacgcgggatacctggccgtgcacgccaaccacgcccggcagctgccgggccggctggtcggtgtctcgctggacgccgacggttcgccggcctaccggttggcgctgcagacccgcgagcagcacatccgccgcgacaaggcgaccagcaacatctgcaccgcgcaggtgctgctggcggtgatggccgccatgtacgccagctaccacggcgctgaggggctgaccgcgatcgcgcgccgcgtgcacgggcacgccgaggcgatcgccgccgcgctgggcaccgcggtggtgcacgacaggtacttcgacaccgtgctggcgcgggtgccgggccgggcccacgaggtgatcgccgcggccaaggccaggggcatcaacctgtggcgggtcgacgacgaccacgtctcggtggcctgcgacgaggccaccaccgacgaacacgtcgccgcggtgctcgaggcgttcggcgtcgcacccgccgagcccgtcgccagcgaaatcgctacccgcacttcggaattccttacccatcccgccttcacccagtaccgcaccgagacggcgatgatgcgctacctgcgcaccctggccgacaaggatattgcgttggaccgcagcatgattccgctcggctcgtgcaccatgaaactcaacgccgccgccgagatggagccgatcacctggccggagttcgcccgtcagcaccccttcgccccggcgtccgacacgccggggctgcgccggctcatcggcgacctggagaactggctggtggccatcaccggctacgacgccgtctcgctgcaacccaacgccgggtcgcagggcgagtacgccggcctgctggccatccacgactaccacgccagccgcggggaaccgcaccgcgacatctgcctcatcccgtccagcgcgcacggcacgaatgccgcgtcggcggccctggccgggatgcgggtggtggtcgtgggctgccacgacaacggcgacgtcgacctcgacgacctgcgcgcgaaggtcaccgaccaccgcgaccggctgtcgacgctgatgatcacctacccgtccacgcacggcgtctacgagcacgacatcgccgagatctgcgcggccgtccacgacgcgggcggccaggtgtacgtcgacggcgccaacctcaacgcgctggtcgggttggcccggccgggcaagttcggcggcgacgtcagccacctgaacctgcacaagacgttctgcatcccgcacggcggcggcgggccgggggtggggccggtggcggtgcgctcgcacctggcgccgttcttgcccgggcatccgcacgccccggagctgccgcaggggcatccggtgtcctcggcgccctacggctcggcgtcgatcctgccgatcagctgggcctacatcaggatgatgggcgccgacggcctgcgcgcggcgtcgctgaccgcgatcacctcggccaactacatcgcccggcggctcgacgaatactttccggtgctctacaccggcgagaacggcatggtggcccacgagtgcatcctggacctgcgtcccatcaccaaggccaccggcgtgaccgtcgacgatgtcgcaaaacggttggcggactacggttttcacgctcccaccatgagcttcccggtggccggcacgctgatggtggagcccaccgagagcgaaaccctcaccgaggtggacgccttctgcgacgccatgatcgccatccgcggcgagatcgaccgggtgggtgcgggggagtggccggtggaggacaatccgctgcgcggcgccccgcacaccgccgagtgcctggtgaccaccgactgggaccacccgtacagccgcgaacaggcggcctatccgctgggcaaggacttccgacccaaggtatggccgccggtgcgacgcatcgacggcgcctacggcgaccgcaacctggtgtgctcgtgcccgccggtcgaggcgttcgcctga

SEQ ID NO: 2857 - protein, 941 aa, Mycobacterium avium 104
MPDHTTFAARHIGPDPQAVAAMLDVIGVGSLDELAAKAVPAGIRDRLSADGIAPGLDRLPPPASETEALAELRGLAEANTVAVSMIGQGYYDTLTPPVLLRNILENPAWYTAYTPYQPEISQGRLEALLNFQTMVADLTGLEIANASMLDEGTAAAEAMTLMHRASRGKSNRLAVDVDVFAQTAAIVATRARPLGIEIVTADLRDGLPDGDFFGVIAQLPGASGAITDWAALVAQAHERGALVALGADLLALTLITPPGEIGADVAFGTTQRFGVPMGFGGPHAGYLAVHANHARQLPGRLVGVSLDADGSPAYRLALQTREQHIRRDKATSNICTAQVLLAVMAAMYASYHGAEGLTAIARRVHGHAEAIAAALGTAVVHDRYFDTVLARVPGRAHEVIAAAKARGINLWRVDDDHVSVACDEATTDEHVAAVLEAFGVAPAEPVASEIATRTSEFLTHPAFTQYRTETAMMRYLRTLADKDIALDRSMIPLGSCTMKLNAAAEMEPITWPEFARQHPFAPASDTPGLRRLIGDLENWLVAITGYDAVSLQPNAGSQGEYAGLLAIHDYHASRGEPHRDICLIPSSAHGTNAASAALAGMRVVVVGCHDNGDVDLDDLRAKVTDHRDRLSTLMITYPSTHGVYEHDIAEICAAVHDAGGQVYVDGANLNALVGLARPGKFGGDVSHLNLHKTFCIPHGGGGPGVGPVAVRSHLAPFLPGHPHAPELPQGHPVSSAPYGSASILPISWAYIRMMGADGLRAASLTAITSANYIARRLDEYFPVLYTGENGMVAHECILDLRPITKATGVTVDDVAKRLADYGFHAPTMSFPVAGTLMVEPTESETLTEVDAFCDAMIAIRGEIDRVGAGEWPVEDNPLRGAPHTAECLVTTDWDHPYSREQAAYPLGKDFRPKVWPPVRRIDGAYGDRNLVCSCPPVEAFA

SEQ ID NO: 2858 - DNA, 2916 bp, Nocardioides sp. JS614
  CDS (1)..(2916): transl_table=11
atgtcagaccaccaccctctcgccgacctcgacgacgcgctgccgttcgtcgaccgccacatcgggctgcgccccggcgacgtcgagacgatgctcgcccggctcggcttcgactcgctcgacgcgctgatggccgcggcggtgcccggcggcatccgggccgccgacgagctggacctgccggccccgctgagcgaggaggccacggcgcgcgagctgcgggcgatcgcccaggccaaccgtccgggggaggcgatgatcgggctcggctaccacgccacgacgaccccgccggtgatccggcgcaacgtgctcgaggacccgagctggtacaccgcctacaccccctaccagcccgagatctcccagggccggctcgaggcgctgctgaacttccagaccgtcgtcggcgacctcaccgggctgccgatcgccaacgcctcgctgctcgacgagggcacggccgcggcggaggcgatgacgctggtgcgccgcgcccatcggaacgctgtcgggccgttcgtggtcgacgccgacgcgctgccacagtccatcgaggtggtccgcacccgcgccgcggggctgggcatcgacgtcgtggtcgccgacctgaccgacggcctgccggcggacgtgctcgagggcgggctgtgcggcgtgctcgtgcagtaccccggcgcgtccggccgggtgctggaccccaggcgcgtgatcgagcaggcccacgagcaggatgcgctcgccgtcgtggccgccgacctgctcgccctcaccctgctcgagtcgcccggcgagctcggggccgacgtggtggtcggctcgagccagcggttcggcgtcccgctgttctacggcggcccgcatgccgggttcatgtcggtggccgccggcctggagcggcacctgcccggccgcctggtcggcgtctcggtggacgccgaggggcgcccggcgtaccggctcgccctccagacccgcgagcagcacatccgccgggacaaggcgacctccaacatctgcaccgcccaggtgctgctcgcggtggtggcgtcgatgtacgccgtctaccacgggccggagggcctgcgcgcgatcgcgacccgcgcgcaccgctacgccgcggtcctcgccgcggcgctcggccagggcgggttcccggtacgccacgagagctacttcgacaccctcgtcgtgcaggcgaccggccgggccgccgcggtcgtcgcagcggcccgggcgctcggcgtgcagctgcggctggtcgacgccgaccacgtgggcatcagcacctccgagtgcacgacccggtccacggtcgccagcgtgctcaaggcgttcggcctggcgaccggcccggccgacggctcggtcgacctggacgcggtggacgccgcgaccggcgacgccctgccggaggccctgcgccggaccacgccgtacctgacccacgaggtgttcaccagctatcacagcgagaccgcgatgctgcgctacctgcgccggctctcggcgcgcgactacgcgctggatcgtggcatgatcccgctcggctcctgcacgatgaagctcaacgccaccaccgagatggagccgatctcgctgcccgggttcgccgacctgcacccgttcgcgcccgccgaggacgcccagggctaccggcagctggtcaccgagctcgagggctggctcgcggaggtcaccggctacgactccgtctcgatccagccgaacgccggctcccagggcgagctcgccggcctgctcgcgatccgcggctaccaccgtgccaacggcgacgaggcccgcaacgtggtgctgatcccgtcctccgcgcacggcacgaacgccgcctcggcggtgctcgcggggatgcgggtcgtggtcgtgaagtcggggccgggcggcgaggtcgacctcgacgacctgcgcgctcagtgtgccgcccacgcggacgacctcgcggcgatcatggtgacctacccgtcgacgcacggcgcgtacgaggagaccatcacggagctgtgcgagatcgtgcacgcccacggcgggcaggtgtacgtcgacggcgcgaacctgaacgccctgctgggctacgccaagcccggcgagttcggcggcgacgtctcgcacctgaacctgcacaagaccttctgcatcccgcacggcggcggcggtcccggggtggggccggtcgcggtgcgcgcccacctggcgccgtacctgccctcgcacgggatgcacccggacgagaccaagcgcaccggcatcggcccggtcagcgccgcgccgtacggctcggcggggatcctgccgatctcgtgggcctacatccggctgatgggcgcggccggcctgacccgggccaccgcggccgccgtgctgtcggcgaactacgtcgccgcccggctcggcgagcactacccggtgctctaccgcggccacggcgggctggtcgcgcacgagtgcatcctggacctgcgcggcctgacgaaggagagcggcgtcaccgtcgacgacgtcgccaagcggctgatcgactacggcttccacgccccgacgatgtccttcccggtcgccggcacgctgatggtcgagccgacggagtccgaggacctcggcgagatcgaccggttcatcgacgcgatgatcgcgatccgcggcgagatcgaccgggtcggcgcgggggagtggacccccgaggactcgccgctgcgcggggcgccgcacacctcgcgcgcgctcgtcggcgagtgggaccgtccgtactcccgtgagctcgcggtcttcccgaccggcctcaccggccccaacggcgtggccgacaagtactggccgccggtggcgcggatcgaccaggcgtacggcgaccggcacctggtctgctcctgcccgcctgtggaagccttcgccgagtga

SEQ ID NO: 2859 - protein, 971 aa, Nocardioides sp. JS614
MSDHHPLADLDDALPFVDRHIGLRPGDVETMLARLGFDSLDALMAAAVPGGIRAADELDLPAPLSEEATARELRAIAQANRPGEAMIGLGYHATTTPPVIRRNVLEDPSWYTAYTPYQPEISQGRLEALLNFQTVVGDLTGLPIANASLLDEGTAAAEAMTLVRRAHRNAVGPFVVDADALPQSIEVVRTRAAGLGIDVVVADLTDGLPADVLEGGLCGVLVQYPGASGRVLDPRRVIEQAHEQDALAVVAADLLALTLLESPGELGADVVVGSSQRFGVPLFYGGPHAGFMSVAAGLERHLPGRLVGVSVDAEGRPAYRLALQTREQHIRRDKATSNICTAQVLLAVVASMYAVYHGPEGLRAIATRAHRYAAVLAAALGQGGFPVRHESYFDTLVVQATGRAAAVVAAARALGVQLRLVDADHVGISTSECTTRSTVASVLKAFGLATGPADGSVDLDAVDAATGDALPEALRRTTPYLTHEVFTSYHSETAMLRYLRRLSARDYALDRGMIPLGSCTMKLNATTEMEPISLPGFADLHPFAPAEDAQGYRQLVTELEGWLAEVTGYDSVSIQPNAGSQGELAGLLAIRGYHRANGDEARNVVLIPSSAHGTNAASAVLAGMRVVVVKSGPGGEVDLDDLRAQCAAHADDLAAIMVTYPSTHGAYEETITELCEIVHAHGGQVYVDGANLNALLGYAKPGEFGGDVSHLNLHKTFCIPHGGGGPGVGPVAVRAHLAPYLPSHGMHPDETKRTGIGPVSAAPYGSAGILPISWAYIRLMGAAGLTRATAAAVLSANYVAARLGEHYPVLYRGHGGLVAHECILDLRGLTKESGVTVDDVAKRLIDYGFHAPTMSFPVAGTLMVEPTESEDLGEIDRFIDAMIAIRGEIDRVGAGEWTPEDSPLRGAPHTSRALVGEWDRPYSRELAVFPTGLTGPNGVADKYWPPVARIDQAYGDRHLVCSCPPVEAFAE

SEQ ID NO: 2860 - DNA, 2880 bp, Azoarcus sp. BH72
  CDS (1)..(2880): transl_table=11
atgccccagacgctgctctccgccccgctcgcccagctcgaacaacgcgacgccttcatccaccggcacctcggccccaacccggacgagatcgcccgcatgtgtgcgacgatcggggttcccgacatcgacacgctgattgcacagaccgtcccagcctcgatccggctgccgcaagcgctgccgctggcgggaccgcgtccggagcacgaagcgctggaactgctgcgcggccttgccgagcgcaacgcggtgaagaaatccatgatcggcatgggctactacggcacccacacgcccgcggtaatcctgcgcaacgtgatggaaaacccgggctggtacaccgcctacaccccttaccaggccgagattgcccaagggcgcctggaagccctgctcaatttccagcagatggtcatcgacctcaccgggctggaacttgccaacgcctcgctgctggacgaagccaccgccgccgcggaggcgatggccatggcacgtcgcgtgtccaagtcgaagtcgaacgcgttcttcgtcgatgccgcctgttttccgcagaccctcgacgtcgtgcgtacccgcgccgagtatttcggtttcaacctcgtgttaggcgatgccgctgaggcggccgagcacgacgtgttcggcgcactgctgcagtaccccaatgtccacggcaccgtaggcgatctcggcgcggtgatcgcggcactcaagggccgcggcgcgatcaccgcccttgcgacggacctgatggcgctggtgctgctgaagtcccccggcgcaatgggcgcggacatcgcgctcggctcggcccagcgctttggcgtaccgatgggattcggcggcccgcatgcggccttcttcgcgacacgtgaagcctatgtccgctcgatgcccggccgcatcatcggcgtctcgcgcgatgctcgcggcaagaccgcactgcgcatgaccctgcagacgcgcgaacagcatatccggcgcgaaaaggcgaactccaacatctgcacctcgcaggtgctgctcgccaacatggcgggtttctatgccgtctatcacggcccgcagggcttgcgcacgattgccgcgcgcattcatcgcctcgccgcgctgctcgacgccggtctgcgcgccgccggtttcgcggtgcgctcgtccgcctacttcgacaccctggaggtcgacgccgacgagcgcgccgcggcgatcctttccgcggccgaccaagcgggtttcaacctgcgcgacgccggccacggccgcatcgggctgtcggtggacgagaccactacccgcgcggacatcgcggcggtgctcgcctgcttcggcgccaacgtcgacctcgagaccctgacgcctgcctcggccctgcctgcgggcctgctgcgcgacgacgcgatcctggcgcacccggtgttcaacacccatcacaccgagcacgagatgctgcgctatctgaagaagctgcagaaccgtgacctcgcgctggaccattcgatgatctcgctgggctcgtgcacgatgaagctcaacgccaccagcgagatgatcccggtcacctggccggcatttgccaacctgcatccgtttgcgccgcccgcgcagacccagggctacatggcgatgatcgacggcctggccgactacctgaaggccgtcaccggcttcgacgcgatctgcatgcagcccaactcgggcgcgcaaggcgaatacgccggcctggtggcgatccgccgttaccacgccagtcgcggcgaagcccatcgcgacgtatgcctcatcccgcgttcggcccacggcaccaaccccgccaccgcacagatgtgcggcatggaggtggtggtggtcgattgcgacggtagcggcaacgtcgatctcgaaaacctccagagcaaggccgcgcagtacgccgaccgcctcgccgcgatgatgatcacctatccgtccacccacggcgtgttcgaggagaacatccgcgaaatctgcgccgcggtgcacgcccacggcggccaggtgtacatggacggcgccaacctcaacgcccaggtcggcctgacctcgcccgccatcattggcgccgacgtgtcgcacatgaaccttcacaagaccttctgcatcccccatggcggcggcgggccgggcatggggccgatcgggctcaaggcccatctcgcgcccttcatggcggaccacgcggtggctgccaccggcgacgcggagcgggtcaacaagggccagggcgctgtttccgcggcaccgttcggctcggccagcatcctgccgatctcctggatgtacatcacgatgatgggcggcgaggggctcaagcgtgcgaccgaagtcgccatcctcaacgccaactatctcgccagccggctggcgcctcattacccggtgctgtacaccggcagccgtggccgcgtcgcccacgagtgcattctcgacatccgtccgatcaaggcggcaaccgggatcagcgaggtcgacatcgcgaagcgcctgatggactacggtttccacgccccgacgatgtccttcccggtggcgggcacgatcatggtggaaccgaccgagtccgaagacctcgccgaactcgaccgtttcatcgaggccatggtggcgatccgcggcgaaatcctgcggatcgagcgcggcgaatggccggccgacgacaacccgttgcgcaacgcgccccacacccaaggcgaaatcgccgcggcgcaatgggagcggccctacagccgcgagcaggcggtctttccgctgccctgggtcgcggacaacaagttctggcccagcgtcaatcgcatcgacgacgtgtatggcgaccgcaacctgttctgcgcctgcgtgccgatggaggcctacagctga

SEQ ID NO: 2861 - protein, 959 aa, Azoarcus sp. BH72
MPQTLLSAPLAQLEQRDAFIHRHLGPNPDEIARMCATIGVPDIDTLIAQTVPASIRLPQALPLAGPRPEHEALELLRGLAERNAVKKSMIGMGYYGTHTPAVILRNVMENPGWYTAYTPYQAEIAQGRLEALLNFQQMVIDLTGLELANASLLDEATAAAEAMAMARRVSKSKSNAFFVDAACFPQTLDVVRTRAEYFGFNLVLGDAAEAAEHDVFGALLQYPNVHGTVGDLGAVIAALKGRGAITALATDLMALVLLKSPGAMGADIALGSAQRFGVPMGFGGPHAAFFATREAYVRSMPGRIIGVSRDARGKTALRMTLQTREQHIRREKANSNICTSQVLLANMAGFYAVYHGPQGLRTIAARIHRLAALLDAGLRAAGFAVRSSAYFDTLEVDADERAAAILSAADQAGFNLRDAGHGRIGLSVDETTTRADIAAVLACFGANVDLETLTPASALPAGLLRDDAILAHPVFNTHHTEHEMLRYLKKLQNRDLALDHSMISLGSCTMKLNATSEMIPVTWPAFANLHPFAPPAQTQGYMAMIDGLADYLKAVTGFDAICMQPNSGAQGEYAGLVAIRRYHASRGEAHRDVCLIPRSAHGTNPATAQMCGMEVVVVDCDGSGNVDLENLQSKAAQYADRLAAMMITYPSTHGVFEENIREICAAVHAHGGQVYMDGANLNAQVGLTSPAIIGADVSHMNLHKTFCIPHGGGGPGMGPIGLKAHLAPFMADHAVAATGDAERVNKGQGAVSAAPFGSASILPISWMYITMMGGEGLKRATEVAILNANYLASRLAPHYPVLYTGSRGRVAHECILDIRPIKAATGISEVDIAKRLMDYGFHAPTMSFPVAGTIMVEPTESEDLAELDRFIEAMVAIRGEILRIERGEWPADDNPLRNAPHTQGEIAAAQWERPYSREQAVFPLPWVADNKFWPSVNRIDDVYGDRNLFCACVPMEAYS

SEQ ID NO: 2862 - DNA, 3012 bp, Rubrivivax gelatinosus PM1
  CDS (1)..(3012): transl_table=11
atgctcaggcccctcgccctgcccctcgccgcactcgaacacaccaccgacttcgccggccgtcacatcggcatcgaccccgccgacgaacagcacatgctgtcggtgatcggcgcggcttcgcgccaggccatgatcgaggccatcgtcccgcgcagcatcgcccgcgcgcgcccgatggtgctgcccgaacccgtcggcgaggtccaggcgctggccgagctgaaggcgatcgccgcgaagaaccgcgtgtaccgcagctacatcgggcagggctaccacggaacgcacacgccgggcgtcatcctgcgcaacatcctcgagaacccggcctggtacaccgcctacacgccctaccaggccgagatctcgcagggtcggctcgaggcgctggtgaatttccagaccatggtgtgcgacctgaccggcatggcgatcgccaacgcctcgatgctcgacgaggccaccgccgccgccgaggccatgacattggcccgacgcagcgtgaagagcaagagcgccacggtcatcgtggcttcggattgccacccgcagaccatcgaggtgatccgcacgcgcgcgcggccgctgggcatcgaggtgctggtgggcctggtgccggagctgatggcgcagcacgagtacttcgccgtgatcgcacagtacccggcgaccggcggcatcgtgcacgacatgaagccctatgtggatgcggcgcatgccagcggtgcggccttcgtcgtcgccgccgacctgctggcgctgacgctgctcacgccgcccggtgaatggggtgccgatatcgccatcggcagcacccagcgcttcggcatgccgatgggcgccggcggcccgcacgcggccttcctggcctgccgtgacgagttcaagcgctcgatgccgggacgcctggccggcgtgagcgtcgacgcgcacggccggcccgcctaccggctggcgttgcagacgcgcgagcagcacatccgccgcgagaaggccacgtcgaacatctgcaccgcccaggtactgccggcggtggtggcgagcatgtatgcggtctaccacggacctcaggggctcaagcgcatcgcgcagcgcgtggcgagctacaccgccatcctggcgcacggcctgcgcgcgatgggcttcgagctcgccggtgacagcgccttcgacacgctgtgcgtcgagaccggcatcgaaaccaatgccatcgcccgccgcgcccgcgatgccggagccaacctgcgacgcctgtcggccacgcagctcggcatcacgctggacgagaccaccacgcgcgaagatctcaccgcgctgtggtcatggttcgcgcgctccgagggcatggtgcccaacgtcgctgcgttcgcgcacggcgccgacccgctgatccccagcgagctgcgccgcaccagcgcctacctgacccacccggtcttcaacagccaccacagcgagaccgagatgctgcgctacctgcgcagcctggccgacaaggacctcgcgctcgaccgcacgatgatcccgctgggttcgtgcaccatgaagctcaacgcgaccagcgagatgatcccgatcacctggcccgagttcgcgcacatccacccgttcgccccggccgagcagctggccggctatgccgaactcgacgcccagctgcgccagtggctgtgcgaggccaccggctacgccggcatcagcctgcagcccaacgccggctcgcagggcgaatatgccggcctgctggcgatccaggcctggcatgcctcgcgcggcgacgcgcagcgcgacgtctgcctgatccccgagtcggcgcacggcaccaacccggcgagcgcccagatggccggcatgcgcgtggtggtgacgaagtgcgacgccgagggcaacgtcgacctcgacgacctgcgcgccaagtgcgagcagcacagctcgcaactggccgccgtgatggtcacctacccgtcgacctacggcgtgttcgacccgcacatcaaggcgctgtgcgcactggtccaccagcacggcggccgggtctacgtggacggcgcgaacatgaacgcgctggtcggcgtggccgcgccgggcgagttcggcggcgacgtgagccacctcaaccttcacaagaccttctgcattccgcacggcggcggcggcccgggcgtgggcccggtgtgcgtggtcgaggacctggtgcccttcctgccgacgcaccgcacgggcgcctcggcgagctccgtggatgcctacgtcggcagcgcggtcgagccgacgccgggccgccccaaggtggcgagcgccctctcggggggcagcgaagtgcccgcagggccgagcgtgggggccgtcagtgcttcgccgctgggcaacgcggcggtgctgccgatcagctggatgtacgtccgcatgatgggtgcagccggcctgaccgctgcgaccgagaccgcgatcctgagcgcgaactacatcgccgcgcggctggccgaccactacgacatccacttcagcggcgaggtcgacgggctcaagggcggcggtgtcgcccacgagtgcatcctcgacctgcgcccgctgaaggacagcagcggcgtcagcgccgaggacgtggccaagcgcctgatcgactacggcttccacgcgccgacgctgagcttcccggtcgccggcacgctgatggtcgagccgaccgagagcgagtcgctgcacgagctcgaccgcttctgcgacgcactgatcgcgatccgcgccgagatcgcccgggtcgagcaaggccactggccgcaggacgacaacccgctcaagcacgcgccgcacaccgccgaggcgctgctgaaggccgactggccgcacccctactcgcgtgaggaggccgcctacccggtgagcagcctgcggcgtcagaagtactgggcaccggtcggtcgcgtcgacaacgtgcacggcgaccgcaacctgttctgcagctgcgtgccgctgagcgcctacgccgaagccgacaagcaggcatga

SEQ ID NO: 2863 - protein, 1003 aa, Rubrivivax gelatinosus PM1
MLRPLALPLAALEHTTDFAGRHIGIDPADEQHMLSVIGAASRQAMIEAIVPRSIARARPMVLPEPVGEVQALAELKAIAAKNRVYRSYIGQGYHGTHTPGVILRNILENPAWYTAYTPYQAEISQGRLEALVNFQTMVCDLTGMAIANASMLDEATAAAEAMTLARRSVKSKSATVIVASDCHPQTIEVIRTRARPLGIEVLVGLVPELMAQHEYFAVIAQYPATGGIVHDMKPYVDAAHASGAAFVVAADLLALTLLTPPGEWGADIAIGSTQRFGMPMGAGGPHAAFLACRDEFKRSMPGRLAGVSVDAHGRPAYRLALQTREQHIRREKATSNICTAQVLPAVVASMYAVYHGPQGLKRIAQRVASYTAILAHGLRAMGFELAGDSAFDTLCVETGIETNAIARRARDAGANLRRLSATQLGITLDETTTREDLTALWSWFARSEGMVPNVAAFAHGADPLIPSELRRTSAYLTHPVFNSHHSETEMLRYLRSLADKDLALDRTMIPLGSCTMKLNATSEMIPITWPEFAHIHPFAPAEQLAGYAELDAQLRQWLCEATGYAGISLQPNAGSQGEYAGLLAIQAWHASRGDAQRDVCLIPESAHGTNPASAQMAGMRVVVTKCDAEGNVDLDDLRAKCEQHSSQLAAVMVTYPSTYGVFDPHIKALCALVHQHGGRVYVDGANMNALVGVAAPGEFGGDVSHLNLHKTFCIPHGGGGPGVGPVCVVEDLVPFLPTHRTGASASSVDAYVGSAVEPTPGRPKVASALSGGSEVPAGPSVGAVSASPLGNAAVLPISWMYVRMMGAAGLTAATETAILSANYIAARLADHYDIHFSGEVDGLKGGGVAHECILDLRPLKDSSGVSAEDVAKRLIDYGFHAPTLSFPVAGTLMVEPTESESLHELDRFCDALIAIRAEIARVEQGHWPQDDNPLKHAPHTAEALLKADWPHPYSREEAAYPVSSLRRQKYWAPVGRVDNVHGDRNLFCSCVPLSAYAEADKQA

SEQ ID NO: 2864 - DNA, 2928 bp, Burkholderia vietnamiensis G4
  CDS (1)..(2928): transl_table=11
atgaagcacgaacacccggaccgcctgatgaaccgcacgcccctctcgctcgccgcgctcgaaacgcacgacgcgttcgcagaacgccacatcggccccgatgccgccagccagcaggccatgctcgacacgctcggcttcgcgtcgcgcgccgccctgatcgacgccgtgatccccgcgtcgatccgccgcgccgaagcgctgccgctcggcccgttcgcgcagccgaagagcgaggccgaagcgctcgccgcgctgcgcgcgctcgcggacaagaaccaggtgttccgctcgtacatcggccagggctattacgactcgcacacgccggccgtgatcctgcgtaacgtgctcgaaaacccggcgtggtacacggcgtacacgccgtaccagcccgaaatttcccagggccgcctcgaggcgctcctgaacttccagcagatggtcgtcgacctgaccggcctcgcgatctcgaacgcgtcgctgctcgacgaagcaacggccgcggccgaagcgatgacgctgctgcaacgcaccggcaagccgaagtcgaacgtgttctacgtggccgacgacgtgctgccgcaaaccctcgaagtagtccgcacgcgcgcgctgccgatcggcatcgaagtgaagaccggcccggccgccgaggccgcgcaggccggcgcgttcggcgtgctgctccagtatccgggcgtgaacggcgacgtgcgcgactaccgcgcgctcaccgacgcgatccacgcggcgggcggccatgtcgtcgtcgcggccgacctgctcgcgctgaccgtgctgacgccgcccggcgaatggggcgcggacgtcgcggtcggcaacacgcagcgcttcggcgtgccgatgggcttcggcggcccgcacgccgcctacatggccgtgcgcgacgaattcaagcgccagatgccgggccgtctcgtcggcgtgaccgtcgacgcgcagggcaagcccgcgctgcgcctcgcgctgcagacgcgcgaacagcacatccgccgcgagaaggccacgtcgaacgtgtgtaccgcgcaggcgctgctcgcgatcatggcgagcatgtacgcggtctatcacggcccgcacggcctgaagacgatcgcgctgcgcgtgaaccgcatcgccgcactgctcgccgcgggcgtcaagcagctcggcttcacgaccgtcaacgacaccttcttcgacacgctgacgatcgacgccggcgcacgcaccgcgcagctccacgccttcgcgaacgcgaagcgcatcaacctgcgccgcgtcagcgacacgcaagtcggcgtgtcggtcgacgaaacgacgacccgcgacgacctcgccgatctgctggccgtgttcgcgcaggccgcgggcggcaccgcgccggacgtcgacgcgctggacgcgggcctgcccggcgtcgccgcgctgccggccggcctcgagcgcacgagcgcgtacctgacgcaccacgtgttcaaccgccaccattccgaaaccgagatgctgcgctacctgcgcagcctgtcggacaaggacctcgcgctcgaccgctcgatgattccgctcggctcgtgcacgatgaagctgaacgcgacgtcggaaatgctgccggtcacgtggcccgagttcggccgcatccatccgttcgcgccgtccgagcagacggccggctaccgcgagatgatcgaccagctcgagcagatgctcgtcgctgccaccggctacgcggccgtgtcgctgcagccgaacgccggctcgcagggcgaatacgcggggctgctggtgatccacgcgtaccacgcgtcgcgcggcgaagcgcatcgcgacgtctgcctgatcccggcgtccgcgcacggcaccaacccggcgtccgcgcacatggccggcatgaaggtcgtggtcgtcgcgtgcgacgcgcagggcaacgtcgacatcgccgacctgaaagcgaaggccgaacagcacgcgaacgacctcgcggcgatcatgatcacgtatccgtcgacgcacggcgtgttcgagcagaacgtgcgcgagatctgcgagatcgtccatgcgcacggcggccaggtgtacgtcgacggcgcgaacatgaacgcgatggtcggcctcaccgcgccgggccagttcggcggcgacgtgtcgcacctgaacctgcacaagaccttctgcatcccgcacggcggcggcggcccgggcgtcggcccggtcgcggtcggcccgcacctcgcgaagttcctgccgaaccagcgttcgaccggctacgcgcgcggcgaagaggggatcggcgcggtgtcggccgcgccgtacggctccgcgtcgatcctgccgatctcgtggatgtacatcgcgatgatgggcgcgaagaacctgaccgccgccaccgagacggcgatcctcaacgcgaactacatcgcgaagcgcctcgcgccgcactacccggtgctgtattcgggcccaggcggactcgtcgcgcacgagtgcattctcgacctgcgtccgatcaaggaaaccagcggcatcaccgtcgacgacgtcgcgaagcgcctgatggactacggcttccacgcgccgacgatgagcttcccggtgcccggcacgctgatggtcgagccgaccgaatcggaatcgcaggaagaactcgaccgcttcatcgccgcgatgatcgcgatccgcgaggaaatccgcgccgtcgaggaaggccgcgccgaccgcgaggacaacccgctgcgtcacgcgccgcatacggcagccgtcgtcaccgcgaacgagtggccgcatgcgtactcgcgcgagcaggccgcgtatccggtcgcatcgctcgtcacgaacaagtactggccgccggtcggccgcgcggacaacgcatacggcgaccgcaacctgttctgctcgtgcgtgccgatgtcggaatacgcataa

SEQ ID NO: 2865 - protein, 975 aa, Burkholderia vietnamiensis G4
MKHEHPDRLMNRTPLSLAALETHDAFAERHIGPDAASQQAMLDTLGFASRAALIDAVIPASIRRAEALPLGPFAQPKSEAEALAALRALADKNQVFRSYIGQGYYDSHTPAVILRNVLENPAWYTAYTPYQPEISQGRLEALLNFQQMVVDLTGLAISNASLLDEATAAAEAMTLLQRTGKPKSNVFYVADDVLPQTLEVVRTRALPIGIEVKTGPAAEAAQAGAFGVLLQYPGVNGDVRDYRALTDAIHAAGGHVVVAADLLALTVLTPPGEWGADVAVGNTQRFGVPMGFGGPHAAYMAVRDEFKRQMPGRLVGVTVDAQGKPALRLALQTREQHIRREKATSNVCTAQALLAIMASMYAVYHGPHGLKTIALRVNRIAALLAAGVKQLGFTTVNDTFFDTLTIDAGARTAQLHAFANAKRINLRRVSDTQVGVSVDETTTRDDLADLLAVFAQAAGGTAPDVDALDAGLPGVAALPAGLERTSAYLTHHVFNRHHSETEMLRYLRSLSDKDLALDRSMIPLGSCTMKLNATSEMLPVTWPEFGRIHPFAPSEQTAGYREMIDQLEQMLVAATGYAAVSLQPNAGSQGEYAGLLVIHAYHASRGEAHRDVCLIPASAHGTNPASAHMAGMKVVVVACDAQGNVDIADLKAKAEQHANDLAAIMITYPSTHGVFEQNVREICEIVHAHGGQVYVDGANMNAMVGLTAPGQFGGDVSHLNLHKTFCIPHGGGGPGVGPVAVGPHLAKFLPNQRSTGYARGEEGIGAVSAAPYGSASILPISWMYIAMMGAKNLTAATETAILNANYIAKRLAPHYPVLYSGPGGLVAHECILDLRPIKETSGITVDDVAKRLMDYGFHAPTMSFPVPGTLMVEPTESESQEELDRFIAAMIAIREEIRAVEEGRADREDNPLRHAPHTAAVVTANEWPHAYSREQAAYPVASLVTNKYWPPVGRADNAYGDRNLFCSCVPMSEYA

SEQ ID NO: 2866 - DNA, 2958 bp, Crocosphaera watsonii WH 8501
  CDS (1)..(2958): transl_table=11
atgcctaacctggatattactgctaatcaacctaaaactaacgacaatagaacttataacattgaaaacacactagcacctactgatagctttatcaatcgacacattggacccaatagccaagagattgataaaatgctcaaagtgttaggattttccagtctagacaaactcattgatgctacagtaccccaaggaatacaccttagtaaaaccctgattttacccgaagcacagagcgaatatggtgcattagcccaattaaagtctattgcttccaaaaatcaaatatttcgttcttatatcggcatgggttatcatgactgtatcacacccccagtcattcaacgcaacatcctagaaaacccaggttggtatactgcttacaccccatatcaagcagaaattgctcaaggaagactcaaagccctcttaaactatcaaactatgatagtagagttaacaggactcgaaattgctaacgcttccttactagatgaaggtacagcagcagcagaagccatgagcatgagttatggtttatgtaagaacaaaaatgctaatgctttctttgtggactgccattgtcacccccaaaccatcgaagtcattaaaacaagggcgtatcctttaggtattgagttaattattgccgatcatcgcttctttgagttcgagcaagaaattttcggcgcattattacaatatcctgccaccgatggcaccatctacgactatcgcacctttatcgaaagcgcacatgacaagggtgcattagttaccgttgcggctgaccccttgagtttagcactcttaacaccccccggagaatttggcgcagatatcgccgtaggcagcactcaacgcttcggtgtacccttggggtatggtggacctcatgcagcctattttgccacccgagaagcctataaacggaagattccagggcgtattgtgggagtatctaaggatgcacaaggaaaccctgctttaagattagcactgcaaaccagagaacaacatatccgtagagacaaagctaccagtaacatctgtacagcgcaggtattactagcagttattgcgggaatgtatggggtgtatcatggaccagagggtgttaaaaatatcgctcaaagaatacatcaattaacggtaattctcgctaaaggattacaaaagttaagctacacagttaacgatgaacccttctttgacaccgttagagttggggtaggtgatgccagtgtaaaagctgtgattgcagcagcagcagaacgcaaaattaatctcaggttatatacagaaggagtcttatgtattagcttagatgaaactaccacagttcatgacgttgttgagttgtggcaaatttttgcagctaaagatgagttacctttcaccgttgaagagatagcagaggaagttaattttgacttacctatcttctttcaacgtacctcagaatatttaaccgatcctgttttcaatcagtaccattcggaaagtaaattactgcgttacttacaccagttagaaagcaaagacttagctttgaatacttccatgattcctttgggatcatgtactatgaaattgaactcagcagccgaaatgatgccagttacttggccagagtttggtaaactccatccttttgcccccttatcccaaaccgaaggctatcaaattctctttcaacagttagaagtatggttaggagagataacaggatttgacggtatttctttacaacctaatgctggttctcaaggagaatatgcaggacttcaagtaattcgtcaataccacgaaaatcgtggcgaagctaaccgcaatatctgcttgattcctgaatctgcacacggcacaaaccctgctagtgcagtgatgtgcgggatgaaagttgttcccgttaaatgtgataaagagggaaacattgatattgcagacttgcagaaacaagctgaaaaacactccgaaaatttaggggcgttaatggtaacatatccttccactcacggggtatttgaagaagaaataatcaacatctgtaatatcgttcataatcacggtggacaagtgtatatggatggggctaatatgaacgcccaagtaggggtatgtcgtcccgctgactttggggccgatgtttgtcacctcaacctgcacaaaaccttctgtatccctcacggtggtggtggcccgggaatgggtcccatcggtgtaaaagaacatttgatcccatttttacccacaaccaacctggataaattcaccgaccccaacagtaatggtaaagtagacacatccataggagccatttccgcagccccttggggtagtgctagtatcctggtcatttcttggatgtacatcgctatgatgggggaaaaagggctgactgaggcgacaaaagtagctatcctcaacgctaactatatggcctctcgtttagctgactattatcccatcttgttcaaaggtgcatccggttgtgtcgctcatgaatgtatcattgatctacgtcccctgaaaaaccaagcagaggtaggggtggatgatattgctaaacggttgatggactttggtttccatgcacccacagtgtcttggcctgttggtggtactatgatggttgaacctacggaaagcgaagacttagcagagttggatcgtttctgtgatgccatgatcaccattcaccaagaggctcaagcgatcgcagatggtacaattgaccctgctaacaatcctttgaaaaatgcgccccacacagcagaaatggtaatttgtcaagagtgggatcgtccttattcccgtgaaaaagcagcttatcccgcgtcttggagcaaagaacataagttctggccaactgtaggacgtattgataacgcttacggagacagaaacctagtttgttcttgtgaaggaatggacgcttataaagaagactaa

SEQ ID NO: 2867 - protein, 985 aa, Crocosphaera watsonii WH 8501
MPNLDITANQPKTNDNRTYNIENTLAPTDSFINRHIGPNSQEIDKMLKVLGFSSLDKLIDATVPQGIHLSKTLILPEAQSEYGALAQLKSIASKNQIFRSYIGMGYHDCITPPVIQRNILENPGWYTAYTPYQAEIAQGRLKALLNYQTMIVELTGLEIANASLLDEGTAAAEAMSMSYGLCKNKNANAFFVDCHCHPQTIEVIKTRAYPLGIELIIADHRFFEFEQEIFGALLQYPATDGTIYDYRTFIESAHDKGALVTVAADPLSLALLTPPGEFGADIAVGSTQRFGVPLGYGGPHAAYFATREAYKRKIPGRIVGVSKDAQGNPALRLALQTREQHIRRDKATSNICTAQVLLAVIAGMYGVYHGPEGVKNIAQRIHQLTVILAKGLQKLSYTVNDEPFFDTVRVGVGDASVKAVIAAAAERKINLRLYTEGVLCISLDETTTVHDVVELWQIFAAKDELPFTVEEIAEEVNFDLPIFFQRTSEYLTDPVFNQYHSESKLLRYLHQLESKDLALNTSMIPLGSCTMKLNSAAEMMPVTWPEFGKLHPFAPLSQTEGYQILFQQLEVWLGEITGFDGISLQPNAGSQGEYAGLQVIRQYHENRGEANRNICLIPESAHGTNPASAVMCGMKVVPVKCDKEGNIDIADLQKQAEKHSENLGALMVTYPSTHGVFEEEIINICNIVHNHGGQVYMDGANMNAQVGVCRPADFGADVCHLNLHKTFCIPHGGGGPGMGPIGVKEHLIPFLPTTNLDKFTDPNSNGKVDTSIGAISAAPWGSASILVISWMYIAMMGEKGLTEATKVAILNANYMASRLADYYPILFKGASGCVAHECIIDLRPLKNQAEVGVDDIAKRLMDFGFHAPTVSWPVGGTMMVEPTESEDLAELDRFCDAMITIHQEAQAIADGTIDPANNPLKNAPHTAEMVICQEWDRPYSREKAAYPASWSKEHKFWPTVGRIDNAYGDRNLVCSCEGMDAYKED

SEQ ID NO: 2868 - DNA, 2886 bp, Kineococcus radiotolerans SRS30216
  CDS (1)..(2886): transl_table=11
atgacctcgcccacgcccctgcgcaccgagctgcccgagttcgcccccgaacccgcggccctgcccttcagcgcccgccacatcggccccgacgcggccgccgtcgcgcggatgctccaggtcgtcggcctcacctccaccgaggagctcgtcgaccgcgccgtgcccgccggcatccgcgacggcgtcctcgacctccccgaggccctcgacgagacctccgtgaccgccgccctgcgcgagctggccgggcgcaaccgggtcgtcccctcgatgatcggcctcgggtacttcggcacccgcaccccggccgtcgtgcggcgcaacgtcctggaggacccctcctggtacaccgcctacacgccctaccagccggagatctcccaggggcgcctcgaggcgctgctgaacttccagaccgctgtcaccgacctcaccgggctcgacgtcgccaacgcctcgctgctcgacgaggggaccgccgccgccgaggcgatgaccctggcccgccgcacctccaaggcgccgcgcggcgcggtgttcgccgtcgacgccgacgtcctgccccagaccctcgccgtgctgcgcacccgcgccgtccccctcggcatcgacctcgtcaccgtcgacctcgacacccccgacccgctctcggtcgtgggggagtgcggggtgttcggcgtcctgctgcagtaccccgggacctccggccgggtgcgcgacctcgccgccgtcgtggccgacgcgcacgcccggggggcgctcgcgatcaccgcggccgacctgctggcgctgacgctgctcgtcgccccgggcgagttcggcgccgacgtcgccgtcgggtccagccagcgcttcggggtcccgatgggcgccggcggcccgcacgcggcgtacatggccgtccgcaagggcatcgagcgctcgctgcccggccgcctcgtcggggtgtccgtcgacgccgacggcaacaccgcctaccgcctcgcgctgcagacccgcgagcagcacatccgccgcgacaaggccacctccaacatctgcaccgcgcaggtcctgctggccgtgatggccggctgctacgccgtctggcacggaccggaggggctgcgcgccatcgcctcccaggtcgcccgccgggccgcggggatcgccgccgcgctgcgcgccgggggcgtggaggtcgtgcacgacaccttcttcgacaccgtgctggcccgggtgccgggccgggccggcgacgtcgtcgccgccgccctggccgccggggtgaacctgcgcctcgtcgacgccgaccacgtggggctcaccgtcgacgagacgacgtcggaggcccacgtcgccgccgccctgcgcgggttcgggctcgaccccgtcgaggccaccgccgaccccgcgctgcccgccgccctgcgccgcacctcggacttcctcacgcacccggtgttcagccggcaccgctcggagacggcgatgctgcgctacctgcgccggctctccgacgccgactacgccctggaccgcggggccatcccgctgggctcctgcaccatgaagctcaacgccacgaccgagctcgaaccggtctcctggccggagttcgccgacctgcacccctacgccccggccgaccagctcgccggcaccgcgcagctcgtcgccgacctcgagggctggctggccgaggtcaccggctacgacgcggtctcgctgcagcccaacgccgggtcgcagggggagttcgcgggcctgctcgccatccgcgcctaccacctggcccagggccggggggagcgcacggtctgcctcatccccagctccgcgcacggcaccaacgccgccagcgccgtcatggcggggctgcgggtcgtggtcgtgacgtgcgacgagggcggcaacgtcgacctcgacgacctgcgggccaaggtcgccgagcacgccgacgacctcgctgcgctcatggtcacctacccctccacccacggggtctacgaggagtccatccgcgaggtctgcggcctcgtccacgacgccggcggtcaggtctacgtcgacggcgccaacctcaacgccctcgtgggcctggcccgccccggcaagttcggggccgacgtctcccacctgaacctgcacaagacgttctgcatcccccacggcggcggcggtcccggcgtcggcccggtcgcggtccgcgagcacctcgccccgttcctgccctccaccgcccccgggggcgacctcgacgggcgtggcgtgggcatggtgtcggccgcgccgttcggttccgccggcatcctgcccatcccgtgggcctacctgcgcctcatgggccccgacgggctgcgcgccgcgaccgtccaggccgtcctgtcggccaactacgtcgccgcccgcctcgccgacgcgttcccggtgctctaccgcggccccggcgggctcgtcgcccacgagtgcatcctcgacctgcgcccgatgacgaaggccaccggcgtcaccgtcgacgacgtcgccaagcgcctcgtcgaccacgggttccacgccccgacgatgtccttccccgtcgcgggcaccctcatggtcgagcccaccgagagcgaggacctcgccgagctcgaccgcttctgcgacgcgatgctcgccatcgccgccgaggtccgggagatcgccgacggccgctgggccgtcgaggactccccgctgcggcacgccccgcacaccgccgcctcgctcgtgggggagtggaaccacccctacacccgcgaggaggccgtgtacccgaacgggatggacccccgctcgaagtactggcccccggtgcgccgcatcgacggcgccgccggggaccgcaacctcgtctgctcctgcccgccgctgtcggagtactga

SEQ ID NO: 2869 - protein, 961 aa, Kineococcus radiotolerans SRS30216
MTSPTPLRTELPEFAPEPAALPFSARHIGPDAAAVARMLQVVGLTSTEELVDRAVPAGIRDGVLDLPEALDETSVTAALRELAGRNRVVPSMIGLGYFGTRTPAVVRRNVLEDPSWYTAYTPYQPEISQGRLEALLNFQTAVTDLTGLDVANASLLDEGTAAAEAMTLARRTSKAPRGAVFAVDADVLPQTLAVLRTRAVPLGIDLVTVDLDTPDPLSVVGECGVFGVLLQYPGTSGRVRDLAAVVADAHARGALAITAADLLALTLLVAPGEFGADVAVGSSQRFGVPMGAGGPHAAYMAVRKGIERSLPGRLVGVSVDADGNTAYRLALQTREQHIRRDKATSNICTAQVLLAVMAGCYAVWHGPEGLRAIASQVARRAAGIAAALRAGGVEVVHDTFFDTVLARVPGRAGDVVAAALAAGVNLRLVDADHVGLTVDETTSEAHVAAALRGFGLDPVEATADPALPAALRRTSDFLTHPVFSRHRSETAMLRYLRRLSDADYALDRGAIPLGSCTMKLNATTELEPVSWPEFADLHPYAPADQLAGTAQLVADLEGWLAEVTGYDAVSLQPNAGSQGEFAGLLAIRAYHLAQGRGERTVCLIPSSAHGTNAASAVMAGLRVVVVTCDEGGNVDLDDLRAKVAEHADDLAALMVTYPSTHGVYEESIREVCGLVHDAGGQVYVDGANLNALVGLARPGKFGADVSHLNLHKTFCIPHGGGGPGVGPVAVREHLAPFLPSTAPGGDLDGRGVGMVSAAPFGSAGILPIPWAYLRLMGPDGLRAATVQAVLSANYVAARLADAFPVLYRGPGGLVAHECILDLRPMTKATGVTVDDVAKRLVDHGFHAPTMSFPVAGTLMVEPTESEDLAELDRFCDAMLAIAAEVREIADGRWAVEDSPLRHAPHTAASLVGEWNHPYTREEAVYPNGMDPRSKYWPPVRRIDGAAGDRNLVCSCPPLSEY

SEQ ID NO: 2870 - DNA, 2946 bp, Xylella fastidiosa Dixon
  CDS (1)..(2946): transl_table=11
atgatgtctcacaccctatcttctttgcgtgatcttgaatatcacggtgcgtttgttgagcgccatatcggccctaatgatgttgagatcgcgcatatgttgcgtgtcgttggctacgattcgttggagtcgctgacggatgccattgtgccggagaagatcaggtcaaccgttgcgttggatttgcctaaggggatcacggaagaggaagcgctcgccaagattcgggtgattgccaataaaaatcgagtgtttcgcagcttcattggtcagggttactacggcacgcatacgccgaaggtgattttgcgaaatatccttgagaatccggcgtggtacacggcttataccccgtaccaggcggagatttcgcagggacgaatggaagcgctgatcaactttcagaccatgtgcgccgatctaacagggatggagatcgccaatgcgtctttgttggatgaggcgactgctgcggccgaagcgatgagcttggccaagcgttcggcgaaatcgcgctcggatctgttttttgtgcacgatgcggtgcatccgcagacgttggagttactgcgtacccgtgccgagccgttgggcattgtgttgcgtgtgggcacgccggaggaggcgttgcaggccgatgtgttcggaatattgttgcaatatccagataccttcggtcgcatcggtgatcacagggtcttggcgaatgccgtgcatgcacagggtggattggttgtggtggccagcgatctgttggcgctgacgttgattacgccaccaggcgaatggggggcggatattgtcgtaggcaatagtcagcgctttggcgtgccgtttggctttggtgggccgcatgctgggttcatggcatgtcgcgatatatataagcgctctataccagggcgtttgattggtgtctcggtcgatgctgccggtcatccggcgtaccgtttggctttgcagacgcgtgagcagcatattcgccgtgagaaggcaacttccaacatctgtactgcgcaagtgttgctggcggtgatggcctctatgtatgcggtctatcacggccctcaaggattgctccgtattgcgtggcgtactcaccgcatggcggcgattctggcggcggcgttgcgtggtgccggtctgactgtcggtgagtatttcttcgatacgctccatattgtcggtattgatgccgtggcgatccattgtgcggcggcggcggctgggatgaatctgcgcatgattgataatgcgcagcttgggatcagtctggatgagacggtcacccgttctgacgtggtggctttagggcaggtatttggtgtgcaggtcgatgtggaggcgcttgatgcgatcactgccgatgcgttgccagcggggttgttgcgcagcagcgcatttttgacgcatcccgtgttcaatacgcatcacagtgagcatgagttgctacgttatttgcgcatgttggccgataaggatttggcaatggatcggaccatgatcccgttggggtcgtgcacgatgaagctcaatgccactgctgagatgattccagtgacgtggcaggaatttgcttgcattcatccattggctccggtggtgcaatggagcggctatcgccagttgattgatgagttggaggcgatgttggccgaatgcactggttacgatgcgatcagtttgcagccgaattctggtgcacagggtgaatatgcgggtctgttggcgatccgtgcgtatcaccgttcacgtggtgaggaacggcgcaatgtgtgcctgattcctgagtcggcgcatgggactaatccggcgtcggcgcagctatgtgggatgcaggtggtcattatcaaatgcgacagaagcggtaatgtcgatgtcgatgatttgcggatgaaggcggagaaatattcagacactctcgccgcgctcatggtgacctatccgtccacgcatggggtgttcgaggaggcgattactgagatttgtgagattgtccatgcgcatgggggccaggtgtatacggacggcgccaatatgaatgcgttggttggtgtggcgaaaccggggcgatggggttcggacgtgtcccacctgaatcttcataagacgttttgtatcccgcatggcggcggtggtccgggtgtaggcccctgtgctgtgaaagcgcatttggctccttttttgcctaaaacgttgccattgccgggagacgcagcgggattgccggttcagggcacgcaagaagccaaggtcggtatggtgagtgcggccaattttggttcagcgtcgatcctgccggtgagttggatgtacatcaccatgatgggggcggcggggttgcgtaaggcgacccaggttgcgttactcaacgcaaattacattgctaagcgcttggcacctcactataagacgttgtataccggccgccatggtctggttgcacatgagtgcattcttgatgtgcgttcgttggagaaggtgagtggtgtcagtgccgaagatattgctaaacggttgatcgattttggtttccatgcgccgacattgagtttccccgtggcgggtacgctgatggtggagccgaccgagagtgaatcgcagcaagagttggatcgttttgtcgatgcaatgattcagatccgtggggagattgcggcgattgagaaggggcatcttgatcctgaggataatccgctcaagcaggcgccacacacggcggtacaggtcatggcttcgcaatgggagcatgcttattcgcgtgagttggctgccttcccattgggcgtgttgcaccatgccaaatactggcctccggtagcgcgtgtggataacgtttacggtgataagcacgtgatgtgtgcctgtattccggtagaggcttacaaggagaaagaggattctgaaatccaggatctgattgaggaggatgcatcccgttgctga

SEQ ID NO: 2871 - protein, 981 aa, Xylella fastidiosa Dixon
MMSHTLSSLRDLEYHGAFVERHIGPNDVEIAHMLRVVGYDSLESLTDAIVPEKIRSTVALDLPKGITEEEALAKIRVIANKNRVFRSFIGQGYYGTHTPKVILRNILENPAWYTAYTPYQAEISQGRMEALINFQTMCADLTGMEIANASLLDEATAAAEAMSLAKRSAKSRSDLFFVHDAVHPQTLELLRTRAEPLGIVLRVGTPEEALQADVFGILLQYPDTFGRIGDHRVLANAVHAQGGLVVVASDLLALTLITPPGEWGADIVVGNSQRFGVPFGFGGPHAGFMACRDIYKRSIPGRLIGVSVDAAGHPAYRLALQTREQHIRREKATSNICTAQVLLAVMASMYAVYHGPQGLLRIAWRTHRMAAILAAALRGAGLTVGEYFFDTLHIVGIDAVAIHCAAAAAGMNLRMIDNAQLGISLDETVTRSDVVALGQVFGVQVDVEALDAITADALPAGLLRSSAFLTHPVFNTHHSEHELLRYLRMLADKDLAMDRTMIPLGSCTMKLNATAEMIPVTWQEFACIHPLAPVVQWSGYRQLIDELEAMLAECTGYDAISLQPNSGAQGEYAGLLAIRAYHRSRGEERRNVCLIPESAHGTNPASAQLCGMQVVIIKCDRSGNVDVDDLRMKAEKYSDTLAALMVTYPSTHGVFEEAITEICEIVHAHGGQVYTDGANMNALVGVAKPGRWGSDVSHLNLHKTFCIPHGGGGPGVGPCAVKAHLAPFLPKTLPLPGDAAGLPVQGTQEAKVGMVSAANFGSASILPVSWMYITMMGAAGLRKATQVALLNANYIAKRLAPHYKTLYTGRHGLVAHECILDVRSLEKVSGVSAEDIAKRLIDFGFHAPTLSFPVAGTLMVEPTESESQQELDRFVDAMIQIRGEIAAIEKGHLDPEDNPLKQAPHTAVQVMASQWEHAYSRELAAFPLGVLHHAKYWPPVARVDNVYGDKHVMCACIPVEAYKEKEDSEIQDLIEEDASRC

SEQ ID NO: 2872 - DNA, 2847 bp, Croceibacter atlanticus HTCC2559
  CDS (1)..(2847): transl_table=11
atgaacaccaaatcatttgcacttcgccatattggtcctcgtgaaagcgatcttaaggatatgttagacaaggtaggcgcttcatctttagatgaacttatctatgaaactattccagacggtataagacttaagtctgaattagacttagatgtcgctatgagcgagtctgaatatttacaccatattacaaatcttgctgctaagaataaggtgtttagcacttacattggcttaggataccaccaaagtatcacgccagctgtaatacagagaaatgttttagaaaatccgggttggtatactgcttacacaccttaccaagcagaaattgctcaaggtaggttagaggcattgcttaacttccaaactatggttacagacctaacaggtatggagctagctaatgcatctttgttagacgagtctacagctgctgcagaagcaatgggtttactttttgcagttagagaacgagagcaaaagaaaaacaatgtatctaaattctttgtttcagaagaggtattgccacaaactatttctttgcttaaaacaagagctattcctttagatattgagttagttataggaaaccacgaagagttcaatttctcaaaagatttctttggagcattgctacaatatccaggaaaatctggtcaagtttatgattatgcaggctttgttgaacaagccaaaagtgcagatattaaagttgctgttgctgcagatattttaagcctagtaaatttacgtgctccaggtgagtttggggtagatgtagttgtaggtacaacacaacgctttggtatacctttaggttatggaggaccacacgctgcttattttgcaacaaaagaagcgtataagagaaacattcctggaagaattataggtgtaactaaagatacagatggtggtcgtgcattacgtatggcattacaaaccagagaacaacatataaaacgcgataaagcaacatctaatatttgtacagctcaagtgcttttagctgttatggcaggaatgtatgctgtttatcatggtcctaagggattacaatttattgcagatgatgtttctaataaaactgctacattggtagatagtttagagaaattaggttattaccaaaccaactcgtcttactttgataccattcaagtaaaggcagatgcatctaaagttaaaaataatgcagaagcacatggcgttaatttttattatccagatgcagaaacagtatcaatctctttaaatgaagctaccaatttagatgatttaaactgcatcataagaatatttgcagaggttaatgctaaagatgttgttaaggttgaagctttattagataatacatctttatctaatactgtaaaacgagatacaccatttttagaaaatgatgtgtttaacagctatcattctgaaacagagttaatgcgttatattaagaagttagaacgcaaagatttatctcttaatcactctatgattgcattaggatcttgtacgatgaaacttaatgcagcagcagaaatgctacctttaagttacccacaatggggtaatattcatccatttgtacctataaatcaggcagaaggttatcaagaagttttaaagaaattagaagatcaattaacagaaattactggttttgctgctacgtctttacaaccaaactctggtgcacaaggtgagtttgcagggttaatggtaattagagcatatcacgaatctcgtggtgactcaaccagaaatatttgtttaattccttcatctgcacacggtactaatcctgcaagtgcagtaatggctggtatgaaagtagttgttactaaagccaatgataaagggaatatagatgttgaggatttaagagaaaaagcagagaaacataaggataaccttgcagctttaatggtaacatatccttctacgcatggtgtttatgaatctgccattaaggagattacatcaatcattcataataatggtggtcaagtgtatatggatggtgcaaatatgaatgctcaagtaggattaacaagtcctggaaatattggagcagatgtatgccaccttaatttacataaaacctttgccatacctcatggtggtggtggtcctggcgtaggtcctatttgtgttgcttcacagttagctccttttttaccaggtaatcctgttataaaatcaggtggagaacaagctataacagcaatttctgcagcaccttttggttcttcattagcttgcttaattagttatgcctacattacaatgttaggtcctaagggcttaagaagtgctacagagcatgctattttaaatgcaaactatataaagcaacgtttaaaaggacattacgaaactctctattctggagaacgcggtagagcagctcacgagatgattatagactgccgtccttttaaagctaatggtattgaagttgtagatattgcaaagcgtttaatggattacggatttcacgcaccaactgtctcatttccagttgctggaactatgatgattgaacctacggaaagcgaaagtaaagaagagcttgatcgtttttgtgatgctatgatttctattaaaaatgaaatagatgcatctagcaaagatgatgagcaaaacctacttaaaaatgcaccacacacattgcaaatgcttacagcagatgtttgggaaatgccttatacaagacaacaagcagcatttccattagagtacatttcagataataaattttggccaacagtacgtcgtgtagatgatgcttatggagatagaaacttaatttgtacttgtgagcctattgaaagttatatggagtaa

SEQ ID NO: 2873 - protein, 948 aa, Croceibacter atlanticus HTCC2559
MNTKSFALRHIGPRESDLKDMLDKVGASSLDELIYETIPDGIRLKSELDLDVAMSESEYLHHITNLAAKNKVFSTYIGLGYHQSITPAVIQRNVLENPGWYTAYTPYQAEIAQGRLEALLNFQTMVTDLTGMELANASLLDESTAAAEAMGLLFAVREREQKKNNVSKFFVSEEVLPQTISLLKTRAIPLDIELVIGNHEEFNFSKDFFGALLQYPGKSGQVYDYAGFVEQAKSADIKVAVAADILSLVNLRAPGEFGVDVVVGTTQRFGIPLGYGGPHAAYFATKEAYKRNIPGRIIGVTKDTDGGRALRMALQTREQHIKRDKATSNICTAQVLLAVMAGMYAVYHGPKGLQFIADDVSNKTATLVDSLEKLGYYQTNSSYFDTIQVKADASKVKNNAEAHGVNFYYPDAETVSISLNEATNLDDLNCIIRIFAEVNAKDVVKVEALLDNTSLSNTVKRDTPFLENDVFNSYHSETELMRYIKKLERKDLSLNHSMIALGSCTMKLNAAAEMLPLSYPQWGNIHPFVPINQAEGYQEVLKKLEDQLTEITGFAATSLQPNSGAQGEFAGLMVIRAYHESRGDSTRNICLIPSSAHGTNPASAVMAGMKVVVTKANDKGNIDVEDLREKAEKHKDNLAALMVTYPSTHGVYESAIKEITSIIHNNGGQVYMDGANMNAQVGLTSPGNIGADVCHLNLHKTFAIPHGGGGPGVGPICVASQLAPFLPGNPVIKSGGEQAITAISAAPFGSSLACLISYAYITMLGPKGLRSATEHAILNANYIKQRLKGHYETLYSGERGRAAHEMIIDCRPFKANGIEVVDIAKRLMDYGFHAPTVSFPVAGTMMIEPTESESKEELDRFCDAMISIKNEIDASSKDDEQNLLKNAPHTLQMLTADVWEMPYTRQQAAFPLEYISDNKFWPTVRRVDDAYGDRNLICTCEPIESYME

SEQ ID NO: 2874 - DNA, 2844 bp, Sulfitobacter sp. EE-36
  CDS (1)..(2844): transl_table=11
atggttttcaaaccgaccgaatatttgccgtatgattttgccaatcgcagacatatcgggccgtccccggcagagatgtcggacatgttgaaaaccgtcggcgcacaaagccttggcgcgttgatcgatgacacgatgcccgcgcagatccgccagaaagagccgctggatttcggcaagcccatgtcagagcgcgaagtgctggaatacatgcgcgtggtggcgggtaagaacaaggtgctcacctcgctgatcgggcagggctatcacggcacggtgacgccgcctgcgatccagcgcaatatttttgaaaaccccgcatggtacacggcctacaccccctaccagcccgagatcagccaggggcgtcttgaggcattgctgaacttccagaccatggtcagcgatctgaccgggcttgaggtcgccaatgcgtcactgctggacgaggcgacggcctgtgccgaggcgatgaccatggcgatgcgcctatcgaagtcaaaggccaaggcgttctttgtcgaccgcgattgccacccccagaacatcgccgtgatccagactcgggcagccccgctggatatcgaggtgatcatcggcgaccctgacaaaatggacgcgagcgctgtcttcggggcgctattccagtaccctggcacctacggccatgtgcgcgactttaccgaccatatggccgcgctgcatgaggcaggtgccttgggtgtcgtatccgctgatccgatggcgctgacgttgctgaaagaacccggtgccatgggggctgatatcgccgtcgggtccacccagcggtttggcgtgcccgaaggctatggcggtccgcatgcggcctatatggcatgcaaggatgcctataagcgcgcaatgccggggcggattgtcggtgtctcgattgatgcgcatggcaaccgcgcctaccgtctgtccctgcagacccgcgagcagcacatccgccgcgaaaaggcgacctctaacgtgtgcacggcgcaggctttgctggcggtgatggcgtccatgtatgcggtgttccacgggcccgaggggctgaaggccatcgcgcagcgcatccatcgcaaggcggtgcgtttggcgaacgggctggaggaggccggctttaaggtcgatcccaaatccttcttcgacacggtgacggttgacgtcggccccttgcaggccgcagtcatgaaatccgcggtggacgaaggcatcaacctgcgccgcgtcggtgaaacacgtgtcggcatcacgctggacgaacgtacggtgcccgagacgatcgaagccgtctggcgcgcctttggcatccgccgcagcgacgagacattcgaggcgcagtatcggttccccgatgatatgctacgtgagagcgcctatctcacccatccgatcttccacatgaaccgcgccgagaccgagatgatgcgctacatgcgccgtctggccgaccgtgatctggcactggaccgtgcgatgatcccgctggggtcctgcacgatgaagctgaactccgccgcggagatgatgcccgttagctggcgcgagttctcgatgatccacccgtttgtgccgcaggatcaggcgcttggttacaagcatatgatcgacgacctgtcggccaagctttgtgacatcaccgggtatgatgcgatttccatgcagccgaattccggcgcgcagggcgaatatgcgggcctgctggcgattgcgtcctatcaccgtgccaacgggcaggggcatcgcaacatctgcctgatccccatgtcggcccatggcaccaaccccgccagcgccaatatggtgggttggaaggtggtcgtgatcaagacggcggccaatggtgacatcgatctggatgacttccgcgccaaggcggaaaagcacagcgagaaccttgccggttgcatgatcacctatccctcgacccacggcgttttcgaggaaaccgtgaccgaggtgaccaagatcacccatgatcacggtgggcaggtctatatcgacggggcgaatatgaacgcgatggtcggtctggcgcgtccgggcgatgtgggcggggatgtcagccacctgaacctgcacaagaccttctgcatcccgcatgggggcggcggtcccggcatggggccgatcggcgtgaaatcacatctcatcccccatgtgcccggccatccgaacggcggtgaaggcgctgtttcggcggcaccttacgggtcgccatcgttgctgccgatctcgtggtcgtattgcttgatgatgggcggtgacgggctgacgcaggcgacgcgggtggcgatcctgaacgccaactacattgccaaacggctcgaaggggcgttcgaggtgctgtacaaagggccgacagggcgcgttgcacatgaatgtatctttgacgtgcgcccgttcgaggacagcgcaggcgtgacggtggatgacattgcgaaacgtctgatcgacgccggcttccatgcgccaacgatgagcttccctgtcgcaggcacgctgatggtggaaccgacggagtcggaaaccaaggccgagctggaccgtttctgtgatgcgatgctcgcgatccgtgacgagatccgcgcaatcgagaacggcgatatgccgcgcgagaacaacgcgctgaagaacgcgccgcacacggtcgaggatctggttggcgagtgggatcgcccctacacgcgcgagcagggctgcttcccccccggtgcgttccgcgtcgacaaatactggcctccggtcaaccgtgtcgacaacgtgcatggcgaccgtaacctgatctgcacctgccccccgatggaggaatacgcagaggcggctgagtaa

SEQ ID NO: 2875 - protein, 947 aa, Sulfitobacter sp. EE-36
MVFKPTEYLPYDFANRRHIGPSPAEMSDMLKTVGAQSLGALIDDTMPAQIRQKEPLDFGKPMSEREVLEYMRVVAGKNKVLTSLIGQGYHGTVTPPAIQRNIFENPAWYTAYTPYQPEISQGRLEALLNFQTMVSDLTGLEVANASLLDEATACAEAMTMAMRLSKSKAKAFFVDRDCHPQNIAVIQTRAAPLDIEVIIGDPDKMDASAVFGALFQYPGTYGHVRDFTDHMAALHEAGALGVVSADPMALTLLKEPGAMGADIAVGSTQRFGVPEGYGGPHAAYMACKDAYKRAMPGRIVGVSIDAHGNRAYRLSLQTREQHIRREKATSNVCTAQALLAVMASMYAVFHGPEGLKAIAQRIHRKAVRLANGLEEAGFKVDPKSFFDTVTVDVGPLQAAVMKSAVDEGINLRRVGETRVGITLDERTVPETIEAVWRAFGIRRSDETFEAQYRFPDDMLRESAYLTHPIFHMNRAETEMMRYMRRLADRDLALDRAMIPLGSCTMKLNSAAEMMPVSWREFSMIHPFVPQDQALGYKHMIDDLSAKLCDITGYDAISMQPNSGAQGEYAGLLAIASYHRANGQGHRNICLIPMSAHGTNPASANMVGWKVVVIKTAANGDIDLDDFRAKAEKHSENLAGCMITYPSTHGVFEETVTEVTKITHDHGGQVYIDGANMNAMVGLARPGDVGGDVSHLNLHKTFCIPHGGGGPGMGPIGVKSHLIPHVPGHPNGGEGAVSAAPYGSPSLLPISWSYCLMMGGDGLTQATRVAILNANYIAKRLEGAFEVLYKGPTGRVAHECIFDVRPFEDSAGVTVDDIAKRLIDAGFHAPTMSFPVAGTLMVEPTESETKAELDRFCDAMLAIRDEIRAIENGDMPRENNALKNAPHTVEDLVGEWDRPYTREQGCFPPGAFRVDKYWPPVNRVDNVHGDRNLICTCPPMEEYAEAAE

SEQ ID NO: 2876 - DNA, 2850 bp, Roseovarius nubinhibens ISM
  CDS (1)..(2850): transl_table=11
atggcattcgaacccaccgactatcttccttatgatttcgccaaccgccgccatatcgggccgtcgcccgaggaaatgcaggagatgctgcaggtggtgggggccggggatctcgacgatctgatcgatcagaccgtgccgaaatccatccggcaggaggtgcctctcaatttcggcaagcccaagtccgagcgcgagctcatgcatttcatgcggctcaccgcgtcgaagaacaaggtcatggtgaacatgatcggtcagggctattacgggacggtgacgccgcccgcgatccagcgcaacatcctcgagaacccggcgtggtacacggcctatacgccctatcagccggagatcagccaggggcggctcgaggcgctgttgaacttccagacgatgatttccgatctcaccgggctcgaagtggcgaatgcctcgctgcttgacgaggcgacggcctgtgccgaggcgatgaccatggcgcagcgggtgtcgaaatcgaaggccaaggcgtttttcgtcgaccgcgactgtcatccgcagaatatcgcggtgatccagacacgggccgagccgctcggcatcgaggtgatcgtcggcaacccggacaagatggaggcgtccgaagtgttcggcgcgattttccagtatccgggcacctatggccatgtgcgcgatttcactgattacatcgcggccctgcatgagcataaggcgattgcggtgatgtcggcggatccgctggcgctcaccctgctcaaggagccaggcgagatgggggcggatattgctgtcggctcgacccagcggtttggcgtgccgatgggctatggggggccgcacgcggcctatatggcctgcaaggatgcctataagcggtcgatgccggggcggatcatcggggtcagtatcgacgcccatggcaaccgggcctaccggctgtcgctgcagacccgcgagcagcatatccgccgcgagaaggcgatgtcgaatgtctgcacggcgcaggcgctcttggcggtgatggcgtcgatgtatgcggtgttccacgggccgaaggggctcaaggccattgcgcagcgcatccatcgcaagacggtgcggctggccaaggggctcgaagaggcggggttcaaggtcgatccgcaggtgttctttgacacgatcaccgtggatgttgggccgctgcaggcggcggttctgaaatcggcggtggacgaggggatcaacctgcgtcgtgtcggcgagagccgggtcggcatttccctcgacgaggcgacgcggccgaagaatatcgaagcggtctggcgggcctttggcatcacccgggcggatgaggatttcacccccgaataccgcgtgccggaaaacatgcaccggaccagcgcctatctcacccatccgattttccacatgaaccgggcggaaaccgagatgatgcgctatatgcggcggctggcggatcgcgatctggcgctggatcgggcgatgatcccgcttggcagctgcacgatgaagctcaactcggccgccgaaatgatgccggtgagctggcgcgagttttcgcggctccatccctattgcccggtcgatcaggccgagggctataaggtgatgatcgacgatctgagcgccaagctctgcgagatcaccggctatgacgcgatctcgatgcagcccaattcgggggcgcagggcgaatatgccggtctcttgaccattgccgcctatcaccgggcgcagggcgaggggcaccgcaatgtctgcctcatcccgatgtcggcccatggcaccaacccggcgagcgcgcagatggtgggctggaaggtggtgccggtcaaatccgccgaaaccggggatatcgatcttgccgatttccgcgccaaggccgagcaatatgccgagacgctggctggcacgatgatcacctatccgtcgacccatggcgtgttcgaggaacatgtgaaggagatcaccgcgatcacccatgagcatggcggtcaggtctatatcgacggggccaatatgaacgccatggtggggctcgcccggcccggcgatattggcggcgatgtgagccatctcaacctgcacaagaccttctgcatcccgcatggcggcggtggtcccggcatggggccgattggcgtcaaggcgcatctggcgccctatctgccggggcatccctcgaccgggggcggcgaagggccggtgtcggcggcgccgttcggctcgccctcgatcctgccgatcagctgggcctatacgctgttgatggggggcgaaggtctcacccaggcgacgcgggtggcgatcctcaacgcgaactatatcgcgaagcggctcgaaggggcctatgaggtgctctatcgcgggcgcaatgaccgggtggcgcatgagtgcatcatcgacacgcggccctttgaagagagcgccggtgtcacggtcgatgacattgccaagcgtcttatcgacaacgggttccacgcgccgaccatgtcctttccggtgcccgggacgctgatggtcgagccgaccgagagcgagaccaaggccgagctcgaccggttctgcgatgcgatgctggcgatccgcgaggagatccgcgacatcgaggaaggccggatcgacgcggcgaacaacccgctcaaacacgcgccgcatacggtcgaggatctggtgggcgaatgggaccggccctatagccgcgaacaggcctgtttcccggccggggcgttccgggtcgacaaatattggccgccggtgaaccgggtggacaatgtctatggcgaccgcaacctcgtctgcacctgcccgccgatggaggagtatgccgaggcggcggagtaa

SEQ ID NO: 2877 - protein, 949 aa, Roseovarius nubinhibens ISM
MAFEPTDYLPYDFANRRHIGPSPEEMQEMLQVVGAGDLDDLIDQTVPKSIRQEVPLNFGKPKSERELMHFMRLTASKNKVMVNMIGQGYYGTVTPPAIQRNILENPAWYTAYTPYQPEISQGRLEALLNFQTMISDLTGLEVANASLLDEATACAEAMTMAQRVSKSKAKAFFVDRDCHPQNIAVIQTRAEPLGIEVIVGNPDKMEASEVFGAIFQYPGTYGHVRDFTDYIAALHEHKAIAVMSADPLALTLLKEPGEMGADIAVGSTQRFGVPMGYGGPHAAYMACKDAYKRSMPGRIIGVSIDAHGNRAYRLSLQTREQHIRREKAMSNVCTAQALLAVMASMYAVFHGPKGLKAIAQRIHRKTVRLAKGLEEAGFKVDPQVFFDTITVDVGPLQAAVLKSAVDEGINLRRVGESRVGISLDEATRPKNIEAVWRAFGITRADEDFTPEYRVPENMHRTSAYLTHPIFHMNRAETEMMRYMRRLADRDLALDRAMIPLGSCTMKLNSAAEMMPVSWREFSRLHPYCPVDQAEGYKVMIDDLSAKLCEITGYDAISMQPNSGAQGEYAGLLTIAAYHRAQGEGHRNVCLIPMSAHGTNPASAQMVGWKVVPVKSAETGDIDLADFRAKAEQYAETLAGTMITYPSTHGVFEEHVKEITAITHEHGGQVYIDGANMNAMVGLARPGDIGGDVSHLNLHKTFCIPHGGGGPGMGPIGVKAHLAPYLPGHPSTGGGEGPVSAAPFGSPSILPISWAYTLLMGGEGLTQATRVAILNANYIAKRLEGAYEVLYRGRNDRVAHECIIDTRPFEESAGVTVDDIAKRLIDNGFHAPTMSFPVPGTLMVEPTESETKAELDRFCDAMLAIREEIRDIEEGRIDAANNPLKHAPHTVEDLVGEWDRPYSREQACFPAGAFRVDKYWPPVNRVDNVYGDRNLVCTCPPMEEYAEAAE

SEQ ID NO: 2878 - DNA, 2841 bp, Oceanicola batsensis HTCC2597
  CDS (1)..(2841): transl_table=11
atgaccttcaccccgaccggttacgacgcctatgatttcgccaaccgccgccacatcggcccctctccgcaggagatggaggaaatgctggccaccataggcgtcaactccctcgacgaactgatcgaccggaccgtgcccagggcgatccgccaggccgagccgctcgatttcggcgcccccctgtccgaatccgaactgctctcgcacatgcgcgaggtcgcgggccgcaacaccgtcctcacctcgctgatcgggcaggggtatcacaacacgatcacgccgcccgcgatcaagcgcaacatcttcgaaaaccccgcctggtacaccgcctacaccccctaccagcccgagatcagccagggccggctcgaggcgctgctgaattaccagaccatggtctgcgacctcaccgggctcgacatcgccaatgcctcgctgctggacgaatccaccgccgccgccgaggcgatgaccatggcgcagcgtgcctcgaaatcgaagagcatgaagttcttcgtggacgaggcctgccacccccagaacatcgacgtgatccgcacccgcgccgaacctctcgggatcgaggtggtgctgggccgtccctcggatctcgtggccgacgaggtcttcggcgcgatcttccagtatcccggcaccaacggcgtcctgcgcgacttcacgccccagatggaggcgctgcacgccgccaaggccatcggcatcgtcatcgccgatcccatggcgctctgcctgctcaaggagccgggggccatgggcgccgacatcgccgtcggctccacgcagcgtttcggcgtgcctctgggctacggcggcccccatgccgcctacatggcctgcaaggacgcgctgaaacggtcgatgcccggccggatcgtcggggtctcgatcgacgcgcgcggcaaccgcgcctaccgtctgtcgctccagacccgcgaacagcacatccgccgcgaaaaggcgacgtccaacgtctgcaccgcccaggccctgctggcggtcatggcctcgatgtacgccgtcttccacggtccctccgggctcaaggccatcgcccagggcatccacgcccgcaccgtcaccatggcccggggcctgcgcgacgccggcttcgacgtcttccccaagaaggtcttcgacaccgtcacggtcgaggtcggccccttccagggcgcgatcctgaaatccgcggtcgaagagggtctgaacctgcgccgcgtcggcaccacccgtatcggcatcacgctcgacgaagtgaccacccccgacaccatcgccgccgtctggcgggccttcggcatcacgggcccggtccccgaaagcacgacctacgacctgccggaaaaactggtccgcgagaccccctatctcacccacgagatcttccacatgaaccgggccgagaccgagatgatgcgctacatgcgccgcctcgcagaccgcgacctcgcgctcgaccgggcgatgatcccgctcggctcctgcacgatgaagctcaacgccgcggccgagatgatcccggtcagctgggacgaaatcagctcgctccaccccttcgtgcccgccgaccaggccgagggctacacccacctgatcgccgacctctcggccaagctctgcgccatcaccggctacaacgccttttccatgcagccgaattccggcgcgcagggggaatacgcggggctgctgacgatccgcaacttccacatcgccaacggcgagggcgaccgcgacgtctgcctgatccccatgtccgcgcatggcaccaatccggcctcggcccagatggtcggatggaaggtcgtgccgatcaagtccgccgccaacggcgacatcgacctgcaggatttcgaggccaaggcgcaggaacatgccggccggctcgccgccgccatgatcacctatccctcgacccacggcgtcttcgaggaaaccgtgaccgaggtctgcaagatcgtccaccagcacggcgggcaggtctatatcgacggcgccaacctcaacgcaatggtcggcctctcgcgtcccggcgacctcggcggcgacgtcagccacctcaacctgcacaagaccttctgcattccccatggcggcggcggccccggcatgggtccgatcggggtcaaggcgcacctgatcccgcacctgcccggccacaccgcccagggcggcaccggcgcggtctcggcggcgcccttcggctcgccctcgatcctgccgatctcctgggcctactgcctgatgatgggcggcgaggggctgacccaggccacccgggtcgccatcctcaacgccaactacatcgccgcgcggctgagagaggcctatccgatcctctacaaggggcctctgggccatgtcgcgcatgaatgcatcctcgacacccggcccttcgccgaggtcggggtgaccgtcgacgacatcgccaagcgcctgatggactgcggcttccacgcccccacgatgagctggccgatctccggcacgctgatggtggaacccacggaatccgagaccaaggccgaactcgaccgcttctgcgacgccatgctcgccatccgcgaggagatcatggacatcgagagcggccgccacgaccacgccgcctcgccgctggcccatgcgccccacacggtcgaggatctcgtcggcgactgggaccgcgcctattcccgcgaacagggctgcttccccccgggcgccttccgcgtcgacaagtactggccccccgtcaaccgcgtcgacaacgtctggggcgaccgcaacctgacctgcacctgccccccgatgagcgactatgccgtggcggcggaatag

SEQ ID NO: 2879 - protein, 946 aa, Oceanicola batsensis HTCC2597
MTFTPTGYDAYDFANRRHIGPSPQEMEEMLATIGVNSLDELIDRTVPRAIRQAEPLDFGAPLSESELLSHMREVAGRNTVLTSLIGQGYHNTITPPAIKRNIFENPAWYTAYTPYQPEISQGRLEALLNYQTMVCDLTGLDIANASLLDESTAAAEAMTMAQRASKSKSMKFFVDEACHPQNIDVIRTRAEPLGIEVVLGRPSDLVADEVFGAIFQYPGTNGVLRDFTPQMEALHAAKAIGIVIADPMALCLLKEPGAMGADIAVGSTQRFGVPLGYGGPHAAYMACKDALKRSMPGRIVGVSIDARGNRAYRLSLQTREQHIRREKATSNVCTAQALLAVMASMYAVFHGPSGLKAIAQGIHARTVTMARGLRDAGFDVFPKKVFDTVTVEVGPFQGAILKSAVEEGLNLRRVGTTRIGITLDEVTTPDTIAAVWRAFGITGPVPESTTYDLPEKLVRETPYLTHEIFHMNRAETEMMRYMRRLADRDLALDRAMIPLGSCTMKLNAAAEMIPVSWDEISSLHPFVPADQAEGYTHLIADLSAKLCAITGYNAFSMQPNSGAQGEYAGLLTIRNFHIANGEGDRDVCLIPMSAHGTNPASAQMVGWKVVPIKSAANGDIDLQDFEAKAQEHAGRLAAAMITYPSTHGVFEETVTEVCKIVHQHGGQVYIDGANLNAMVGLSRPGDLGGDVSHLNLHKTFCIPHGGGGPGMGPIGVKAHLIPHLPGHTAQGGTGAVSAAPFGSPSILPISWAYCLMMGGEGLTQATRVAILNANYIAARLREAYPILYKGPLGHVAHECILDTRPFAEVGVTVDDIAKRLMDCGFHAPTMSWPISGTLMVEPTESETKAELDRFCDAMLAIREEIMDIESGRHDHAASPLAHAPHTVEDLVGDWDRAYSREQGCFPPGAFRVDKYWPPVNRVDNVWGDRNLTCTCPPMSDYAVAAE

SEQ ID NO: 2880 - DNA, 2901 bp, Prochlorococcus marinus str. MIT 9211
  CDS (1)..(2901): transl_table=11
atgattcgacagttcagtgattgtgaagagttctgtgatcgccacattgggatagatgcttgcgcccaagagtcaatgcttgctgcattgggcttcactgatctagaagattttgtagcttcagttattcctaatcagatactcaatcaaaattcatcaagcaatttgttgtctaaaggttctaatgagttgcaggcattagagcaattaaatgaaattgcccgcaaaaatattgttaatcgctctttgatcggccttggttattttgggacattaatgcctcctgctattaagcgtaatattctcgaaaacccagcatggtattcctcttataccccttatcaggcagaaatttcacaaggaagattagaggccctttttaattttcaaacactaattagtgaacttactggtctgcctatttctaatgcttctttactagatgaggcaacagcggcagcagaagcaatgagtttatctctgttagttcataaagcatctcatgcaagaaaatttttcgtagatcaagctgtttttccccagactattgaagttttaaggacaagagcggaacccttgaatattgttttggaacaaattgatccaaggaattgtgagatagatgaaaaagtttttggcttgctgattcaattgcctggatctgatggcagattatgggatccgtctttagctatagaaaaggcacatcgagttggagcattggcgacagtagctattgaccctttagcgcaggttcttttgaaacctgttggagagttaggagccgatattgctattggaagttcgcagagatttggagttcctatgggttttggaggccctcatgccgcattttttgcaactaaggaaacttttaagagacaagtccctggtcgcttagtaggtcagtctgtagatcaggatggtcaaattgcattgcgattagcattgcaaactagggagcagcatattcgacgggataaagcgactagcaatatatgtactgctcaggttttattggctatcattgcatctttttatgcaatttatcatggtccagaaggtttagaagcaatagcaaaaagaattgcttgtttccgtaaacgacttgaagatgttttaagaatacttggttatcctcttgagcctataagtggctttgacactatttcagtgaattgcgaagaagctacagaaattcataagctggctgctttaaaaggatttaatttcaggattttacctttaggagcttcgattgagaaagcaactgggtttgcgatctccttagatgaattgagtaatgaagaagagattaattctctttctgaaatctttgcaaaagtcaaaggagaagtctataaaactccctcaacttgcgatttaaacattgaagattgtcttagtgaacttccattaagacaaacaccttggttgaaccaaaaagtctttcattccttcaggtcagaaacagagttgattagatatatccagttactagcaagtaaggacttttctcttgtacatggaatgattcctttgggaagttgcaccatgaaattaaacgccacagcggaactgataccagttagttggaaagaattttcttcaattcatcctttggcacctatcgagcaatctcaaggttatgagcaattaattaaagaattggagagttggctttctgagttaactggatttaatggtgcttctttgcagccaaatgctggttctcaaggtgaatatgcagggttattagttattcgtgaatggcataagtctagagggcatcaaaatagaaacgtttgtttaattcctactagtgcgcatggtacaaatccagctagtgcagtcatgtcaggatttagggtcgtatcaattatctgtgatgaacaaggcaacatagacctcagagatcttgtacaaaaagttgaagttcattcttctgagttggctgctttaatgattacttatccttcaacgcatggagtttttgagcccaaaattcgagaaatttgtgagttggttcatgatcatggtgggcaggtttatttagatggagctaatctcaatgcccaggttggtctttgtaagcctggagaatatggtgcagatgtttgtcatttaaatcttcataagactttttgcattccccatggtggaggtggccctggtgttggaccaatagctgtcgctaaacatttattaccctatttaccaggacatccttttagaaagtgtggtggtgttaattccataggagcagtttctgcggctccatttggtagtgcgagtattttgccaatcagttggatgtatatcaggatgatgggcctaaatggtttgagaaaagcaagctctgtggcaattctctcagctaattatttggctagtcgattagacccatattatccaattttatttagaggccctaatggaaatgttgcacatgaatgcatattggatttaagacctattaaaactaaaacgggtattgaagtagatgacattgcaaaaagattaatggactatggatttcatgccccaacagtaagttggcctgttgcgggtacattaatggttgaacctactgagagtgagagcttggcagaattggatcgtttttgtgatgcgatgatatctattcgaaaagaaatcgaggctattgaatcaggggatagtgatctaaataacaatgttttacgtctttctcctcatactttgcagacagttacttctgaagattgggacagaccttactctagacagcaagctgcttttccattgaaaggccagatcaaaaacaagttttggcctgctgtttcgagaattgataatgcctttggtgatcgtaatttggtatgttcttgtccctctatggaggactttgctgaaaattag

SEQ ID NO: 2881 - protein, 966 aa, Prochlorococcus marinus str. MIT 9211
MIRQFSDCEEFCDRHIGIDACAQESMLAALGFTDLEDFVASVIPNQILNQNSSSNLLSKGSNELQALEQLNEIARKNIVNRSLIGLGYFGTLMPPAIKRNILENPAWYSSYTPYQAEISQGRLEALFNFQTLISELTGLPISNASLLDEATAAAEAMSLSLLVHKASHARKFFVDQAVFPQTIEVLRTRAEPLNIVLEQIDPRNCEIDEKVFGLLIQLPGSDGRLWDPSLAIEKAHRVGALATVAIDPLAQVLLKPVGELGADIAIGSSQRFGVPMGFGGPHAAFFATKETFKRQVPGRLVGQSVDQDGQIALRLALQTREQHIRRDKATSNICTAQVLLAIIASFYAIYHGPEGLEAIAKRIACFRKRLEDVLRILGYPLEPISGFDTISVNCEEATEIHKLAALKGFNFRILPLGASIEKATGFAISLDELSNEEEINSLSEIFAKVKGEVYKTPSTCDLNIEDCLSELPLRQTPWLNQKVFHSFRSETELIRYIQLLASKDFSLVHGMIPLGSCTMKLNATAELIPVSWKEFSSIHPLAPIEQSQGYEQLIKELESWLSELTGFNGASLQPNAGSQGEYAGLLVIREWHKSRGHQNRNVCLIPTSAHGTNPASAVMSGFRVVSIICDEQGNIDLRDLVQKVEVHSSELAALMITYPSTHGVFEPKIREICELVHDHGGQVYLDGANLNAQVGLCKPGEYGADVCHLNLHKTFCIPHGGGGPGVGPIAVAKHLLPYLPGHPFRKCGGVNSIGAVSAAPFGSASILPISWMYIRMMGLNGLRKASSVAILSANYLASRLDPYYPILFRGPNGNVAHECILDLRPIKTKTGIEVDDIAKRLMDYGFHAPTVSWPVAGTLMVEPTESESLAELDRFCDAMISIRKEIEAIESGDSDLNNNVLRLSPHTLQTVTSEDWDRPYSRQQAAFPLKGQIKNKFWPAVSRIDNAFGDRNLVCSCPSMEDFAEN

SEQ ID NO: 2882 - DNA, 2964 bp, Synechococcus sp. RS9917
  CDS (1)..(2964): transl_table=11
gtgacccttctggaacagcgctgcgtcgcctctgcagaagccattgagcaacacaggctgtcgccttttgtggagcggcatctcggacctgatccggagcagcagcagtgcatgctccaggctctcgggttcgcgtcgttggaagactttgtgcgggcggtggtgcccgccgacatcctcgatgccgagccgccactggaggccatgcccgagggtgtggctgaagcacaggctcttgcggagctgcgcaagatcgctgcggcgaaccgtctgcatcgttccctgatcggtctcgggtatcacgacacggcgacgccggccctgattcagcgccacgtgctggagaatccggcctggtacacggcctacaccccgtatcaggctgagattgcccaggggcggttggaggctctgctcaatttccagaccctgatcagcgagctcaccgggctgccgatcgccaatgcgtctttgctcgatgagagcacggcctgcgctgaagcgatgagcctcagtctggctgtgtgtaagcgcccgcaggcgtgtcgctttctggtggatgcggccgtgctgccccagacgttggcggttctcgagacccgggccacgccgctgggggtcagcctggaggtgggcgagcctgatgccttccgctgggacgaggacgtgttcggggtgttgctccaacttcccggtcgcaacggccatctctgggatccatcggcgctgatcgctgcggcccatgcgcacggtgctctggccaccgtggcgattgatcccctggcccaggtgctgctcgctcccgtcgggtcactcggagctgatatcgctgtgggcagcgctcagcgcttcggtgtgcccatggccggcggcggtccccatgccgccttttttgccacccgtgagatctacaagcgtcaggtgcccggccggatcgtcggtcagtcggtggatgcggaaggccgcccggcattgcgcctggctctgcagacccgggagcaacacatccgccgcgacaaagccaccagcaacatctgcaccgcccaggtgctgctggcggtgatggcgtcgttttacgcgattcatcacggtccggatggcctcgcggtgattgcccggcgcctggtggggcagcgcatcgccctggagcggggtctggtggcccttggctatccgttgcctcaggccccccgcttcgatggcttcgatgtggtcactcccctggcccccgctgtgcatcaacgcgcaagcgagtgcggtttcaatctgcgcgtgctgcccgatggggctcctgtggagcaggcggagggctttggactcagccttgatgagctcagcgatccaggcgagctgcaggcgctgttgaccgtgctggcggaggtggtcgatcagcccgttcccgtcctggatcccctggcgatggcagcggagacggtcgatctggagcaggctcttcccgcgcttcctctgcgccgcggccgctggctccaacagccggtgttccagcgctaccgcagcgaaaccgagctgctgcgctacatccagcggctggtgagccgggatctttcgctggtgcacagcatgatccccctggggagctgcaccatgaagctcaacgcggcggctgaactggtgccggtgagctggcgctcgttctccgccctccatccctttgcgccagcggagcagtgccggggcctgcagcacctggtgcacgatctggaaggttggctggcggctcttaccggttttgcggcggtgtcattgcagcccaatgccggttcccagggtgaatatgccggtctgctggtgatccgggcctggcaccgctcccgccaggacgcccatcgcgatgtctgtctgattcccaccagcgcccatggcaccaatcccgccagtgcggtgatggccggcctgcgcgttgtgccggtggcctgtgatgcgcagggcaatgtggatgtggaggatctgcgggccaaggcggagcagcacagtgcctccctggcggccctgatggtcacctatccctcaacccatggggtgtttgaaacccggatccgcgagatctgcgatctcgtgcatcagcacggtggtcaggtgtatctcgatggtgccaacctcaacgcccaggtgggtctttgccggcccggtgcctacggggctgatgtttgccatctgaatctgcacaaaaccttctgcattccccacggtggtggtggccccggggttggtccgatcggcgtggcggcgcacctccaaccgttcctgcccggccaccccctggtggcctgcggcggcgaccagggaatcacgcccgtgtctgctgcaccctggggaagtgcgggcatcctgccgatcagctggatgtatctgcgtttgatggggccgcgcggtctgcggcgggcgtcagctgtggcgctgttggccgccaattacctcgcccatcggctcggcgatcactacccggtgctgttccgcggtgacgcaggcctcgtcgcccatgagtgcatcctggatctgcgcgacctcaagcgttccgccggcctggatgtggatgacatcgccaagcgcttgatggattacggcttccatgcgcccacggtgagctggccggtggcgggaacggtgatggtggaacccacagagagtgaaagcttgccggaactggatcgcttctgcgacgccatgatcgcgatccgtgccgaggcggctgcgatcgaatccggcgatgtggatcgccagaacaaccccctcaagcgtgcgccccacaccctggctgcggtcacagctgaccactgggatcgtccttattcgcgccgtgaagcggcgtacccgatggctgatcaacgggaggccaagttctggccccatgtggcccggatcgacaatgctttcggtgatcgcaacctgatctgcacctgtccgtctgttgaggagctggcggcagcccaaccggcagggtaa

SEQ ID NO: 2883 - protein, 987 aa, Synechococcus sp. RS9917
MTLLEQRCVASAEAIEQHRLSPFVERHLGPDPEQQQCMLQALGFASLEDFVRAVVPADILDAEPPLEAMPEGVAEAQALAELRKIAAANRLHRSLIGLGYHDTATPALIQRHVLENPAWYTAYTPYQAEIAQGRLEALLNFQTLISELTGLPIANASLLDESTACAEAMSLSLAVCKRPQACRFLVDAAVLPQTLAVLETRATPLGVSLEVGEPDAFRWDEDVFGVLLQLPGRNGHLWDPSALIAAAHAHGALATVAIDPLAQVLLAPVGSLGADIAVGSAQRFGVPMAGGGPHAAFFATREIYKRQVPGRIVGQSVDAEGRPALRLALQTREQHIRRDKATSNICTAQVLLAVMASFYAIHHGPDGLAVIARRLVGQRIALERGLVALGYPLPQAPRFDGFDVVTPLAPAVHQRASECGFNLRVLPDGAPVEQAEGFGLSLDELSDPGELQALLTVLAEVVDQPVPVLDPLAMAAETVDLEQALPALPLRRGRWLQQPVFQRYRSETELLRYIQRLVSRDLSLVHSMIPLGSCTMKLNAAAELVPVSWRSFSALHPFAPAEQCRGLQHLVHDLEGWLAALTGFAAVSLQPNAGSQGEYAGLLVIRAWHRSRQDAHRDVCLIPTSAHGTNPASAVMAGLRVVPVACDAQGNVDVEDLRAKAEQHSASLAALMVTYPSTHGVFETRIREICDLVHQHGGQVYLDGANLNAQVGLCRPGAYGADVCHLNLHKTFCIPHGGGGPGVGPIGVAAHLQPFLPGHPLVACGGDQGITPVSAAPWGSAGILPISWMYLRLMGPRGLRRASAVALLAANYLAHRLGDHYPVLFRGDAGLVAHECILDLRDLKRSAGLDVDDIAKRLMDYGFHAPTVSWPVAGTVMVEPTESESLPELDRFCDAMIAIRAEAAAIESGDVDRQNNPLKRAPHTLAAVTADHWDRPYSRREAAYPMADQREAKFWPHVARIDNAFGDRNLICTCPSVEELAAAQPAG

SEQ ID NO: 2884 - DNA, 3027 bp, Synechococcus sp. WH 5701
  CDS (1)..(3027): transl_table=11
gtgagcgtcgagagcagcagcgacagcgccgtggccggcgccccccgggaattctccccttttctgcaacgccatctgggcccatccgccgctgagcaggcccggatgctggagcgcctgggttgcgctgatctggagggcttcgtggctgaagtcgttcccgctgacatcctgattccagccagcgccgccgagcaggatctgcccgagggcgtgggggaagccgaggccttggcggaactgcgccggatctcttccctcaaccaggtgcgtcgcagcctgatcggcctggggtactacggcaccgccaccccggccctgatccagcgccatgtgctggagaacccctcttggtacaccgcctacaccccctaccaggcggagatcgcccagggacggctggaagccctgctcaatttccagaccctgatcagcgagctcacggccctgccgatcgccaacgcctcgctgctggatgaggccaccgcggcggccgaggcgatgtcgctcagtgcaggcgcctgccgccggagcgaggcccgccgtttccttgtggatgagcaggtgtttccccagaccctggaggtgctgcgcacccgggccgagcccctggggatcctgatcgagaccttcgatccagccacggcttctgcagccagcagcagcgcggccaaggccgcttctggtgatcagttcttcggctccgatgtcttcggggtgctgctgcaactgcctggcagccgtggccgcctgctcgatcccagcgcggtgatcgcggcggcccaccaggttggcgccatggtcaccgtggcgatcgatcccctggcccaggtgttgttggcccctgtgggcgccctcggcgccgacatcgccatcggcagcagccagcgcttcggggtgcccctgggcttcggtggaccccacgccgccttcttcgccaccaccgaggcccacaagcgtcagatccctggccgcctggtgggtcgctcgctcgatgccgaaggccgcccggccctgcgcctggccctgcagacccgcgagcagcacatccgccgcgacaaggccaccagcaacatctgcaccgcccaggtgctgctggcggtgatggccggtttttatgccgtgcaccacgggcctgaggggctcagcgccattgcccggcaggttttgcgcctgcgcgctgccctggccctggggctcacccgcctcggcttccagctcgagcccggcccctctttcggcaccctcagcgtgctcacggccgaggccgccccgctgttggagcgggcggaggtggccggcttcaacctccggccgctcatggctccaggcgggccgctggagggggtggccctcagcctcgatgagcgcagcgatgccgccgagctcgaccagttgctggcgctgttcgccgcgggcgccgcttgcgccgatgtgccctcaaccgccgccctgctggccgagttggctgatgatcaggagctgctggcggggttgcccctgcgcgagggcccctggttgcggcaggaggccttccagcgctaccgcagcgaatctgagctgctgcgttacatccagcgcctggcttcccgcgatctctccctggtgcacgggatgatcccgctggggagctgcacgatgaagctcaacgccgccgccgagctggctccggtgagctggagtgagttcgccgacctgcatcccatggcgccgccctcccaggcccgggggtatgcccgtctgatcgctgatctggagagctggctggcggcgatcaccggtttcgccggtgtgtcgctgcagcccaatgccggctcccagggggaatacgccggcctgctggtgatccgcgcctggcaccgcagccgtggcgacggtcaccgcgacatctgcctgatccccaccagcgcccatggcaccaacccggccagcgcggtgatggcgggtctgcgggtggtgcccgtggcctgtgacgccaagggcaacatcgacctggaggatctggaggccaaggcccagacccacgccgcctccctggcgggggtgatggtcacctacccctccacccacggggtgttcgagcccggcatccgccgactctgcgacgtgatccatcgccatcgaggtcaggtgtatctcgacggggccaacctcaacgcccaggtgggcctggccaagccgggcctctacggcgccgatgtgtgccacctcaacctgcacaagaccttctgcatccctcacgggggcggcggtcccggggtggggcccatcggggtggccgctcatctggtgccgttcctgcccggtcaggtccagggcatcggcgcggtggcggctgctcgctggggcagcgccggcatcttgccgatcagctggatgtacatccgcatgatgggtggcgccggcctgcgcagggcgagcgccgtggccctgttagcggcgaatgtgatcgccgagcgcctggagccccattaccccgtgctcttccgcggaccgggcgggcgggtggcccatgagtgcatcctcgatctgcgtccgctcaagcgcagcgccggcctggaggtggatgatctggccaagcgcctgatggactatggcttccatgcccccaccgtgagctggcccgtggccggcaccgtgatggtggagcccacggagagcgaatcgctcgcggagatcgatcgcttctgcgaggccctgatcgcgatccgagccgaagctgcggcgatcgaggccggccaggtggaccccctcgacaacccgctcaagcgtgcgccccacaccctggcggccgtcaccgctgatgactggggccgtccctacagccggcagcaggctgctttccccgccggggagggccagtacgccaccaagttctggccggcggtggcccgcatcgacaacgcctacggcgacaggaatctggtctgcacttgcccatcggtggaggagctggcggcggtgtccctggggtcggtcccggaaggggtagccacggcaccagccctggctggccatgggcgttaa

SEQ ID NO: 2885 - protein, 1008 aa, Synechococcus sp. WH 5701
MSVESSSDSAVAGAPREFSPFLQRHLGPSAAEQARMLERLGCADLEGFVAEVVPADILIPASAAEQDLPEGVGEAEALAELRRISSLNQVRRSLIGLGYYGTATPALIQRHVLENPSWYTAYTPYQAEIAQGRLEALLNFQTLISELTALPIANASLLDEATAAAEAMSLSAGACRRSEARRFLVDEQVFPQTLEVLRTRAEPLGILIETFDPATASAASSSAAKAASGDQFFGSDVFGVLLQLPGSRGRLLDPSAVIAAAHQVGAMVTVAIDPLAQVLLAPVGALGADIAIGSSQRFGVPLGFGGPHAAFFATTEAHKRQIPGRLVGRSLDAEGRPALRLALQTREQHIRRDKATSNICTAQVLLAVMAGFYAVHHGPEGLSAIARQVLRLRAALALGLTRLGFQLEPGPSFGTLSVLTAEAAPLLERAEVAGFNLRPLMAPGGPLEGVALSLDERSDAAELDQLLALFAAGAACADVPSTAALLAELADDQELLAGLPLREGPWLRQEAFQRYRSESELLRYIQRLASRDLSLVHGMIPLGSCTMKLNAAAELAPVSWSEFADLHPMAPPSQARGYARLIADLESWLAAITGFAGVSLQPNAGSQGEYAGLLVIRAWHRSRGDGHRDICLIPTSAHGTNPASAVMAGLRVVPVACDAKGNIDLEDLEAKAQTHAASLAGVMVTYPSTHGVFEPGIRRLCDVIHRHRGQVYLDGANLNAQVGLAKPGLYGADVCHLNLHKTFCIPHGGGGPGVGPIGVAAHLVPFLPGQVQGIGAVAAARWGSAGILPISWMYIRMMGGAGLRRASAVALLAANVIAERLEPHYPVLFRGPGGRVAHECILDLRPLKRSAGLEVDDLAKRLMDYGFHAPTVSWPVAGTVMVEPTESESLAEIDRFCEALIAIRAEAAAIEAGQVDPLDNPLKRAPHTLAAVTADDWGRPYSRQQAAFPAGEGQYATKFWPAVARIDNAYGDRNLVCTCPSVEELAAVSLGSVPEGVATAPALAGHGR

SEQ ID NO: 2886 - DNA, 2937 bp, Synechococcus sp. WH 7805
  CDS (1)..(2937): transl_table=11
atgaccctgctcgatcagcggacggcggcctcgaagactgttcaaccaatttctcccttcgtccgtcgccacatcggacctgagccccaggctgtggaccagatgttgcaagcccttggatttgcagatctcgacgccttcatccaagcggttgttccaggtgacatcctcgatccagagccgccttgtgcggatctccccgagggagtcgatgaagctcctgccttggctgaattgcgaacgattgccagttgcaatcagctgagccgttccctgatcggccttggttatttcgagacggtcacaccggctctgattcagcgccaagttctagaaaatccatcctggtacaccgcttacaccccttaccaggcggagatcgcccaagggcgcctggaggcgctgctgaattttcagactctcatcagcgagctgacgggactgccgatcgccaatgcgtctctgctcgatgaggccacggccgccgctgaggccatgtcgatgagctttggcgtatgcaaacgcgagggggcaaaccgctttctggttgatgctgctgttttgccgcaaaccttggcggttctgcgcacccgctgcgagcccatcggagtgcagctggacgttgctgaaccggaggccttccgctggggggatgacgtttttggggtcttgctccaacttcccggacgttgcgggcggctttgggatcctcgtgcctgcatagaacgtgcccacacccatggtgcgctggtcaccgtttcggtggatccactcgcgcaggtgctcttagagcccgtgggcgcactcggtgcggacattgcagtgggtagtgcccagcgctttggggttccgatgggtgggggcggaccccacgcagcgttcttcgccacccgagatgcttaccgccgtcaggtgcctggccggctggtgggtcagtcccgcgatgccgaggggcgtcctgccctacggctggccttgcaaacccgtgagcagcacatccgccgggacaaagccactagcaacatctgcaccgctcaggttctgctcgccgtgatggcgtccttctacgccatccatcacggccccgagggtcttgagaccatcgccaaccggattgtgatgttgcgctctcgtctggagctggggttggctgcgctcggtttccctgtgccaggtggcgttcgcttcgacagtgtcgacgtgcattgcccccaggctccactcgtccatcgtctggctgctcgcgagggttacaacctgagagtgctgcccgacggtgtgccggcggacgaagcccatggttttggcatcagccttgatgagctcagtgatgaggccgagattcagagcttgctctccatctgcgcagaggttgttcagacggttccacctgtgtcttcgcagccatcgtctccagcggaggtgatggctggggtgcctttgcgtcagcgtccctggcttcagcagagcgtgttccatcgctatcgcagcgaaaccgaattgatgcgctacatccagcgcctcgtcagcaaggatctgtcgttagtgcacggcatgatcccgttggggagctgcacgatgaagctcaacgcggcggccgaactagcccctgtgagttggcgtgagttcgctgcggtccacccctttgctcccgtggcgcaacaggaggggttccaggcgttgatccgtgatctggagcgttggcttgccgctctgacgggcttcgccggagtttcactgcagcccaatgccggatcccagggggagtatgccggtctgttggtgatccgggcctggcatcgttcccgcggggaggcccagcgggatgtgtgcctcattcccaccagcgcccatggcaccaatcccgccagtgcggtgatggctggactgcgtgtggtggccgtggcctgtgatgaggaaggcaatgtggatgtgggggacctgcgatccaaagccagggagcacgctgatgtgctggctgcactgatggtgacctatccctcaacccatggtgtgttcgaaacccggattcgagagatctgctctctggttcatgagcatggcggccaggtgtatctcgatggcgccaacctcaatgcccaggtggggttgtgccgccccggtgccttcggcgccgatgtctgccatctgaatctgcacaaaactttctgcattccccacggtggaggtggccccggggtgggtccgatcggggttgctgctcatctccagccttttctgccgggccatccgctgatgccgtgcggaggcaatcagccgatttcatcagtgtcagcggcggcctggggcagtgctggaatcctgccgatcagctggatgtatctgcgcatgatgggtgctgaagggttgcgcaccgctacggcggtggctctgttgtcggctaactacctggcccatcgcttgcatgcgcactatcccgtgctgtttcggggtgaaggaggtctggtggcccatgaatgcattcttgacctgcgcggactcaaacgcagcgcagggctggaggtggatgatctcgccaagcgtctgatggattacggctttcatgcccccaccgtgagttggcctgtggccggcaccgtgatggtggagcccacagagagcgaaagcctggaagaactcgatcgtttctgtgacgccatgattgccatccgggaggaggtgtcccgcattgagagcggagagagcgatcgtgacaacaatcccctgaaacgctcaccccacaccctggcagccgtgacagacgaccactgggagaggccctactcgcgtcaagaggcagctttccccttgcctggccagcaacagaacaagttctggccggccgtagcccgcattgacaatgcttttggagatcgcaacctgatctgcacctgcccgagcgtggccgagctggctgaatcgctcccagtgcgataa

SEQ ID NO: 2887 - protein, 978 aa, Synechococcus sp. WH 7805
MTLLDQRTAASKTVQPISPFVRRHIGPEPQAVDQMLQALGFADLDAFIQAVVPGDILDPEPPCADLPEGVDEAPALAELRTIASCNQLSRSLIGLGYFETVTPALIQRQVLENPSWYTAYTPYQAEIAQGRLEALLNFQTLISELTGLPIANASLLDEATAAAEAMSMSFGVCKREGANRFLVDAAVLPQTLAVLRTRCEPIGVQLDVAEPEAFRWGDDVFGVLLQLPGRCGRLWDPRACIERAHTHGALVTVSVDPLAQVLLEPVGALGADIAVGSAQRFGVPMGGGGPHAAFFATRDAYRRQVPGRLVGQSRDAEGRPALRLALQTREQHIRRDKATSNICTAQVLLAVMASFYAIHHGPEGLETIANRIVMLRSRLELGLAALGFPVPGGVRFDSVDVHCPQAPLVHRLAAREGYNLRVLPDGVPADEAHGFGISLDELSDEAEIQSLLSICAEVVQTVPPVSSQPSSPAEVMAGVPLRQRPWLQQSVFHRYRSETELMRYIQRLVSKDLSLVHGMIPLGSCTMKLNAAAELAPVSWREFAAVHPFAPVAQQEGFQALIRDLERWLAALTGFAGVSLQPNAGSQGEYAGLLVIRAWHRSRGEAQRDVCLIPTSAHGTNPASAVMAGLRVVAVACDEEGNVDVGDLRSKAREHADVLAALMVTYPSTHGVFETRIREICSLVHEHGGQVYLDGANLNAQVGLCRPGAFGADVCHLNLHKTFCIPHGGGGPGVGPIGVAAHLQPFLPGHPLMPCGGNQPISSVSAAAWGSAGILPISWMYLRMMGAEGLRTATAVALLSANYLAHRLHAHYPVLFRGEGGLVAHECILDLRGLKRSAGLEVDDLAKRLMDYGFHAPTVSWPVAGTVMVEPTESESLEELDRFCDAMIAIREEVSRIESGESDRDNNPLKRSPHTLAAVTDDHWERPYSRQEAAFPLPGQQQNKFWPAVARIDNAFGDRNLICTCPSVAELAESLPVR

SEQ ID NO: 2888 - DNA, 2892 bp, Pseudoalteromonas tunicata D2
  CDS (1)..(2892): transl_table=11
atgtcacacgccaaatctcttgatcaactagagcaaaagcaagattttattcgccgtcatatcggcccggatgcagcgcaaactgcagccatgctagctgaattaaatgtatcaagtgtagaagagcttatcagccaaactgtacctgcagatattcgtttaaagcagggcttaacagtcggtgaaagccgtactgaagtagaagcattaagctacttaaaatcggtagtatcaaaaaataaactctacaaatcgtatatcggtcaaggctaccacccgacattagttcctaacgttattttacgtaacgtacttgaaaatccaggttggtacacagcgtacacgccataccaaccagaaatcgcccaaggtcgtttagaatcattattaaacttccaaacgctttcgattgatttaaccggtttagatttagcatcagcgtcattacttgatgaagcaacagccgctgccgaagcaatggcccttgcaaaacgtgttgctaaagcgaaaaaagccaatgctttcttcgtagccgatgacgtacacacacaaacaatcgacgtaattaaaacacgtgcaggccaatttggttttgacgttgttgttgcgcctgcggcagatgtggcaaatcacgacatttttggtgcgttattccaatacccatcaacaacgggtgaagttgttgatatcccagctttaattgcaacagtacaagataaaaaagccattgcctgtgttgcagcagacatcatgagcttaattttattaaaatcaccaggatcactgggtgcagacgtagtgctaggttcagcacaacgttttggtgtacctatgggttacggcggtccacacgcagcgttttttgcaacgcgtgatgaatacaaacgttcattaccaggtcgtatcatcggtatttcaaaagaccgtttaggtaacgacgcgctacgtatggcaatgcaaacccgcgagcaacacattcgccgcgaaaaagccaactcaaatatttgtacagcgcaagtattacttgccaacatggctgcgttttatgcggtttaccacggcccacaaggcttaaaagtcattgcgcagcgtattcaccgttttgcggatattttagccgctggtttacaagctaaaggcgtaagcttaaaacattcaacatggtttgatacgctaacagttgtggctgcaaataaagacgaagttgttgctcgtgcattagctgcagaaattaactttgcgactaaccacgcgggtgaatactcgatttcagtgaacgaagaaacaacacgtgctgatatcgcaacattatttgacgttattttaggcgcaggccatggcttagatgttgctgcacttgatgcgcaaatcacagcaaatggttcagattcaattccagcggcactggtacgtgacgatgccattttaacgcatccaaacttcaactcgtaccatagcgaaacagaaatgcttcgttatatcaaacgtctagaaaacaaagatttatcgcttaatcattcaatgatttcattaggttcttgtaccatgaaattgaatgcaacagcagagatgatcccagtaacgtggcctgaaattgctaaccttcacccattctgcccattagaccaagcagctggttaccaaatcatgatcaacgaattacatgattggttagtgaatattaccggttacgatgcggtgtcaatgcaaccaaactcaggtgcacaaggcgaatacgcaggcttaatcgccattcgtaaataccacgaatcacgcggcgacttccaccgtaatgtgtgtttaattccaagctctgcgcacggtacaaaccctgcaacagcgcaaatggcaagcatgaaagtagtggttgttaactgtgataaaaacggtaacgttgatatggctgacttaaaagcgaaagctgaagaagtgtcagaaaacctatcgtgcatcatggtaacttatccatcaacacacggcgtgtacgaagctaccatccgtgagttatgtgacgtcattcaccaacacggtggccaagtgtacatggatggcgcaaacatgaacgcgcaagtaggtgttacaagcccaggtttcatcggctcagacgtatcacacttaaacttacacaaaacattctgtatcccacacggcggcggcggcccaggtgttggcccaattggtgtgaaatcacacttagcgccatttatgcctaaccacagcgttatcaacgtgccaggtacaacagcaggtaacggtgcagtatctgcagcgccttatggttctgctgccatccttcctatttcatgggcatacatcaccatgatgggtagcgaaggcttaaaacaagcaaccgaaatggctattgtcaatgcaaactacttaactgaaaagttaagcaagcatttcccaattttataccgtggtcaaaatagccgtgttgcgcacgaatgtatcgttgatttacgcccattaaaagaagccacaggcatcacagaaatggacgtagcaaaacgcttaatggattacggtttccacgcaccaactatgtcgttcccagtagctggcacgttaatgattgagccaactgaatctgagtctaaagttgaaatcgaccgctttattgaagcaatggtttctattaaaggcgaaatcgataaagtagcaagcggcgagtggacagtggaaaacaacccattagtatttgcaccgcatactcaagcagacgtacttggcaacgagtgggaccgtgcatatgaccgtttctacgcagcgttcccagtaccagcggtagctaaaaacaaattctggccaacagtaacccgtattgatgacgtatacggcgaccgcaacctagtgtgtgcatgcccaccgattgacagctatacagaataa

SEQ ID NO: 2889 - protein, 963 aa, Pseudoalteromonas tunicata D2
MSHAKSLDQLEQKQDFIRRHIGPDAAQTAAMLAELNVSSVEELISQTVPADIRLKQGLTVGESRTEVEALSYLKSVVSKNKLYKSYIGQGYHPTLVPNVILRNVLENPGWYTAYTPYQPEIAQGRLESLLNFQTLSIDLTGLDLASASLLDEATAAAEAMALAKRVAKAKKANAFFVADDVHTQTIDVIKTRAGQFGFDVVVAPAADVANHDIFGALFQYPSTTGEVVDIPALIATVQDKKAIACVAADIMSLILLKSPGSLGADVVLGSAQRFGVPMGYGGPHAAFFATRDEYKRSLPGRIIGISKDRLGNDALRMAMQTREQHIRREKANSNICTAQVLLANMAAFYAVYHGPQGLKVIAQRIHRFADILAAGLQAKGVSLKHSTWFDTLTVVAANKDEVVARALAAEINFATNHAGEYSISVNEETTRADIATLFDVILGAGHGLDVAALDAQITANGSDSIPAALVRDDAILTHPNFNSYHSETEMLRYIKRLENKDLSLNHSMISLGSCTMKLNATAEMIPVTWPEIANLHPFCPLDQAAGYQIMINELHDWLVNITGYDAVSMQPNSGAQGEYAGLIAIRKYHESRGDFHRNVCLIPSSAHGTNPATAQMASMKVVVVNCDKNGNVDMADLKAKAEEVSENLSCIMVTYPSTHGVYEATIRELCDVIHQHGGQVYMDGANMNAQVGVTSPGFIGSDVSHLNLHKTFCIPHGGGGPGVGPIGVKSHLAPFMPNHSVINVPGTTAGNGAVSAAPYGSAAILPISWAYITMMGSEGLKQATEMAIVNANYLTEKLSKHFPILYRGQNSRVAHECIVDLRPLKEATGITEMDVAKRLMDYGFHAPTMSFPVAGTLMIEPTESESKVEIDRFIEAMVSIKGEIDKVASGEWTVENNPLVFAPHTQADVLGNEWDRAYDRFYAAFPVPAVAKNKFWPTVTRIDDVYGDRNLVCACPPIDSYTE

SEQ ID NO: 2890 - DNA, 2880 bp, Photobacterium sp. SKA34
  CDS (1)..(2880): transl_table=11
atgaccaatactacttttcttcaagctctcagtgacgataacgatttttcacatcgccataatggccctaatgcactcgaacaacagcgaatgttagaaactataggtgtcggtagtattgaccaacttatagcgcaaaccgttcctgcttccattcgtttaacagagccgatgacattaccacaggcacaaagtgaagcggcaatgctggcagaacttaaacaaatcgctggcaaaaacatcatcaataaaagttatattggtcagggttattacaacacgtttaccccaaatgttattctgcgtaatgtattagagaaccctggttggtataccgcttataccccttaccaaccagaaatctctcaaggacgtttagaatctctgcttaactatcaacaaatgatcatggatctaaccgccatggagctggctaatgcatcactactagatgaagccactgccgcagcggaagccatgacactatgtaagcgcgcaggtaaaaacaaaagcaatgcgtttttcatctcaactgatcttcaccctcaaaccattgatgttgttactacacgtgcaaaatacattggttttgaaatcattacaggcagtgtagaagatctcgcgaaacacgatgtattcggtgctttactgcaataccctgccagtaatggtgaattaaaagatctaaccgacatcattgacgcggcacatgataagaaaacattagtcgcggtggcgtctgatctactggcattaaccgtattaaaagcaccgggtgagatgggcgctgatgtggttattggtagtgcgcaacgctttggtgtaccgatgggctttggtggtccacatgctggctttatggcaaccaaagataaacacaaacgtactatgccgggtcgtgtcattggcgtatctaaagatgccaaaggcaatcaagcactacgcatggcaatgcaaacccgtgaacagcacatccgacgtgaaaaagcgacttcaaacatttgtacagcgcaagcactgcttgccaacatggcagcgttttatgccctgtaccatggtcctgaaggcttaaagaaaataggtcgtcgtgttcaccactttacagccgttttagctgctggtttacgcaataatggttttgaactagaaaaccaacacttcttcgacacgctaacaatcaaaacaggcactaaaactaacacgctatatcaaaaagcacttgatgccggtgttaaccttcgtaaatacagcgataagctaggtgtaagtattgatgaaaccacccttgctgaagatatcgagcagttacttggcttatttactaatcaagatcttaaagtatcgatgttcagtgatgacattgctgctgatgagtttgctgcgattccaccagcgtgtcgccgaagcagtgcatacctaacccactctgtgtttagccgctaccatagcgaaacacagatgatgcgttatatgaagcagctagaaaacaaggactactcattaactcacggtatgatcccactgggtagctgtaccatgaagctaaatgcagtagcagaaatgatccctgtcacttggcctgagtttggacaactgcacccatttgcaccacaagcacaaacattaggttaccaagaattagctaaaaacctatctgaaatgctgtgctcaatcacgggttatgatgcgttctcgctacaaccaaattctggtgcacaaggtgaatatgccggtctaatcgctattcagcgttaccatgaagccaatggcgatagccaccgtaatgtttgtttgatcccaagctctgcgcacggtactaacccagcgtctgcggcaatggtttcaatgaaagtagtggtagtgggctgtgatgagttaggtaatatcgatattaatgatctaaaagccaaaatcgaaaaacaccgtgatgcgctgtcatgtatcatgatcacctacccgtctacccatggcgtgtatgaagaagcagtacaagaagtgtgtgatcttgtccatgaagctggcggtcaggtttaccttgatggtgctaacatgaacgcgcaagtaggtttaactagcccaggctttattggctcggatgtttcccacttaaacctacacaaaaccttctgtattcctcacggtggtggcggcccaggtatgggacctattggtgttaaatcgcaccttacaccgttcttaccgggacatgttgaaggtacaaatagcgatgaacagcaatatgccgtgtctgcggcagcattaggttcagcgtctattttgcctatctcttacgcttacatagcgatgatgggagaacaaggtttaacccaagccactgaacttgccattttaaatgcaaattacgtaatggaacgccttcgtccacactaccctgttttataccgtggtactgaaggccgtattgcgcacgaatgtattattgatttacgtccaatcaaagatgcctctggcatttcagaagaagacatcgcaaaacgattaatggattatggcttccatgccccaaccatgtcgttccctgttgctggcacattaatgattgagccaactgaatctgaagacattgcagagcttgaccgcttctgtgacgcgatgattgcgattaaagaagaaatcaaccttgttcaatctggcgagtggccattagacgataatccactggttaacgcaccgcacagccaagttgatatgatggaatcagagtggaaccacgcttatagccgtgaagtcgcttgtttcccatcagcacacacgaaagcagcgaaatactggccgagtgttaaccgtgttgataacgtatttggcgaccgaaatcttgtatgttcttgcccaagtattgagaactatattgaagactaa

SEQ ID NO: 2891 - protein, 959 aa, Photobacterium sp. SKA34
MTNTTFLQALSDDNDFSHRHNGPNALEQQRMLETIGVGSIDQLIAQTVPASIRLTEPMTLPQAQSEAAMLAELKQIAGKNIINKSYIGQGYYNTFTPNVILRNVLENPGWYTAYTPYQPEISQGRLESLLNYQQMIMDLTAMELANASLLDEATAAAEAMTLCKRAGKNKSNAFFISTDLHPQTIDVVTTRAKYIGFEIITGSVEDLAKHDVFGALLQYPASNGELKDLTDIIDAAHDKKTLVAVASDLLALTVLKAPGEMGADVVIGSAQRFGVPMGFGGPHAGFMATKDKHKRTMPGRVIGVSKDAKGNQALRMAMQTREQHIRREKATSNICTAQALLANMAAFYALYHGPEGLKKIGRRVHHFTAVLAAGLRNNGFELENQHFFDTLTIKTGTKTNTLYQKALDAGVNLRKYSDKLGVSIDETTLAEDIEQLLGLFTNQDLKVSMFSDDIAADEFAAIPPACRRSSAYLTHSVFSRYHSETQMMRYMKQLENKDYSLTHGMIPLGSCTMKLNAVAEMIPVTWPEFGQLHPFAPQAQTLGYQELAKNLSEMLCSITGYDAFSLQPNSGAQGEYAGLIAIQRYHEANGDSHRNVCLIPSSAHGTNPASAAMVSMKVVVVGCDELGNIDINDLKAKIEKHRDALSCIMITYPSTHGVYEEAVQEVCDLVHEAGGQVYLDGANMNAQVGLTSPGFIGSDVSHLNLHKTFCIPHGGGGPGMGPIGVKSHLTPFLPGHVEGTNSDEQQYAVSAAALGSASILPISYAYIAMMGEQGLTQATELAILNANYVMERLRPHYPVLYRGTEGRIAHECIIDLRPIKDASGISEEDIAKRLMDYGFHAPTMSFPVAGTLMIEPTESEDIAELDRFCDAMIAIKEEINLVQSGEWPLDDNPLVNAPHSQVDMMESEWNHAYSREVACFPSAHTKAAKYWPSVNRVDNVFGDRNLVCSCPSIENYIED

SEQ ID NO: 2892 - DNA, 2901 bp, Oceanospirillum sp. MED92
  CDS (1)..(2901): transl_table=11
atgccgacacagaatcaggctcctttggcgactttggagcagacagacgcgtttatcgcacgccatattggcccttctgccgctgagcagcaggctatgctgaaagaactaggcgtagcggatcttgaccaactgattactcagactgtacctgaggacattctggtcaaaagcccaattaatcttccggatagccgaactgaagaggaggtactgacctaccttaaatcagtggccgctaagaacaagatcaatacatcgatgatcggcatgggctacaccgatacaatcgtgccaaacgtgattctgcgtaacgtgttggaaaacccaggctggtacaccgcttatacaccttatcagcctgaagtctctcaaggccgactggaagcgattcttaacttccagactatggtactggacctgacaggtctggatctggccaacgcttcccttcttgacgaatccactgctgcggcagaagcgatgacgctatgtaagcgtatgtcaaaagcgaagaaagccaataccttcctgatcgataaaaacgtacacccgcagaacatcagcgttattgaaactcgtgcagaaccgctgggttacgaagtgattgtgggtgatgtggctgagctgatcgatcagcacgaatgctttggtgtgctggttcagtacccaggcaccttcggtgatgtaaatgattacgcagagctgattgagaaagcgcacgataagaaagcactgttctgtgcggctgccgatatcatgagcctggtaacgctgaaatctcctggcgagatgggcgctgacgttgtattcggttctgcgcaacgctttggtgtgcctatgggctttggtggcccgcatgcggcgttctttgcaacacgtgatgcctacaagcgttctgtaccaggtcgtattatcggtgtttctgttgattcacgcggtaacaaagccctgcgtatggcgatgcaaacccgcgagcagcatatccgccgtgaaaaagcgacatcgaacatctgtactgcgcaggttctgctagccaacatggccggcttctacgcggtataccacggcccacaaggcctgaaaactattgccggtcgtattaaccgtttcgcttcgattctggcgaaaggcctgcagagcaaaggcgttgaactggttaaccagagttggtttgacacgattaccatcaaactggataacgcagaagcggtttatagcaaagcgctggaagcaggcatcaatctgcgtaatacgggcgataaccagttaggtatgacctgtgacgagtgtacttcacgcgaaacaatcaacaccctatgggattgcatcctgggcgaagatcacggcctgaatctggaacagatcgatgctgagatcgctgcatcaggtgagaactcctacgccgctaatctggcgcgtgaatcagagattctgactcacccagtcttcaacagctaccacagcgaaacagagatgctgcgttacctgaagaaactggaaaacaaggacatctccctggcgcacagcatgatcgcactgggctcctgcaccatgaagctaaatgcgacagctgagatgatccctgtcacctggcctgagttcggcaagcttcacccgttcgcgccaatggaccaggcacagggttacaaacagctaatcgatgagctggaagagcagctcaaagcgatcactggcttcgacgcagtctgcatgcagcctaactcgggtgcacaaggtgagtacgccggtctgcttgcgattcgcaaataccaccaggcaaatggtgacggtcacagaaatatctgcctgattccgacatccgctcacggtactaaccctgcatcggctgcactggcagacatgaaggtggttctgactgcctgcgatgaaaacggtaacgttgatgtggctgatctgcgagcaaaagcagaacagcataaagatgacctgtcctgcctcatgatcacctacccatcgacacacggtgtatatgaggaagatattcgtgagatctgccagatcgttcacgataacggtggtcaggtctatatggacggtgccaacctgaacgctcaggtagccgtaagccagcctgcagagatcggtgcagacgtttcgcacatgaacctgcacaagacattctgtattcctcacggtggcggcggtccgggcatgggccctatcggtatcaaagcgcacctggcacctttcgttgccaaccacccaatccagcagatcgatggtcctaacccagaaaacggtgccgtatctgcagcaccatggggcagtgcatcgatcctgccaatctcttgggtttacattgccctgatgggaggcacaggcctgcgcgctgcgactgagaatgcgattctgaacgcaaactacctgtctaagaaactgggcgaacactaccctgttctttacacaggtcgtaacgatcgtgtggcacatgaatgcatcatcgacatgcgtccactcaaagagtcttcaggcatcactgaggaagatgtggcgaagcgtctgatggatttcggtttccacgcgccaaccatgtccttcccggtggcaggcacgctgatgatcgagcctactgagtctgaatctaaagcagaactggatcgctttatcgaagcgatggcgcagatccgtgaagagattggccaggtagaagacggtgatatcgacgcggaaaacaacccgctacgtaacgcaccgcataccatggctgacctgatcggcggcgactgggatcgtccatacagttttgaacagggcgctttcccggtagcacgcctgcataccagcaaagtatggccaacggtgaaccgtatcgacaatgtatacggcgaccgtaacctgttctgctcatgcattccggttgaagattatgctgagtaa

SEQ ID NO: 2893 - protein, 966 aa, Oceanospirillum sp. MED92
MPTQNQAPLATLEQTDAFIARHIGPSAAEQQAMLKELGVADLDQLITQTVPEDILVKSPINLPDSRTEEEVLTYLKSVAAKNKINTSMIGMGYTDTIVPNVILRNVLENPGWYTAYTPYQPEVSQGRLEAILNFQTMVLDLTGLDLANASLLDESTAAAEAMTLCKRMSKAKKANTFLIDKNVHPQNISVIETRAEPLGYEVIVGDVAELIDQHECFGVLVQYPGTFGDVNDYAELIEKAHDKKALFCAAADIMSLVTLKSPGEMGADVVFGSAQRFGVPMGFGGPHAAFFATRDAYKRSVPGRIIGVSVDSRGNKALRMAMQTREQHIRREKATSNICTAQVLLANMAGFYAVYHGPQGLKTIAGRINRFASILAKGLQSKGVELVNQSWFDTITIKLDNAEAVYSKALEAGINLRNTGDNQLGMTCDECTSRETINTLWDCILGEDHGLNLEQIDAEIAASGENSYAANLARESEILTHPVFNSYHSETEMLRYLKKLENKDISLAHSMIALGSCTMKLNATAEMIPVTWPEFGKLHPFAPMDQAQGYKQLIDELEEQLKAITGFDAVCMQPNSGAQGEYAGLLAIRKYHQANGDGHRNICLIPTSAHGTNPASAALADMKVVLTACDENGNVDVADLRAKAEQHKDDLSCLMITYPSTHGVYEEDIREICQIVHDNGGQVYMDGANLNAQVAVSQPAEIGADVSHMNLHKTFCIPHGGGGPGMGPIGIKAHLAPFVANHPIQQIDGPNPENGAVSAAPWGSASILPISWVYIALMGGTGLRAATENAILNANYLSKKLGEHYPVLYTGRNDRVAHECIIDMRPLKESSGITEEDVAKRLMDFGFHAPTMSFPVAGTLMIEPTESESKAELDRFIEAMAQIREEIGQVEDGDIDAENNPLRNAPHTMADLIGGDWDRPYSFEQGAFPVARLHTSKVWPTVNRIDNVYGDRNLFCSCIPVEDYAE

SEQ ID NO: 2894 - DNA, 2904 bp, Oceanospirillum sp. MED92
  CDS (1)..(2904): transl_table=11
atggcagtagaaactcgtactctgagtgatcttcagcaagcgaatgaatttactcatcgccacattggccccgatgccgaacagactcaggaaatgttgtcttacctgggcgttgattctgtagaagatctgatgactcagactgttcctgattccatccgcctggatgatgcgctggatatgactgatagcgtaagcgaagccgatgctttggcttacctgaaacagctggcagcgaaaaataaagtcaataaatcctaccttgggatgggctatagcaataccctggtgccaaacgttattctgcgtaacgttatggaaaacccaggttggtatactgcttataccccatatcagccagaaattgctcagggtcgtctagaagcattgctgaatttccagcaaatggtgatggacctgacaggcatggagctggcgaacgcatccctgctggatgagtcaacagccgcggctgaagcgatgacattgtgcaagcgctcaaatcgtaagaagtctaataccttctttgtcgctgacgatgtgcatccgcagacaattgacgttatcaaaacccgtgctgaatacttcggttacgatatcgtagtgggtaacccgctaactgatcttgaagcggcggatccatttggtgtccagctgcagtacccaagcacatacggcgatatcactgatattaagtctgttattgatgctgcgcacggtcagaaagcaatggtatctgttgcggctgatattctggcgctggtacttctgaaatcaccgggtgaactaggtgctgatatcgtactgggttcttcacagcgctttggtgtgccaatgggctttggtggtcctcacgcggcattctttgctgcgtctgaaaaacttaagcgctctgttccgggtcgtatcatcggtgtatctatcgacgtaaacggcaaccaggcattgcgtatggcaatgcagacacgtgagcagcatatccgtcgtgagaaagcgacatcaaacatctgtactgctcaggcattgctggcaaacatggcttctttctatgttgtgtaccatggtccagaaggtctgaaacgtatcgctgagcgcgtgcaccgcctgacagctattctggctaacggccttaaagctaaaggtgttcaggttaacgatacttacttcgatacactgacagtaaccctgcctgaaactcaggaagtggtttaccagcgcgcgctggaagaaggttgtaacctgcgtaagatcggctctgacaagctgggtatcagcctggatgaaacaacgcttcctgcagacgttgcagtactactggacgttattttgggcgacgctcacggtcagacggttgaagcgctggatgcagcaatcgttgcaggtgaagcaacaggtatctccgctgatgcacgtcgtgaagatgcgatcctgactcacccgacatttaacagctatcacagcgaaacagatatgcttcgctacatgaagaagctggagaacaaagattactctctggttcacggcatgatcccactgggttcttgtacgatgaaactgaatgcgactgcggagatgatcccggtaacatggcctgagtttgctaacatccacccatttgcgcctgctgaccaggttgctggttaccaccagatgctaaatgagctggaagagcagttggttgaaatcactggttacgacaaagtatccctgcagcctaactcaggtgcatcaggtgaatatgcaggtctgctggcgattcgtaagtaccaggagtctatcggtgaaggtcaccgtaacgtctgcctgattccatcttctgcgcacggtactaacccggcatctgcagctatgatggacatgaagatcattgtaactaagtgcgatgacaacggtaacgtcgatgtggctgatctgcgcgctcaggctgagctgcacaaagatgatctgtcatgcttgatgatcacttacccgtctacacacggtgtttacgaagaagatatcgttgaaatctgtgacatcatccacaaaaacggtggtcaggtgtacatggatggcgcgaacatgaacgcgcaggtaggtatctctaaaccaggcctgatcggttctgacgtatctcacctaaacctgcataaaacattcgcgatcccacacggtggtggcggtccgggtatgggcccaattggtgttaagagtcacctggcaccgttcctggcgagtcacaaagtgagcccggttgaaggtttgaaccctgaaaacggcgcggttgccgccgctccttatggttcggcgtctattttgccaatcacttggatgtacaacgtaatgctgggtaaatctggccttaaagcatccactcagatggcaattctgaatgcgaactacatgactgagaaactggctgagcactacccggttctgtatcgcggtcgtaacaacaaagttgctcatgagtgcatcgttgatattcgtccacttaaggaagagagcggtgtaactgaggaagatattgctaagcgtctgatggactacggtttccacgcgccaaccatgtctttcccagtagcaggcacattgatgattgagccaactgagtctgaatctaaagttgaaatcgatcgtttcgtcgatgcaatggttcagatccgcgaggagatcgcaaaagttcagaatggtgagtggcctgcggacaacaacccgttgttcaacgcgcctcacactcaggcagatgtaatgaatggtgcttgggatcgtccatatactcgtgaagaggctgtcttccctaatgaagcgactcgtacgaataagttctggccgatgactaaccgtatcgacaacgtatacggcgaccgtaacttcatctgttcatgcccaggcattgaagcttatcaggatcaagaaggttaa

SEQ ID NO: 2895 - protein, 967 aa, Oceanospirillum sp. MED92
MAVETRTLSDLQQANEFTHRHIGPDAEQTQEMLSYLGVDSVEDLMTQTVPDSIRLDDALDMTDSVSEADALAYLKQLAAKNKVNKSYLGMGYSNTLVPNVILRNVMENPGWYTAYTPYQPEIAQGRLEALLNFQQMVMDLTGMELANASLLDESTAAAEAMTLCKRSNRKKSNTFFVADDVHPQTIDVIKTRAEYFGYDIVVGNPLTDLEAADPFGVQLQYPSTYGDITDIKSVIDAAHGQKAMVSVAADILALVLLKSPGELGADIVLGSSQRFGVPMGFGGPHAAFFAASEKLKRSVPGRIIGVSIDVNGNQALRMAMQTREQHIRREKATSNICTAQALLANMASFYVVYHGPEGLKRIAERVHRLTAILANGLKAKGVQVNDTYFDTLTVTLPETQEVVYQRALEEGCNLRKIGSDKLGISLDETTLPADVAVLLDVILGDAHGQTVEALDAAIVAGEATGISADARREDAILTHPTFNSYHSETDMLRYMKKLENKDYSLVHGMIPLGSCTMKLNATAEMIPVTWPEFANIHPFAPADQVAGYHQMLNELEEQLVEITGYDKVSLQPNSGASGEYAGLLAIRKYQESIGEGHRNVCLIPSSAHGTNPASAAMMDMKIIVTKCDDNGNVDVADLRAQAELHKDDLSCLMITYPSTHGVYEEDIVEICDIIHKNGGQVYMDGANMNAQVGISKPGLIGSDVSHLNLHKTFAIPHGGGGPGMGPIGVKSHLAPFLASHKVSPVEGLNPENGAVAAAPYGSASILPITWMYNVMLGKSGLKASTQMAILNANYMTEKLAEHYPVLYRGRNNKVAHECIVDIRPLKEESGVTEEDIAKRLMDYGFHAPTMSFPVAGTLMIEPTESESKVEIDRFVDAMVQIREEIAKVQNGEWPADNNPLFNAPHTQADVMNGAWDRPYTREEAVFPNEATRTNKFWPMTNRIDNVYGDRNFICSCPGIEAYQDQEG

SEQ ID NO: 2896 - DNA, 2838 bp, Flavobacteria bacterium BBFL7
  CDS (1)..(2838): transl_table=11
atgaatacagatcgttttgcccttagacatatcggacctcgcaaggcagaccttgcacccatgctagaaaaaataggtgtagaatctattgaccagctcgtttatgaaaccattcctgaaaatatacgccttcaacaggatttacagttagacactgcaatgagtgaatatgagtttttatctcatattaaaaagttaggcgataagaataagcaatttagatcttatatcggtttaggttacaatgctcctattacaccggcagtaatccaaagaaatattctggaaaacccaggatggtatacagcttacacgccataccaagccgaaattgctcaaggtcgactagaagctctattgaacttccagaccatgataacagatcttactggtatggagctggctaatgcatctttactagatgagtctacggcagcggcagaagctatgacattacttttctcagttagagaaagagctcagaaaaaagaaaatgttgtaaaattctttgtcgatcacgatactttaccacagactaaagaattattaaaaactcgcgctactccattaggtatagagcttgtagaaggtaatcctcaagatatggatatgagcgatggctactatgccattcttctacaatatcctggcgctagtggtaatgtggtagattataccgcatttgctcaaaaatgtcatgataataatatacgtattgcagtagcggcagatatattatcattagtacttttagaagcaccaggacactggaatgcagatgtggtagtaggaaccacacaacgtttcgggattccactaggttatggtggacctcatgctgcatattttgcaactcgcgaagagtacaagagacaaattccaggacgtataataggtgttactaaagatactgatggaaaacgtgcgctacgtatggcgttacagactcgtgaacagcatattaaaagagataaagccacttctaacatctgtactgcgcaagttttactggctgtaatggctggtatgtatggtgtatatcacggaccacgtggattaaagtttatcgcaaataaattacatgcacaaacagcaacacttgcagatgctgttgagaaattaggaatatatcaaactaatgagaatttctttgacacactttgctttaaagtgaatgccgaagctgtaaagaaagaagctttagcattagagatcaacttctattatccagatgcagatacagttcaggtttcattaaatgaaacgacttcattaacagacttaaatgatattgtttccgctttcgcgaaagcagtaaataaagacttctcacctataactgcgcttctagatagtacacacttaggaacaggtcgtcaaactgagttcatgacttatgatgtatttaattcttatcactcagagacggaattaatgcgttatatcaagaaactagaacgtaaagatctagcattaaatcactctatgattgcgctgggatcttgtacaatgaaattaaacgcggcggcagaaatgctacctctttcaaatccacaatggggaaatattcacccatttgtaccggtagatcaagctcaaggttatcaagaaatgttacagaaattagagcttcaattaaatgaggcaacaggttttgctggcacatctttacaacctaattctggtgcacaaggagaatttgcgggattaatggcgatacgagcatatcatcaaagtcgtggagatcatcatagaaacatctgcttaattccatctagtgctcatggtactaatcctgcaagtgcagtaatggcaggtatgaaagttatcgttactaaagcactagaaaacggaaacatcgatgtcgatgacttacgtgaaaaagcagaaaagcataaagataatttaagtgctttaatggttacttatccatcgactcatggtgtatatgaaagtgccattaaagaaataacaggcatcatccatgaaaatggtggacaggtttatatggatggcgcaaatatgaatgcacaagtaggattaactaatcctggaaacatcggtgcagacgtttgtcacttaaatcttcataaaacatttgccatacctcatggtggtggtggacctggtgtaggacctatatgtgtagcaccacaattagtaccattcttacctagcaatccaattattaaaacaggtggtgaccaggcaattacacctatcagtgctgcaccatacggtagcgcatctgtatgtttaatatcttatggttacatctgtatgttaggtgctgaaggtttaaaacgctctacagagtatgctattatcaatgcaaactacattaaggaacgtcttaaaggtagttatgaatgtctgtatacgggtgagaaaggtcgcgcagcgcatgaaatgattatagactgtcgtccatttaaacaacatggtattgaagtagtagacattgcaaagcgtttaatggattatggatttcatgcaccaaccgtttcatttccagtaaatggcaccatgatgatagaacctactgagtctgaatctaaagaagaaatggatcgcttttgtgatgccatgatttctataagaaaagaaatagcagattgctctagtgatgatcctaataatgttcttaaaaacagtcctcatacattagaaatgattactaatgatgagtgggaactaccatatactagaaaacaagcagcttatccattagaatatattgcagataataaattttggcctaccgtacgtcgtgcagatgatgcttatggagaccgtaatttaatgtgtacttgtgcaccgatggaagagtatatgtaa

SEQ ID NO: 2897 - protein, 945 aa, Flavobacteria bacterium BBFL7
MNTDRFALRHIGPRKADLAPMLEKIGVESIDQLVYETIPENIRLQQDLQLDTAMSEYEFLSHIKKLGDKNKQFRSYIGLGYNAPITPAVIQRNILENPGWYTAYTPYQAEIAQGRLEALLNFQTMITDLTGMELANASLLDESTAAAEAMTLLFSVRERAQKKENVVKFFVDHDTLPQTKELLKTRATPLGIELVEGNPQDMDMSDGYYAILLQYPGASGNVVDYTAFAQKCHDNNIRIAVAADILSLVLLEAPGHWNADVVVGTTQRFGIPLGYGGPHAAYFATREEYKRQIPGRIIGVTKDTDGKRALRMALQTREQHIKRDKATSNICTAQVLLAVMAGMYGVYHGPRGLKFIANKLHAQTATLADAVEKLGIYQTNENFFDTLCFKVNAEAVKKEALALEINFYYPDADTVQVSLNETTSLTDLNDIVSAFAKAVNKDFSPITALLDSTHLGTGRQTEFMTYDVFNSYHSETELMRYIKKLERKDLALNHSMIALGSCTMKLNAAAEMLPLSNPQWGNIHPFVPVDQAQGYQEMLQKLELQLNEATGFAGTSLQPNSGAQGEFAGLMAIRAYHQSRGDHHRNICLIPSSAHGTNPASAVMAGMKVIVTKALENGNIDVDDLREKAEKHKDNLSALMVTYPSTHGVYESAIKEITGIIHENGGQVYMDGANMNAQVGLTNPGNIGADVCHLNLHKTFAIPHGGGGPGVGPICVAPQLVPFLPSNPIIKTGGDQAITPISAAPYGSASVCLISYGYICMLGAEGLKRSTEYAIINANYIKERLKGSYECLYTGEKGRAAHEMIIDCRPFKQHGIEVVDIAKRLMDYGFHAPTVSFPVNGTMMIEPTESESKEEMDRFCDAMISIRKEIADCSSDDPNNVLKNSPHTLEMITNDEWELPYTRKQAAYPLEYIADNKFWPTVRRADDAYGDRNLMCTCAPMEEYM

SEQ ID NO: 2898 - DNA, 2889 bp, marine gamma proteobacterium HTCC2207
  CDS (1)..(2889): transl_table=11
atggagaacattaaaatgttacagaagacacgcagcttgactgatctggaaaatgccgcagagtttatcgctcgccatataggccccagcgccgacgatcagcagaaaatgcttagctctctgggctgcagcagcctgcaggaattgaccagtcaggttgttcccgaagccatcgctatgactcaggccttggatatagtcgatggttgcagcgaagcccaggcgctggccgaattgcgtgaaatcgccgcccataacaaagttttccggagctttattggccagggttattacaacaccattacccccaatgtagtgcagcgcaatattctcgaaaatcccgcttggtacaccgcatacacaccttaccagcctgagatatctcagggtcgtttagaagccttgatcaacttccaaaccatgatcaccgaccttaccggcatggagatgtccaatgcctccatgctcgacgaaggcacagccgccgcagaagccatgtctctctgtcagcgcatgtccaagtccaagtctctacgcttctttgtcgacagcgactgtctgcctcagacgatcgacgttataaaaacccgcgctgagccggtcggcattgaagtgattgtcggcaatccagatcagcttccagaagatctatttggcgcgctgtttcagtacccaggtgccagtggtgaagtccgcaacttccgcgacgtgattcaacaagtgcagcagcagggcgcgctggtggttatggctgctgatattctcagtctagtgctactggagtcccccggctccttaggtgcagatgtggttattggctcaacccagcgctttggagtacccctcgggtttggtgggccacatgccgcctatatgtcgactcgggaagcctacaagcgcaacctgccaggacgtctggttggcctatcccaagacgccaatggcgagccagcctaccgtttggcgctgcagacccgggagcagcatattcgccgtgaaaaggcgacttcgaatatctgtactgctcaggtactgcttgctgttattgccggtatgtatgcggtatatcatggtcccgaagggctgcagcgtatcgctcgacgagtaaacctgatgacctctgtattggcccagggattagcgctgcatggcatcaagccaatcaacaaccattggttcgataccttgaccctagacacaggtgcgcgaacagaagagatcctccaagtcgccgcagcccatgaagtgaatctacgtcgtatcgacgaaaacactctgggcgtgtctctggatgaaacagtaacccgcagtgatattaacttgctgtggacgatcctgattggtgaacaccaaatcgatattgacgatctggccgaccaagcggttgattcactgcctggcgagttaatgcgtaccgagagtttcctgactcacccaacctttaatcgctatcattctgaaactgaaatgctgcgctacctgcgcaaactgtcagacaaggatatagccctggatcgcgcaatgatccccctcggctcttgcaccatgaaactcaacgccactgccgagatgctgccgatcacctggcctgaattctcgaccatgcacccctttgcgccaactgatcaaactcagggctatcgcctgatgattgatcagcttgaagatatgctctgtgcctccaccggttacgatgccatgtcactgcagcccaatgcgggctcccagggcgagtacgctggactactggcaattcgtggctatcatgaaagccgcggcgacaccgatcgcgatatctgtctaatccccagctcagctcacggaactaaccccgcctcagcgcagatgtgtggcatgaaagtagtggtagtgaaatgtgatgatcagggtaacgttgatgtcgacgaccttattgccaaagccgaactccactccgccaagctctccgcgatcatggttacctatccctcgactcacggcgtatttgaagagcgtatcggagagatctgcgaaattgttcacgaccacggtggtcaagtttatatagatggcgccaacctcaacgccatggtcggtgtctgccaaccgggtaaattcggcggcgacgtctcgcatctcaacctgcacaaaacgttctgtatccctcatggtggcggtggccccggcgttggacccataggcgtaggcgcccacctagcaccctttatgccgcgagaaactgcagatggtgagcgtcagggcgcaaaggtatcagccgccccttacggcagcgccagcatcttgccgatcacctggatgtatatccgcatgatggggcgcagtggcttaaagcaagccactgaaatggccatactcaacgccaactacatcgccacccgcctgcaagacgactatgagatcctgtacaccggtgcacagggacgcatcgcccacgaatgtatactcgacgtgcgctcgattaaagacgacgttggcatcagcgtagacgatattgccaagcgtcttatcgacttcggcttccacgccccaaccatgtcattcccggttgccggcaccctgatgatcgagccaaccgaaagcgaatccaaagccgagatcgaccgcttctgcgacgccatgattgccatcaagcatgaaatcaatcaagtggcagcagggcagctagatttggctgacaatcccctggtccatgcccctcacaccgctgaagtcgttggtgctgatgagtggacacgcagctacagccgtagccaagccgcttacccactgcgctcactgcgtgagaacaaatactggccaccagtaggccgtctcgaccatgtatttggcgaccgcaatctgatctgctcctgcccatcgatctctgactacgaaaccgacgaagtttag

SEQ ID NO: 2899 - protein, 962 aa, marine gamma proteobacterium HTCC2207
MENIKMLQKTRSLTDLENAAEFIARHIGPSADDQQKMLSSLGCSSLQELTSQVVPEAIAMTQALDIVDGCSEAQALAELREIAAHNKVFRSFIGQGYYNTITPNVVQRNILENPAWYTAYTPYQPEISQGRLEALINFQTMITDLTGMEMSNASMLDEGTAAAEAMSLCQRMSKSKSLRFFVDSDCLPQTIDVIKTRAEPVGIEVIVGNPDQLPEDLFGALFQYPGASGEVRNFRDVIQQVQQQGALVVMAADILSLVLLESPGSLGADVVIGSTQRFGVPLGFGGPHAAYMSTREAYKRNLPGRLVGLSQDANGEPAYRLALQTREQHIRREKATSNICTAQVLLAVIAGMYAVYHGPEGLQRIARRVNLMTSVLAQGLALHGIKPINNHWFDTLTLDTGARTEEILQVAAAHEVNLRRIDENTLGVSLDETVTRSDINLLWTILIGEHQIDIDDLADQAVDSLPGELMRTESFLTHPTFNRYHSETEMLRYLRKLSDKDIALDRAMIPLGSCTMKLNATAEMLPITWPEFSTMHPFAPTDQTQGYRLMIDQLEDMLCASTGYDAMSLQPNAGSQGEYAGLLAIRGYHESRGDTDRDICLIPSSAHGTNPASAQMCGMKVVVVKCDDQGNVDVDDLIAKAELHSAKLSAIMVTYPSTHGVFEERIGEICEIVHDHGGQVYIDGANLNAMVGVCQPGKFGGDVSHLNLHKTFCIPHGGGGPGVGPIGVGAHLAPFMPRETADGERQGAKVSAAPYGSASILPITWMYIRMMGRSGLKQATEMAILNANYIATRLQDDYEILYTGAQGRIAHECILDVRSIKDDVGISVDDIAKRLIDFGFHAPTMSFPVAGTLMIEPTESESKAEIDRFCDAMIAIKHEINQVAAGQLDLADNPLVHAPHTAEVVGADEWTRSYSRSQAAYPLRSLRENKYWPPVGRLDHVFGDRNLICSCPSISDYETDEV

SEQ ID NO: 2900 - DNA, 2847 bp, Mycobacterium sp. JLS
  CDS (1)..(2847): transl_table=11
gtgctcgactctcatcagccccgtttcgccgaccggcacatcggtccggactccgatgccgtcgcggtcatgctcgacaccatcggcgtggcgaccctcgacgacctcgccgccaaggcgctgcccgcgaacattctcgacgccctgtcggccgacggtgtcgcgcccggcctcgaattgctgccggcccctgcgtccgagaccgaggcgctcgcggaactccgggcgctcgcggagtcgaacaccgtcgcggtgtcgatgatcgggcagggctacttcgacaccctgaccccgccggtgctgcgccgcaacatcctggagaacccggcctggtacaccgcctacacgccgtaccagcccgagatcagccagggtcggctcgaggcgctgctcaacttccagaccatggtgtccgatctgaccggcctcgaggtcgccaatgcgtcgatgctcgacgaggccaccgccgcggccgaggccatgacgctgatgcagcgcgccggccgcagcaagtcgaaccggttggcagtcgacgccgatctgtaccgccagaccgccgcggtgctcgccacccgggcccggcccctcgggatcgagatcgtcaccgccgacctccgccaggggctgcccgagggcgacttcttcggcgtcatcgtccaacttcccggtgcgagcggagcactcgtcgactgggcgccgctggtggccgacgcgcacgaccgtggtgccctcgtggccgtcggcgccgatctgctggcactgacgctggtcaccccgccgggtgagttcggcgccgacgtctccttcggcagcacgcagcgattcggtgtgccgatggggttcggcggcccgcatgccggttatctcgcggtgcacaccaaacacgcccggcagctgcccggccgcctcgtcggggtgtccgtggatgcggacggatcgccggcgtaccgattggcgctgcagacccgcgaacagcacatccgccgggacaaggcgaccagcaacatctgcaccgcccaggtgctgctggcggtcatcgcggcgatgtacgcgagctatcacggcgccgaaggtctgacctcgatcgcccgccgcgtgcacgggcacgcccgcgcggtcgccaccggactcgccgaggccggggtcgacgtggtgcacgacgcattcttcgacaccgtgctggtcaacgtgccgggccgggccgccgagatccgcgacgccgcgaagtcgcacggcatcaacatctggctggtcgacgccgatcacgtctcggtgtcctgcgacgaggcgaccactgccgaccatgtcgccgcggtgctctcggcgttcggcgccacccgcggcgggaaacccttcgccggacccgagatcgccacgcgcacatcggaattcctcacccatccggcgttcacccggtaccgcaccgaaaccgagatgatgcgctacctgcggtcgttggccgataaggacatcgcactggaccgcagcatgatcccgctcggttcctgcaccatgaagctcaacgcagccgcggagatggagccgatcacctggccggagttcgccaggcaacacccgttcgggcccgagagcgatgcgccgggcctgcgcaggctgatcgccgatctgcagacctggctgaccggtatcaccggttacgacgagatctcgctgcagcccaacgccggatcgcagggcgagtacgccggcctgctggcgatcaaggccttccacgacgccaacggcgcacccgaacgcgacgtgtgcctgatcccgtcgagcgcccacggcaccaacgcggcctcggcggcgttggccgggatgcgggtcgtcgtggtggggtgccggccgaacggtgacgtcgacctggacgacctgcgcgccaaggtcaccgagaacgccgagcgcctggccgcactgatgatcacctatccgtcgacgcacggtgtgtacgagcacgacgtcgccgagatctgcgcggccgtgcacgatgcgggcggtcaggtctacgtcgacggcgcgaacctcaatgcgttggtcggcctggcccggccgggccgattcggcggcgacgtcagccacctcaacctgcacaagacgttctgcatcccgcacggcggcggcggtccgggtgtcgggcccgtcgcggtgcgcgcccacctggcgccgtacctgccgggccacccgctcgccgacgaactcggcgacgactacaccgtctcggccgcgccctacggctcggcgtcgatcctgccgatcacgtggatgtacatccgcatgatgggagcgccgggtctgcgggcggcgtccctgacggcgatcgcctcggccaactacgtcgcccgccggctcgacgagtactacccggtgctctacacgggcgagaacgggatggtggcccacgagtgcatcctggacctgcggaccatcaccaaacagaccggcgtcaccgtcgacgacgtggcaaagcggttggcggacttcggcttccacgcaccgacgatgagcttcccggtggcggggacgctgatggtcgagccgaccgaaagcgaatcgctgagcgaggtcgacgcgttctgtgaggcgatgatcgcaatccgggccgagatcgaccaggtcgggtcgggcgcctggccggtggacgacaacccgttgcgcggtgcgccgcacaccgcggagtcactgctggtgaccgagtgggagcacccgtacacccgcgagcaggcggcctacccgctgggcaagggcttccggcccaaggtgtggccgccggtgcggcggatcgacggggcctacggcgatcgcaacctgatgtgctcgtgcccgccggtcgaggcgttcgcgtaa

SEQ ID NO: 2901 - protein, 948 aa, Mycobacterium sp. JLS
MLDSHQPRFADRHIGPDSDAVAVMLDTIGVATLDDLAAKALPANILDALSADGVAPGLELLPAPASETEALAELRALAESNTVAVSMIGQGYFDTLTPPVLRRNILENPAWYTAYTPYQPEISQGRLEALLNFQTMVSDLTGLEVANASMLDEATAAAEAMTLMQRAGRSKSNRLAVDADLYRQTAAVLATRARPLGIEIVTADLRQGLPEGDFFGVIVQLPGASGALVDWAPLVADAHDRGALVAVGADLLALTLVTPPGEFGADVSFGSTQRFGVPMGFGGPHAGYLAVHTKHARQLPGRLVGVSVDADGSPAYRLALQTREQHIRRDKATSNICTAQVLLAVIAAMYASYHGAEGLTSIARRVHGHARAVATGLAEAGVDVVHDAFFDTVLVNVPGRAAEIRDAAKSHGINIWLVDADHVSVSCDEATTADHVAAVLSAFGATRGGKPFAGPEIATRTSEFLTHPAFTRYRTETEMMRYLRSLADKDIALDRSMIPLGSCTMKLNAAAEMEPITWPEFARQHPFGPESDAPGLRRLIADLQTWLTGITGYDEISLQPNAGSQGEYAGLLAIKAFHDANGAPERDVCLIPSSAHGTNAASAALAGMRVVVVGCRPNGDVDLDDLRAKVTENAERLAALMITYPSTHGVYEHDVAEICAAVHDAGGQVYVDGANLNALVGLARPGRFGGDVSHLNLHKTFCIPHGGGGPGVGPVAVRAHLAPYLPGHPLADELGDDYTVSAAPYGSASILPITWMYIRMMGAPGLRAASLTAIASANYVARRLDEYYPVLYTGENGMVAHECILDLRTITKQTGVTVDDVAKRLADFGFHAPTMSFPVAGTLMVEPTESESLSEVDAFCEAMIAIRAEIDQVGSGAWPVDDNPLRGAPHTAESLLVTEWEHPYTREQAAYPLGKGFRPKVWPPVRRIDGAYGDRNLMCSCPPVEAFA

SEQ ID NO: 2902 - DNA, 2895 bp, Oceanobacter sp. RED65
  CDS (1)..(2895): transl_table=11
atgagtacacgtgcaactttgaccgagttagagaaccgtgatgaattcgtcaatcgccacatcagcaatgatcagagcgacctacaagacatgcttaacaccgtgggtgcagaatcgcttgatgatctaacccagcaaatcgtaccgccctctatcttacgtgagcctttcctagaaatgggtgaggcattacctgagcacgaagccttggccaatttgcgcgccatcgctaacaagaacaaggtatataaaagctacatcggcatgggctatcacgatacgcgattgcccaatgtgattctgcgtaacgttttggaaaacccaggttggtacaccgcttataccccttatcagccagaaatcgcccaaggccgtttggaagcgcttctaaactaccagcaaatggttatcgacctaacgggaatggagctagccaacgcttctctgctagacgaagccaccgcagccgccgaagccatggctctgattaagcgccaagtgcgtaaaaacaagagcaacgtattctttgtggatgagctttgcttgccgcaaaccatcgacgtattgaaaacccgtgcggacggctttggttgggagctacacattggcccagcggaaaccgccaccgacgtagaatgcttcggtgccctactgcaatacccggcggtagacggcaacattgatgactttgaagaactcattgcgcaaatgcatgagaaaaacgccatggtagccatggccacagacctaatggcgctcaccctattgaaaagcccaggtgaactgggtgctgacgtggcgctggggaatagccagcgctttggtgtacccatgggctttggtggtccacacgctgctttctttgcaacgaaagatgcctttaaacgtgcaataccaggtcgcttgattggtgtgtccattgatagtaacggcaaccgagccttacgtatggccctgcaaactcgcgaacaacacattcgccgtgagaaagccacatctaatatctgtaccgctcaggttctactttccaacttagcgtctttctacgcggtatatcacggtcgtgatggtatcaagcgcatcgccaatcgtattcaccgtatgacagagatcatggcagcggcgatcacggatgcggacattgaagatctagtgattgttaaccaaagcgcctttgatacattaaccattgaagtaccaaataaagctgaagttttggcccgtgccgacgaagcacaagtgaacctgcgtacacaaagccaagtggactttgataatgtggttggtttcagcattggtgaaaccaccagccgcgctgacttagaaacgctttattatgtgattacaggccgtcgtgatatcgacatcgaaatgctggaccaagaagtggaaagctcgattcctgaatcgctcaaacgtaccagcgatttcttgactcaccctgttttcaacagctatcaaactgaacacgaaatgctgcgctacatgaagcgtcttgaaagcaaagacttggccatgaaccacagcatgatcacactgggtagctgtaccatgaaactgaacgcgacggcggaaatgatccccgtgacatggccagagatcggaggtattcacccgtttgcaccaaaagaacaaaccccaggttacgaagaactcattcaaaacctcgatacgtggctacgtgacatcactggctttgatgcgatttgtatgcagcctaactcaggtgctcagggtgaatacgcgggcctaatggccatcaagcactatcacgagagccgtggtgaaggtcaccgcaacgtgtgtttgatcccagcatctgctcacggtaccaaccctgcttcagcacaaatggcaggcatgcgcgtggtcttgaccaagtgtgatgagcaaggcaacatcgactttgatgatttgaaagccaaagccgaagaactgagcgaaagcctatcttgcttgatgatgacctatccatcgacccacggtgtttacgaagacggtgcaaaagccatctgcgaattgatccatgaacacggtggtcaggtgtatatggatggcgctaacctgaacgcacaagtgggtatcaccagcccaggttacattggcgccgatgttagccacatgaaccttcacaaaacctttgcgattccacacggtggcggtggcccaggtatgggacccattggtgtcgccaaacacctagcgccatttgtagctaaccatagcttgcgtccaattgaagatgcctccaaaggacaaagcgcagtgagcgcagcaccttatggttcggcttctattttgccgatttcctacatgtacattcacatgatgggtgccaaaggattgcgtaaagcgacgcaaatggcgctactgaatggtaactacttggcgaaaaaactgggcgagcactacccaattctttacgcaggtcagaatggtcgtgttgcccacgaatgtattgtggatttgcgcccaattaaggcagagactggcattactgaagtggatatcgctaagcgcctaatggactatggtttccacgcgcccaccatgagcttcccagttgcgggtaccttcatgattgagccaacggaatccgaagccaaagcagaactggatcgcttcatcgaagccatggtttccatcaaagcagaaatcaatgccgtaaaagccggtgaattggacgagactaacaacccattgaccaatgcgcctcacacagtgaaagacattacgggcaactgggatcgtccttatgatcgagagcaaggtgccttccctgtagcagcggtttacgaaaataaattctggccttctgtgaaccgtattgatgatgtatacggcgatcgcaacctgatttgtagctgcccggctatcgaagaatatcaagattaa

SEQ ID NO: 2903 - protein, 964 aa, Oceanobacter sp. RED65
MSTRATLTELENRDEFVNRHISNDQSDLQDMLNTVGAESLDDLTQQIVPPSILREPFLEMGEALPEHEALANLRAIANKNKVYKSYIGMGYHDTRLPNVILRNVLENPGWYTAYTPYQPEIAQGRLEALLNYQQMVIDLTGMELANASLLDEATAAAEAMALIKRQVRKNKSNVFFVDELCLPQTIDVLKTRADGFGWELHIGPAETATDVECFGALLQYPAVDGNIDDFEELIAQMHEKNAMVAMATDLMALTLLKSPGELGADVALGNSQRFGVPMGFGGPHAAFFATKDAFKRAIPGRLIGVSIDSNGNRALRMALQTREQHIRREKATSNICTAQVLLSNLASFYAVYHGRDGIKRIANRIHRMTEIMAAAITDADIEDLVIVNQSAFDTLTIEVPNKAEVLARADEAQVNLRTQSQVDFDNVVGFSIGETTSRADLETLYYVITGRRDIDIEMLDQEVESSIPESLKRTSDFLTHPVFNSYQTEHEMLRYMKRLESKDLAMNHSMITLGSCTMKLNATAEMIPVTWPEIGGIHPFAPKEQTPGYEELIQNLDTWLRDITGFDAICMQPNSGAQGEYAGLMAIKHYHESRGEGHRNVCLIPASAHGTNPASAQMAGMRVVLTKCDEQGNIDFDDLKAKAEELSESLSCLMMTYPSTHGVYEDGAKAICELIHEHGGQVYMDGANLNAQVGITSPGYIGADVSHMNLHKTFAIPHGGGGPGMGPIGVAKHLAPFVANHSLRPIEDASKGQSAVSAAPYGSASILPISYMYIHMMGAKGLRKATQMALLNGNYLAKKLGEHYPILYAGQNGRVAHECIVDLRPIKAETGITEVDIAKRLMDYGFHAPTMSFPVAGTFMIEPTESEAKAELDRFIEAMVSIKAEINAVKAGELDETNNPLTNAPHTVKDITGNWDRPYDREQGAFPVAAVYENKFWPSVNRIDDVYGDRNLICSCPAIEEYQD

SEQ ID NO: 2904 - DNA, 2895 bp, Acidovorax sp. JS42
  CDS (1)..(2895): transl_table=11
atgcagatgccctcccccctgcccctggcggcgcttgaaaacgccgctgaattcctgccccgccacattggcatcgacgccgccgacgaagcacacatgctgtcggtgatcggcgaggcttcgcgccgcgcgctcattgattccatcgtgccgcgctccatcgcgcgccagcgccccatggacctgcccgcgccggccaccgaggccgcagcgctggctgaactccaggccattgcgtcgaagaaccgcattctcaagagcttcatcggccagggctactacggcacgcacacgccgggcgtcatcctgcgcaacgtgctggaaaaccctgcctggtacacggcctacacgccctaccaggccgagatctcccagggccgcatggaggcgctgctcaacttccagaccatggtgtgcgacctcacggccatgcccatcgccaacgcctccatgctagacgaggccaccgctgccgccgaggccatgacgctggctaagcgctcggtcaagtccaagagcgacgtcttcatcgtggcaggcgatgcgcacccgcagaccatcgaagtcatccagacccgcgccgcccccatcggcatcaccgtggtggtggccaattcccaggaggaatggcaggcggccctggccggcgacttcttcgccgccctcatccagtaccctgccagcagcggctgggtgcaggactggcaggccgacgtggacgccatccacgccaaacaggccgccgccatcttcgttaccgacctgctggcgctcacgctgctcaaggcccccggcgagtgggacgccgacatcgtggtgggctccacccagcgctttggcatgcccatgggcgccggcggaccgcacgccgccttcatggcctgccgcgacgaattcaagcgcagcctgcccggccgcctggtgggcgtgagcgtggacgtgcacggcaagcccgcctaccgcctggcgctgcaaacgcgcgagcagcacatccgccgcgagaaggccacgagcaacatctgcacggcccaggtgctgccggccgtgatcgccagcatgtacgccgtgtaccacggccccgagggcctcacgcgcatcgcccgccgcgtggcgcgcttcaccgccatcctgagccgcggcctggcgcagctggggttcaccagccgccaccatggctcggccttcgacacactcagcctgcacaccaaggatgctacggattcaatagctgctcgcgcagtccagatgggcgcaaacctgcgaaaagcctggaatgactacctgtgcatctcgctggacgagaccaccacccgcgccgatatcgagctgctgtggaagatctttgcgcgggacggccagcaactgcccaccatcgaggcgatggacgccgccggcgcaccggcgctgttccccgacaccctggcgcgcaccagccgcttcttggcgcacccggtgttcaacacccaccattccgaaaccggcatgctgcgctacatccgccagctgtccgacaaagacctggcgctggaccgcaccatgatcccgctgggctcgtgcaccatgaagctcaacgccacgagcgagatgatccccatcacctggcccgaatttgccaacgtgcacccgttcgccccggccgaccagctcgaaggctaccgcctgctcgacgagcaactgcgcgcctggctgtgccaggccacgggctacgcgggcgtcagcctgcagcccaacgcaggcagccagggcgaatacgccggcctgctggccatcaagggctaccacgaggcccgtggcgagagccaccgcaaggtctgcctgatccccagcagcgcgcacggcaccaaccccgccagcgcccagatggtgggcatgcaggtggtggtgaccaagtgcgacgaaaacggcaacgtggacatggccgacctgcaggcccaatgcgagaagcacagcgccaacctcgcctgcgtgatgatcacctaccccagcacgcatggcgtgttcgagacccaggtgaaggccttgtgcgagctggtgcatcgccacggcgggcgcgtgtatgtggacggcgccaacatgaacgccctggtcggcgtggccgcgccgggcgagttcggcggcgacgtgagccacctgaacctgcacaagaccttctgcatcccccacggcggcggcggccccggcgtgggcccggtgtgcgtggtggaggacctcgtgccctacctgcccggccacgccacgggcggcattgcttccaaaacaggagctgtcagcgcagctcccttgggcaatgcagccgttttacccatcagctggatgtacatccgcatgatgggcgccgacggtctgcaggccgcgaccgagacagcgatcttgagcgccaactacatcagcgcgcgcctgaaggaccactatcccacgctgtacgcttccgccaacggccatgtggcgcacgagtgcatcctggacctgcgccagttgaaggacaccagcggcgtgatggccgaggacgtggccaaacgcctgatcgactacggctttcacgcacccacgctgtcgttccctgtgcccaacacgctgatggtggagcccaccgagagcgagacgctgttcgagctggaccgcttcatcgacgcgatgatcgccatccggcgcgagatccgccagatcgaggccggcacctggccgcaggacgacaaccccctcaagaacgcgccccacacggccgagtgcctgctggtagccgactggcagcacccctacccgcgcgatgcggcagcctatcccgttgccgccctgcgccagaacaagtactggagccccgtgggccgtgtggacaacgtctacggcgaccgcaacctgttctgcagctgtgttccggtgagcgaactgggctga

SEQ ID NO: 2905 - protein, 964 aa, Acidovorax sp. JS42
MQMPSPLPLAALENAAEFLPRHIGIDAADEAHMLSVIGEASRRALIDSIVPRSIARQRPMDLPAPATEAAALAELQAIASKNRILKSFIGQGYYGTHTPGVILRNVLENPAWYTAYTPYQAEISQGRMEALLNFQTMVCDLTAMPIANASMLDEATAAAEAMTLAKRSVKSKSDVFIVAGDAHPQTIEVIQTRAAPIGITVVVANSQEEWQAALAGDFFAALIQYPASSGWVQDWQADVDAIHAKQAAAIFVTDLLALTLLKAPGEWDADIVVGSTQRFGMPMGAGGPHAAFMACRDEFKRSLPGRLVGVSVDVHGKPAYRLALQTREQHIRREKATSNICTAQVLPAVIASMYAVYHGPEGLTRIARRVARFTAILSRGLAQLGFTSRHHGSAFDTLSLHTKDATDSIAARAVQMGANLRKAWNDYLCISLDETTTRADIELLWKIFARDGQQLPTIEAMDAAGAPALFPDTLARTSRFLAHPVFNTHHSETGMLRYIRQLSDKDLALDRTMIPLGSCTMKLNATSEMIPITWPEFANVHPFAPADQLEGYRLLDEQLRAWLCQATGYAGVSLQPNAGSQGEYAGLLAIKGYHEARGESHRKVCLIPSSAHGTNPASAQMVGMQVVVTKCDENGNVDMADLQAQCEKHSANLACVMITYPSTHGVFETQVKALCELVHRHGGRVYVDGANMNALVGVAAPGEFGGDVSHLNLHKTFCIPHGGGGPGVGPVCVVEDLVPYLPGHATGGIASKTGAVSAAPLGNAAVLPISWMYIRMMGADGLQAATETAILSANYISARLKDHYPTLYASANGHVAHECILDLRQLKDTSGVMAEDVAKRLIDYGFHAPTLSFPVPNTLMVEPTESETLFELDRFIDAMIAIRREIRQIEAGTWPQDDNPLKNAPHTAECLLVADWQHPYPRDAAAYPVAALRQNKYWSPVGRVDNVYGDRNLFCSCVPVSELG

SEQ ID NO: 2906 - DNA, 2964 bp, Synechococcus sp. RS9916
  CDS (1)..(2964): transl_table=11
ttgacccagctcgaacagcgtccacagtccgctgagacggccatcaagttttcgccctttgtgcagcgccatgtcggcccgaatgcggccgatcagcaggtgatgctgcaggccctcggctttgccgatctcgacgcgttcgtacgagcggttgttcccgcagcgatcctggatgcggagccgccggtggcgtcgatgccgccgggttgtggtgaggccgaggccctggcagagctgcgtcagatcggttcccagaacaaggtccgccgctccttgatcggcttgggctatcacgacaccgcaactccggcgctgatcaagcgccatgtgctcgagaacccgtcctggtataccgcttacaccccatatcaagcagagattgcccagggccggttggaggccctgctcaatttccagactctgatcagcgagctcacgggcttgccgatcgccaatgcctctctgctggatgagtccaccgctgcggccgaagcgatgggcctcagctttgcggtctgcaagcgaccggatgccaagcgcttcctggtggacgctgctgtgttgcctcagacctgggcggtgttgcagacccgcgctgagcccctcggggtggtgctggagctggcggaaccggaagccttccgctgggatgcggatgtgtttggggtgttgctgcagttgcccgggcgctgcggacgtctctgggatcccaagccgctgatcgagcaggcccatgcccatggggcgctcgccactgtggcgatcgatccctttgcccaggtgctgatggcccctgtgggtgatctgggggcggacattgccgtgggtagtgcccagcgctttggtgtgcccatggccggtggtggcccccatgcggcctttttcgccacgcgcgacgccttcaaacgccaggtgcctggtcgcatcgtcggccagtcacgggatgccgaaggcaaccctgccttgcgcctggcactccagacccgggagcagcacatccgccgcgataaagccaccagcaacatctgcaccgcccaagtgctgctggcagtgatggcgtcgttttatgccgttcatcacggccccgatggccttgccgtgatcgcccggcgcatggtcgctttgcgtcaccagttggaaagcggcttgcgtcagctcggctacccggtggctgagcagtgtcgtttcgacggcctcgatgtgcattgccctcaggctcccgtggtgcatcgcctggcctcagagcagggctacaacctgcgggtgttgcctgatggcgcctctccggagcaggccgagggattcggcatcagcctggatgaatgcagcgatagcgaggagctggagagcttgctggggcttctggctgcggccttgggcgtcactccgccgcccccgctggagaggggtgccgatgatgaaactctctccggagctgcattggcggcagctttgccgggtgttcccctgcgccagaccccctggctgcagcagccggtgttccatcagcaccgcagtgaaacggagctgctgcgctacatccagcgcctggtgagccgcgatctctccttggtgcacagcatgatcccgctgggcagctgcacgatgaagctcaatgcggcggcggaactggcaccagtgagctggcatggctttgccgctctgcatccgttcgctccagcggagcagctggcgggtttcgagcggatggtgactgacctggaacgctggttggcggcgctcaccggattcgcgggtgtgtcgttgcagcccaatgccggctctcagggtgaatacgccggactgctggtgattcgtgcctggcatcagtcccgcggggaagcccaccgggatgtgtgtctgatccccaccagtgcccatggcaccaatcccgccagtgcggtgatggcaggcctgcgggtggtggcggtggcctgcgacgagcagggcaacgttgacctggcggatctacgtgccaaggccgagcaacatgccgaccgtctggctgccctgatggtcacctacccctcgacccatggggtgtttgagccggggattcgggacatctgcgactgcgtgcatgcccacggcggtcaggtctatctcgatggcgccaacctcaatgcccaggtggggctttgccgccctggggcgtttggggcggatgtctgccatctcaacctgcacaagacgttctgtattccccatggtggtggcgggcctggggttggtccgatcggtgtggcgacccatctgctgcccttccttcccggtcaccccctcgcgacctgtggcggtgaccaggcgatcagtgcggtgtcagccgcgccttggggcagtgccggcattttgccgatcagctggatgtatctgcggctgatgggcccccatggcctgcgccaggccacggctgtggccttgttgtcggccaactatctcgcccgtcgccttgatgcccatttcccagtgctgtttcgaggtgaaggagggctggtggcccatgaatgcattcttgatttgcgtgggctgaagcgcaccgccgctctggaagtggacgacattgccaagcggttaatggattacggcttccatgcccccaccgtcagctggcctgtggccggcacggtgatggttgagcccaccgaaagtgaaagcctggcggaattggatcgtttttgtgacgccatgattgccattcgggcggaagcggcggcgattgaatcaggcgccatcgattcgctgaacaatcccctgaaacgggctcctcacacgcttgctgcggtcaccgctgatcactgggatcgcccttacagccgtgagcaagcggctttccccctggccggtcaacgggagtcaaaattctggccccatgtggcccggattgataacgcctttggcgatcgcaatctggtctgcacctgtccttctgtggaagagctggcggagttgccgtccgccggttaa

SEQ ID NO: 2907 - protein, 987 aa, Synechococcus sp. RS9916
MTQLEQRPQSAETAIKFSPFVQRHVGPNAADQQVMLQALGFADLDAFVRAVVPAAILDAEPPVASMPPGCGEAEALAELRQIGSQNKVRRSLIGLGYHDTATPALIKRHVLENPSWYTAYTPYQAEIAQGRLEALLNFQTLISELTGLPIANASLLDESTAAAEAMGLSFAVCKRPDAKRFLVDAAVLPQTWAVLQTRAEPLGVVLELAEPEAFRWDADVFGVLLQLPGRCGRLWDPKPLIEQAHAHGALATVAIDPFAQVLMAPVGDLGADIAVGSAQRFGVPMAGGGPHAAFFATRDAFKRQVPGRIVGQSRDAEGNPALRLALQTREQHIRRDKATSNICTAQVLLAVMASFYAVHHGPDGLAVIARRMVALRHQLESGLRQLGYPVAEQCRFDGLDVHCPQAPVVHRLASEQGYNLRVLPDGASPEQAEGFGISLDECSDSEELESLLGLLAAALGVTPPPPLERGADDETLSGAALAAALPGVPLRQTPWLQQPVFHQHRSETELLRYIQRLVSRDLSLVHSMIPLGSCTMKLNAAAELAPVSWHGFAALHPFAPAEQLAGFERMVTDLERWLAALTGFAGVSLQPNAGSQGEYAGLLVIRAWHQSRGEAHRDVCLIPTSAHGTNPASAVMAGLRVVAVACDEQGNVDLADLRAKAEQHADRLAALMVTYPSTHGVFEPGIRDICDCVHAHGGQVYLDGANLNAQVGLCRPGAFGADVCHLNLHKTFCIPHGGGGPGVGPIGVATHLLPFLPGHPLATCGGDQAISAVSAAPWGSAGILPISWMYLRLMGPHGLRQATAVALLSANYLARRLDAHFPVLFRGEGGLVAHECILDLRGLKRTAALEVDDIAKRLMDYGFHAPTVSWPVAGTVMVEPTESESLAELDRFCDAMIAIRAEAAAIESGAIDSLNNPLKRAPHTLAAVTADHWDRPYSREQAAFPLAGQRESKFWPHVARIDNAFGDRNLVCTCPSVEELAELPSAG

SEQ ID NO: 2908 - DNA, 2865 bp, Vibrio sp. Ex25
  CDS (1)..(2865): transl_table=11
atgactgaattacttcaaagcctcagcacacaaaatgagttcgttggacgccacaacggaccaagcaaatcagaccaacaaaaaatgttggatgccatcaacgcggtaagccttgacgccctcatcgaagaaaccgtgcctgcacaaattcgcctagaacaaccaatgacgttggcagaagcgaaaagcgaagcagacatgctagtgacgatgaagcagtttgctaaacaaaaccaaattaaacgtacattcattggccagggctactacaacacgtttactccaaacgtcattctacgtaacgtgctagaaaaccctggctggtataccgcttacacaccttaccaacctgaaatctctcaaggtcgcttggaagcacttttgaacttccaacaaatgatcatcgacctaactggtatggaaatcgcgaacgcctcattgctagacgaagcaacagcggcagcagaagcaatgactctgtgtaagcgcgcaggtaagagcaagagcaacgtattctttgtggctgacgatgttcacccacaaacgctagaagtagtaaaaactcgtgcaaaattcatcggttttgaagttctggttggttcgctagaatccctaccagagcaagacgtgttcggtgcattagttcaatacccaagcacaacaggtgaagttcgtgacctaacggacatcatcgcaaaagcgcaagcaaacaaaacgcttgtcactgttgcgactgacctgcttgcttctaccctattgaaacctgctggtgaaatgggcgcagacgtagcaattggctctgcacaacgtttcggcgttcctatgggttacggcggtccacacgcggcattcatggcaacgcgtgacaaacacaagcgtaccatgccaggtcgtgttataggtgtttctatcgataccaacggtaaccaagcactgcgcatggcaatgcaaactcgtgagcagcatatccgccgcgaaaaagcgacatcgaacatctgtaccgctcaagcattgctagcgaacatggcgtctttctacgcggtttaccacggcgcagaaggtctacgcactattgctcgccgtacacaccatatgactgcgattatcgccgctggcctaaccaaaggcggctttgaacttgctcataacagcttcttcgataccatcacgatcaacacaggttcaaaaacagaagagctttacgcaaaagcactttcagcagacatcaacctacgtctactacctggcaagctaggtattagctgtgacgaaacaaccacggtcgctgatgtagaagcactatttgcagtctttggtgtaaaagaagacgtagcagcactatcgacggaaatcggaggcaacgagtttgcggcaattccagaagcgctacgccgcacaacagaatacctgactcaccctgtattcaatacgcaccatagcgaaacgcaaatgatgcgttacctgaaacagctagagaacaaagacttctcgctaacgcacggcatgatcccactaggcagctgtacgatgaagctgaacgcagcagcagagatgatcccaatcacttggcctgagtttggttctatccacccattcgcgccagcagaacaagcggcgggctatgcagcactagcgaaagatctaaaagagaagctttgtgagatcacaggctacgacgcattctcacttcagccaaactctggtgcatctggtgagtatgcaggtcttatcgcgattcaacgctaccacgaaagccgtggcgaaggtcaccgcaatgtatgtttgatcccgagctctgcgcacggtactaaccctgcgacagcatctatggtgtcaatgaaagttgtcgtggttaagtgtgatgaagaaggcaacatcgacatcgacgacctagcagcgaaaatcgagaaacacaaagacaatctatcaagcattatgatcacttacccttctacgcacggcgtttacgaagagaaagtgaaagaagtgtgtgaaatggttcatgccgctggcggtcaggtttacctagacggcgctaacatgaacgcgcaggttggtctaacatcaccaggcttcatcggttcagacgtttctcacctaaacctacacaaaaccttctgcatcccgcacggtggtggcggtccgggtatgggtcctatcggtgtgaaatctcacctagcgcctttcctaccaggccatattgaagacggcgtagaaggcgaagattttgcagtatcagcagcagatatgggtagcgcttctatcctaccgatctcttgggcttacatcgcaatgatgggcgaagcaggcctaacagatgcaacaaaagtagcaattctgaacgcaaactacgtgatggaaacacttcgccaacactaccctgttctttatcgtggcaaaaatggtcgtgtagcgcacgaatgtattatcgacattcgtccactgaaagaagaaacaggcatcagcgaagaagacattgcgaagcgtctaatggactacggtttccacgcaccaactatgtcgttccctgtagcgggcacgctaatggttgagccaacggaatcggaagatctagaagagctagaccgcttctgtgatgcgatgatcgctatccgcgaagaaatggaaaaagtgaaaaacggtgaatggccactagagaacaaccctctcgttaatgcgccacacacgcaagttgacctttctgctgaagagtgggaccgtccttactctcgcgagcttggctgcttcccttctaaagcgaccaagtcttggaagtactggccaacagtaaaccgcgtagataacgtatacggcgaccgtaacctaatctgttcatgcccaagcatcgataactacgaagattaa

SEQ ID NO: 2909 - protein, 954 aa, Vibrio sp. Ex25
MTELLQSLSTQNEFVGRHNGPSKSDQQKMLDAINAVSLDALIEETVPAQIRLEQPMTLAEAKSEADMLVTMKQFAKQNQIKRTFIGQGYYNTFTPNVILRNVLENPGWYTAYTPYQPEISQGRLEALLNFQQMIIDLTGMEIANASLLDEATAAAEAMTLCKRAGKSKSNVFFVADDVHPQTLEVVKTRAKFIGFEVLVGSLESLPEQDVFGALVQYPSTTGEVRDLTDIIAKAQANKTLVTVATDLLASTLLKPAGEMGADVAIGSAQRFGVPMGYGGPHAAFMATRDKHKRTMPGRVIGVSIDTNGNQALRMAMQTREQHIRREKATSNICTAQALLANMASFYAVYHGAEGLRTIARRTHHMTAIIAAGLTKGGFELAHNSFFDTITINTGSKTEELYAKALSADINLRLLPGKLGISCDETTTVADVEALFAVFGVKEDVAALSTEIGGNEFAAIPEALRRTTEYLTHPVFNTHHSETQMMRYLKQLENKDFSLTHGMIPLGSCTMKLNAAAEMIPITWPEFGSIHPFAPAEQAAGYAALAKDLKEKLCEITGYDAFSLQPNSGASGEYAGLIAIQRYHESRGEGHRNVCLIPSSAHGTNPATASMVSMKVVVVKCDEEGNIDIDDLAAKIEKHKDNLSSIMITYPSTHGVYEEKVKEVCEMVHAAGGQVYLDGANMNAQVGLTSPGFIGSDVSHLNLHKTFCIPHGGGGPGMGPIGVKSHLAPFLPGHIEDGVEGEDFAVSAADMGSASILPISWAYIAMMGEAGLTDATKVAILNANYVMETLRQHYPVLYRGKNGRVAHECIIDIRPLKEETGISEEDIAKRLMDYGFHAPTMSFPVAGTLMVEPTESEDLEELDRFCDAMIAIREEMEKVKNGEWPLENNPLVNAPHTQVDLSAEEWDRPYSRELGCFPSKATKSWKYWPTVNRVDNVYGDRNLICSCPSIDNYED

SEQ ID NO: 2910 - DNA, 2892 bp, Alteromonadales bacterium TW-7
  CDS (1)..(2892): transl_table=11
atgtcaaacgccaaatctcttgaacagttagagcaaaagcaagattttattcgccgccatattgggccaagcccagcgcaagtaagcgatatgctaagcgctcttgaagtatcgagtgtacaagagctgatcgatcaaacggtaccggctaacattcgcctagagcaaccgctaagcattggcgaaagccgtactgaagttgaaacactaagctacttaaaatcagtagcaagcaaaaataaagttttcaaatcgtacattggccaaggctaccacccaacacatgtaccgcacgtaattttacgtaacgtacttgaaaacccgggttggtatacagcgtacacgccatatcagccagagattgcacaagggcgtttagaatcattactaaacttccagactatgaccctagatttaaccggccttgatttagcaagcgcgtcgttacttgacgaatcaactgctgcagccgaggcaatgggccttgcaaaacgtgtatctaaagctaaaaaagccaatgccttttttattgccgacgacgtacacacacaaactatcgacgtagtaagcacccgtgctgagcagtttggttttgaaataattgtaggtaaagcggccgacgccgttaaccacgacatttttggtgcattattccaatacccatctacatcgggtgaaatagttgacgtaaccgacctaattgctggcgttcaaagcaaaaaagccattgcctgtgttgctgccgacattatgagtttattactattaaaagcaccgggtaaactaggcgcagacgtagtattaggttcggctcagcgttttggtgtaccaatggggtacggcggtccacatgctgcattttttgcaacacgtgacgcatacaaacgttcattaccagggcgtattattggtgtatctaaagaccgtttaggtaatgacgcactgcgtatggcaatgcaaacgcgcgaacaacacatccgccgcgacaaagctaattcaaacatttgtacagcgcaggtattgcttgccaacatggcggcgttttatgcggtgtaccacggcccacaaggcttaaaaactattgcgcagcgtatacaccgctttgctgatattttagctgctggcctaaaaaccaaaggcgtagcccttaagcacagcacgtggtttgatacgttaacaattgttggcgacaacaaagacgacgtaatagcacgtgcttttgccaaaggcgttaactttgctacaaaccacgacggcgaatactcaatttcggtttcagaaaccacaacccgtgcagacgttgccgagctatttgatattgtactaggtgaaggccacggcctaagcgtagacagtattgcagccgatattgaagcaaacggtagcgactctattccagcgagtttagtacgtgatgacgaagtattaacgcatccaaactttaacagctaccacagcgaaacagacatgcttcgctacattaagcgccttgaaaacaaagatttagcgcttaaccactcaatgatctcgttaggttcatgcaccatgaaactaaacgcgaccgctgagatgattccagttacatggcctgagtttgcaaaccttcacccattctgcccgctagaccaagcagagggttaccaaataatgattaacgagctacacgactggctagttaacattacgggttacgatgcggtttcacttcagccaaactcgggtgcacaaggtgaatacgcaggcttaattgccattcgtaaataccacgagtcacgcggggatgcacaccgtaatgtatgtttaattccaagctcagcgcatggtactaacccagcgtcggcacaaatggccagcatgaaaattgtggtggttaactgtgataaaaacggcaacatcgacatggaagacttaaaagcgaaagctgaagacgtgtctgaaaacctgtcgtgtgccatgatcacatacccatctacccatggtgtttacgaagaaaccattcgtgaactatgtgacattattcatgagcacggcggccaagtttacatggacggcgcaaacatgaacgcgcaagtgggtgtaacaagcccaggctttattggctcagacgtatcgcacttaaacttgcacaaaacgttttgtattccacacggtggcggcggcccaggtgtaggcccaattggtgttaaatcgcaccttgcgccatttatgccaaaccacagcgtaattaacgtgccaggtacaaacattgacaacggtgccgtatcggcagcgccttacggctcagccgctattttacctatttcatgggcgtacattgccatgatggggtcagagggcttaaaacaagctactgaaatggcgattgtgaacgctaactacctaacgcacgagttaagccagcacttcccaattttataccgtggccgtaacaatcgcgttgctcacgaatgtattgttgatttacgcccattaaaagaagcgtcaggcattactgaaatggacgttgctaagcgcctacaagattacggcttccattcacccactatgtcgttcccagttgcgggcacattaatgattgagccgactgagtctgagtcaaaaggcgagatagaccgctttatcgaagcaatggtgtcaatcaaaggcgaaattgataaagtaatctctggcgaatggtcaatcgaaaacaacccacttgtgtttgcaccgcatacacaagctgacgtacttggtaacgaatgggaccgcgcgtacgaccgtttttacgctgcgttcccagtgccttcggtagctaaagacaagttctggccaacggttacacgtatagatgacgtatacggcgaccgtaacttagtatgttcatgcccagcggtagagacatatcgcgactaa

SEQ ID NO: 2911 - protein, 963 aa, Alteromonadales bacterium TW-7
MSNAKSLEQLEQKQDFIRRHIGPSPAQVSDMLSALEVSSVQELIDQTVPANIRLEQPLSIGESRTEVETLSYLKSVASKNKVFKSYIGQGYHPTHVPHVILRNVLENPGWYTAYTPYQPEIAQGRLESLLNFQTMTLDLTGLDLASASLLDESTAAAEAMGLAKRVSKAKKANAFFIADDVHTQTIDVVSTRAEQFGFEIIVGKAADAVNHDIFGALFQYPSTSGEIVDVTDLIAGVQSKKAIACVAADIMSLLLLKAPGKLGADVVLGSAQRFGVPMGYGGPHAAFFATRDAYKRSLPGRIIGVSKDRLGNDALRMAMQTREQHIRRDKANSNICTAQVLLANMAAFYAVYHGPQGLKTIAQRIHRFADILAAGLKTKGVALKHSTWFDTLTIVGDNKDDVIARAFAKGVNFATNHDGEYSISVSETTTRADVAELFDIVLGEGHGLSVDSIAADIEANGSDSIPASLVRDDEVLTHPNFNSYHSETDMLRYIKRLENKDLALNHSMISLGSCTMKLNATAEMIPVTWPEFANLHPFCPLDQAEGYQIMINELHDWLVNITGYDAVSLQPNSGAQGEYAGLIAIRKYHESRGDAHRNVCLIPSSAHGTNPASAQMASMKIVVVNCDKNGNIDMEDLKAKAEDVSENLSCAMITYPSTHGVYEETIRELCDIIHEHGGQVYMDGANMNAQVGVTSPGFIGSDVSHLNLHKTFCIPHGGGGPGVGPIGVKSHLAPFMPNHSVINVPGTNIDNGAVSAAPYGSAAILPISWAYIAMMGSEGLKQATEMAIVNANYLTHELSQHFPILYRGRNNRVAHECIVDLRPLKEASGITEMDVAKRLQDYGFHSPTMSFPVAGTLMIEPTESESKGEIDRFIEAMVSIKGEIDKVISGEWSIENNPLVFAPHTQADVLGNEWDRAYDRFYAAFPVPSVAKDKFWPTVTRIDDVYGDRNLVCSCPAVETYRD

SEQ ID NO: 2912 - DNA, 2889 bp, marine gamma proteobacterium HTCC2143
  CDS (1)..(2889): transl_table=11
atgctgaacacctacgcatcattaactgaactcgaagcggctgatgaatttatccagcgccacattggacccgatgaatcacagcagcaggagatgctggacttactcggcgttagttcactcgatgaattaattaccagcacagttccagctaacattctccgcgctaagccgatgaacatcgccgatccaaaaactgaagccaatgctcttgccgaactgcaccttcttgcccaacaaaatcaggtaatggataactacattggccaaggctatcatccaaccttaacgcccaatgtcatcctgcgaaatgttttacagaatcctggctggtacaccgcctatacgccttaccagccagaaattgctcaggggcgtctggaaggtctgttaaattaccagcaaatgatcatggatttaaccggtatggaactcgctaacgcttccatgctagacgaaggtactgcagcagcggaagctatggcgctactaaaacgtgttaataaaaagaatcgctccaatcagttttttgtcgccaacgacactcacccacaaactatcgccgtattaaaaactcgcgccgcaacttatggctttgaactggttatcggcgaagtttcagaactgaacggcgccgatgtatttggtgcactgctacaataccccggcacttatggacatatcaccgatctggaaacggtcattgcacaagcccagcagcaaaatacccttgtagtggttgccgccgacatcatgagcctcgtgatactaaaaccgcccggtgaaatgggcgctgacgtcgtcgttggcaacagccaaagatttggcgtgccgatgggatttggtggcccacatgccgccttcttcgcgatcaaggacaaatacaaacgctctataccagggcgtcttattggcgtttcaattgaccgccatggcaatcaggcactgcgtatggcgatgcagacccgcgagcaacatattcgccgcgagaaagcgactagtaatatttgcacagctcaggccctgctggccatcatggccagtttttatggggtttatcacggccctcaaggccttaaaacgatcgccaatcgtattcatcgtttaacaaacattctcgcccatgggctcgaaaaacttgggcttgctacagtcaatacacattggtttgataccctcaccattgatgttgccgaacaacaaccggccattcttgctcgcgccatagaaaataatatcaatctgcgaaaggtgggggattcgaagattgctatcagtctagacgaaacaacaactcgagcccatgttgatattttgtggagagtgatctccggtatggatattggtttgagtattgagtctatcgatgtcgaaactattaatcactcacctattcccgagcattatcgtcgaaacagcgtctttatgacgcacccagttttcaatcagcatcattctgaaactgaaatgttgcgttacatgaaacgcctggaaagcaaggatatcgcccttaaccactcaatgatagcgttaggatcatgtaccatgaaactcaacgcgaccgcagaaatgattccggtaacgtggcctcagttcgccaacatgcaccccttcgctccgcaaaatcaggccaagggttatctcgcaatgttcaaacaattggaagaaatgcttatcgaagccaccggctacgatgcaatttctctacagccaaattctggtgcccaaggggaatatgccgggctgctgaccatcatgaaataccatcaaagccgtggtgactttaatcgtgatctctgcctgattccaagttcggctcatggcaccaatcctgctagcgctgccgtcgcaggtatgcgtatcgtcatcgttgaatgtgacgacagcggcaatgtcgacatggatgacctgaaaacgaaagccgctcatcacgcggacgaactcgccgccatcatgattacctatccctcaactcatggggtatttgaagaaagtatcactgagatatgtgacactatccacgatcacggtggccaggtttatgttgacggcgctaatttaaacgcgctggttggcatcgcggctcctgggaagtttggtgcggacgtttctcatatcaacctgcacaaaacattttgtatccctcatggcggcggcgggcctggcatgggacccatcggcgtaggtaaacatctggcgccatttttgcccaacaatcccgcacaaccaatcgatgggctcgacatcaataacgacaccgtgtcatcagccagctggggaagcgctgccatattgcctatctcttggatgtacatcgcaatgatgggtgagcaaggcctaaaaaaggctactcaggttgccattcttaatgccaattatatcgctcagaaattaagcaaacactaccctattctctacacaggtagaaataatcgtattgcacacgaatgtattctcgacatgcgcacaataaaagaaagtagcggcatcagtgaagaggatgttgctaagcgtttaatggactttggttttcacgcgcctaccatgtcctttcccgttcccggcacgttgatggtagaaccaacagaaagtgaaccaaaagaagaactcgaccgatttatagaggccatgattgcaatacgtaaagaaattgcgcaggtagaaaccggagagctagacgaagaagacaatccattgaaaaatgccccgcacacatccatggaagccacttcgtcagattgggttcactcatacagtcgtgaacaagcaatattcccaattggcagtgacaacaaatattggcctcccgttgcacgcattgataatgtctttggcgatcgtaatttgatctgctcttgcccagacattgatagttaccgggaagactga

SEQ ID NO: 2913 - protein, 962 aa, marine gamma proteobacterium HTCC2143
MLNTYASLTELEAADEFIQRHIGPDESQQQEMLDLLGVSSLDELITSTVPANILRAKPMNIADPKTEANALAELHLLAQQNQVMDNYIGQGYHPTLTPNVILRNVLQNPGWYTAYTPYQPEIAQGRLEGLLNYQQMIMDLTGMELANASMLDEGTAAAEAMALLKRVNKKNRSNQFFVANDTHPQTIAVLKTRAATYGFELVIGEVSELNGADVFGALLQYPGTYGHITDLETVIAQAQQQNTLVVVAADIMSLVILKPPGEMGADVVVGNSQRFGVPMGFGGPHAAFFAIKDKYKRSIPGRLIGVSIDRHGNQALRMAMQTREQHIRREKATSNICTAQALLAIMASFYGVYHGPQGLKTIANRIHRLTNILAHGLEKLGLATVNTHWFDTLTIDVAEQQPAILARAIENNINLRKVGDSKIAISLDETTTRAHVDILWRVISGMDIGLSIESIDVETINHSPIPEHYRRNSVFMTHPVFNQHHSETEMLRYMKRLESKDIALNHSMIALGSCTMKLNATAEMIPVTWPQFANMHPFAPQNQAKGYLAMFKQLEEMLIEATGYDAISLQPNSGAQGEYAGLLTIMKYHQSRGDFNRDLCLIPSSAHGTNPASAAVAGMRIVIVECDDSGNVDMDDLKTKAAHHADELAAIMITYPSTHGVFEESITEICDTIHDHGGQVYVDGANLNALVGIAAPGKFGADVSHINLHKTFCIPHGGGGPGMGPIGVGKHLAPFLPNNPAQPIDGLDINNDTVSSASWGSAAILPISWMYIAMMGEQGLKKATQVAILNANYIAQKLSKHYPILYTGRNNRIAHECILDMRTIKESSGISEEDVAKRLMDFGFHAPTMSFPVPGTLMVEPTESEPKEELDRFIEAMIAIRKEIAQVETGELDEEDNPLKNAPHTSMEATSSDWVHSYSREQAIFPIGSDNKYWPPVARIDNVFGDRNLICSCPDIDSYRED

SEQ ID NO: 2914 - DNA, 2835 bp, marine gamma proteobacterium HTCC2080
  CDS (1)..(2835): transl_table=11
atggctttcacgcccgaagactacaatccctatgattttgccaatcgacgccacatcggcccgtccccaagtgaaatgaccgccatgcttgacgtgcttggtgtttctgatcttgacgaactgattgagcaaacgatccctgctgcgttaaggcaggctcagcccctcaactttgaggagccgctttccgagcgtgaactgatctttaaaatgcgccaggtggcggctaagaataaggtcttcaccaccatgattggacaggggttttatggcactgtctgtccacctgcgattcaacgcaatattttggaaaacccggcttggtatacggcctatacgccgtaccaacccgaaatttcccaaggcaggttggaggccctactcaattttcagactgtcgtgtcagatctgaccgggctagaggtcgctaatgcctctttgctcgacgaagcaaccgcggcggccgaagcgatggtcatggcacaacgggtagccaagtctaaagctcgtggcttttttattgacgagaacagtcacccacagaatatagcggtcatgcaaacacgtgctgagccactcgatatcgatatcattattggagctccggaggagcttgatgccagcacggtttttgggggtatcttccagtaccctgggacttacgggcacattcgcgatttctctccacaagccgagcagctgcaggcggctaaagcgattaccgttatcgttgctgacccccttgcactggccttgttgaaggagcccgctgccatgggtgccgatattgccgtggggtctactcagcgatttggtgtgcccatgggatgcggtggcccgtctgcggcctacatggcatgcaaagcggcttacaagcgcagcatgcccggaaggattgtcggtgtatcaatcgatgtcgagggaaacactgcctaccgcctctccctgcaaactcgcgagcagcatattaggcgcgaaaaggcgacctctaatgtctgcactgctcaggcactgttggccaatatcgcgagcttttatgctgtatttcacggtccagaagggcttaaagccattgctcaaaccgtgcattgcaaaactgtttgtgtggctagagggctagaggcgcacggtttttccgtagagcccgcaacgttctttgacacgatcacggttgaagttggcgcgtttcagggcacgattattgatgcagcccgccgcgagcgtataaacctgcgtaaggtcggcgatacgcgtgtgggtatctctctcgacgagagcacgttgacccatgtgattgagcgtttgtggcgcgcgtttggtattcatgacagagacgccgaactgaccagcgattaccggttcgatgatgctcttattcgacagactcagtatctaacccacccgatattccacctaaatcgggctgagacagaaatgatgcgttacatgcgacggctagccgatcgtgacctcgctttagatagggccatgattccgctcggctcctgcacgatgaagctcaacgctgctgcggaaatgctgcctataacctggcctgaatttgccaacatacatccgtttgcacctgcagatcagacccaagggtacgctgaactcactcaagacttaagcaacaagctgtgtgaaattactggctacgacgccatgagcctgcaacccaactcaggtgctcaaggtgagtacgcgggcttgttaacgatccgagcttaccatcgtgccagaggtgaaactgaacgtaatatttgcctcatccccgtatcagcccacggtaccaatccggcttcagcacaaatggtgggtctggacgttgttgttgtcaggtctgctaccaatggcgatgttgatgtagccgatttccgcgctaaggctcgggccgctggcaaccgtcttgccgcctgcatgattacctacccatccactcatggagtctttgaagagacagtgacggaaatctgcaacatcacccacgagttcggtgggcaggtgtatatcgatggcgccaacatgaacgccatggtgggtcttgttcgcccgggtgatattggcggggacgtaagtcacttgaacttgcataagaccttttgcattcctcacgggggtggagggccaggcatgggacctattggtgtaaaagcgcatttagcgccgcacttacccggtcatgcagaggccgacggcgacggagccgtcagtgctgctccccttgggtcggcgtcaatactccccatctcctgggcttacttattgatgatgggcggggaggggctgacccaggcaactcgggtcgctattctcaatgccaattacattgccaaacagctcgagggtggctacgacatcctttttaagggctctagagggcggatagctcacgagtgcattgtcgatacgcgctctttcgttgagtccgcaaatgtcacggtggacgatattgccaagcgcctgattgataacggattccacgcacctacaatgagttggccggtgtcagggaccctcatgattgagcccactgagagtgaaactaaggctgaacttgatcgctttatcaccgcgatgaagtccatcagagaagaaatcgccacaattgaaaggggtgagatggcgattgataacaacccgcttaaacacgcgccccacactgttaattcgttgatgggagattgggatcgtccttacacccgtgaagagggttgttttccgccgggaagttttcgcatcgataaatattggtcccccgtcagtcgagtagacaatgcttatggagatcgacatttcatctgtacctgcccgtcgctagacgaatacgagtag

SEQ ID NO: 2915 - protein, 944 aa, marine gamma proteobacterium HTCC2080
MAFTPEDYNPYDFANRRHIGPSPSEMTAMLDVLGVSDLDELIEQTIPAALRQAQPLNFEEPLSERELIFKMRQVAAKNKVFTTMIGQGFYGTVCPPAIQRNILENPAWYTAYTPYQPEISQGRLEALLNFQTVVSDLTGLEVANASLLDEATAAAEAMVMAQRVAKSKARGFFIDENSHPQNIAVMQTRAEPLDIDIIIGAPEELDASTVFGGIFQYPGTYGHIRDFSPQAEQLQAAKAITVIVADPLALALLKEPAAMGADIAVGSTQRFGVPMGCGGPSAAYMACKAAYKRSMPGRIVGVSIDVEGNTAYRLSLQTREQHIRREKATSNVCTAQALLANIASFYAVFHGPEGLKAIAQTVHCKTVCVARGLEAHGFSVEPATFFDTITVEVGAFQGTIIDAARRERINLRKVGDTRVGISLDESTLTHVIERLWRAFGIHDRDAELTSDYRFDDALIRQTQYLTHPIFHLNRAETEMMRYMRRLADRDLALDRAMIPLGSCTMKLNAAAEMLPITWPEFANIHPFAPADQTQGYAELTQDLSNKLCEITGYDAMSLQPNSGAQGEYAGLLTIRAYHRARGETERNICLIPVSAHGTNPASAQMVGLDVVVVRSATNGDVDVADFRAKARAAGNRLAACMITYPSTHGVFEETVTEICNITHEFGGQVYIDGANMNAMVGLVRPGDIGGDVSHLNLHKTFCIPHGGGGPGMGPIGVKAHLAPHLPGHAEADGDGAVSAAPLGSASILPISWAYLLMMGGEGLTQATRVAILNANYIAKQLEGGYDILFKGSRGRIAHECIVDTRSFVESANVTVDDIAKRLIDNGFHAPTMSWPVSGTLMIEPTESETKAELDRFITAMKSIREEIATIERGEMAIDNNPLKHAPHTVNSLMGDWDRPYTREEGCFPPGSFRIDKYWSPVSRVDNAYGDRHFICTCPSLDEYE

SEQ ID NO: 2916 - DNA, 3096 bp, x Tritordeum sp
  CDS (1)..(3096)
atggagcgcgcacgccgcctcgccagccgcgcgctgctgcgccgcctcctcgcggcctcctcctccgccacgtccccggcgccgtcccgcggcgtctccaccctggcgcccaagccggcggccgggtcgcgcccccgcgcgcgcccggcccaccagtacacgcccggctgccccgtctccgtgtcggcgctgcagcccagcgacaccttcccgcggaggcacaactccgccacccccgccgagcaggccgtcatggcgtccgagtgcggcttcaacaccctcgacgcgctcatcgacgcaaccgtcccggccgcaatccgcgcgccgccgatgcagttcaccggcaagttcgacgccggcttcaccgagtcgcagatgctcgaacacatggcgcacctcgcctccatgaacaagacctacaagtccttcatcgggatgggctactacaacacccacatcccggccgtcatactgcgcaacctcatggagaaccccgcgtggtacacgcagtacacgccctaccaggcggagatcgcgcagggacgcctcgagtcgctgctcaactaccagaccatggtcgccgacctcaccggcctgcccatgtccaacgcctcgctgctcgacgaggccaccgccgccgccgaggccatggccatgtgcctcggcatcgtcaagtccaagaagaagaccttcctcatcgcctccaactgccacccgcagaccattgacatctgccagacgcgtgccaccggcttcgacatcaacgtcgtcgtctcggccgccaaggacttcgactacagcagcggcgacgtctgcggcgtgctcgtgcagtaccccggcaccgagggggaggtgctggactacgccgagttcgtcaaggacgcgcacgcgcacggcgtcaaggtggtgatggccactgacctgctcgcgctcaccacgctgcgcccgccgggcgagattggcgccgacatcgccgtgggctccgcgcaacggttcggcgtgcccatggggtacggcggcccgcacgctgcgttcctcgccacctcccaggagtacaagcggctgatgcccggccgcatcatcggagtgagcgtcgactccagcggcaagcccgcgctccgcatggcgatgcagaccagggagcagcacatccggcgagacaaggccaccagcaacatctgcaccgcgcaggcgttgctcgccaacatggcagcgatgtatgctgtctaccatgggcctgctggcctgaaggcgatcgccgaccgtgtccatggcctggctggtactttcgcccatggtttgaagaagctcgggacagtgacggtgcaagagctgccctacttcgacacggtcaagatcacttgcgctgatgctaatgcgattgccgaggaggcccgcaaaaacgagatgaaccttcgcgttgtcgacgcgaacacgatcaccgttgccttcgatgagaccaccaccttggaggatgttgacaagctgttcaaggttttctctggtggcaagccagtggacttcacagctgaatccatcgcacctgaggtctcaagctcaattcctcctagccttgtgcgcgacagcccctacttgactcacccaatctttagcatgtaccacactgagcacgagctcctccgttacctgcataagttgcaatccaaggatctctcactgtgccacagtatgatccctcttggttcttgcaccatgaaactaaatgctaccgtcgagatgatgcctgtcaccgatcccaagttcgccaacatgcacccatttgcccctattgatcaagctgctggctatcatgaaatgtttgacaacctgggcgatctgttgaacaccatcactggttttgattcgttctctttgcaaccgaatgctggtgcttcaggagagtatgctggactgatggttattcgggcctaccacaaggcaagaggagaccaccaccgaaatgtctgcatcattcctgtctctgcgcacggtacaaaccctgcaagtgctgctatgtgtggaatgaagattgttgccgttggaactgatgccaaaggtaacattaacattgaggagttgaggaaagctgctgaagcaaacaaggacaacctgtctgctctgatggttacctatccttcaacccatggagtctatgaagaaggcattgatgagatatgcaggattattcatgagaacggcggtcaggtctatatggatggagctaacatgaacgctcaggttgggttgacaagccctggttttattggagcagatgtttgccatcttaaccttcacaagacattttgcattccacatggtggaggtggtcctggcatgggtcctattggtgttaagaagcacttggcgccatttttgccatctcatccagtgatccccactggtggcttccctctccctgagaaaaccgaccctcttggttccatttctgctgctccatggggatctgctttgattcttccaatttcgtacacctacatagccatgatgggctctcagggactcactgaagcttcaaagattgctatcctgaacgcgaactacatggcaaagcgtctggagaaacactacccagttcttttccgtggagtcaatggaactgttgcccatgaattcatcattgatttaagagggttcaaggcaactgctggtattgagcctgaggatgtggcgaagcgcttgatggactacggattccatgggccaaccatgtcatggcccgttccaggcacacttatgattgaacccactgaaagtgaaagcaaggctgaactagacaggttctgtgatgcccttatctccatcagagaggaaattgcagaggtagaaaatggcaaagcagatgcacacaacaatgtcctgaagggcgctcctcacccaccccaactcctgatgggtgacgcatggactaagccatactctagggagtatgctgcgttccccgccgcgtggcttcgtggtgccaagttctggccaacaacatgtcgtgtggacaacgtgtacggggatcgcaacctgatctgcactctgcagcaggcatcccaggtggcagaggaagctgcagctgccaccgcgtaa

SEQ ID NO: 2917 - protein, 1031 aa, x Tritordeum sp
MERARRLASRALLRRLLAASSSATSPAPSRGVSTLAPKPAAGSRPRARPAHQYTPGCPVSVSALQPSDTFPRRHNSATPAEQAVMASECGFNTLDALIDATVPAAIRAPPMQFTGKFDAGFTESQMLEHMAHLASMNKTYKSFIGMGYYNTHIPAVILRNLMENPAWYTQYTPYQAEIAQGRLESLLNYQTMVADLTGLPMSNASLLDEATAAAEAMAMCLGIVKSKKKTFLIASNCHPQTIDICQTRATGFDINVVVSAAKDFDYSSGDVCGVLVQYPGTEGEVLDYAEFVKDAHAHGVKVVMATDLLALTTLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPAGLKAIADRVHGLAGTFAHGLKKLGTVTVQELPYFDTVKITCADANAIAEEARKNEMNLRVVDANTITVAFDETTTLEDVDKLFKVFSGGKPVDFTAESIAPEVSSSIPPSLVRDSPYLTHPIFSMYHTEHELLRYLHKLQSKDLSLCHSMIPLGSCTMKLNATVEMMPVTDPKFANMHPFAPIDQAAGYHEMFDNLGDLLNTITGFDSFSLQPNAGASGEYAGLMVIRAYHKARGDHHRNVCIIPVSAHGTNPASAAMCGMKIVAVGTDAKGNINIEELRKAAEANKDNLSALMVTYPSTHGVYEEGIDEICRIIHENGGQVYMDGANMNAQVGLTSPGFIGADVCHLNLHKTFCIPHGGGGPGMGPIGVKKHLAPFLPSHPVIPTGGFPLPEKTDPLGSISAAPWGSALILPISYTYIAMMGSQGLTEASKIAILNANYMAKRLEKHYPVLFRGVNGTVAHEFIIDLRGFKATAGIEPEDVAKRLMDYGFHGPTMSWPVPGTLMIEPTESESKAELDRFCDALISIREEIAEVENGKADAHNNVLKGAPHPPQLLMGDAWTKPYSREYAAFPAAWLRGAKFWPTTCRVDNVYGDRNLICTLQQASQVAEEAAAATA

SEQ ID NO: 2918 - DNA, 3135 bp, Arabidopsis thaliana
  CDS (1)..(3135)
atggagcgtgcaaggagacttgcttacagagggatcgtgaaacgtctcgtcaacgagacaaaacgccaccgtaacggcgaatcctctcttcttccgacgacgactgttactccctcaaggtatgtctcctccgtctcctcctttctccatcgccgtcgtgatgtctctggatcggcttttaccacctccggtagaaatcaacaccagacacgatcgatctccgtcgatgcgttgaagccaagcgacactttcccgcgccggcacaactcagcaacaccggatgaacaagctcagatggcgaattactgcggattcgataatctcaacacgttgattgattcgactgttccgaaatcgattcggttagattcgatgaagttttccgggatatttgatgaaggattaacggagagtcaaatgattgagcatatgagtgatttagcttcgaagaacaaagttttcaaatcgttcattggtatgggatactataacactcatgttcctcctgtgattttgcgtaatataatggagaatcctgcttggtatactcaatatactccttatcaagctgagatttctcaaggaagactcgaatctctgctcaattaccagacggttattactgatctcaccggtctaccgatgtcgaacgcttcgttgctcgatgaaggtacggcggcggcggaagcaatggcgatgtgtaataatattctaaaggggaagaagaagacgtttgttattgctagtaattgtcatcctcagactattgatgtttgcaagacgagagcggatggtttcgatttgaaagttgtgacggttgatattaaggatgtggattatagctctggtgatgtgtgtggagtgttggttcagtatccggggactgaaggggaggtgttggattatggtgagtttgttaagaatgctcatgctaatggtgttaaggttgttatggctacggatttgttggctttgacgatgttgaaaccgccgggtgagtttggggcggatattgttgttgggtcgggtcagaggtttggtgttccgatgggttatggtggtcctcatgctgctttcttggctacttcacaagagtataagagaatgatgcctgggaggattattggtgttagtgttgattcttccgggaagcaagctttgcgtatggctatgcagactagggaacagcatatccgcagggataaagctaccagcaacatctgtaccgctcaggccttgcttgcaaatatgactgctatgtatgctgtttaccatggaccagaaggcttaaaatctattgcacaacgggttcatggtctcgctggtgtatttgccttaggattgaagaaactgggaactgcacaagtccaagatcttcccttctttgacactgtcaaagttacatgttcagatgcaactgcaatttttgatgtggcagccaagaaggagatcaatttgcgtcttgtggactccaacactattactgttgctttcgatgaaacaaccaccttggatgatgtcgataaactttttgaagtttttgcttcgggcaagcccgttcaattcacggctgagtctcttgcaccggagtttaacaatactattccctctagcctaacaagagagagcccttatctgacccatccaatcttcaacatgtaccacacggagcatgagttgcttaggtacatccacaagttacaaaataaagatctatcattgtgccacagcatgattccacttggatcttgtacgatgaaattgaatgccaccactgaaatgatgccagtcacatggccaagtttcaccaacatgcacccttttgctcctgttgaacaagcccaaggttatcaggaaatgtttacgaatttgggtgagctcttatgtacgatcactggattcgactctttctcattgcaacctaatgccggtgctgctggcgagtacgccgggctcatggttatccgtgcatatcatatgtcaagaggcgatcatcacagaaatgtgtgcatcatacctgtttctgcacacgggacaaaccctgctagtgctgccatgtgcggaatgaaaattgttgccgttggaactgatgccaaaggaaacattaacatcgaagagttgaggaacgccgccgaagccaacaaggacaacttggctgctcttatggttacatacccttccacccatggagtctacgaagagggtatcgacgagatctgcaacataattcatgaaaatggaggccaagtttatatggatggtgctaatatgaatgcacaggtgggtttgacaagccctggttttattggagcggatgtttgccatctcaatctccacaagaccttctgtatccctcacggaggtggaggtcccggaatgggccctatcggtgtgaagcaacatttggctccattcctaccttctcacccagtgatacctaccggtggtatccctgaacccgagcagacatcaccgctgggaaccatttctgcagcaccatgggggtctgcgcttatcttgccaatctcgtatacttacattgccatgatgggatctggaggactcaccgatgcctcaaagattgcaattttgaacgctaactacatggcaaagcgtctggagagccactacccagttcttttccgtggtgtcaatggaacagtcgctcacgaattcatcattgacttgagaggattcaagaacactgctggaattgaaccagaggatgtggccaaacgattgatggattatggtttccatggaccgacaatgtcttggcctgtccctggaacgcttatgatcgagccaaccgaaagcgaaagcaaggctgagttagataggttctgtgatgctctcatctcgatcagggaagagatttcacagattgagaaaggaaacgcagatccaaacaacaacgttctgaagggtgctccacatcctccgtcattgctaatggcagatacatggaaaaagccgtattcacgggaatacgcagccttccccgctccatggctccgctcctccaagttctggcccactacagggcgagtggacaacgtgtatggagaccgtaatctggtgtgcactctccaaccggcgaacgaagaacaggctgcagctgcagtgtctgcttaa

SEQ ID NO: 2919 - protein, 1044 aa, Arabidopsis thaliana
MERARRLAYRGIVKRLVNETKRHRNGESSLLPTTTVTPSRYVSSVSSFLHRRRDVSGSAFTTSGRNQHQTRSISVDALKPSDTFPRRHNSATPDEQAQMANYCGFDNLNTLIDSTVPKSIRLDSMKFSGIFDEGLTESQMIEHMSDLASKNKVFKSFIGMGYYNTHVPPVILRNIMENPAWYTQYTPYQAEISQGRLESLLNYQTVITDLTGLPMSNASLLDEGTAAAEAMAMCNNILKGKKKTFVIASNCHPQTIDVCKTRADGFDLKVVTVDIKDVDYSSGDVCGVLVQYPGTEGEVLDYGEFVKNAHANGVKVVMATDLLALTMLKPPGEFGADIVVGSGQRFGVPMGYGGPHAAFLATSQEYKRMMPGRIIGVSVDSSGKQALRMAMQTREQHIRRDKATSNICTAQALLANMTAMYAVYHGPEGLKSIAQRVHGLAGVFALGLKKLGTAQVQDLPFFDTVKVTCSDATAIFDVAAKKEINLRLVDSNTITVAFDETTTLDDVDKLFEVFASGKPVQFTAESLAPEFNNTIPSSLTRESPYLTHPIFNMYHTEHELLRYIHKLQNKDLSLCHSMIPLGSCTMKLNATTEMMPVTWPSFTNMHPFAPVEQAQGYQEMFTNLGELLCTITGFDSFSLQPNAGAAGEYAGLMVIRAYHMSRGDHHRNVCIIPVSAHGTNPASAAMCGMKIVAVGTDAKGNINIEELRNAAEANKDNLAALMVTYPSTHGVYEEGIDEICNIIHENGGQVYMDGANMNAQVGLTSPGFIGADVCHLNLHKTFCIPHGGGGPGMGPIGVKQHLAPFLPSHPVIPTGGIPEPEQTSPLGTISAAPWGSALILPISYTYIAMMGSGGLTDASKIAILNANYMAKRLESHYPVLFRGVNGTVAHEFIIDLRGFKNTAGIEPEDVAKRLMDYGFHGPTMSWPVPGTLMIEPTESESKAELDRFCDALISIREEISQIEKGNADPNNNVLKGAPHPPSLLMADTWKKPYSREYAAFPAPWLRSSKFWPTTGRVDNVYGDRNLVCTLQPANEEQAAAAVSA

SEQ ID NO: 2920 - DNA, 2997 bp, Coprinellus disseminatus
  CDS (1)..(2997)
atgctgcgactccgttgtgtgcagaggttccctcgcctccacaacaagagggctgcccctcttgcccgcggtcttgccagcctcaagcagccatcctccatcttctcgcccctggataccttccaggagcgtcatatcggtccagatgacgctgaggccaccaccatgctttccaacctcggctacgactccatggatgccttcattgcggatactgttcctcccaaaatccgcatctcgccctcgaccgtcagcaacgagtccattcccgctctcagtgaatccgagctgcaggccaacgcgaaggctcttggagctcagaacaaaccgttcaagagttacattggcatgggctaccacaatgctgtcgtcccacccgtcatcctccgcaacgtgatggagaacccttcatggtacacgcaatacaccccttaccagcctgagattgcccaaggtcgcttggagtctcttatcaacttccaggccatggtcatgtccctaaccagcatggatatcgccaacgcctcacttctcgacgaagccactgctgcagccgaaggcatggtcatggctcacacgtctgcccccaagaagaagaccttcattgtcgactcgggagtcgcaccgcaaacccttgcagttattcggtcgcgtgccaagggattcgatgtcaagatagtcgttggggatgtttccgctttggtcgaggattccagccttatcgccgatgtttgtggtgtcctcgtacaatatccggacgtcgacggcaacattaaagattgggcagctcttgccgagcagacgcacaagatcggtggtttggtcgtcgctgcgaccgatctccttgccttgaccaagctcaaggctcctggggagtggggtgctgatgttgtcgttggtaactctgcgcggtttggagtccccgctgggtatggtggtccgcacgctgcgttcttcgctgtcaccgacaagctgaagcgcaagatgcctggccgcctcatcggcctcagcagggatgctcaaggaaagcccgcctatcgactggcactgcaaacccgtgagcagcatattcgtcgcgagaaggctactagcaacatttgcaccgcccaagctttgctcgccaacatggctaccatgtacgcagtgtaccatggacccgaaggcctgaaacgcatttccaacaaggtccacggcttcacacaggtcttcaagtcatccgtcgaatcccttggcttcaaagcaatcaacaccactttcttcgacacccttaccctcgacgtcactggtgccgttgccaactcatgggccgtccacgcctctgccaatgctgccgccattaaccttcgtcgtatcgacgataagcacgtcggtgtcacctttgacgagagcgtcactcctgccgagctcgtggacttgatcaacgttttcgccaccgctgcgaacaagtctcccttcgccctttcagacttggcagagtctacggagtcggctatctctccacacctgaagcgtacctccaagttcttaccacacgctgtgtttaacaagcatcactccgaaaccgagatgcttcgatacatcaaccatctctcctccaaggacctcagccttacccactctatgattgccctcggtagttgcacaatgaagctgaacagcacgagcagtatggtccctcttacctggccagaattcagcaacgtccaccccttcgctccgcaagaccaagtcgagggttatcggaccatcatcaaggagttggaggagtacctctgcaagatcaccggcttccactctgcttccctccagcctaactctggagccgccggagagtacgccggtctttgtgtcatccgcgctttccacgaatcccgtggcgaggggcacagggatatttgcttgattcctctcagcgcccacggaaccaaccccgcatctgcccaccttgccgggttgaaggtcgttcccgtcaaggttcacaatgacggcaacctcgatcttgctgatctcaaggccaaggctgagaaacacaaagataatctcgctgcattcatgatcacgtacccttcgacgttcggcgtattcgagagcggtgttcaggatgcatgtcagatcattcacgggaaaggtggtcaggtgtacctcgacggtgccaacctgaacgcccaggtcggcctcaccagccctgctacctgtggtggtgacgtttgtcatctcaacctccataagacctttgcaattccccacggtggtggagggcctggtgtcggccctatctgtgtcgctgagcacctcgctcccttcctcccaggacacaccgcgctccccgtccagggtgagagcgctatcaacgctgtagccgcggctcctttcggcagcgcgtccatcctccttatctcctgggcttatatcaaaatgctcggtggcaagggtctcgccgactcatccaagcttgccctccttaacgccaactacatggcgcacaagctcgctccttactacaccctccgatacaagaacgagaatgggcgcgttgctcacgaactcctcatcgaccttgctgagtttgataaggccgctggactcaaggttaccgattttgccaagcgactccaggactacggcttccaccctcccacctgctcgtggcctatctccacttgcatgctcattgagcctaccgagtccgagacgctggaggagctcgacaggttctgcgaggccatgatccagattcgcaaagaggccgacgacgtcattgctggcaagcaacccaaggagaacaatcttctgaagaacgcgcctcaccctatttccgtcatctctctgtccgaggaccggtggaatcgcccgtactctcgcgagaccgctgcgttccctctgccctggctgaaggagaagaagttctggcccactgttggccgcctcgacgatgcttacggggaccttaacctcgtctgcgactgtccttcggtggaggaggttgcttcgaactga

SEQ ID NO: 2921 - protein, 998 aa, Coprinellus disseminatus
MLRLRCVQRFPRLHNKRAAPLARGLASLKQPSSIFSPLDTFQERHIGPDDAEATTMLSNLGYDSMDAFIADTVPPKIRISPSTVSNESIPALSESELQANAKALGAQNKPFKSYIGMGYHNAVVPPVILRNVMENPSWYTQYTPYQPEIAQGRLESLINFQAMVMSLTSMDIANASLLDEATAAAEGMVMAHTSAPKKKTFIVDSGVAPQTLAVIRSRAKGFDVKIVVGDVSALVEDSSLIADVCGVLVQYPDVDGNIKDWAALAEQTHKIGGLVVAATDLLALTKLKAPGEWGADVVVGNSARFGVPAGYGGPHAAFFAVTDKLKRKMPGRLIGLSRDAQGKPAYRLALQTREQHIRREKATSNICTAQALLANMATMYAVYHGPEGLKRISNKVHGFTQVFKSSVESLGFKAINTTFFDTLTLDVTGAVANSWAVHASANAAAINLRRIDDKHVGVTFDESVTPAELVDLINVFATAANKSPFALSDLAESTESAISPHLKRTSKFLPHAVFNKHHSETEMLRYINHLSSKDLSLTHSMIALGSCTMKLNSTSSMVPLTWPEFSNVHPFAPQDQVEGYRTIIKELEEYLCKITGFHSASLQPNSGAAGEYAGLCVIRAFHESRGEGHRDICLIPLSAHGTNPASAHLAGLKVVPVKVHNDGNLDLADLKAKAEKHKDNLAAFMITYPSTFGVFESGVQDACQIIHGKGGQVYLDGANLNAQVGLTSPATCGGDVCHLNLHKTFAIPHGGGGPGVGPICVAEHLAPFLPGHTALPVQGESAINAVAAAPFGSASILLISWAYIKMLGGKGLADSSKLALLNANYMAHKLAPYYTLRYKNENGRVAHELLIDLAEFDKAAGLKVTDFAKRLQDYGFHPPTCSWPISTCMLIEPTESETLEELDRFCEAMIQIRKEADDVIAGKQPKENNLLKNAPHPISVISLSEDRWNRPYSRETAAFPLPWLKEKKFWPTVGRLDDAYGDLNLVCDCPSVEEVASN

SEQ ID NO: 2922 - DNA, 3195 bp, Aspergillus oryzae
  CDS (1)..(3195)
atggctgcatcctggtgcgcccttcgtggcactcgccagcttgctcttcggactcgcttgcgctctgctccttcccccattgcactccgcaaagctactccatcctctcccttccgcgccacccatcgcgccctgcacacagctacacagcagccgtcgcggcgaccggtctacacaagctcagtagctgaccatggcgaccctcacccccgcgacctctttcaacccctcgacaccttccccagacgtcatatcggtccttcgccagatgccgcgaaggaaatgctggccactcttgaccccccagtggcgtctctcgacgaattcgtaaagcaggtgcttcccgcagacattctgtccaagaaggacttgaaggttactgatcctcacgctaaaacgaatctgtaccgggataatgtgggcggtggtcttggagagaccgatatgctgaagctcttggatgtctaccggaagcaaattgatgtttctggcaaaacctacatcggaactggttattacggtacaattgtgcctcctgtgatcctccgcaatgtgctggagaaccccgcatggtacacaagctacaccccctaccagcccgagatcagccagggtcgtctggaatcactcctgaacttccaaacattgactgccgacttgacgggcttgccattcgccaatgcctccgttctggacgaagctaccgctgctgccgaggcgatgaccatgtctttcgctactatgcctgcttcaaaacagaagaagcccggtaaggcttacgttgtttcgcatctttgccaccctcagacaatcgccgtgatgcggtcgcgcgccgagggtttcggcatcaacctggttatcggtgacattctggcggatgatttcaagttggtgaaagaacaaggcgacaatcttattggtgtgcttgctcaatatccggacactgagggtggcatctatgacttccaggccttgagcgacaatattcatggcgctggcggtaccttcagcgtcgccaccgacttgatggctttgaccgttttgaaggcacccggagagtttggagctgatattgcgttcggtaatgcccagagattcggtgttcctatgggatacggtggtccacacgcagcattcttcgcttgtgtagacaagtacaagcgtaaggttcctggccgtgttgtgggtgtctccaaagatcgtctcggcaatcgtgctttgagattggctctgcagacccgagagcagcatatccgccgtgagaaagccactagcaacatctgcactgcacaggcccttctcgccaacatgagcgccatgtatgctgtttaccacggcccgactggcctgaaatctattgctcaacgcatcatgtccatgacttcgaccttgcaggcgaagcttgctgctttgggctataacgttccgatcaagactaacgtcgccgatggcggtgcgattttcgacaccgttactgtagagttgcccaccagccaagaggcggacgccattgttgcagctgcccgggaacagtctatattcctccgccgcgtgaactctaccaaggttggtatctctcttgatgagactagcggccgggacgaagtcaagtccattttgcaggtgtttgctacccatgcttccaagggagaagtgtccatcgatggggagcttggtatctcccctcttccggccagccttgagcggacttccgaatatctgactcacccggtattcaacacccaccactcggagacggaaatgctccggtatatccgccatctggagtccaaggacctgtctctggctcactctatgatccctctgggctcttgcactatgaagctcaacgcaaccaccgagatgatccctatctcttggcctgagttctctcagatgcaccccttcttgcccgcagatgtcgcgaagggttacacccagatgatcgatgatctggaacagcaacttgccgacatcaccggtatggctgaagtcactgtccagcctaactctggcgcccagggtgagtttgcgggtctgcgtgtcatcaagaagtatctggaggctcaaggcgagtccaagcgcaacatctgtctgattcccgtgtctgctcatggcacaaaccccgccagtgccgccatggctggcatgaaggttgttaccattaagtgtgacaccaagaccagcaatttggatcttgaagatctcaaggctaagtgtgagaagcacaaggatgagctggccgctgttatgatcacctatcctagcacttttggtgtgtacgagcctggtgtcaaggaggcctgcgagatcgtgcaccagcatggtggacaggtctacatggatggcgccaacatgaacgcccagattggtctctgctctcctggcgagatcggtgcggatgtctgccatcttaacctgcacaagaccttctgtatccctcacggtggcggtggtcctggtgttggtcctatcggtgttgcagagcacctgcgccccttcctgccgtctcacccggccagcgaataccttcagtctaagcgtacggaatcctcctcgcccccgatcagcgctgctccttggggtagcgccagcatcctgcccatcaccttcaactacatcaacatgatgggtgccaagggtcttacccatgcgacaaagatcaccctgctcaacgccaactacattctctcccgtctgaaggaacactaccctatcctgtacaccaatgagaacggccgctgcgcccacgagttcatcctcgatgtccgcaagtttaaggagacctgcggcgttgaggccatcgatattgccaagcgtctccaggattatggcttccatgccccgaccatgtcctggcccgtgtccaacaccctcatgatcgaacccaccgagtcggagagcaaggcggagctggatcgattttgcgatgctctgatctccattcggcaggagattgccgaggtggagagcggcgcgcagccacgtgagggcaacgtgctgaagatggctcctcacactcagcgcgatcttttgtccaacgagtggaaccgcccgtacacccgggagacggccgcttaccccttgccgtaccttgtggagaagaagttctggccttcagtgactcgggtggatgatgcttacggtgaccaaaacctgttctgcacttgcggtcctgtggaggagactgactag

SEQ ID NO: 2923 - protein, 1064 aa, Aspergillus oryzae
MAASWCALRGTRQLALRTRLRSAPSPIALRKATPSSPFRATHRALHTATQQPSRRPVYTSSVADHGDPHPRDLFQPLDTFPRRHIGPSPDAAKEMLATLDPPVASLDEFVKQVLPADILSKKDLKVTDPHAKTNLYRDNVGGGLGETDMLKLLDVYRKQIDVSGKTYIGTGYYGTIVPPVILRNVLENPAWYTSYTPYQPEISQGRLESLLNFQTLTADLTGLPFANASVLDEATAAAEAMTMSFATMPASKQKKPGKAYVVSHLCHPQTIAVMRSRAEGFGINLVIGDILADDFKLVKEQGDNLIGVLAQYPDTEGGIYDFQALSDNIHGAGGTFSVATDLMALTVLKAPGEFGADIAFGNAQRFGVPMGYGGPHAAFFACVDKYKRKVPGRVVGVSKDRLGNRALRLALQTREQHIRREKATSNICTAQALLANMSAMYAVYHGPTGLKSIAQRIMSMTSTLQAKLAALGYNVPIKTNVADGGAIFDTVTVELPTSQEADAIVAAAREQSIFLRRVNSTKVGISLDETSGRDEVKSILQVFATHASKGEVSIDGELGISPLPASLERTSEYLTHPVFNTHHSETEMLRYIRHLESKDLSLAHSMIPLGSCTMKLNATTEMIPISWPEFSQMHPFLPADVAKGYTQMIDDLEQQLADITGMAEVTVQPNSGAQGEFAGLRVIKKYLEAQGESKRNICLIPVSAHGTNPASAAMAGMKVVTIKCDTKTSNLDLEDLKAKCEKHKDELAAVMITYPSTFGVYEPGVKEACEIVHQHGGQVYMDGANMNAQIGLCSPGEIGADVCHLNLHKTFCIPHGGGGPGVGPIGVAEHLRPFLPSHPASEYLQSKRTESSSPPISAAPWGSASILPITFNYINMMGAKGLTHATKITLLNANYILSRLKEHYPILYTNENGRCAHEFILDVRKFKETCGVEAIDIAKRLQDYGFHAPTMSWPVSNTLMIEPTESESKAELDRFCDALISIRQEIAEVESGAQPREGNVLKMAPHTQRDLLSNEWNRPYTRETAAYPLPYLVEKKFWPSVTRVDDAYGDQNLFCTCGPVEETD

SEQ ID NO: 2924 - DNA, 3099 bp, Avena sativa
  CDS (1)..(3099)
atggagcgcgcacgccgcctcgccaaccgcgcgctgctgcgccgcctcctcgcggggtccgcatccaccacaaccccctccccgtcccgcggcatctccaccctagtgccgtcgcccgcggccgggtcgcggccccgccgcgcgcgcccggcccaccagcacacgccctcgcgcccggtgtccgtctccgcgctgcagcccagcgacaccttcccgcggaggcacaactccgcctcccccgccgagcagaccgtcatggcctccacctgcggcttcaacaccctcgactccctcatcgacgccaccgtcccggccgcgatccgcgcgccgccgatgcagttcacgggcaagttcgacgccggcttcacggagtcgcagatgctcgagcacatggcgcacctcgcatccatgaacaaggtctacaagtccttcatcgggatgggatactacaacacccacatcccggccgtcatactgcgcaacctcatggagaaccccgcctggtacacgcagtacacgccctaccaggccgagatcgcgcagggccgcctcgagtcgctgctcaactaccagaccatggtcgccgacctcaccggcctgcccatgtccaacgcatcgctgctcgacgaggccaccgccgccgcagaggccatggccatgtgcaacggcatcctcaaggccaagaagaagacgttcctcatcgcgtccaactgccacccgcagaccatcgacatctgccagacgcgcgccgcgggattcgacctcaacgtcgtcgtgtccgacgccaaggacttcgactacagcagcggtgacgtctgcggcgtgctcgtgcagtaccctggcacggagggcgaggtgctggactacgccgagttcgtcaaggacgcgcacaagcacggcgtcaaggtggtcatggccactgacctgctcgcgctcaccacgctgcgcccgcctggcgagatcggcgccgacatcgccgtcggctccgcgcagaggttcggcgtgcccatgggctacggcggcccgcacgctgcgttcctcgccacctcccaggagtacaagaggctgatgcccggccgcatcatcggcgtgagcgtcgactccagcggcaagccagcgctccgcatggcgatgcagaccagggagcagcacatccgccgcgacaaggccaccagcaacatctgcaccgcgcaggccttgctcgccaacatggcagccatgtatgctgtctaccatggtcctgctgggctcaaggctatcgccgaccgtgtccatggcctggctggtactttcgcccatgggttgaagaagctcgggacagtgaccgtgcaggagctgccctactttgacaccgtcaagatcacttgcgctgatgccaatgctattgctgaggaggctcgcaaaaacgagatgaaccttcgcgtcgtagacgcaaacacgatcaccgttgcctttgatgagacaaccaccttggaggatgttgacaagctgttcaaggtgttctctggtggcaagccagtggacttcacagccgaatccattgcacctgaagtctcaagctccattcctagcagccttgtgcgcgacagcccctacctaactcacccaatctttagcatgtaccacacagagcacgagcttctccgttacctgcacaagttgcaaaccaaggatctctcactatgccacagtatgattcctcttggttcttgcaccatgaaactgaatgctacggttgagatgatgcctgtcaccgatcccaagtttgccaacatgcacccatttgcccctattgatcaggctgcaggctatcatgaaatgttcgacaacttgggcgagctgttgaacacgatcaccggttttgactctttctctttgcaaccaaatgctggtgcttctggagagtatgctggattgatggttattcgggcctaccacagggcaagaggagaccaccaccgaaatgtctgcatcattcctgtctcggcacatggtacaaatcctgcaagtgctgctatgtgtggcatgaagattattactgtcggaactgactccaaaggtaacattaacattccggagttgaagaaagctgccgaagcaaacaaggacaacctgtctgctctgatggttacctatccttcaacccatggagtctatgaagaaggcattgatgagatatgcaggatcattcatgacaacggtgggcaggtctatatggatggggccaacatgaatgctcaggttgggttgacaagccctggttttattggagcagatgtttgccatcttaaccttcacaagacattttgcattccacatggtggaggtggtcctggcatgggtcctattggtgttaagaagcacctggcaccatttttaccatctcatccagtgatcccaactggtggctttcccctccctgagaaaaccgaccctcttggctccatttctgctgctccatggggatctgctttgattcttccaatttcctacacatacatagccatgatggggtctcagggactcactgatgcttcaaagattgcgatcttgaatgcaaactacatggcaaagcgtctggagaaacactacccagttcttttccgtggagtcaatggaactgttgcccatgagttcatcattgatttaagagggttcaaggcaactgctggtatagagcctgaggatgttgcgaagcgtttgatggactatggattccatggaccaaccatgtcatggcctgttccaggcacacttatgattgaacccactgaaagtgaaagcaaggctgaactagacaggttctgtgatgcccttatttccatcagggaagaaattgcacaggtagaaaatggcatagcagatgtgaacaacaatgtcctgaagggcgctcctcacccaccccaactcctgatgagtgacgcatggactaagccatactccagggagtacgccgcattccctgcggcatggcttcggggtgccaagttctggccaacaacatgtcgtgtggacaacgtgtacggggatcgcaacctcatatgcactctgcagcaggcatcccaagtggcagaggaagctgcagctgctaccgcgtaa

SEQ ID NO: 2925 - protein, 1032 aa, Avena sativa
MERARRLANRALLRRLLAGSASTTTPSPSRGISTLVPSPAAGSRPRRARPAHQHTPSRPVSVSALQPSDTFPRRHNSASPAEQTVMASTCGFNTLDSLIDATVPAAIRAPPMQFTGKFDAGFTESQMLEHMAHLASMNKVYKSFIGMGYYNTHIPAVILRNLMENPAWYTQYTPYQAEIAQGRLESLLNYQTMVADLTGLPMSNASLLDEATAAAEAMAMCNGILKAKKKTFLIASNCHPQTIDICQTRAAGFDLNVVVSDAKDFDYSSGDVCGVLVQYPGTEGEVLDYAEFVKDAHKHGVKVVMATDLLALTTLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPAGLKAIADRVHGLAGTFAHGLKKLGTVTVQELPYFDTVKITCADANAIAEEARKNEMNLRVVDANTITVAFDETTTLEDVDKLFKVFSGGKPVDFTAESIAPEVSSSIPSSLVRDSPYLTHPIFSMYHTEHELLRYLHKLQTKDLSLCHSMIPLGSCTMKLNATVEMMPVTDPKFANMHPFAPIDQAAGYHEMFDNLGELLNTITGFDSFSLQPNAGASGEYAGLMVIRAYHRARGDHHRNVCIIPVSAHGTNPASAAMCGMKIITVGTDSKGNINIPELKKAAEANKDNLSALMVTYPSTHGVYEEGIDEICRIIHDNGGQVYMDGANMNAQVGLTSPGFIGADVCHLNLHKTFCIPHGGGGPGMGPIGVKKHLAPFLPSHPVIPTGGFPLPEKTDPLGSISAAPWGSALILPISYTYIAMMGSQGLTDASKIAILNANYMAKRLEKHYPVLFRGVNGTVAHEFIIDLRGFKATAGIEPEDVAKRLMDYGFHGPTMSWPVPGTLMIEPTESESKAELDRFCDALISIREEIAQVENGIADVNNNVLKGAPHPPQLLMSDAWTKPYSREYAAFPAAWLRGAKFWPTTCRVDNVYGDRNLICTLQQASQVAEEAAAATA

SEQ ID NO: 2926 - DNA, 3126 bp, Pleurotus djamor
  CDS (1)..(3126)
atgtcctctcttcggtggtccgttggcctcaggatcgttgctggtgtccgacatcgtcctgtgcgatgcccgacgcgtcgtttcgctactctcaaacccctgtcgtccctcttcgcgcctctggatacctttccagagagacatattggtccagatgatcgcgagacgtcgtatatgttgtccaagctcaactacaactcctttgatgccttcatcgcggataccgtccccgaccaaattcgcgtctcagacaccgtcaacaactcaacaattccacccctcagtgaatccgagcttcaccgtcgagcacaggccctgggcgcgaagaatgaaaaattcaagagttacataggtatgggctatcacaatgcggtcgttcctccagttgtcttgcgaaacgtcatggaaaacccccaatggtacacgccgtacactccatatcaacccgaagtcgcccaaggacgtctggaatcccttgtcaatttccagactatggttatgtctctcacgtcaatggatatcgcgaacgcatctttattggacgaagctactgcggctgcagaaggcatggtcatggcctatgtgaactctaatcacaagaaacggtctttcttcgttgattcaggggtttctccgcaaacattggctgtccttcgaacgcgtgccaagggtttcggtatcaatatcgtcactgggaacgttgaacgcattgtttccgacacggcccttcgctcagatctttgtggtgttcttgtgcagtatcctgatgttgatggaaccatcaaggactacagcgctctcgctgattctgttcattccgccggtggactcgttatatgcgcaactgatctgctggccttgaccatgatcaagcctcctggagagtggggagctgatgtggtcttgggcaactcggctcgttttggtgtacctgctggctatggtgggcctcatgctgcgttcttcgcggtgacagacaagttgaagcgaaagatgccgggacgtctgattggacgcagtcgtgatgccagtggacgtcccgcttatcgcttggctcttcaaacacgcgagcagcatatccgacgcgagaaggcgactagcaacatttgtactagtcaagcccttcttgccaacatggctgcgatgtatgctgtctatcatggtccggaaggtcttaagcgcgttgccgaacggattcacggattaacccaagttctgaagactgcggttgaaggattgggttttaagtcggtcaacactgaatttttcgacactcttacgttggatgtctcggcggctactggaacagcggacgtcgtacacgcgacagctatggcagcaaatatcaaccttcgtcagatcgacgatactcatgttggagtcacactcgacgaaagcgttggtcccattgatctcctttcgatcatcaatgtctttgctagcgccgtatctgcacccgtcattgatcgctccagactcgttcttcctgaacgggtggccattgcatccagtttgcgtcgcacatcggaattcctcccccaccctgtcttcaacaaacatcactcggaaacggaaatgcttcgatacatcaaccacttggcctctaaggatatcggtctcgtccatagcatgatccccctcggcagctgcaccatgaagctgaacagcacaagtagtatgatacccttgacctggcccgaattcagttccgtccatcccttcgcccccgccgaacaggttgaaggttatctcacgattatcaaggaacttgaagaggatctttgcagaattactggtttccacgctgcttcgctgcagcccaactcgggagctgctggcgaatatgctggtctctgtgtcatccgggcttaccacgaatcgaggggtgaaggtcatcgagatatttgcttgattccacttagtgcccatggaacaaatcccgcatccgctgtgatggccggtctcaaggtcgttcccgtcaaagcgcttgcagatggtagcctcgacctcaaggacctcaaggagaaggctgagaagcacaaggaccaactcgccgcgttcatgatcacctacccgtccactttcggagttttcgaagacggtgtccaggaggcatgtaaaataatccatgacaacggcggtcaggtttatctcgacggtgctaatctcaacgctcaaatcggttccaccaaccctgcgaaatgcggtggcgatgtttgccacatgaatctccacaagacattcgccattccccatggaggaggaggtcctggtgtaggccctatctgtgttgccgagcatctcgcgcctttcctacccacccatccttacttatcaacagaggccaacagccaagcgatcaatgcagtctcagcggcgcccttcggcagttcttccatccatctcatatcctgggcatacatcaagatgttgggtggccagggacttgctgattcctctagaatcgctctgttgaacgccaattacatggcttaccgtctttctggtcactacagtcttcgctacaagaacaacaacaaccgcgtcgcccatgagttgctcatcgacctggctgaatttgataaagctgctggcctcaaggttaccgacttcgccaaacgtctacaggattacggcttccatccacctacctgctcttggcctatctcaacttgcatgcttatcgaaccaacagaatctgaaacactggaagagattgatcgattctgtgatgctatgatccaaattcgccaagaagctcaggacatcattgatggcaagcagcccaaggataataacttgcttaagaacgccccgcaccccgcacatgtcatcgcacttcccgaagcagaatggaacagaccctattcccgtgaaaccgctgcgtacccagcaccctggttacacgaaaagaagttctggccaactgtttcgcgcattgatgatggtgggtcccgttttctcatcgtgctgtcccttgctgataggtacctggcgcattctagcctacggcgacctcaatctcatcgtgagtgttgtacatcagtggcatgttcatcgccttctctaatgatgtatcttttgcagtgcgattgtccctccgttgaagaattggctcacgcttag

SEQ ID NO: 2927 - protein, 1041 aa, Pleurotus djamor
MSSLRWSVGLRIVAGVRHRPVRCPTRRFATLKPLSSLFAPLDTFPERHIGPDDRETSYMLSKLNYNSFDAFIADTVPDQIRVSDTVNNSTIPPLSESELHRRAQALGAKNEKFKSYIGMGYHNAVVPPVVLRNVMENPQWYTPYTPYQPEVAQGRLESLVNFQTMVMSLTSMDIANASLLDEATAAAEGMVMAYVNSNHKKRSFFVDSGVSPQTLAVLRTRAKGFGINIVTGNVERIVSDTALRSDLCGVLVQYPDVDGTIKDYSALADSVHSAGGLVICATDLLALTMIKPPGEWGADVVLGNSARFGVPAGYGGPHAAFFAVTDKLKRKMPGRLIGRSRDASGRPAYRLALQTREQHIRREKATSNICTSQALLANMAAMYAVYHGPEGLKRVAERIHGLTQVLKTAVEGLGFKSVNTEFFDTLTLDVSAATGTADVVHATAMAANINLRQIDDTHVGVTLDESVGPIDLLSIINVFASAVSAPVIDRSRLVLPERVAIASSLRRTSEFLPHPVFNKHHSETEMLRYINHLASKDIGLVHSMIPLGSCTMKLNSTSSMIPLTWPEFSSVHPFAPAEQVEGYLTIIKELEEDLCRITGFHAASLQPNSGAAGEYAGLCVIRAYHESRGEGHRDICLIPLSAHGTNPASAVMAGLKVVPVKALADGSLDLKDLKEKAEKHKDQLAAFMITYPSTFGVFEDGVQEACKIIHDNGGQVYLDGANLNAQIGSTNPAKCGGDVCHMNLHKTFAIPHGGGGPGVGPICVAEHLAPFLPTHPYLSTEANSQAINAVSAAPFGSSSIHLISWAYIKMLGGQGLADSSRIALLNANYMAYRLSGHYSLRYKNNNNRVAHELLIDLAEFDKAAGLKVTDFAKRLQDYGFHPPTCSWPISTCMLIEPTESETLEEIDRFCDAMIQIRQEAQDIIDGKQPKDNNLLKNAPHPAHVIALPEAEWNRPYSRETAAYPAPWLHEKKFWPTVSRIDDGGSRFLIVLSLADRYLAHSSLRRPQSHRECCTSVACSSPSLMMYLLQCDCPSVEELAHA

SEQ ID NO: 2928 - DNA, 3096 bp, Oryza sativa
  CDS (1)..(3096)
atggagcgcgcacgccgcctcgccaaccgcgcgctgctgcgccgcctcctcgcggcggcgacggcggagtccccggcggccccgtcccgcggcatctcgaccctggccaaggggtcgcgcccgcgcgcccccccacgcccggcgccccaccagtacaccacggggcggcggcccgtgtcggcgtcggcgctgcagccgagcgacacgttcccgcggcggcacaactcggcgacgccggcggagcaggcggcgatggcgtcggagtgcgggttcggcaccgtcgacgcgctcatcgacgccaccgtcccggccgccatccgcgcgccggagatgcgcttctccgggaggttcgacgccgggttcaccgagtccgagatgatcgagcacatgcagcgcctcgccgccatgaacagggcctacaagtccttcatcgggatggggtactacaacacccacgtccccgcggtgatcctgcgcaacctcatggagaacccggcgtggtacacgcagtacacgccgtaccaggcggagatcgcgcagggtcgcctcgagtcgctgctcaactaccagaccatggtcgccgacctcaccggcctccccatgtccaacgcctcgctgctcgacgaggccaccgccgccgccgaggccatggccatgtgcaacggcatcctcaagtccaagaagaagaccttcctcatcgcctccaactgccacccgcagaccatcgacgtgtgccagacgcgcgccgccgggttcgacctcaacgtcgtcgtcgcggacgccaaggacttcgactacggcagcggcgacgtgtgcggggtgctcgtgcagtaccccggcacggagggggaggtgctggactacgcggagttcgtcagggacgcgcacgcgcacggcgtcaaggtggtcatggccaccgacctgctcgcgctcacctcgctgcgcccgcccggcgagatcggtgccgacatcgccgtcggctccgcgcagcggttcggcgtgcccatggggtacggcggcccgcacgccgcgttcctcgccacgtcccaggagtacaagcgcctcatgcccggccgcatcatcggcgtcagcgtcgattccagcggcaagcccgcgctccggatggcgatgcagacccgggagcagcacatccgccgcgacaaggccaccagcaacatctgcactgcccaggccttgctcgccaacatggcagcgatgtatgctgtctaccatggtcccgaggggctaaaggcaattgccgaccgtgtacatggactggctggtacatttgcccaaggattgaagaagctcggaacagtgacggtgcaggagctgcccttcttcgacactgtcaaggtcaaggtcgctgacgcgaatgcgattgcccaggaggcctgcaagaacgagatgaaccttcgtgtcgttgatgcaaccacgataaccgttgcctttgatgagaccacaaccttggaggatgtcgacaagctgttcaaggtgttcaatggtggcaagccagtgaacttcactgctgaatccctcgcaccagaggtctcaagctcaattccgagtagccttgtgcgcaagagcccctacttaacccacccgatctttaacatgtaccatacagagcatgagcttctccgctacctgtacaagttgcaatccaaggacctttcactgtgccacagtatgatccctcttggttcttgcactatgaaactaaatgctacagtggagatgatgcctgtcacctaccccaactttgcaaacatgcacccatttgcacctactgaccaagccgcaggatatcatgaaatgtttgatgacttgggcgatctgctgtgcaagatcactggctttgattctttctctttgcaaccaaatgctggtgcttcaggggagtatgccggattgatggttatccgtgcttaccacagggcaagaggagactaccaccgggatgtctgtatcattcctgtgtcagcccatggtacaaatcctgcaagtgctgctatgtgtggaatgaagattgttgctgttggaactgattccaaaggtaacattaacatcgaggagttgaggaaagctgctgaagcaaacaaggacaacttggctgctcttatggttacctatccttcgacccatggagtctatgaagaaggcattgatgagatatgcatgataattcatgagaacggtgggcaggtctacatggatggagctaacatgaatgctcaggtcggattgacaagccctggctttattggagcagatgtttgccaccttaaccttcacaagacattctgcattccacatggtgggggtggtcctggaatgggtcctattggtgttaagaagcacttagcaccatttttaccatctcatccagtgatcaccaccggtggcttccctctccctgagaaaaccgaccctcttggtaccatttctgctgccccatggggatcagcgttgattctaccaatttcctacacatacatagccatgatgggttctaagggtctcactgatgcttcaaagattgcaatcttgaatgcaaactacatgacaaagcgtctggagaaacactacccagttcttttccgtggagtcaatggaactgttgcccatgagttcattattgatttaagaggatttaagacgactgctggtatagagccagaggatgttgcaaagcgtttgatggactatggattccatgcacctactatgtcatggcctgttccaggcacacttatgattgaaccaactgaaagtgaaagcaaggccgaactagataggttctgtgatgctctaatctcaatcagggaagaaattgcagagatagaaagtggcaaagcagatgtgaacaacaacgtcctcaagagtgctcctcacccgccccaacttctgatgagcgactcatggactaagccgtactccagggagtatgctgcgttccctgcagcgtggcttcggggcgccaagttctggccaacaacatgtcgcgtggacaatgtgtacggggatcgcaacctcatctgcactctgcaacagggatcccaagtcgcagaagaagctgcagctgctaccgcatga

SEQ ID NO: 2929 - protein, 1031 aa, Oryza sativa
MERARRLANRALLRRLLAAATAESPAAPSRGISTLAKGSRPRAPPRPAPHQYTTGRRPVSASALQPSDTFPRRHNSATPAEQAAMASECGFGTVDALIDATVPAAIRAPEMRFSGRFDAGFTESEMIEHMQRLAAMNRAYKSFIGMGYYNTHVPAVILRNLMENPAWYTQYTPYQAEIAQGRLESLLNYQTMVADLTGLPMSNASLLDEATAAAEAMAMCNGILKSKKKTFLIASNCHPQTIDVCQTRAAGFDLNVVVADAKDFDYGSGDVCGVLVQYPGTEGEVLDYAEFVRDAHAHGVKVVMATDLLALTSLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPEGLKAIADRVHGLAGTFAQGLKKLGTVTVQELPFFDTVKVKVADANAIAQEACKNEMNLRVVDATTITVAFDETTTLEDVDKLFKVFNGGKPVNFTAESLAPEVSSSIPSSLVRKSPYLTHPIFNMYHTEHELLRYLYKLQSKDLSLCHSMIPLGSCTMKLNATVEMMPVTYPNFANMHPFAPTDQAAGYHEMFDDLGDLLCKITGFDSFSLQPNAGASGEYAGLMVIRAYHRARGDYHRDVCIIPVSAHGTNPASAAMCGMKIVAVGTDSKGNINIEELRKAAEANKDNLAALMVTYPSTHGVYEEGIDEICMIIHENGGQVYMDGANMNAQVGLTSPGFIGADVCHLNLHKTFCIPHGGGGPGMGPIGVKKHLAPFLPSHPVITTGGFPLPEKTDPLGTISAAPWGSALILPISYTYIAMMGSKGLTDASKIAILNANYMTKRLEKHYPVLFRGVNGTVAHEFIIDLRGFKTTAGIEPEDVAKRLMDYGFHAPTMSWPVPGTLMIEPTESESKAELDRFCDALISIREEIAEIESGKADVNNNVLKSAPHPPQLLMSDSWTKPYSREYAAFPAAWLRGAKFWPTTCRVDNVYGDRNLICTLQQGSQVAEEAAAATA

SEQ ID NO: 2930 - DNA, 2898 bp, Colwellia psychrerythraea
  CDS (1)..(2898): transl_table=11
atgacttcaaaaacaattgttaactcattagctgagttagagcaaactcaagattttatccgtcgccacattggccctagtgaatcagaaactcaagccatgttaaatgaccttggtgtagaatctgttgatgcgttaattgatgaaatcgtaccaagcgatattcgtcttgccgatcttccaaatgttgaagaaagtaaaactgaagtacaagcattggcagatttaaaagccgtagctagcttaaataaagtgaatgacacttatatcggtttaggttacttcggtaccttaacaccgaacgttattttacgtaacgtactagaaaatccaggttggtatacagcgtatacgccgtaccagccagaaattgctcaaggtcgtttagagtcattattaaactaccaacaaatgtgtatagaccttactggtctagagctagcttcagcttcattattagatgaaggtacagcagcagcagaagcaatggcattagccaaacgtgtttctaaaaacaaaaaatcaaacttattctttatctcagatgatgtttacccacaaacgattgacgttgttaagcaacgtgcagaaatgtttggttttgacattgttgttgctccagctgcagatgctgcagaacacgacattttcggcgcacttatccaataccctggcgcctcaggtcaagtaacagatgtaagtgaattgattgctaaaattcatgacaataaaggtattgttgcagtagctgctgacatcatgagcttagtattattgaagtctcctggtgaattaggcgcagatgctgtaattggttcaagccaacgctttggtgttccaatgggttacggtggtccacacgctgcattcttcacaacattagataaatacaaacgttcattgcctggtcgtattatcggtgtttcaaaagacacacgcggtaaaaacgcactacgtatggctatgcaaacacgtgagcaacatatacgtcgtgaaaaagccaactcaaacgtttgtacagcgcaagtattactagccaacatggcagcgttctacgcggtttaccacggtcctcaaggtttaaaaactattgctaaccgtattcaccgtttagctgacattttatgtttaggtacagcaactaaaggcttaacagctgttcatgctaactacttcgacacattaacgtttaacgttgataacaaagacgaaatcgttgctcgtgcattagctgctaacgctaacttccgcacagacgttgacggtcaaatctcaatcgcattagatgaaaccacaacacgtgaaaacgttgcacaactttttgatatcttattaggtgaaggtcacggtctaaacgtgagcgaccttgatgaccaaatcgttgcttcaggtcactcatcaattccagcgtcattagtacgtgagtcagcaatcttaactcacccagtatttaactcgtaccacagcgaaacagaaatgcttcgttatatcaaaagacttgaaaacaaagatttagcattgaaccactcaatgatttctttaggttcttgtacgatgaagttaaacgcaactgcacaaatgatcccagtatcatggcctgaatttgctaacatgcatccatttgcaccagttaaccaagcacaaggttacaaagcaatgattgatgagctagccaaatggttagtagagttaacgggctacgacaaaatgtcaatgcaacctaactcaggtgctcaaggtgaatacgctggcttaatcgctatcagcaagtatcacgaaagccgtggtgactcgcatcgtaacatttgtttaattccagcatctgctcacggtaccaacccagcatcagccatgatggttgatatgaaaattgttatcgttgcttgtgataaagaaggtaacgttgacatggccgacttaaaagcgaaagctgaagagttagcagacaaccttgcatgtatcatgatcacttacccgtctactcacggtgtatatgaaacaacgattgcagaaatctgtaacatcattcatgacaatggcggtcaagtttaccttgatggcgcgaacatgaacgcacaagtaggtttaacttctccaggtttcatcggtgctgatgtttctcaccttaacttgcacaaaacattcgctattccacatggcggcggcggcccaggtatgggacctatcggcgttaagtctcacttagcaccattcttgcctgatcatgcgttaattaacgtagatgaagcaactaaaggtaatggcgcggtttcatcagctcctttcggtagtgctagtattttacctatcacttacctttacattgccttgttaggtaaaaaaggtgttactgacgcgactaaatacgcaattactaacgctaactacgtatctaaaaaattaagcgaacattacccaattttatattcaggtaaaaacggccgtgttgctcatgagtgtattgttgatttacgtccgcttaaagcatcttcaggtgttactgaagttgatatggctaaacgcttaatggattacggtttccattctccaactatgtcgttcccagtagcgggcacgttcatgattgagccaacggaatcagaatctaaagttgagcttgaccgtttcatcgaagcaatggtttgtattcgtgatgaagtacgtaaagttgaatcaggtgagtgggcatcagataacaacccactacacaatgcaccacatacattagcggatattactgaaccatgggatcgtccttactcgattcaagaagcagtattcccggtagtagcagtaacggctaacaaattctggccaactgttaaccgtattgatgatgtattcggagacagaaacttaatttgttcatgtcctccaatcgaaagctatattgactag

SEQ ID NO: 2931 - protein, 965 aa, Colwellia psychrerythraea
MTSKTIVNSLAELEQTQDFIRRHIGPSESETQAMLNDLGVESVDALIDEIVPSDIRLADLPNVEESKTEVQALADLKAVASLNKVNDTYIGLGYFGTLTPNVILRNVLENPGWYTAYTPYQPEIAQGRLESLLNYQQMCIDLTGLELASASLLDEGTAAAEAMALAKRVSKNKKSNLFFISDDVYPQTIDVVKQRAEMFGFDIVVAPAADAAEHDIFGALIQYPGASGQVTDVSELIAKIHDNKGIVAVAADIMSLVLLKSPGELGADAVIGSSQRFGVPMGYGGPHAAFFTTLDKYKRSLPGRIIGVSKDTRGKNALRMAMQTREQHIRREKANSNVCTAQVLLANMAAFYAVYHGPQGLKTIANRIHRLADILCLGTATKGLTAVHANYFDTLTFNVDNKDEIVARALAANANFRTDVDGQISIALDETTTRENVAQLFDILLGEGHGLNVSDLDDQIVASGHSSIPASLVRESAILTHPVFNSYHSETEMLRYIKRLENKDLALNHSMISLGSCTMKLNATAQMIPVSWPEFANMHPFAPVNQAQGYKAMIDELAKWLVELTGYDKMSMQPNSGAQGEYAGLIAISKYHESRGDSHRNICLIPASAHGTNPASAMMVDMKIVIVACDKEGNVDMADLKAKAEELADNLACIMITYPSTHGVYETTIAEICNIIHDNGGQVYLDGANMNAQVGLTSPGFIGADVSHLNLHKTFAIPHGGGGPGMGPIGVKSHLAPFLPDHALINVDEATKGNGAVSSAPFGSASILPITYLYIALLGKKGVTDATKYAITNANYVSKKLSEHYPILYSGKNGRVAHECIVDLRPLKASSGVTEVDMAKRLMDYGFHSPTMSFPVAGTFMIEPTESESKVELDRFIEAMVCIRDEVRKVESGEWASDNNPLHNAPHTLADITEPWDRPYSIQEAVFPVVAVTANKFWPTVNRIDDVFGDRNLICSCPPIESYID

SEQ ID NO: 2932 - DNA, 2880 bp, Pseudomonas aeruginosa
  CDS (1)..(2880): transl_table=11
atgaccgataacctgaacctcggcgccatcgacctgggcaccgacgacgaattcatcgcccgccatatcggcccgcgcgccgccgacacacaggccatgctccagcgcttgggctacgactcgctggacacgctgatcggcaacgtgatcccggacagcatcaagggcagcagcgtgctcgacctgccggccggcatgggcgaggccgaggcgctggccagcctgaaggcgatcgccgcgcgcaatcgcgcgttgcgttccttcatcggccagggctactacaactgccacaccccggcaccgatcctgcgcaacctcctggagaacccggcctggtacaccgcctacacgccgtaccagccggaaatctcccagggccgcctggaggcgctgctgaacttccagaccctggtcagcgacctgtccggcctgccgatcgccaacgcctcgatgctcgacgaggcgaccgccgccgccgaggccatgaccttctgcaagcgcctgtcgaagaaccgcaccagccaggcattcttcgcctcccgccattgccacccgcagaccctcgacgtgctgcgcacccgtgccgagccgctgggcatcgaggtggtggtcggcgacgagagcaccatcgaagacttctccgcctacttcggcgcgttgctgcaataccccacctgcgacggcgagatcgtcgactaccgcgaactggtcagccgcttccatgcggtcgatgcgctggtcgcggtggccgccgacctgctggcgctgaccctgctgaccccgccgggcgagttcggcgccgacgtggccatcggcagcgcccagcgcttcggcgtgccgctcggcttcggcggcccgcacgcggcctatttcgccacccgcgacgccttcaagcgggacatgccgggacgcctggtcggcgtctccatcgaccgccacggcaagccggcctaccgcctggccatgcagacccgcgagcagcacatccgccgcgagaaagccaccagcaacatctgcaccgcccaggtgctgctggccaacatcgccagcatgttcgccgtctaccacggcccgcagggcctgctgcgcatcgcccggcgcacccaccggctgaccgcgatcctcgccgccggcctggagcgcctgggcgtggccgtcgagcagaagcatttcttcgacaccctgagcctggccaccggcgcgcgtaccgcggcgatccatgccaaggcccgcgccgccgggatcaacctgcgcgagatcgatgccggccgtctcggcctgtcgctcgacgagaccgtccgccagaccgatgtggagaccctctggggcttgctggccgaagagggccaggcgctcccggacttcgccgcccttgccgccagcagcggggaccgcctgccagtcgagctgctgcgccagtcggcgatcctcagccacccgatcttcaaccgccatcactcggaaaccgagctgatgcgctacctgcgcaagctggcggacaaggacctggcgctggaccgcacgatgatcccgctgggctcctgcaccatgaagctgaacgccgccagcgagatgatcccggtgacctgggccgaattcggcaacctgcacccgttcgccccggccgagcagagcgaaggctaccgccagctcaccgacgaactggaggcgatgctctgttccgccactggctacgacgccgtgtcgttgcagcccaacgccggctcccagggcgagtacgccggcctgctggcgatccgtgcctaccaccagagccgcggcgacagccagcgcgacatctgtctgatcccgtcctccgcccacggtaccaacccggctaccgccagcatggtcggcatgcgcgtggtggtggtggcctgcgacgcgcgcggcaacgtcgacgtcgaggacctgcgcaacaaggccagcgagcacaaggaacgcctggccgcgctgatgatcacctatccgtccacccacggcgtgttcgaggaagcgatccgcgagatctgcgccatcgtccacgactgcggtggccaggtgtacatcgacggcgccaacatgaacgccatggtcggcctgtgcgccccgggcaagttcggtggcgacgtttcccacctgaacctgcacaagaccttctgcatcccccacggcggcggcggcccgggcgtcggcccgatcggcgtgcgcgcgcacctggcgccgttcctccccggccacgctcgcggcgagcgcaaggaaggcgcggtgagcgcggcgccgtacggcagcgcaagcatcctgccgatcacctggatgtacatccgcatgatgggcggcgaaggcctcaagcgcgcctcggaaatggccatcctcaatgccaactacatcgcccatcgcctggaggagcactacccggtgctctacgccggcggcaacggcctggtcgcccacgaatgcatcctcgacctgcgtccgctcaaggacagcagcgggatcagcgtcgacgacgtggccaagcgcctgatggacttcggcttccatgcgccgaccatgtccttcccggtggccggcacgctgatgatcgagcccaccgagagcgagtcgaaggccgagctggatcgtttctgcgacgcgatgatccgcatccgcgaggaaatccgcgcggtggaacgcggcgagctggacaaggaagacaacccgctgaagaacgcgccgcacaccgccgccgaactgctcggcgaatggaaccacgcctacagccgcgagcaggccgcctatccgctggccagcctggtggaggccaagtactggccgccggtgggccgcgtcgacaacgtctacggcgaccgcaacctgacctgctcctgcccgcccatcgaggcgtacagcgaggagtga

SEQ ID NO: 2933 - protein, 959 aa, Pseudomonas aeruginosa
MTDNLNLGAIDLGTDDEFIARHIGPRAADTQAMLQRLGYDSLDTLIGNVIPDSIKGSSVLDLPAGMGEAEALASLKAIAARNRALRSFIGQGYYNCHTPAPILRNLLENPAWYTAYTPYQPEISQGRLEALLNFQTLVSDLSGLPIANASMLDEATAAAEAMTFCKRLSKNRTSQAFFASRHCHPQTLDVLRTRAEPLGIEVVVGDESTIEDFSAYFGALLQYPTCDGEIVDYRELVSRFHAVDALVAVAADLLALTLLTPPGEFGADVAIGSAQRFGVPLGFGGPHAAYFATRDAFKRDMPGRLVGVSIDRHGKPAYRLAMQTREQHIRREKATSNICTAQVLLANIASMFAVYHGPQGLLRIARRTHRLTAILAAGLERLGVAVEQKHFFDTLSLATGARTAAIHAKARAAGINLREIDAGRLGLSLDETVRQTDVETLWGLLAEEGQALPDFAALAASSGDRLPVELLRQSAILSHPIFNRHHSETELMRYLRKLADKDLALDRTMIPLGSCTMKLNAASEMIPVTWAEFGNLHPFAPAEQSEGYRQLTDELEAMLCSATGYDAVSLQPNAGSQGEYAGLLAIRAYHQSRGDSQRDICLIPSSAHGTNPATASMVGMRVVVVACDARGNVDVEDLRNKASEHKERLAALMITYPSTHGVFEEAIREICAIVHDCGGQVYIDGANMNAMVGLCAPGKFGGDVSHLNLHKTFCIPHGGGGPGVGPIGVRAHLAPFLPGHARGERKEGAVSAAPYGSASILPITWMYIRMMGGEGLKRASEMAILNANYIAHRLEEHYPVLYAGGNGLVAHECILDLRPLKDSSGISVDDVAKRLMDFGFHAPTMSFPVAGTLMIEPTESESKAELDRFCDAMIRIREEIRAVERGELDKEDNPLKNAPHTAAELLGEWNHAYSREQAAYPLASLVEAKYWPPVGRVDNVYGDRNLTCSCPPIEAYSEE

SEQ ID NO: 2934 - DNA, 2856 bp, Pseudomonas fluorescens
  CDS (1)..(2856): transl_table=11
atgaccgtcaacctgagcaccgccaacgaattcatcgcgcgccacatcggcccgcgccagggcgatgagcaagccatgctcaatagcctcggcttcgactccctggaagccctgagcgccagcgtgattcccgagagcatcaagggcaccagcgtgctggagctgggccacggcctgagcgaagcccaggccctggcctcgatcaaggccatcgccgccaggaaccagctgttcaagacctatatcggccagggctactacaactgccatacgccgtcgccgatcctgcgcaacctcctggaaaaccccgcctggtacaccgcctacaccccgtaccagccggaaatctcccagggtcgcctggaagccctgttgaatttccagaccctgatcagcgacctgagcggcctgccgatcgccaacgcctcgctgctggacgaaggcaccgccgccgccgaagccatgaccttctgcaagcgcctgagcaagaacaagggcagccacgccttcttcgcctcgcagcattgccacccacagaccctcgatgtgctgcgcacccgtgccgagcccctggggatcaacgtggtagtgggcgatgagcgcaagctgaccgacgtcagcccgttcttcggcgccctgctgcaatacccggcaagcaacggtgacctgttcgactaccgcgagctgaccgagcgtttccacgctgccaacgccctggtagccgtggccgccgacctgctggccctgaccctgctgaccccgcccggggaattcggcgccgacgtggccatcggcagtgcccagcgcttcggcgtgcccctgggctttggtggcccgcatgcggcctacttcgccacccgcgatgccttcaagcgcgacatgcccggccgcctggtgggcgtctcggtggaccgtttcggcaagccggccctgcgcctggccatgcagacccgcgagcagcatatccgccgcgagaaggccaccagcaacatctgcaccgcccaggtcctgttggccaacatcgccagcatgtatgccgtgtaccacggtcccaagggcctgacccagatcgcccagcgcattcaccagctgaccgcgatcctggccaagggcctggtccagctgggcttgaccgtggagcaggaaagcttcttcgataccctgagcctgcacaccgctggccgcaccgctgcgctgcacgacaaggctcgcgcccagggcatcaacctgcgggtgatagacgccgagcgcctgggtctgtccctggatgaaaccaccactcaagccgacgttgaaaccctgtggagcctgctggccgacggcaagcccgcacccgacttcgcggcactcgcggcggcggtcaccagcggcatccccgcggccctggcacgccagtcggcgatcctcagccacccggtgttcaaccgctatcactcggaaaccgagctgatgcgctacctgcgcaagctggcggacaaggacctggccctggatcgcaccatgatcccgctgggctcctgcaccatgaagctcaacgccgccagcgagatgatccccatcacctgggccgagttcggcgcgctgcaccccttcgctcccgccgagcaaagcgctggctaccagcaactgaccaccgaacttgaagcgatgctctgcgccgccaccggctacgacgcggtgtcgctgcagcccaacgccggctcccagggcgagtacgccggcctgctggccattcgtgcctatcaccagagccgtggcgacgagcgccgcgatatctgcctgattccctcctcggcccacggcaccaacccggccaccgccaacatggccggcatgcgcgtggtggtcaccgcctgcgacgcccgcggcaacgtcgacatcgaggacctgcgggccaaggccatcgagcaccgcgagcacctcgccgcgctgatgatcacctacccgtcgacccacggcgtgttcgaagaaggcatccgcgaaatctgcggcatcattcacgacaacggcggccaggtgtacatcgacggcgccaacatgaacgccatggtcggtctctgcgcgccgggcaagttcggtggcgacgtgtcgcacctgaacctgcacaagaccttctgcattccccacggcggtggcggcccgggcgtcggcccgatcggcgtcaagtcgcacctggcgcccttcctgcccggccatgccgcgctggaaaacaagaaaggcgcggtctgtgccgctccgttcggcagcgccagcatcctgccgatcacctggatgtatatcagcatgatgggcggcgccggcctcaagcgcgcctcgcagttggcgatcctcaatgccaactacatttcgcgccgcctggaagagcactacccggtgctctacaccggtagcaacggcctggtggcccacgaatgcatcctcgacctgcgtcctttgaaagacagcagcggcatcagcgtggacgacgtggccaagcgcctgatcgattttggcttccacgcgccgaccatgtccttcccggtggccggcaccctgatgatcgagcccaccgaaagcgaatccaaggaagaactggaccgcttctgcgacgccatgatccgcatccgcgaagaaatccgcgcagtggaaaacggcgccctggacaaggacgacaacccgctgaagaacgctccgcacaccgcggccgaactggtgggcgagtggtcccatccatacagccgtgaacaggcggtgtacccagtggcatccctggtggaaggcaagtactggccgccggttggccgggtcgacaacgtgttcggcgaccgcaatctggtgtgcgcctgcccttcgatcgagagctaccaggacgcgtaa

SEQ ID NO: 2935 - protein, 951 aa, Pseudomonas fluorescens
MTVNLSTANEFIARHIGPRQGDEQAMLNSLGFDSLEALSASVIPESIKGTSVLELGHGLSEAQALASIKAIAARNQLFKTYIGQGYYNCHTPSPILRNLLENPAWYTAYTPYQPEISQGRLEALLNFQTLISDLSGLPIANASLLDEGTAAAEAMTFCKRLSKNKGSHAFFASQHCHPQTLDVLRTRAEPLGINVVVGDERKLTDVSPFFGALLQYPASNGDLFDYRELTERFHAANALVAVAADLLALTLLTPPGEFGADVAIGSAQRFGVPLGFGGPHAAYFATRDAFKRDMPGRLVGVSVDRFGKPALRLAMQTREQHIRREKATSNICTAQVLLANIASMYAVYHGPKGLTQIAQRIHQLTAILAKGLVQLGLTVEQESFFDTLSLHTAGRTAALHDKARAQGINLRVIDAERLGLSLDETTTQADVETLWSLLADGKPAPDFAALAAAVTSGIPAALARQSAILSHPVFNRYHSETELMRYLRKLADKDLALDRTMIPLGSCTMKLNAASEMIPITWAEFGALHPFAPAEQSAGYQQLTTELEAMLCAATGYDAVSLQPNAGSQGEYAGLLAIRAYHQSRGDERRDICLIPSSAHGTNPATANMAGMRVVVTACDARGNVDIEDLRAKAIEHREHLAALMITYPSTHGVFEEGIREICGIIHDNGGQVYIDGANMNAMVGLCAPGKFGGDVSHLNLHKTFCIPHGGGGPGVGPIGVKSHLAPFLPGHAALENKKGAVCAAPFGSASILPITWMYISMMGGAGLKRASQLAILNANYISRRLEEHYPVLYTGSNGLVAHECILDLRPLKDSSGISVDDVAKRLIDFGFHAPTMSFPVAGTLMIEPTESESKEELDRFCDAMIRIREEIRAVENGALDKDDNPLKNAPHTAAELVGEWSHPYSREQAVYPVASLVEGKYWPPVGRVDNVFGDRNLVCACPSIESYQDA

SEQ ID NO: 2936 - DNA, 2853 bp, Pseudomonas fluorescens
  CDS (1)..(2853): transl_table=11
atgacccaagtaaatctcggcactgccaacgaattcatcgcccgtcacatcggcccgcgcgccggtgacgagcaagccatgctcaacagcctcggcttcgactcgctcgaagccctgagcgccagcgtcatcccggaaagcatcaagggcaccagcgtgctcggtctggacgacggcctgagcgaagccgatgccctggcaatgatcaaaggcatcgccggcaagaatcaattgttcaagacctacatcggccagggttactacaactgccacacgccgtcgccgatcctgcgcaacctgctggaaaacccggcctggtacaccgcttacactccgtaccagccagaaatttctcagggccgtctcgaagcgctgctgaacttccagaccctgatcagcgacctcaccggcctgccgatcgccaacgcttccctgctcgacgaagctaccgccgctgccgaagccatgaccttctgcaaacgcctgagcaagaacaagggcagccaccagttcttcgcctcgatccacagccacacgcaaactcttgacgtgctgcgcacccgtgccgagccactgggcatcgacgtggtggtgggcgatgagcgcgaactgaccgacgtgacgccgttcttcggcgcactgctgcaatacccggccagcaacggcgatgtgttcgactaccgcgaactgaccgaacgcttccacgctgccaacgcactggtcgccgtggccgctgacctgctggccctgaccctgctgactccgccgggcgaattcggcgcagacgtggccatcggcagcgcgcaacgcttcggcgtgccgctgggcttcggtggcccgcacgcggcttatttctccaccaaagatgcgttcaagcgcgacatgccgggccgtctggtcggtgtttcggttgaccgcttcggcaagccggccctgcgtctggcgatgcagacccgcgagcaacacatccgccgcgagaaagccacgtcgaacatctgcaccgcacaagtgctgctggccaacatcgccagcatgtatgccgtgtatcacggcccgaaaggcctgacccagatcgccaaccgcgtgcatcacctgaccgcgattctggccaagggcctgagcgcactgggcgtgaccgtcgaacaaaccagcttcttcgacaccctgaccctggccaccggcgcacaaaccgccgcgctgcatgacaaggctcgcgctcaacagatcaacctgcgtgtgatcgacgctcagcgtctgggcctgtcggtcgacgaaaccaccacccaggccgacatcgaaaccctgtggggcctgttcgccgacggcaagactctgccggatttcgctgcgctggccgctgccgcgcaaagcacgattccggcttcgctggttcgtcagtcgccgatcctcagccacccggtgttcaaccgctatcactcggaaaccgagctgatgcgctacctgcgcaaactggcggacaaggatctggcgctggatcgcaccatgatcccgctgggctcgtgcaccatgaaactcaacgccgccagcgaaatgatcccggtgacctgggccgaattcggcgccctgcacccgttcgccccggccgagcaaagcgccggttaccagcaactgaccgacgagctggaagcaatgctctgcgccgccaccggttacgactcgatctcgctgcaaccgaacgctggttcccagggtgagtacgcaggtctgctggcgattcgcgcctatcaccagagccgtggcgaagaccgtcgcgacatctgcctgatcccgtcgtccgcccacggcaccaacccggcgaccgccaacatggccggcatgcgcgtggtcgtgaccgcgtgcgacgcccgtggcaacgtggacatcgaagacctgcgcgccaaggccatcgagcaccgcgaacacctcgcggcgctgatgatcacctacccgtcgacccacggcgtgttcgaagaaggcatccgcgaaatctgcggcatcattcatgacaacggcggccaggtgtacatcgacggcgccaacatgaacgcgatggtcggcctctgcgcaccgggcaagttcggcggcgacgtctcgcacctgaacctgcacaagactttctgcatcccgcacggcggtggcggcccgggcgtcggcccgatcggcgtgaaatcgcacctgaccccgttcctgccgggccacggccacatggaacgcaaggaaggcgcggtctgcgcagcaccgttcggcagcgcgagcattctgccgatcacctggatgtacattcgcatgatgggtggcgcaggcctgaagcgcgcttcgcaactggcgatcctcaatgccaactacatctcccgtcgcctggaagagcactacccagtgctgtacaccggcagcaacggtctggtggcgcacgagtgcatcctcgatctgcgtcccttgaaagacagtagcggcatcagcgtcgatgacgtcgccaagcgtctgatcgacttcggtttccacgccccgaccatgtcgttcccggtggccggcacgctgatgatcgagccgaccgaaagtgaatccaaggaagaactggaccgtttctgcgacgccatgatccgcatccgcgaagaaatccgcgcggtggaaaacggcacgctggacaaggacgacaacccgctgaagaacgctccgcacaccgcagcggaactggtcggcgagtggactcacccgtacagccgcgaacaagcggtgtacccggtggcgtcgttgatcgaaggcaagtactggccgccggtcggtcgcgtcgacaacgtgttcggcgaccgcaacctggtctgcgcctgcccgtcgatcgaaagctacgcttaa

SEQ ID NO: 2937 - protein, 950 aa, Pseudomonas fluorescens
MTQVNLGTANEFIARHIGPRAGDEQAMLNSLGFDSLEALSASVIPESIKGTSVLGLDDGLSEADALAMIKGIAGKNQLFKTYIGQGYYNCHTPSPILRNLLENPAWYTAYTPYQPEISQGRLEALLNFQTLISDLTGLPIANASLLDEATAAAEAMTFCKRLSKNKGSHQFFASIHSHTQTLDVLRTRAEPLGIDVVVGDERELTDVTPFFGALLQYPASNGDVFDYRELTERFHAANALVAVAADLLALTLLTPPGEFGADVAIGSAQRFGVPLGFGGPHAAYFSTKDAFKRDMPGRLVGVSVDRFGKPALRLAMQTREQHIRREKATSNICTAQVLLANIASMYAVYHGPKGLTQIANRVHHLTAILAKGLSALGVTVEQTSFFDTLTLATGAQTAALHDKARAQQINLRVIDAQRLGLSVDETTTQADIETLWGLFADGKTLPDFAALAAAAQSTIPASLVRQSPILSHPVFNRYHSETELMRYLRKLADKDLALDRTMIPLGSCTMKLNAASEMIPVTWAEFGALHPFAPAEQSAGYQQLTDELEAMLCAATGYDSISLQPNAGSQGEYAGLLAIRAYHQSRGEDRRDICLIPSSAHGTNPATANMAGMRVVVTACDARGNVDIEDLRAKAIEHREHLAALMITYPSTHGVFEEGIREICGIIHDNGGQVYIDGANMNAMVGLCAPGKFGGDVSHLNLHKTFCIPHGGGGPGVGPIGVKSHLTPFLPGHGHMERKEGAVCAAPFGSASILPITWMYIRMMGGAGLKRASQLAILNANYISRRLEEHYPVLYTGSNGLVAHECILDLRPLKDSSGISVDDVAKRLIDFGFHAPTMSFPVAGTLMIEPTESESKEELDRFCDAMIRIREEIRAVENGTLDKDDNPLKNAPHTAAELVGEWTHPYSREQAVYPVASLIEGKYWPPVGRVDNVFGDRNLVCACPSIESYA

SEQ ID NO: 2938 - DNA, 2856 bp, Pseudomonas putida
  CDS (1)..(2856): transl_table=11
atgaccatcaacctcggcaccgccaacgaattcatcgcccgtcacataggcccgcgcgccgctgacgaacaggccatgctcactgcactgggcttcgactcgctggacgccatgaccgctgcggtcatccccgacagcatcaaaggtaccagcgtgcttggctcgcacgacggccagagcgaggccgacgcgctcgctgcgctcaaggccatcgctggcaagaaccagctgttcaaaagctacatcggccagggctactacaacacccacactccggcaccgatcctgcgcaacctgctggaaaacccggcctggtacaccgcctacaccccgtatcagccagaaatttcccaaggccgcctggaagcactgctgaacttccagaccctgatcagcgacctcaccggcctgccgatcgccaacgcctccttgctcgacgaagccactgctgcggccgaggccatgaccttctgcaagcgcctgtcgaagaacaagtccagccatgccttcttcgcctccgtgcactgtcacccgcaaaccctcgacgtgctgcgcacccgtgccgagccgctgggtatcgaggttgtggttggcgacgagcgcgagctgggcgatgtcagcgccttcttcggcgccctgctgcaatacccggccagcaacggtgaagtgttcgactaccgcgaggtcgtgcagcgcttccacgcggccaacgccctggtcgccgtagcggcagacctgctggccctgaccctgctgaccccaccgggcgagttcgacgccgacgtggccatcggcagcgcccagcgcttcggcgtgccactgggcttcggtggtccgcacgcggcttacttcgccacccgcgacgcgttcaagcgcgacatgcctggccgcctggtcggcgtgtcgatcgaccgcttcggcaaaaccgccctgcgtctggccatgcagacccgcgagcagcacatccgccgcgaaaaggccaccagcaacatctgcaccgcccaggtgctgctggccaacatcgccagcatgttcgccgtgtaccacggccctgccggtctcaagcgcattgccgagcgcacccacgccctgaccgcgatcctcgccgccggcctgaaggcgctgggcgtacaagtggtgggcgccagcgccttcgataccctgaccctggccaccggcactgccaccgccagcctgcatgacaaggcacgcgcccagggcatcaacctgcgccagatcgatgccgcccatgtgggcctgtctctggacgaaaccagcactcaggctgacgtcgagtcgctgtggcagctgttgggtggcgagcaggcacagcctgatttcaccgcactggccgccagcaccggttccctgctgcctgccgccctgctgcgccagtcggccatcctcgaacacccggtgttcaaccgctaccacagcgaaaccgagctgatgcgctacctgcgccgcctggccgacaaggacctggcgctggaccgcagcatgatcccgctgggctcgtgcaccatgaagctgaacgccgccagcgaaatgatcccggtcacctgggccgagttcggcaacctgcacccgttcgccccggccgagcagagccagggctacctgcagatgaccaccgaactggaggccatgctgtgcgcggccactggctatgatgccgtgtcgctgcagcccaacgccggctcgcagggcgaatacgccgggctgttggcgatccgcgcctaccaccgcagccgtggtgaaggccatcgcgatatctgcctgatcccgtcgtcggcccatggcaccaacccggccaccgcacacatggctggcatgcgtgtcgtggttaccgcctgtgacgcccgtggcaacgtcgatgtcgaggacctgcgcgccaaagccatcgagcaccgcgagcgcctggctgcaatcatgatcacctacccgtcgacccacggcgtgttcgaggaagcgatcggcgaaatctgcgcgatcatccacgacaacggcggccaggtgtacatcgatggcgccaacatgaacgccatggtcggactgtgcgcgccaggcaagttcggcggcgacgtttcccacctgaacctgcacaagaccttctgcatcccgcacggtggtggtggcccgggtgttggcccgattggcgtcaagtcgcacctggcgccgttcctgccaggccatgcacagctggaaaacacccagggcgcggtatgcgctgcgccgttcggtagcgccagcatcctgcccatcacatggatgtatatccgcatgatgggcggtgccggcctcaaacgtgcctcgcagatggcaatcctcaacgccaactacatcgcccgccgcctggaagagcactatcctgttctgtataccggcggtaacggcctggtggctcacgagtgcattctcgacctgcgcccactgaaggacaccagcggcatcagtgtcgacgacgtggccaagcggttgatcgacttcggcttccacgccccgaccatgtccttcccggtggctggcacgctgatgatcgaaccgaccgaaagcgagtccaaagaagaactggaccgcttctgcaacgcaatgatccagatccgcgaagaaatccgcgcggtggaggacggtagcctggacaaggacgacaacccgctgaaaaacgcaccgcacactgcggctgagctggttggcgaatggacccatggctacagccgcgagcaggcggtataccccctggcgagcctggtggaaggcaagtactggccgccggtcggccgggtcgacaacgtgttcggcgaccgcaacctggtgtgcgcctgcccgtcgatcgagagctatcaggacgcctga

SEQ ID NO: 2939 - protein, 951 aa, Pseudomonas putida
MTINLGTANEFIARHIGPRAADEQAMLTALGFDSLDAMTAAVIPDSIKGTSVLGSHDGQSEADALAALKAIAGKNQLFKSYIGQGYYNTHTPAPILRNLLENPAWYTAYTPYQPEISQGRLEALLNFQTLISDLTGLPIANASLLDEATAAAEAMTFCKRLSKNKSSHAFFASVHCHPQTLDVLRTRAEPLGIEVVVGDERELGDVSAFFGALLQYPASNGEVFDYREVVQRFHAANALVAVAADLLALTLLTPPGEFDADVAIGSAQRFGVPLGFGGPHAAYFATRDAFKRDMPGRLVGVSIDRFGKTALRLAMQTREQHIRREKATSNICTAQVLLANIASMFAVYHGPAGLKRIAERTHALTAILAAGLKALGVQVVGASAFDTLTLATGTATASLHDKARAQGINLRQIDAAHVGLSLDETSTQADVESLWQLLGGEQAQPDFTALAASTGSLLPAALLRQSAILEHPVFNRYHSETELMRYLRRLADKDLALDRSMIPLGSCTMKLNAASEMIPVTWAEFGNLHPFAPAEQSQGYLQMTTELEAMLCAATGYDAVSLQPNAGSQGEYAGLLAIRAYHRSRGEGHRDICLIPSSAHGTNPATAHMAGMRVVVTACDARGNVDVEDLRAKAIEHRERLAAIMITYPSTHGVFEEAIGEICAIIHDNGGQVYIDGANMNAMVGLCAPGKFGGDVSHLNLHKTFCIPHGGGGPGVGPIGVKSHLAPFLPGHAQLENTQGAVCAAPFGSASILPITWMYIRMMGGAGLKRASQMAILNANYIARRLEEHYPVLYTGGNGLVAHECILDLRPLKDTSGISVDDVAKRLIDFGFHAPTMSFPVAGTLMIEPTESESKEELDRFCNAMIQIREEIRAVEDGSLDKDDNPLKNAPHTAAELVGEWTHGYSREQAVYPLASLVEGKYWPPVGRVDNVFGDRNLVCACPSIESYQDA

SEQ ID NO: 2940 - DNA, 3114 bp, Arabidopsis thaliana
  CDS (1)..(3114)
atggagcgcgcaaggagacttgcttacagaggaatcgtcaaacgtctcgttaacgacacaaaacgacaccgtaacgctgaaacacctcaccttgttcctcacgctccggcgaggtatgtctcttccctttcccctttcatctccacccctcgatctgtcaaccacacggcggctttcgggaggcaccagcagacgcgttccatctccgtcgatgctgttaaacccagcgatactttccctcgtcgtcacaactctgcaacaccagacgaacaaacccacatggctaaattctgtggctttgaccatatcgattcactcatcgatgctacggtgcccaaatcgattcgattagattccatgaagttctccaaattcgacgctggtttaaccgagagccaaatgattcaacacatggttgatttagcttccaagaacaaggttttcaaatccttcatcgggatgggttactacaacactcatgtccctactgtcattctccgtaacatcatggagaatccagcttggtacactcaatacactccttatcaagctgagatctctcaaggtcgtctcgaatcgctcctcaatttccagaccgtgatcacagatctcacgggtcttcctatgtccaatgcgtcgcttctggatgaaggcactgctgctgcggaggcaatggccatgtgtaacaacattcttaagggtaaaaagaagacctttgtcattgctagtaactgtcaccctcagactattgatgtttgtaagactagagctgatgggtttgatttgaaagttgtcacctctgatcttaaggatatagattacagctctggtgatgtttgtggggttcttgttcagtatcctggtactgaaggtgaagtcttggattatgctgagtttgttaagaatgctcatgctaatggtgttaaggttgtgatggctacggatttgctggctttgactgtgttgaaacctcctggagaatttggggcggatattgttgttggctctgctcaaaggtttggtgttccgatgggttatggtggtcctcatgctgcgttcttggctacttcacaagagtataagagaatgatgcctgggaggattattggtattagtgttgattcttcaggaaagcaagctctgcgtatggctatgcagactagagaacagcatattaggagggacaaagccactagcaacatctgtactgctcaagcgttgcttgccaacatggctgccatgtatgctgtttaccatggacctgcaggtctaaaatctattgcccagcgtgtccatggtctcgctggtatattttccttagggttgaacaagcttggggttgcagaagttcaagaacttcctttctttgacactgttaaaattaagtgttcggatgcacatgcaattgctgatgcagcttccaaaagtgaaattaatctgcgtgttgtggactcaaccactattactgcttcctttgacgaaacaaccaccttggatgatgtcgataaacttttcaaagtttttgcttctggcaagcctgttccatttacggctgaatctctagcacccgaggttcagaattccattccttctagcctaacaagagagagtccttatcttacccacccaatcttcaacatgtaccacacagagcatgagttgcttaggtacatccacaagttacagtcaaaggatctatcactgtgccacagcatgattccgttgggatcttgtacgatgaaactaaatgcaacaactgaaatgatgccagtcacatggccaagtttcactgacattcacccttttgctcctgttgaacaagcacaaggttatcaggaaatgttcgaaaatttgggtgacctcttgtgtacgatcactgggtttgactctttctcgttgcaacctaatgctggtgctgctggtgagtatgccgggcttatggttatccgcgcatatcacatgtcaagaggagatcatcaccgtaatgtgtgtatcatacctgtctctgcacacggtacaaaccctgcaagtgctgctatgtgcgggatgaaaattattacagttggaactgatgctaagggaaacattaacattgaggaggtgagaaaagctgcagaagccaacaaagacaacttagctgctcttatggttacatacccttcaactcatggagtctatgaagagggcatcgacgagatttgcaacataatacacgaaaatggaggtcaagtgtacatggatggtgccaacatgaatgcacaggttggtttgacgagccctggttttattggagcggatgtgtgccatctcaatctccacaagaccttctgtattcctcatggaggtggtggtcctggtatgggtcccattggtgtgaagaatcatttggcaccatttcttccttctcaccccgtgataccgactggtggtatcccacaacccgagaagacagcacctttgggtgcaatatccgctgcaccatggggatctgcgcttatcttgcctatatcttatacttacattgccatgatgggatctggtgggctcactgatgcctctaagattgcaattttgaatgccaattacatggcaaagcgcctagagaaacactacccagttcttttccgtggtgttaacggaacagtagcacacgaattcatcatagacttgagaggcttcaagaacactgctggaatagaaccagaggatgtggcgaaacggctaatggactatggattccatggacccacaatgtcttggcctgtccctggaactcttatgattgagccaaccgagagtgaaagcaaggcggagctagacaggttctgcgatgctctcatttcaatcagggaagaaattgcacagattgaaaaaggaaatgcagatgtccagaacaacgttctcaagggagctccacatcccccatcgttgctaatggcagacacatggaaaaagccgtattctcgagagtatgctgctttccctgcgccttggctccgctcctccaagttctggcccaccacagggcgtgtggacaatgtatatggagacaggaaactggtgtgcactctcctcccagaggaagaacaagtcgcagctgcagtgtctgcttga

SEQ ID NO: 2941 - protein, 1037 aa, Arabidopsis thaliana
MERARRLAYRGIVKRLVNDTKRHRNAETPHLVPHAPARYVSSLSPFISTPRSVNHTAAFGRHQQTRSISVDAVKPSDTFPRRHNSATPDEQTHMAKFCGFDHIDSLIDATVPKSIRLDSMKFSKFDAGLTESQMIQHMVDLASKNKVFKSFIGMGYYNTHVPTVILRNIMENPAWYTQYTPYQAEISQGRLESLLNFQTVITDLTGLPMSNASLLDEGTAAAEAMAMCNNILKGKKKTFVIASNCHPQTIDVCKTRADGFDLKVVTSDLKDIDYSSGDVCGVLVQYPGTEGEVLDYAEFVKNAHANGVKVVMATDLLALTVLKPPGEFGADIVVGSAQRFGVPMGYGGPHAAFLATSQEYKRMMPGRIIGISVDSSGKQALRMAMQTREQHIRRDKATSNICTAQALLANMAAMYAVYHGPAGLKSIAQRVHGLAGIFSLGLNKLGVAEVQELPFFDTVKIKCSDAHAIADAASKSEINLRVVDSTTITASFDETTTLDDVDKLFKVFASGKPVPFTAESLAPEVQNSIPSSLTRESPYLTHPIFNMYHTEHELLRYIHKLQSKDLSLCHSMIPLGSCTMKLNATTEMMPVTWPSFTDIHPFAPVEQAQGYQEMFENLGDLLCTITGFDSFSLQPNAGAAGEYAGLMVIRAYHMSRGDHHRNVCIIPVSAHGTNPASAAMCGMKIITVGTDAKGNINIEEVRKAAEANKDNLAALMVTYPSTHGVYEEGIDEICNIIHENGGQVYMDGANMNAQVGLTSPGFIGADVCHLNLHKTFCIPHGGGGPGMGPIGVKNHLAPFLPSHPVIPTGGIPQPEKTAPLGAISAAPWGSALILPISYTYIAMMGSGGLTDASKIAILNANYMAKRLEKHYPVLFRGVNGTVAHEFIIDLRGFKNTAGIEPEDVAKRLMDYGFHGPTMSWPVPGTLMIEPTESESKAELDRFCDALISIREEIAQIEKGNADVQNNVLKGAPHPPSLLMADTWKKPYSREYAAFPAPWLRSSKFWPTTGRVDNVYGDRKLVCTLLPEEEQVAAAVSA

SEQ ID NO: 2942 - DNA, 2871 bp, Colwellia psychrerythraea
  CDS (1)..(2871): transl_table=11
atgactaacaataatttattagcacaactgaatgataacttagattttatcagtcgacataatggccctgatcgaacccaacaacagcatatgttagacacgctgaaagtagactctatcgaacaaatgatcgataaaacagtacccgataatattcgccttttgcagccaatggcattagcaaaaccgcaaagcgaaattgaaatgttagctacactcaaaggtatagcgtcaaaaaacaaagtaaacagaagttatattggacaagggtattatgatacccatgtccctcacgttattttacgtaatgtcttcgaaaaccctggctggtataccgcttatacgccttatcagccagaaatttcacaaggtcgtttagaagcactgcttaattttcaacaaatgatcacagatcttaccgcaatggaattatccaatgcgtctttgctagatgaagccactgcagctgcagaagcaatgagcttatgtaagcgtgccagtaaaaataaaagtaatgtcttttttgttagtgacgatgttcacccgcaaacattagacgtcatcaatacccgagcaaagtatttctcttttgaggttgtggtagccccctgctcagaactagaaaatcatgatgtgtttggcgctttgttgcaatatcccggcacaacaggacaagtacataatttagaaaaaatcatagaacaagcccatagcaaaaaaaccttagttgcagttgccgctgacttactggcgttaaccgtacttaaagcccctggcgaaatgggcgcggatgttgttataggtagtgctcaacgctttggcgttccaatgggttacggtggtccacatgctgcattcatggccactaaagaaaagtataaacgtaccatccctggtcgagttattggtgtttcaattgactcaaagggtaaacctgctttacgtatggcgatgcaaactcgagaacaacatattaggcgagaaaaagccaattcgaatatttgtaccgcgcaagcattacttgccaatatggcatcattttatgccgtatatcatggcccgcaagggttgcgaaaaatgggtcgacgcgtgaatcgtttaacatcagtgctcgctgcaggtttgcaaaaagcaggtattgaactggtccataatgatttcttcgatacgattaccctacaaacaaatgaaaaaactgatgctatttatcaacgcgcattagctgcagaccttaatttgcgcttattacctgatcaacttggtatcagtttagatgaaaccacaacgtctgctgacgttgaagcattatggttagccattactgaacaatcttttaacgtcgatgatattgaacaaacactaagtgcagagttttgtaacatacctgcagattgtcagcgtactagtgagtatttaagtcacccagtgtttaatagttatcacagtgaaacacgtatgttgcgttatttaaaaagtcttgaaaataaagacttttcattaactcacggcatgataccgctgggctcttgtacaatgaaactcaatgctaccgcgcaaatgatccctgttacctggcctgaattttcacgcatgcacccttttgcaccaagcgatcaatgtacaggatatgaaaccttagctgaaagctttagcgacatgctaatagaaatcactggatatgacgctttttcattacagccaaactctggtgcgcaaggtgaatatgccggacttatcgccattcaacgttaccacgcctctcgcggtgaagattatcgaaatatctgcttaattcctagctctgcacacggtactaaccctgccagtgcttccatggtatcaatgcgtattgtgctggttaattgtgataaagaaggcaatgttgacctagatgatttgaaggaaaaaataaaccttcatcgtgatcaactctctgcaatgatgatcacttatccttcaacacatggcgtttatgaagaaagcatcaaagaaatttgcgagcttattcacgaagctggtggtcaagtttatcttgatggtgccaatatgaatgctcaagtagggttaacttcgcctggtttcattggcgctgatgtctctcatctcaacctacataaaacattttgtattccgcacggcggcggtggcccaggtatgggacctataggtgttaaatcacacttagccgactttttgccagggcacagtgttactaatacagtaggcgcagtatcagcaaccgcactaggtagtgcttctattttacctatttcttgggcctacattgctttaatgggcgctgaaggactaaaatcagccactgagctcgctattttaaatgctaactacattatggaaaaactcagcccgcactaccctatattattcagaggtaagcaaggacgtgttgctcatgaatgtattattgacctcagaccattgaaagagtcttccggtatcagtgaagaagatgttgcgaaacgtttaatggattttggctttcatgcaccaaccatgtcatttcctgtcgctggcaccttgatgattgaaccaactgagagtgagtctttagaagaattagataaatttattgatgcactgattacgattcgccatgaaatagcgaaagttgaagagggaacttggacacttgccgataacccactagtcaatgcacctcacacattaaacgatctgaccggtagtgactggcctcgtgcttattcacgcttaaccgcttgttatccgagtagttgtccgagccaaccaaaattttggccaacaactaaccgtattgacaatgtctacggggatcgaaacctaatttgtagctgtcctccgattgagagctaccaatcaactgatacataa

SEQ ID NO: 2943 - protein, 956 aa, Colwellia psychrerythraea
MTNNNLLAQLNDNLDFISRHNGPDRTQQQHMLDTLKVDSIEQMIDKTVPDNIRLLQPMALAKPQSEIEMLATLKGIASKNKVNRSYIGQGYYDTHVPHVILRNVFENPGWYTAYTPYQPEISQGRLEALLNFQQMITDLTAMELSNASLLDEATAAAEAMSLCKRASKNKSNVFFVSDDVHPQTLDVINTRAKYFSFEVVVAPCSELENHDVFGALLQYPGTTGQVHNLEKIIEQAHSKKTLVAVAADLLALTVLKAPGEMGADVVIGSAQRFGVPMGYGGPHAAFMATKEKYKRTIPGRVIGVSIDSKGKPALRMAMQTREQHIRREKANSNICTAQALLANMASFYAVYHGPQGLRKMGRRVNRLTSVLAAGLQKAGIELVHNDFFDTITLQTNEKTDAIYQRALAADLNLRLLPDQLGISLDETTTSADVEALWLAITEQSFNVDDIEQTLSAEFCNIPADCQRTSEYLSHPVFNSYHSETRMLRYLKSLENKDFSLTHGMIPLGSCTMKLNATAQMIPVTWPEFSRMHPFAPSDQCTGYETLAESFSDMLIEITGYDAFSLQPNSGAQGEYAGLIAIQRYHASRGEDYRNICLIPSSAHGTNPASASMVSMRIVLVNCDKEGNVDLDDLKEKINLHRDQLSAMMITYPSTHGVYEESIKEICELIHEAGGQVYLDGANMNAQVGLTSPGFIGADVSHLNLHKTFCIPHGGGGPGMGPIGVKSHLADFLPGHSVTNTVGAVSATALGSASILPISWAYIALMGAEGLKSATELAILNANYIMEKLSPHYPILFRGKQGRVAHECIIDLRPLKESSGISEEDVAKRLMDFGFHAPTMSFPVAGTLMIEPTESESLEELDKFIDALITIRHEIAKVEEGTWTLADNPLVNAPHTLNDLTGSDWPRAYSRLTACYPSSCPSQPKFWPTTNRIDNVYGDRNLICSCPPIESYQSTDT

SEQ ID NO: 2944 - DNA, 2877 bp, Pseudomonas aeruginosa
  CDS (1)..(2877): transl_table=11
atgtcgcagacgccgtccctcgcccagctccagcccgccgatgccttcctgcgccgccatctcggccccgatcctgcggaacagcaggccatgctggccttcctcggagtttccactcgcgccgaactgatcgtgcagacggtgccgccggcgatccgcctcaaccggccgctggaactgcccgccgcgctcgacgaacaggccgccctggcgcgcctgcgcggctacgccgggctcaaccagcgctggaccagcctgatcggcatgggctactacggcaccgtgacgccgtcggtgatcctccgcaacgtgctggagaatcccggctggtacaccgcctatacgccctaccagccggaaatcgcccagggccgcctggaagcgctgctgaatttccagcaactgaccatcgacctcaccggactcgacctggccagcgcctcgctgctcgacgaagccaccgccgccgccgaggccatggccctggccaggcgggtggcaaaggccaggagcaaccggttcttcgtcgatgcgcattgccatccgcagaccgtttcggtgttgcgtacccgcgccgaggcgttcggtttcgagctggtcgtcgacgagccggacaatcttgccgcccacgcggtgttcggcgccttgctgcaatacccggacagtcgcggcgagatccgcgacctgcgcccgcttatcgaggcgttgcacggccaacaggcgctggcttgcgtcgccagcgacctgctcgccctgttgttgctgaccccgccgggggaactcggtgccgacgtggtgctcggcagcgcccagcgctttggcgtaccgatgggctacggcgggccgcacgcggcgttcttcgccacccgcgaagggtacaagcgggcaatgccggggcggatcatcggcgtttcccgcgacgcccgcggcaacccggcgttgcgcatggccctgcaaacccgcgagcagcacatccgtcgggaaaaggccaactcgaacatctgcaccgcccaggtgctgctggccaacattgcttcgctgtatgccgtctaccatgggccacaggagctgaaacgcatcgcccaacgcgtccagcgcctgaccgcgctgctggcggcgggcctgaaaagcaagggactgcggcggctcaaccggcacttcttcgacaccctgacctacgaggtcggcgagcgtcaggcggcgatcctcgaacgggcgcgggcggcacgggtcaacctgcgcgtggtcgacgaccggcggctggccctgagcctcgacgaaacctgtgacgcggcgaccctggcgaccctgttcgagatcttcctcggcgccggccacgggctggatgtcgcgcacctggatggcggggcggtggccgacggcatcccggcggtcctgcaacgcacttcggcctacctgcagcatccggtgttcaacgcccaccacagcgagaccgagatgcttcgctacctgcgccagctggaaggcaaggacctggcgctgaaccaggcgatgatcccgctcggctcctgcaccatgaagctcaacgccagcagcgaaatgatccccatcacctggccggaattcgccgaactgcatccgttcgtgccgcgcgagcaggccgagggctatcgccggatgatcgacgaactggaagcctggctgcgggcgatcaccggcttcgacgccatctgcatgcagccgaactcgggagcacagggcgaatatgccgggttgctggcgatccgccgctaccaccagagccgcggcgatagccagcgcgacatctgcctgatccccgcatcggcgcatggcaccaacccggcctcggcgatcatggccagcatgcgggtggtgatcgtcgagtgcgatccccgcggcaacgtcgacctcgacgacctgcgcctcaaggcggccgaggcgggcgaccggctgtcctgcctgatgatcacctatccctcgacccacggcgtctacgaagaggggataggcgagatctgcgaagtggtccaccgccacggcggccaggtctacatggacggcgccaacctcaacgcccaggtcggcctggcgcgaccggcggacatcggcgcggacgtctcgcacatgaacctgcacaagaccttctgcatcccccatggtggtggcgggccgggcatggggccgatcggggtcaagcggcacctggcgccgttcgtcgccaaccatccggtgatccgcgtcgaagggccgaacccgctgaacgacgcggtcagcgcgacgccctggggcagcgccagcatcctgccgatcagttggatgtacatcgccatgatgggcccgcagctggccgacgccagcgaggtggcgatcctctccgccaactacctggcgaaccgcctggacggggcgttcccggtgctctaccgcgggcgcaacgagcgcgtcgcccacgaatgcatcctcgacctgcgaccgctcaaggcgcagaccgggataaccgaggaagacgtggccaagcgcctgatggactacggcttccacgccccgaccatgtccttcccggtgccgggcacgctgatggtggagccgaccgagagcgagtcgaaggcggagctggatcgcttcgtcgaggcgatgctgagcatcagggccgagatcggcaaggtggagagcggcgcctggccggcggaggacaacccgctgaaacgggcgccgcataccctggccgacgtcaccgggatctggcagagaccctacgagatcgccgaggcagtgaccccgagcgaacatgcgcgggcgttcaagtactggccggcggttaaccgggtggacaacgtctacggcgaccgcaacctgttctgcgcctgcgtgccgctggacgactaccgcgagtga

SEQ ID NO: 2945 - protein, 958 aa, Pseudomonas aeruginosa
MSQTPSLAQLQPADAFLRRHLGPDPAEQQAMLAFLGVSTRAELIVQTVPPAIRLNRPLELPAALDEQAALARLRGYAGLNQRWTSLIGMGYYGTVTPSVILRNVLENPGWYTAYTPYQPEIAQGRLEALLNFQQLTIDLTGLDLASASLLDEATAAAEAMALARRVAKARSNRFFVDAHCHPQTVSVLRTRAEAFGFELVVDEPDNLAAHAVFGALLQYPDSRGEIRDLRPLIEALHGQQALACVASDLLALLLLTPPGELGADVVLGSAQRFGVPMGYGGPHAAFFATREGYKRAMPGRIIGVSRDARGNPALRMALQTREQHIRREKANSNICTAQVLLANIASLYAVYHGPQELKRIAQRVQRLTALLAAGLKSKGLRRLNRHFFDTLTYEVGERQAAILERARAARVNLRVVDDRRLALSLDETCDAATLATLFEIFLGAGHGLDVAHLDGGAVADGIPAVLQRTSAYLQHPVFNAHHSETEMLRYLRQLEGKDLALNQAMIPLGSCTMKLNASSEMIPITWPEFAELHPFVPREQAEGYRRMIDELEAWLRAITGFDAICMQPNSGAQGEYAGLLAIRRYHQSRGDSQRDICLIPASAHGTNPASAIMASMRVVIVECDPRGNVDLDDLRLKAAEAGDRLSCLMITYPSTHGVYEEGIGEICEVVHRHGGQVYMDGANLNAQVGLARPADIGADVSHMNLHKTFCIPHGGGGPGMGPIGVKRHLAPFVANHPVIRVEGPNPLNDAVSATPWGSASILPISWMYIAMMGPQLADASEVAILSANYLANRLDGAFPVLYRGRNERVAHECILDLRPLKAQTGITEEDVAKRLMDYGFHAPTMSFPVPGTLMVEPTESESKAELDRFVEAMLSIRAEIGKVESGAWPAEDNPLKRAPHTLADVTGIWQRPYEIAEAVTPSEHARAFKYWPAVNRVDNVYGDRNLFCACVPLDDYRE

SEQ ID NO: 2946 - DNA, 2865 bp, Pseudomonas fluorescens
  CDS (1)..(2865): transl_table=11
ttgctatctttgagccagttacgcgagcccaacgcttttctcaaccggcacctggggcccgacgccgaggagcagcaagcgatgctcgccagcctcgggctgggcagccgggccgaactgatcgagcagacggtgccgccgggaatccgcttcaaccgtgcactggacctgccgccggccctggacgaagcggccgccctggccaggctcaagggttatgccgggcagaaccaggtctggaccagcctgatcggcatgggttaccacgccaccctgacgccgacggtgatcctgcgcaacgtgctggagaaccccggctggtacaccgcctataccccctaccagccggaaatcgcccagggccggctcgaagccttgttgaatttccagcagatgaccatcgacctcaccggcctggacctggccaacgcctcgttgctggacgaagccaccgccgccgccgaagccatggccctggccaagcgtgtgagcaagtcttcgagcaacctgttctttgtcgatgaacactgccacccgcaaaccgtttccgtggtccgcactcgggccgaaggcttcggtttcgagctggtggtcggcggggtcgacgaattgtccgggcaccaggtgttcggcgcgttgctgcagtacccggacacccatggcgagatccgcgacctgcggccgctgatcgaccagttgcacgcccagcaggccctggcctgtgtcgcggccgacctgctcagcctgttgttgctgaccccgccgggcgaactgggggccgacgtggtgctcggttcgtcccagcgcttcggcgtgcccatgggctacggcggcccccatgcggcgtttttcgcctgccgcgacgactacaagcgcgcgatgcccgggcgcatcatcggcgtgtccaaggatgcccgcggccaggtggccctgcgcatggccttgcagactcgcgagcagcatattcgccgcgagaaggccaactcgaacatctgcaccgcccaggtgctactggccaatatcgcgggtttctacgccgtctatcacggcccggccgggctcaagcgcattgcccagcgggtacaccggctgacttgcatcctcgcggtcggcctggagcgccacggcattgccagggtcaaccggcacttcttcgacaccctgaccctggaggtcggcggcagccagacggcgatcatcgaaagcgccagggcgcagcagatcaacctgcggattctcggccgtggccggctggggctgagcctggatgaaacctgtgacgaaagcaccgtgacccgtttgttcgacgtgttcctgggtgccgaccacgggctggatgtcagcaacctggacgccgaggcgctggagtcggggattcccgacccgctgctgcgacgcacgcgctacctgacccacccggtgttcagtgcccatcacagcgaaaccgaaatgttgcgctacctcaagcagctggagaacaaggacctggcgctcaaccagtcgatgattcccctgggctcctgcaccatgaagctcaatgccagcagcgagatgatccccatcacctggccggagttcgccaacctgcatcccttcgcaccccgggagcaggctgccggctatggcctgctgatcgcggagctggagcgttggctgtgcgccatcaccggtttcgacgccatctgcatgcagcccaactccggggcccagggcgagtacgccgggctgctggcgattcgtcgctaccacgagagccgccggcaaggcggccggcatgtctgcctgatcccggcgtcggcccacggcaccaacccggcctcggcgcagatggccgggatgcaggtggtgatcgtcgagtgcgacgaggccggcaacgtcgacctggaagacttgaaggccaaggcccaggcggccggcgagcgcctgtcgtgcctgatggctacctacccttcgacccacggtgtgtacgaagagggcatcagccagatctgcgaagttatccacagccacggcggccaggtgtacatggacggcgccaacctcaacgcccaggtaggcctggcccggccggcggacattggcgccgatgtctcgcacatgaacctgcacaagactttctgcattccccatggcggcggtggcccgggcatggggccgattggcgtgcgcgcgcacctggcgccgtttgtcgccaaccacccggtggtgcccatcgacgggcctttaccggagaacggcgccgtcagcgcagcgccctggggcagtgcgagcatcctgcccatcagctggatgtacatcgccctgatggggccgcagctggcggatgccagcgaggtggcgatccttgcggccaactatctggccgagcaattgagcggtgccttcccggtgctctacagcggccgcaacggccgggtggcccacgaatgcatcctcgatctgcgcccgctcaaggcccagaccgggatcagcgaggaagacgtggccaagcgcttgatggactacggcttccatgccccgaccatgtccttcccggtgccgggcaccctgatggtggagcccacggaaagcgaatccaaggccgagctcgaccgttttatcgaagccatgctgagcatccgcgccgagatcgcccaggtacaggagggcaactggccggccgaggacaacccgctcaagggcgctccccataccctggcggatatcaccggagtctgggagcgctcctacagtatcgaacaggcggtgctgcccaccgcccatacccgggcccacaagtactggccggcggtgaaccgggtggacaacgtctatggcgaccgcaacctgttctgcgcctgcgtgccgctggcggactaccgctga

SEQ ID NO: 2947 - protein, 954 aa, Pseudomonas fluorescens
MLSLSQLREPNAFLNRHLGPDAEEQQAMLASLGLGSRAELIEQTVPPGIRFNRALDLPPALDEAAALARLKGYAGQNQVWTSLIGMGYHATLTPTVILRNVLENPGWYTAYTPYQPEIAQGRLEALLNFQQMTIDLTGLDLANASLLDEATAAAEAMALAKRVSKSSSNLFFVDEHCHPQTVSVVRTRAEGFGFELVVGGVDELSGHQVFGALLQYPDTHGEIRDLRPLIDQLHAQQALACVAADLLSLLLLTPPGELGADVVLGSSQRFGVPMGYGGPHAAFFACRDDYKRAMPGRIIGVSKDARGQVALRMALQTREQHIRREKANSNICTAQVLLANIAGFYAVYHGPAGLKRIAQRVHRLTCILAVGLERHGIARVNRHFFDTLTLEVGGSQTAIIESARAQQINLRILGRGRLGLSLDETCDESTVTRLFDVFLGADHGLDVSNLDAEALESGIPDPLLRRTRYLTHPVFSAHHSETEMLRYLKQLENKDLALNQSMIPLGSCTMKLNASSEMIPITWPEFANLHPFAPREQAAGYGLLIAELERWLCAITGFDAICMQPNSGAQGEYAGLLAIRRYHESRRQGGRHVCLIPASAHGTNPASAQMAGMQVVIVECDEAGNVDLEDLKAKAQAAGERLSCLMATYPSTHGVYEEGISQICEVIHSHGGQVYMDGANLNAQVGLARPADIGADVSHMNLHKTFCIPHGGGGPGMGPIGVRAHLAPFVANHPVVPIDGPLPENGAVSAAPWGSASILPISWMYIALMGPQLADASEVAILAANYLAEQLSGAFPVLYSGRNGRVAHECILDLRPLKAQTGISEEDVAKRLMDYGFHAPTMSFPVPGTLMVEPTESESKAELDRFIEAMLSIRAEIAQVQEGNWPAEDNPLKGAPHTLADITGVWERSYSIEQAVLPTAHTRAHKYWPAVNRVDNVYGDRNLFCACVPLADYR

SEQ ID NO: 2948 - DNA, 2874 bp, Pseudomonas fluorescens
  CDS (1)..(2874): transl_table=11
atgtcccagttgccatccctgagccagttacgcgatccccatgcctttctgcgccgccacctcgggcccgatgctgccgagcaacaggcgatgctggacagcctcggcctcggcagccgggtcgagctgatcgaacagaccgtgccgccgggcattcgcctcaaccgcgagctggacctgccgccggcgctggacgaacaggcagcgctggccagactgcgcggttatgccgaacagaaccaggtctggaccagcctgatcggcatgggctaccacggcaccctgacgccgaccgtcatcctgcgcaacgtgctggaaaatcccggctggtacaccgcctacacgccttaccaaccggaaatcgcccaaggccggctcgaagcgttgctcaactttcagcaactgaccatcgacctcaccggccttgaactggccaacgcttcgctgctcgatgaagccaccgccgcggcggaagccatggccttggccaaacgtgtggcaaagtcgaaaagcaatctgttcttcgtcgacgaaaactgtcatccacaaaccatttccgtggtgcagacccgcgccgaaggcttcggcttcgagctgatcgtcgacgctgtggataacttgaagcagcaccaggtgttcggcgcgctgctgcaataccccgacacccacggcgagatccgcgacctgcggccgctgatcgatcacctgcacgcgcaacaggcgctggcctgcgtggcggccgatctgctcagtctgttgctgctgaccccgccgggcgaactgggtgccgacgtggtgttcggttcatcccagcgcttcggtgtaccgatgggttacggaggtccgcacgcggcggttttcgccagtcgcgaggagtacaaacgggcgattcccgggcggatcatcggcgtgtcgaaagatgctcgcggcaacgtcgcgctgcgcatggccctgcaaactcgcgagcagcacattcgtcgggagaaggccaattcgaacatctgcacagctcaagtgttgctggccaatatcgccagtttctatgcggtctatcacggcccggaagggctgaaacgaatcgcccagcgggtgcaccggctgacctgcattctcgccgccgggctcgaacgccatggcatccagcgcctcaaccaacacttcttcgacaccctcacgctggacgtgggcggggcgcaaaccgcgatcatcgaaagcgcccaggccgcgcagatcaacctgcgcatcctcggtcgtggccaactgggtctgagcctcgacgaggcctgtgatgaaaacaccgtggccagactgttcgatgtgctgctgggcgccgatcacgggttgagcatcgatgatctcgacgccgaaacgctggcctccggcattcccgaaatgctgcaacgcagcacgtcgtacctgcgccacccggtgttcaacgcccaccacagcgaaaccgagatgctgcgctacctcaagcaactggagaacaaggatctggcgctcaaccagtcgatgatccctctgggctcctgcaccatgaaactcaacgccaccagcgagatgatcccgatcacctggccgcaattcgccaatctgcacccgttcgtaccccgggagcaggccgtcggttacacgctgatgatcgaggagctggagcgctggctgtgcgcaatcaccgggttcgatgcgatctgcatgcagcccaactccggcgcccagggcgagtacgccgggctgctggcgatccgcaaataccacgagagtcgccagcagggcgggcgggatatctgcctgatcccttcttcggcccacggcaccaacccggcctcggcacagatggccgggatgcgcgtggtgattgtcgagtgtgacgacgctggcaatgtcgatctggaggacttgaaagccaaggcatccgaggccggggccaagctgtcgtgcctgatggcgacctacccgtcgacccacggcgtgtacgaggaaggcatcagcgaaatctgcgaagttatccacaagcacggcggccaggtgtacatggacggcgccaacctcaatgcccaggtcgggctggcgcggccggcggacatcggcgccgacgtgtcacacatgaacctgcacaagaccttctgcattccccacggcggaggcgggccgggcatggggccgattggcgtgcgtgcgcatctggcgccgttcgttgccaaccatccggtggtcccgatcgacgggccgcaaccgcagaacggagcggtcagcgccgcgccatggggcagtgcgagcattttgccgatcagctggatgtacatcgcgatgatggggccgcaactggcggatgccagtgaagtggcgatcctcgcggcgaattacctggcgcagcacctgtccggtgctttccccgttctgtataccggtcgcaatgagcgggtcgcccacgaatgcattctggatctgcgcccgctcaaggctgccactggtatcagcgaggaggacgtcgccaagcgcctgatggattacggcttccacgcgccgaccatgtcgttcccggtgccgggcaccttgatggtcgagccgaccgagagcgagtccaaggccgaactcgatcgcttcatcggcgcgatgctaagcatccgcgcagaaatcaccgaggtgcagaacggcaactggccggccgaggacaacccgctcaaacgggcaccgcataccatggccgatatcaccggcgtgtgggagcggccgtacagcatcgagcagggcatcacgccggatgcgcacaccaaggcgcacaaatattggccggcagtgaatcgggtcgataacgtctatggcgaccgcaacctgttctgcgcctgtgtgccggtggacgattaccgttga

SEQ ID NO: 2949 - protein, 957 aa, Pseudomonas fluorescens
MSQLPSLSQLRDPHAFLRRHLGPDAAEQQAMLDSLGLGSRVELIEQTVPPGIRLNRELDLPPALDEQAALARLRGYAEQNQVWTSLIGMGYHGTLTPTVILRNVLENPGWYTAYTPYQPEIAQGRLEALLNFQQLTIDLTGLELANASLLDEATAAAEAMALAKRVAKSKSNLFFVDENCHPQTISVVQTRAEGFGFELIVDAVDNLKQHQVFGALLQYPDTHGEIRDLRPLIDHLHAQQALACVAADLLSLLLLTPPGELGADVVFGSSQRFGVPMGYGGPHAAVFASREEYKRAIPGRIIGVSKDARGNVALRMALQTREQHIRREKANSNICTAQVLLANIASFYAVYHGPEGLKRIAQRVHRLTCILAAGLERHGIQRLNQHFFDTLTLDVGGAQTAIIESAQAAQINLRILGRGQLGLSLDEACDENTVARLFDVLLGADHGLSIDDLDAETLASGIPEMLQRSTSYLRHPVFNAHHSETEMLRYLKQLENKDLALNQSMIPLGSCTMKLNATSEMIPITWPQFANLHPFVPREQAVGYTLMIEELERWLCAITGFDAICMQPNSGAQGEYAGLLAIRKYHESRQQGGRDICLIPSSAHGTNPASAQMAGMRVVIVECDDAGNVDLEDLKAKASEAGAKLSCLMATYPSTHGVYEEGISEICEVIHKHGGQVYMDGANLNAQVGLARPADIGADVSHMNLHKTFCIPHGGGGPGMGPIGVRAHLAPFVANHPVVPIDGPQPQNGAVSAAPWGSASILPISWMYIAMMGPQLADASEVAILAANYLAQHLSGAFPVLYTGRNERVAHECILDLRPLKAATGISEEDVAKRLMDYGFHAPTMSFPVPGTLMVEPTESESKAELDRFIGAMLSIRAEITEVQNGNWPAEDNPLKRAPHTMADITGVWERPYSIEQGITPDAHTKAHKYWPAVNRVDNVYGDRNLFCACVPVDDYR

SEQ ID NO: 2950 - DNA, 2874 bp, Pseudomonas putida
  CDS (1)..(2874): transl_table=11
atgtcccagtcgccatccctgcatcaactgcaagagctcaacccgtttctgcgtcgccacctgggccccgatgccacagagcagcaggccatgctcaacgcgctgggtatcgccagccgcaacgagctgatcgagcagaccgttccgccagacatccgcctcaatcgccccctcgacctcccagcggcactggacgagcaagccgccctggccaagctcgccggttacgccgaacagaaccaggtctggaccagcctcatcggcatgggctaccacggcaccatcacccccacggtcatcctgcgcaacgtgctggaaaaccctggctggtacaccgcctacacgccctaccaacccgaaattgcccaaggccggctggaggcgctgctgaacttccagcaaatggtcatcgacctcaccggcctgcctctggccaatgcctcgctgctcgatgaagccaccgctgccgccgaagccatggccctggccaagcgggtggcacgcaacaagagcaacgccttctttgccgacgagcactgccatccgcagaccctatcggtactcaagacccgcgccgaaggcttcggctttgagctgatcgtcgattctgtggataaccttgccaagcactcggtgttcggcgccttgctgcagtacccggacacccacggcgaagtgcgcgatttgcgcccgctgatcgaccagttgcacagccagcaggccctggcctgcgtagccgctgacctgctgagcctggtggtgctggcaccgcccggagagctcggcgccgatgtggtgctgggctcgacccagcgctttggtgtgccgatgggctacggcgggcctcacgcggcctatttcgcctgtcgcgacgactacaagcgagccatgccggggcgcatcatcggcgtatcgcgcgatgcccgtggcaacaccgcattacggatggccctgcaaacccgcgagcagcatattcgccgcgaaaaggccaactccaacatctgcacggcccaggtgctgttggccaacattgccggcttctacgcggtgtaccacggcccggaaggcctgcaacgcatcgcgcagcgtgtgcaccggttgaccttcatcctggcagccggccttgaggccaaaggcatcaaacgcctcaatcagcacttcttcgacacccttaccctgaatgttggcggtgcccaggcggccatcattgaaagcgccgaggccgcgcacatcaatttgcgcattctcggtcgcgggcacctgggggtgagcctggacgaaacctgcaccgaacagacggtgctgcgcctgctcgacatcttcctgggggtggatcatggcctggaaatcaccgccctcgaccagctggccctgcctgaaggcatccccgccagcctggtgcgacgcacgccattcctcgcccatccggtgttcaacctgcatcacagcgaaacagagatgctgcgctacctcaagcagctagagaacaaggacctggcgctgaaccagtcgatgataccgttgggctcgtgcaccatgaagctcaacgccaccagtgagatgatccccatcacctggcccggttttgcccagctgcacccgttcgccccggcggcccaggcagcgggctacaaggcgatgatcgacgaactggaaagctggctgtgcgcgatcaccggcttcgatgcgatctgcatgcagcccaactccggtgctcagggtgaatacgccggcctgatggccattacccgctatcactgcagccgccaccagccgatgcgcacgttgtgcctgatcccgtcgtcggcccacggcaccaacccggcgtcggcacagatggccggcatggaagtggtgatcgtcgattgcgacaacgatggcaacgtcgacctggctgacctcaaagccaaggcgcatgcggccggggagcgtctgtcgtgcctgatgattacctacccctcgacccacggcgtgtacgaagaggggatacgcgaaatctgcgatgtggtgcaccagtacggcggccaggtttacatggacggtgccaacctcaacgcccaggtgggcctggcgcgccccgcagacattggggccgacgtttcacacatgaacctgcacaagacgttctgcattccccacggcggcggcggcccgggtatggggccgatcggtatccgcgcgcacctcaagccgttcgtcgccagccatccggtggtgccggtgcctgggttggacccgaacaacagcgcggtcagcgccgcgccctggggcagcgcaagcatcttgccgatcagctggatgtacatcgccatgatgggcccgcagctggccgacgccagcgaggtggctatcctttcggccaactacctggccagccagttgggcgcggcgttcccggtgctctaccgcgggcgcaaccagcgcgtggcgcatgaatgcatcctcgacctgcggccgttgaaagcgctgacaggcatcagcgaagaggacgtggccaagcgcctgatggactatggcttccacgcaccgaccatgtccttcccagtgccgggcacgctgatggtggagccgaccgagagtgaatcgaaggctgagctggatcggtttgtcgaagcgatgctggcgattcgcgcggaaattgacgaagtacagcagggcaactggccagcggagaacaacccgctgaaacatgcaccgcataccttggctgatgtcttgggggtatgggacagaccgtatagcctggagcaggcggtggcccccagtgctcacgtgcgccagcacaaatactggccggcggtgaaccgggtagacaacgtgtatggggacaggaacctgttctgtgcgtgtgtgccggtagaggcttatcgctga

SEQ ID NO: 2951 - protein, 957 aa, Pseudomonas putida
MSQSPSLHQLQELNPFLRRHLGPDATEQQAMLNALGIASRNELIEQTVPPDIRLNRPLDLPAALDEQAALAKLAGYAEQNQVWTSLIGMGYHGTITPTVILRNVLENPGWYTAYTPYQPEIAQGRLEALLNFQQMVIDLTGLPLANASLLDEATAAAEAMALAKRVARNKSNAFFADEHCHPQTLSVLKTRAEGFGFELIVDSVDNLAKHSVFGALLQYPDTHGEVRDLRPLIDQLHSQQALACVAADLLSLVVLAPPGELGADVVLGSTQRFGVPMGYGGPHAAYFACRDDYKRAMPGRIIGVSRDARGNTALRMALQTREQHIRREKANSNICTAQVLLANIAGFYAVYHGPEGLQRIAQRVHRLTFILAAGLEAKGIKRLNQHFFDTLTLNVGGAQAAIIESAEAAHINLRILGRGHLGVSLDETCTEQTVLRLLDIFLGVDHGLEITALDQLALPEGIPASLVRRTPFLAHPVFNLHHSETEMLRYLKQLENKDLALNQSMIPLGSCTMKLNATSEMIPITWPGFAQLHPFAPAAQAAGYKAMIDELESWLCAITGFDAICMQPNSGAQGEYAGLMAITRYHCSRHQPMRTLCLIPSSAHGTNPASAQMAGMEVVIVDCDNDGNVDLADLKAKAHAAGERLSCLMITYPSTHGVYEEGIREICDVVHQYGGQVYMDGANLNAQVGLARPADIGADVSHMNLHKTFCIPHGGGGPGMGPIGIRAHLKPFVASHPVVPVPGLDPNNSAVSAAPWGSASILPISWMYIAMMGPQLADASEVAILSANYLASQLGAAFPVLYRGRNQRVAHECILDLRPLKALTGISEEDVAKRLMDYGFHAPTMSFPVPGTLMVEPTESESKAELDRFVEAMLAIRAEIDEVQQGNWPAENNPLKHAPHTLADVLGVWDRPYSLEQAVAPSAHVRQHKYWPAVNRVDNVYGDRNLFCACVPVEAYR

SEQ ID NO: 2952 - DNA, 3114 bp, Flaveria pringlei
  CDS (1)..(3114)
atggagcgtgcacgcaggctagccaacaaagccatcctggggcgccttgtgtcacaaaccaaacacaacccatcaatatcatcccctgctctgtgttcaccttcacggtatgtttcctctttatctccttatgtatgtagtggcacaaacgttagatcagatagaaaccttaatgggtttggttcacaagttagaaccatatcagttgaagctttgaaacccagtgacactttcccacgtcgccataactcagccacccctgaagaacaaaccaaaatggctgaattcgttggttttccgaatcttgattcactcattgatgcaactgtgcccaagtcaatccgtcttgattcaatgaagtactctaagtttgatgaggggttgactgaatctcaaatgattgcacacatgcaagatttagcttctaagaacaagatctttaagtcttttattggtatgggttattacaacacatctgtgcctactgttatattaagaaacattatggagaaccctggttggtatactcagtacacaccataccaagctgaaattgcgcagggtcggctcgagtccctgctcaatttccagaccatggttactgatcttacaggtttgcccatgtcgaatgcttcattgcttgatgaaggaactgcagctgctgaagctatggctatgtgcaataatattcaaaagggtaaaaagaagacctttattattgcaagtaactgtcacccacaaacaattgatatatgtaaaactcgagccgatgggtttgacctgaaagtggtcacttctgatcttaaagattttgattactcatctggtgatgtttgtggagttttggttcagtatccagggactgagggtgagttattggactacagtgagttcatcaagaatgctcatgcaaatggggtgaaagtggtcatggctagtgatttgttggctttaactattttgaagcctcctggtgaacttggggctgatattgtggtgggttcggctcaacggtttggggttccaatgggttatggtggtccgcatgcagcctttcttgcaacatctcaagagtataagagaatgatgcctggaagaattattggtgttagtgttgattcttctgggaaaccagctttacgtatggcgatgcagacccgtgagcaacatatcaggagagataaagcaactagtaacatttgtacagctcaggcattgcttgcaaacatggctgctatgtttggtgtttaccatgggccagaaggcctaaagaccatcgccaaacgagtccatggtctagctggcacatttgctgcaggtttgaagaagttagggacagtacaagtccaagatctccccttttttgacactgtgaaagtaacgtgtgttgattcaaaggcaattgctgaagaagcttacaagcataaaatgaatcttcgcattgtggacaagaacactatcactgtcgcgttcgatgagacaacaacaattgaagatgttgatactttgttcaaagtttttgcattagggaaacctgtgacattcactgctgcatctattgcaccagaggttcaggatgctatcccatctgggcttgtaagggagactccatatttgacacatcctattttcaacatgtatcatacggagcatgagctactaagatacattagcaaattgcaatcaaaggacctctcattgtgccacagtatgattccactgggatcatgtaccatgaagcttaatgcaactacagaaatgatgcctgtgacatggcccgcctttgcagatatacatccttttgctcctaccgaacaggcacagggttatcaggaaatgttcaagaacttgggtgacttgttgtgtaccattactggatttgattctttctccttgcagccgaatgctggtgctgctggagaatatgccgggcttatggttatccgagcataccatatggcaagaggtgatcatcacaggaatgtatgcatcatccctgtgtctgcacatggaacaaatcctgctagtgctgctatgtgtggaatgaaaattattactgtgggaacagactctaaaggtaacataaatattgaagagttacgcaaggctgcggaggcaaacaaagagaatttatctgctcttatggttacctatccttcgactcatggagtttatgaagagggtattgatgaaatctgcaaaatcattcatgacaatggaggtcaagtttacatggacggagcaaacatgaatgcacaggttggtttgacaagtccagggtggattggtgctgatgtgtgtcatctaaacctgcacaagacattttgcattccacatggcggaggtggtcccggaatgggtcccattggtgtgaagaaacacttggcaccatatttgccttcacaccctgtggtcgcgactggtggcataccagcccccgaacaaagtcagccacttggtaccattgctgcagccccttggggttcggctcttatcttgcctatatcatatacatacattgccatgatgggatctcaaggaataaccaatgcatcaaagatagccatcctgaatgcaaattatatggcaaaacgtctagagaatcactatccaattcttttccgtggtgtcaatggaactgttgcccatgaattcattgttgatttgagaccactgaagactactgctggaattgaaccagaagatgttgctaagcgtcttatagattatgggttccatggtccaacaatgtcgtggccagtcccaggaacactcatgattgaaccaactgaaagtgaaagcaaggcggagttggacaggttttgtgatgctttaatctccattagacaagaaatagcagagattgagaaaggaaatgttgatctcaacaacaatgtcatcaagggcgctcctcacccgccacaactactcatggctgataagtggacaaaaccgtactctagagaatatgcagcttaccctgctccctggcttcgtgctgctaagttctggcctactacatgccgtgtggacaatgtgtatggtgatcgcaacctcatctgcactcttcaaccaccacaggagtatgaagagaaagcggaggctactgcttaa

SEQ ID NO: 2953 - protein, 1037 aa, Flaveria pringlei
MERARRLANKAILGRLVSQTKHNPSISSPALCSPSRYVSSLSPYVCSGTNVRSDRNLNGFGSQVRTISVEALKPSDTFPRRHNSATPEEQTKMAEFVGFPNLDSLIDATVPKSIRLDSMKYSKFDEGLTESQMIAHMQDLASKNKIFKSFIGMGYYNTSVPTVILRNIMENPGWYTQYTPYQAEIAQGRLESLLNFQTMVTDLTGLPMSNASLLDEGTAAAEAMAMCNNIQKGKKKTFIIASNCHPQTIDICKTRADGFDLKVVTSDLKDFDYSSGDVCGVLVQYPGTEGELLDYSEFIKNAHANGVKVVMASDLLALTILKPPGELGADIVVGSAQRFGVPMGYGGPHAAFLATSQEYKRMMPGRIIGVSVDSSGKPALRMAMQTREQHIRRDKATSNICTAQALLANMAAMFGVYHGPEGLKTIAKRVHGLAGTFAAGLKKLGTVQVQDLPFFDTVKVTCVDSKAIAEEAYKHKMNLRIVDKNTITVAFDETTTIEDVDTLFKVFALGKPVTFTAASIAPEVQDAIPSGLVRETPYLTHPIFNMYHTEHELLRYISKLQSKDLSLCHSMIPLGSCTMKLNATTEMMPVTWPAFADIHPFAPTEQAQGYQEMFKNLGDLLCTITGFDSFSLQPNAGAAGEYAGLMVIRAYHMARGDHHRNVCIIPVSAHGTNPASAAMCGMKIITVGTDSKGNINIEELRKAAEANKENLSALMVTYPSTHGVYEEGIDEICKIIHDNGGQVYMDGANMNAQVGLTSPGWIGADVCHLNLHKTFCIPHGGGGPGMGPIGVKKHLAPYLPSHPVVATGGIPAPEQSQPLGTIAAAPWGSALILPISYTYIAMMGSQGITNASKIAILNANYMAKRLENHYPILFRGVNGTVAHEFIVDLRPLKTTAGIEPEDVAKRLIDYGFHGPTMSWPVPGTLMIEPTESESKAELDRFCDALISIRQEIAEIEKGNVDLNNNVIKGAPHPPQLLMADKWTKPYSREYAAYPAPWLRAAKFWPTTCRVDNVYGDRNLICTLQPPQEYEEKAEATA

SEQ ID NO: 2954 - DNA, 3105 bp, Flaveria pringlei
  CDS (1)..(3105)
atggagcgtgcacgcaggctagccatcctggggcgccttgtgtcacaaaccaaacacaacccatcaatatcatcccctgctctgtgttcaccttcacggtatgtttcctctttatccccttatgtatgtagtggcacaaacgttagatcagatagaaaccttaatgggtttggttcacaagttagaaccatatcagttgaagctttgaagccaagtgacactttcccacgtcgccataactcagccacccctgaagaacaaaccaaaatggccgaattcgtcggctttccgaatcttgattcactcattgatgcaactgtgcccaagtcaatccgtcttgattcaatgaagtactcgaagtttgatgaggggttgactgaatctcaaatgatcgcacatatgcaagatttagcttctaagaacaagatctttaagtcctttattggtatgggctattacaacacatctgtgcctactgttatattaagaaacattatggagaaccctggttggtatactcagtacacaccataccaggctgaaattgcgcaggggcggctcgagtccctgctcaatttccagaccatgattactgatctaacaggtttgccgatgtcgaatgcttcattgcttgatgaagggactgcagctgctgaagctatggctatgtgtaataatattcagaagggtaaaaagaagacctttattattgcaagtaactgtcacccacaaacaattgatatttgtaaaactcgtgccgatgggtttgacctgaaagtggtcacttctgatcttaaagattttgattactcatctggtgatgtttgtggagtgttggttcagtatccagggactgagggtgagttgttggactacagtgagttcatcaagaatgctcatgcaaatggggtgaaagtggtcatggctagtgatttgttggctttgactattttgaagccacctggtgaacttggggctgatattgtggtgggttcggctcagcggtttggggttccaatgggttatggtggtccgcatgcagcttttcttgcaacgtcccaagagtataagagaatgatgcccggaagaattattggtgttagtgttgattcttctggaaaaccagctttacgtatggcgatgcagacccgtgagcaacatatcaggagagataaagcaactagtaacatttgtacagctcaggcattgctagcaaacatggctgctatgttcggtgtttaccatgggccagaaggcctaaagaccattgccaaacgggtccatggtctagctggcacatttgcttcaggtttgaagaagttagggacagtacaagtccaagatctccccttttttgacactgtgaaagtaacttgtgctgactcaaaggcaattgctgaagaagcctacaagcataaaatgaatcttcgcattgtcgacaagaacactatcactgttgcgttcgatgagacaacaacgattgaagatgttgatactttgttcaaagtttttgcattagggaaacctgtgacattcactgctgcatctattgcaccagaggttcaggatgctatcccatctgggcttgtaagggagactccatatttgacacatcctattttcaacatgtatcatacggagcatgagctactaagatacattagtaaattgcaatcaaaggacctctcattatgccacagtatgattccattgggatcatgtacgatgaagcttaatgcaactacagaaatgatgcctgtgacatggcccgcatttgcagatatacatccttttgctcctaccgaacaggcacagggttatcaggaaatgttcaagaacttgggtgacttgttgtgtaccattactggatttgattctttctccttgcaaccaaatgctggtgctgctggagaatatgccgggctgatggttatccgagcataccatatggcaagaggtgatcatcacaggaatgtatgcattatccctgtgtctgcacatggaacaaatcctgctagtgctgctatgtgtggaatgaaaattattactgtgggaacagactccaaaggtaacataaatatagaagaattacgcaaggctgcagaggcaaacaaagagaatttatctgctcttatggttacctatccttcgactcatggagtttatgaagagggcattgatgaaatctgcaaaatcattcatgacaacggaggtcaagtttacatggacggagcaaacatgaatgcacaggttggtttgacaagcccagggtggattggtgctgatgtgtgtcatctaaacctgcacaagacattttgcattcctcatggcggaggtggtcccggaatgggtcccattggtgtgaagaaacacttggcaccatacttgccttcacaccctgtggtcccgactggtggcataccagcccccgaacaaagtcagccacttggtaccattgctgcagccccttggggttcggctcttatcttgcctatatcatacacatatattgccatgatgggatctcaaggaataaccaatgcatcaaagatagctatcctgaatgcaaattatatggcaaaacgtctagagaatcactatcctattcttttccgtggggtcaatggaacagttgctcatgaattcattgttgatttgagaccattgaagactactgctggaattgaaccagaagatgttgctaagcgtcttatagattatgggttccatggtccaacaatgtcatggcctgtcccaggaacactcatgattgaaccaactgaaagtgaaagcaaggcggagttggacaggttttgtgatgctttaatctccattagacaagaaatagcagagattgagaaaggaaatgttgatttcaacaacaatgtcatcaagggcgctcctcacccgccacaactactcatggctgataagtggaccaaaccgtactctagagaatatgcagcttacccggctccctggcttcgtgctgctaaattctggcctactacatgccgtgtggacaatgtgtatggagaccgcaacctcatctgcactcttcaaccaccacaggagtatgaagagaaagcagaagctactgcttaa

SEQ ID NO: 2955 - protein, 1034 aa, Flaveria pringlei
MERARRLAILGRLVSQTKHNPSISSPALCSPSRYVSSLSPYVCSGTNVRSDRNLNGFGSQVRTISVEALKPSDTFPRRHNSATPEEQTKMAEFVGFPNLDSLIDATVPKSIRLDSMKYSKFDEGLTESQMIAHMQDLASKNKIFKSFIGMGYYNTSVPTVILRNIMENPGWYTQYTPYQAEIAQGRLESLLNFQTMITDLTGLPMSNASLLDEGTAAAEAMAMCNNIQKGKKKTFIIASNCHPQTIDICKTRADGFDLKVVTSDLKDFDYSSGDVCGVLVQYPGTEGELLDYSEFIKNAHANGVKVVMASDLLALTILKPPGELGADIVVGSAQRFGVPMGYGGPHAAFLATSQEYKRMMPGRIIGVSVDSSGKPALRMAMQTREQHIRRDKATSNICTAQALLANMAAMFGVYHGPEGLKTIAKRVHGLAGTFASGLKKLGTVQVQDLPFFDTVKVTCADSKAIAEEAYKHKMNLRIVDKNTITVAFDETTTIEDVDTLFKVFALGKPVTFTAASIAPEVQDAIPSGLVRETPYLTHPIFNMYHTEHELLRYISKLQSKDLSLCHSMIPLGSCTMKLNATTEMMPVTWPAFADIHPFAPTEQAQGYQEMFKNLGDLLCTITGFDSFSLQPNAGAAGEYAGLMVIRAYHMARGDHHRNVCIIPVSAHGTNPASAAMCGMKIITVGTDSKGNINIEELRKAAEANKENLSALMVTYPSTHGVYEEGIDEICKIIHDNGGQVYMDGANMNAQVGLTSPGWIGADVCHLNLHKTFCIPHGGGGPGMGPIGVKKHLAPYLPSHPVVPTGGIPAPEQSQPLGTIAAAPWGSALILPISYTYIAMMGSQGITNASKIAILNANYMAKRLENHYPILFRGVNGTVAHEFIVDLRPLKTTAGIEPEDVAKRLIDYGFHGPTMSWPVPGTLMIEPTESESKAELDRFCDALISIRQEIAEIEKGNVDFNNNVIKGAPHPPQLLMADKWTKPYSREYAAYPAPWLRAAKFWPTTCRVDNVYGDRNLICTLQPPQEYEEKAEATA

SEQ ID NO: 2956 - DNA, 2865 bp, Agrobacterium tumefaciens
  CDS (1)..(2865): transl_table=11
atgacgacgcccacggaattccatttcaccgactatcagccctatgatttcgccaaccggcgtcacatcgggccgtcgccgtcggaaatggcggagatgctgaaggtcgtcggctataagagcctcgacgccctgatcgacgccaccgttccctcctccatccgccagaaggtgccgctcacttggggtgcggcgctgaccgaacgcgaggcgctggatcgtcttcgcgaaacggccaacaagaaccaagtcctgacctcgctgatcggccagggctattacggcaccatcacaccgccggtcatccagcgcaatattctggaaaacccggcctggtacacggcctatacgccttaccagccggaaatcagccagggccgtcttgaggcgctgctgaattaccagaccatggtctgcgatctgaccggtctcgatgtcgccaatgcatcgctgcttgatgaagcgacggccgccgccgaagccatggccatgtgccagcgcgttgccaagtccaaggcgactgccttcttcgtagatgccaattgtcatccgcagaccatcgcgctgatcgagacccgtgcggccccgctcggctggaaggtgattatcggcaacccgttcaccgatctcgatccggtcgacgtgtttggcgcgatcttccagtatcccggcacccacggccatgtcagcgatttcacaggcctgatttcccgcctgcatcagacgggtgcgattgccgccgtcgccgccgatcttctggcgctgacgctcttgaagtctccaggcgaaatgggtgctgacatcgccatcggcacctcgcagcgtttcggcgttccggtcggttacggcggtccgcatgctgcttacatgtccgtcaaagacgcacataagcgctccatgcccggccgtctggtcggcgtctcggtcgacgcacgcggaaaccgcgcctatcgcctgtcgttgcagacccgcgagcaacatatccgccgcgagaaggcgacgtcgaatatctgcaccgcgcaggtgctgctcgccgtcatggcctccatgtatggcgtcttccacggcccgcagggcatcaaggcgattgcccagcagacccaccagaaggccgttttgatggccaagggtctggaaaagctcggctacaccatcgagccggaaaccttcttcgacacgatcaccgtcgaagtcggccacatgcagggcgtcatcctgcgctctgccgtagcggaaggtgtcaacctgcgcaaggtcggcgccaccaagatcggcatgagccttgacgagcgcacgcgccccgcgacgcttgaggccgtctggcgtgctttcggcggcaatttctcgatttcggatttcgagccggactatcgcctgccgaaggatctgctgcggaccagccagtacatgacgcatccgatcttccacatgaaccgtgccgaaagcgagatgacacgttacatccgccgtctttcggatcgcgatctggcgctcgaccgctcgatgatcccgcttggttcctgcaccatgaaactgaacgccacggcggaaatgctgccgatcacctggccggaattttccgacatccatccctttgtgccggccaatcaggcgctcggttacaaggagatgatcgatgatctctcggaaaagctctgctcggtgaccggttacgacgccttctccatgcagccgaattccggcgcgcaaggggaatatgcggggcttctcaccatccgcaactatcatctcgccaatggcggcacgcatcgtgacgtctgcctcattccgacgtcggcgcatggcaccaaccccgcctcggcgcagatggtcggcatgaaagtggtgccggtgaaggtgcgggacaacggtgacatcgatatcgatgatttccgtttaaaagcagagcagtatgcggaaaacctctcgtgctgcatgatcacatatccgtcgacccacggcgtgttcgaagagacggttcgcgaaatctgcgagatcacccacaagcatggcggacaggtctatcttgacggcgccaacatgaacgccatggtcggccttgcccgcccgggcgacatcggctccgacgtcagccacctcaacctgcacaagaccttctgcattccgcatggcggcggcggcccgggcatgggcccgatcggcgtcaaggcgcatctggctcccttccttcccggccatccgacgacggacggtcgtgagggtgcggtgtctgcagcccccttcggttcgccttccatcctgccgatctcctggagctactgcctgatgatgggcggcgaagggctgacgcaggcgaccaaggtggcgatcctcaacgccaactatatcgccgaacggctgaagggcgcttacgacgtgctctacaagtccgagaccggtcgcgtggcgcatgagtgcatcatcgacacacgaccgctcgcggatagctgcggcgtgacggtggacgatgttgcaaaacgcctcatcgactgcggtttccatgcgccgaccatgagctggccggtggccggcacgctgatgatcgagccgaccgaatccgaaaccaaagcggaaatcgaccgtttctgcgatgccatgctggcgatccgcgaggaagcccgcgacatcgaggaaggccgtgcggacaagaataacaacccgctgaagaacgcgccgcacacggtggaagacctggtcggtgaatgggatcgtccctatagccgcgaaaagggctgcttcccgcccggcgccttccgcatcgacaaatactggtcgccggtcaaccgcatcgacaatgtctatggcgaccgcaacctgatctgcacctgcccgccgatggaggcttatgccgaggccgcagaataa

SEQ ID NO: 2957 - protein, 954 aa, Agrobacterium tumefaciens
MTTPTEFHFTDYQPYDFANRRHIGPSPSEMAEMLKVVGYKSLDALIDATVPSSIRQKVPLTWGAALTEREALDRLRETANKNQVLTSLIGQGYYGTITPPVIQRNILENPAWYTAYTPYQPEISQGRLEALLNYQTMVCDLTGLDVANASLLDEATAAAEAMAMCQRVAKSKATAFFVDANCHPQTIALIETRAAPLGWKVIIGNPFTDLDPVDVFGAIFQYPGTHGHVSDFTGLISRLHQTGAIAAVAADLLALTLLKSPGEMGADIAIGTSQRFGVPVGYGGPHAAYMSVKDAHKRSMPGRLVGVSVDARGNRAYRLSLQTREQHIRREKATSNICTAQVLLAVMASMYGVFHGPQGIKAIAQQTHQKAVLMAKGLEKLGYTIEPETFFDTITVEVGHMQGVILRSAVAEGVNLRKVGATKIGMSLDERTRPATLEAVWRAFGGNFSISDFEPDYRLPKDLLRTSQYMTHPIFHMNRAESEMTRYIRRLSDRDLALDRSMIPLGSCTMKLNATAEMLPITWPEFSDIHPFVPANQALGYKEMIDDLSEKLCSVTGYDAFSMQPNSGAQGEYAGLLTIRNYHLANGGTHRDVCLIPTSAHGTNPASAQMVGMKVVPVKVRDNGDIDIDDFRLKAEQYAENLSCCMITYPSTHGVFEETVREICEITHKHGGQVYLDGANMNAMVGLARPGDIGSDVSHLNLHKTFCIPHGGGGPGMGPIGVKAHLAPFLPGHPTTDGREGAVSAAPFGSPSILPISWSYCLMMGGEGLTQATKVAILNANYIAERLKGAYDVLYKSETGRVAHECIIDTRPLADSCGVTVDDVAKRLIDCGFHAPTMSWPVAGTLMIEPTESETKAEIDRFCDAMLAIREEARDIEEGRADKNNNPLKNAPHTVEDLVGEWDRPYSREKGCFPPGAFRIDKYWSPVNRIDNVYGDRNLICTCPPMEAYAEAAE

SEQ ID NO: 2958 - DNA, 2952 bp, Anabaena sp
  CDS (1)..(2952): transl_table=11
gtggtatcttatgcctctattcctcagtctagcgatgaagctcactctaccgtaggtgctagtctacagctagacgaaaggaaacaagatttaaataattttatacaaagacatataggcccatcatcggcagatattcaacaaatgcttgatgtgctgggattttctagtctagatgacttgattgagaaaacagtaccaagcgcaatcaggctgcatgaacagctacagttgccagaagcacaaactgagtatgcagccttggcaaagttaaaacaaattgcctctaaaaatcaggtgtttcgctcatacattggtatgggatattacgatacgattactccttcagtcatcgggcgtaatatcttagaaaaccctggttggtatactgcctatactccctatcagccggagattgcccaagggcgactagaagcactgcttaatttccaaaccatgattatcgatctaacagggttggaaattgccaatgcttccctacttgatgaagcaacagccgccgccgaagccatgagtatgagttacggtgtgagcaaaaataaggccaatgcttattttgtctctcatgattgtcatccccaaatcatcgacgttttacaaacacgggctaaacccttagggattgagattattatcggggatcaccagacatttgattttgataaaccgatttttggtgcagttttacaatatcccgccagtgatggcacaatctacgactaccgagcttttattgaaacatctcatgctcaaggtgcattggtaactgtagccgcagacccattaagtttaactttacttacccctcctggtgagtttggggctgatattgccgtaggtagcacccaacgcttcggtattcccttggggttcggcggcccccatgcggcatattttgcaaccaaagaagagtacaagcggcaagttccagggcgcattgtgggggtatctaaagatgtccacggtaaaactgccctgcgtctggctttgcaaacccgcgaacaacatattcgtcgtgaaaaagctacgagtaatatttgtacagcacaggtattgctggcagtgatggcgagtatgtacgctgtgtatcacgggccagaaggactcaagcaaattgccgagagaatacatcacctgactctggtcttaggagtgtggttgcagcgactaggttatacaatcacgtctcaatctttctttgatacattgcagataaagttgggggaaaaacccctccaagaaattctagaagcggctgaagcttaccgaattaatttgaggattgtggatacatccacagtgggaatatctcttgacgaaactacaactctcgaagatgtcaaggatatatgccggatatttgcgggaacggatgagttgccatttgttttaaatgtgcaagagtttgactggataattcagcaatcatctttaaaagatgaaccctttagccgtcaaagcagttacttaacacaccccgtcttcaaccgttatcactcagaaactgagttattgcgttatctacacaggctggaaactaaagatttgtcgttaactacttcgatgattcccttgggttcctgcacgatgaagttaaacgctacatcggagatgattcccgtaacttgggaagaatttggcagaatacatccttttgcgcccttaacccaaacgcggggttatcaaattctcttccaacaacttgaggcgtggttaggggaaattactggatttgctggggtttcgctgcaacccaatgctggttctcaaggggaatatacaggacttttggtaattcgtcagtatcaccaaagtcggggagaaacacaccgcaatgtgtgtttaattcctaattccgcacacgggacaaacccagcaagtgcggtgatgtgtggcatgaaggttgtagctgttgcctgtgatgccggaggtaatattgatattgatgacctcaaagccaaggcagaaaaacacagccatgaactggcggctttgatggtgacttatccctcaactcatggtgtgtttgaggcaggaattcaagaaatttgtgctgtgattcatagtcatggcggtcaagtttatatggatggggcaaatatgaatgcccaagtgggtatctgtcgtccaggggatattggcgcggatgtttgtcatttgaacttgcacaaaaccttctgtattcctcacggtggtggtggccctggtatggggccgattggcgttgcatcccatcttgtaccgtttttaccaggacatcctgttttggagagtgggaaaaatcctcaaaatatcggtgctgtagctgctgcaccttggggaagtgctagtattttggtgatttcttggatgtatattgtcatgatgggggcggatgggttgacgcaagcaaccaaggtggcaattctcaatgctaattacatcgctaagaaattggcagcttactatcctgtgttgtacaaagggcaaaatggcctagttgcccatgagtgtattttagatttgcgcgccctcaaaaaatcagcaaacatcgaaattgatgatatagccaagcgtcttatagactacggtttccatgccccgactgtctcctggcctgtggcaggtacaatcatggtggaacccacagaaagcgagtctcaagcagaattagatcgtttttgtgaggcgctgattgctattcgtcaagaaatcgccgacattgaagcaggtaaggtagatattcaagataattccttgaaaaatgccccccatacagttgaaagtttgattgttggggaatggcctcatccttattcccgtgaacaggcggcttatcccgcgccttggacaagggagcataaattctggccgagtgtaggcagaattgacgcagcttttggggataggaattttgtttgttcttgcctgccaatggatgcttataactaa

SEQ ID NO: 2959 - protein, 983 aa, Anabaena sp
MVSYASIPQSSDEAHSTVGASLQLDERKQDLNNFIQRHIGPSSADIQQMLDVLGFSSLDDLIEKTVPSAIRLHEQLQLPEAQTEYAALAKLKQIASKNQVFRSYIGMGYYDTITPSVIGRNILENPGWYTAYTPYQPEIAQGRLEALLNFQTMIIDLTGLEIANASLLDEATAAAEAMSMSYGVSKNKANAYFVSHDCHPQIIDVLQTRAKPLGIEIIIGDHQTFDFDKPIFGAVLQYPASDGTIYDYRAFIETSHAQGALVTVAADPLSLTLLTPPGEFGADIAVGSTQRFGIPLGFGGPHAAYFATKEEYKRQVPGRIVGVSKDVHGKTALRLALQTREQHIRREKATSNICTAQVLLAVMASMYAVYHGPEGLKQIAERIHHLTLVLGVWLQRLGYTITSQSFFDTLQIKLGEKPLQEILEAAEAYRINLRIVDTSTVGISLDETTTLEDVKDICRIFAGTDELPFVLNVQEFDWIIQQSSLKDEPFSRQSSYLTHPVFNRYHSETELLRYLHRLETKDLSLTTSMIPLGSCTMKLNATSEMIPVTWEEFGRIHPFAPLTQTRGYQILFQQLEAWLGEITGFAGVSLQPNAGSQGEYTGLLVIRQYHQSRGETHRNVCLIPNSAHGTNPASAVMCGMKVVAVACDAGGNIDIDDLKAKAEKHSHELAALMVTYPSTHGVFEAGIQEICAVIHSHGGQVYMDGANMNAQVGICRPGDIGADVCHLNLHKTFCIPHGGGGPGMGPIGVASHLVPFLPGHPVLESGKNPQNIGAVAAAPWGSASILVISWMYIVMMGADGLTQATKVAILNANYIAKKLAAYYPVLYKGQNGLVAHECILDLRALKKSANIEIDDIAKRLIDYGFHAPTVSWPVAGTIMVEPTESESQAELDRFCEALIAIRQEIADIEAGKVDIQDNSLKNAPHTVESLIVGEWPHPYSREQAAYPAPWTREHKFWPSVGRIDAAFGDRNFVCSCLPMDAYN

SEQ ID NO: 2960 - DNA, 3135 bp, Arabidopsis thaliana
  CDS (1)..(3135)
atggagcgtgcaaggagacttgcttacagagggatcgtgaaacgtctcgtcaacgagacaaaacgccaccgtaacggcgaatcctctcttcttccgacgacgactgttactccctcaaggtatgtctcctccgtctcctcctttctccatcgccgtcgtgatgtctctggatcggcttttaccacctccggtagaaatcaacaccagacacgatcgatctccgtcgatgcgttgaagccaagcgacactttcccgcgccggcacaactcagcaacaccggatgaacaagctcagatggcgaattactgcggattcgataatctcaacacgttgattgattcgactgttccgaaatcgattcggttagattcgatgaagttttccgggatatttgatgaaggattaacggagagtcaaatgattgagcatatgagtgatttagcttcgaagaacaaagttttcaaatcgttcattggtatgggatactataacactcatgttcctcctgtgattttgcgtaatataatggagaatcctgcttggtatactcaatatactccttatcaagctgagatttctcaaggaagactcgaatctctgctcaattaccagacggttattactgatctcaccggtctaccgatgtcgaacgcttcgttgctcgatgaaggtacggcggcggcggaagcaatggcgatgtgtaataatattctaaaggggaagaagaagacgtttgttattgctagtaattgtcatcctcagactattgatgtttgcaagacgagagcggatggtttcgatttgaaagttgtgacggttgatattaaggatgtggattatagctctggtgatgtgtgtggagtgttggttcagtatccggggactgaaggggaggtgttggattatggtgagtttgttaagaatgctcatgctaatggtgttaaggttgttatggctacggatttgttggctttgacgatgttgaaaccgccgggtgagtttggggcggatattgttgttgggtcgggtcagaggtttggtgttccgatgggttatggtggtcctcatgctgctttcttggctacttcacaagagtataagagaatgatgcctgggaggattattggtgttagtgttgattcttccgggaagcaagctttgcgtatggctatgcagactagggaacagcatatccgcagggataaagctaccagcaacatctgtaccgctcaggccttgcttgcaaatatgactgctatgtatgctgtttaccatggaccagaaggcttaaaatctattgcacaacgggttcatggtctcgctggtgtatttgccttaggattgaagaaactgggaactgcacaagtccaagatcttcccttctttgacactgtcaaagttacatgttcagatgcaactgcaatttttgatgtggcagccaagaaggagatcaatttgcgtcttgtggactccaacactattactgttgctttcgatgaaacaaccaccttggatgatgtcgataaactttttgaagtttttgcttcgggcaagcccgttcaattcacggctgagtctcttgcaccggagtttaacaatgctattccctctagcctaacaagagagagcccttatctgacccatccaatcttcaacatgtaccacacggagcatgagttgcttaggtacatccacaagttacaaaataaagatctatcattgtgccacagcatgattccacttggatcttgtacgatgaaattgaatgccaccactgaaatgatgccagtcacatggccaagtttcaccaacatgcacccttttgctcctgttgaacaagcccaaggttatcaggaaatgtttacgaatttgggtgagctcttatgtacgatcactggattcgactctttctcattgcaacctaatgccggtgctgctggcgagtacgccgggctcatggttatccgtgcatatcatatgtcaagaggcgatcatcacagaaatgtgtgcatcatacctgtttctgcacacgggacaaaccctgctagtgctgccatgtgcggaatgaaaattgttgccgttggaactgatgccaaaggaaacattaacatcgaagagttgaggaacgccgccgaagccaacaaggacaacttggctgctcttatggttacatacccttccacccatggagtctacgaagagggtatcgacgagatctgcaacataattcatgaaaatggaggccaagtttatatggatggtgctaatatgaatgcacaggtgggtttgacaagccctggttttattggagcggatgtttgccatctcaatctccacaagaccttctgtatccctcacggaggtggaggtcccggaatgggccctatcggtgtgaagcaacatttggctccattcctaccttctcacccagtgatacctaccggtggtatccctgaacccgagcagacatcaccgctgggaaccatttctgcagcaccatgggggtctgcgcttatcttgccaatctcgtatacttacattgccatgatgggatctggaggactcaccgatgcctcaaagattgcaattttgaacgctaactacatggcaaagcgtctggagagccactacccagttcttttccgtggtgtcaatggaacagtcgctcacgaattcatcattgacttgagaggattcaagaacactgctggaattgaaccagaggatgtggccaaacgattgatggattatggtttccatggaccgacaatgtcttggcctgtccctggaacgcttatgatcgagccaaccgaaagcgaaagcaaggctgagttagataggttctgtgatgctctcatctcgatcagggaagagatttcacagattgagaaaggaaacgcagatccaaacaacaacgttctgaagggtgctccacatcctccgtcattgctaatggcagatacatggaaaaagccgtattcacgggaatacgcagccttccccgctccatggctccgctcctccaagttctggcccactacagggcgagtggacaacgtgtatggagaccgtaatctggtgtgcactctccaaccggcgaacgaagaacaggctgcagctgcagtgtctgcttaa

SEQ ID NO: 2961 - protein, 1044 aa, Arabidopsis thaliana
MERARRLAYRGIVKRLVNETKRHRNGESSLLPTTTVTPSRYVSSVSSFLHRRRDVSGSAFTTSGRNQHQTRSISVDALKPSDTFPRRHNSATPDEQAQMANYCGFDNLNTLIDSTVPKSIRLDSMKFSGIFDEGLTESQMIEHMSDLASKNKVFKSFIGMGYYNTHVPPVILRNIMENPAWYTQYTPYQAEISQGRLESLLNYQTVITDLTGLPMSNASLLDEGTAAAEAMAMCNNILKGKKKTFVIASNCHPQTIDVCKTRADGFDLKVVTVDIKDVDYSSGDVCGVLVQYPGTEGEVLDYGEFVKNAHANGVKVVMATDLLALTMLKPPGEFGADIVVGSGQRFGVPMGYGGPHAAFLATSQEYKRMMPGRIIGVSVDSSGKQALRMAMQTREQHIRRDKATSNICTAQALLANMTAMYAVYHGPEGLKSIAQRVHGLAGVFALGLKKLGTAQVQDLPFFDTVKVTCSDATAIFDVAAKKEINLRLVDSNTITVAFDETTTLDDVDKLFEVFASGKPVQFTAESLAPEFNNAIPSSLTRESPYLTHPIFNMYHTEHELLRYIHKLQNKDLSLCHSMIPLGSCTMKLNATTEMMPVTWPSFTNMHPFAPVEQAQGYQEMFTNLGELLCTITGFDSFSLQPNAGAAGEYAGLMVIRAYHMSRGDHHRNVCIIPVSAHGTNPASAAMCGMKIVAVGTDAKGNINIEELRNAAEANKDNLAALMVTYPSTHGVYEEGIDEICNIIHENGGQVYMDGANMNAQVGLTSPGFIGADVCHLNLHKTFCIPHGGGGPGMGPIGVKQHLAPFLPSHPVIPTGGIPEPEQTSPLGTISAAPWGSALILPISYTYIAMMGSGGLTDASKIAILNANYMAKRLESHYPVLFRGVNGTVAHEFIIDLRGFKNTAGIEPEDVAKRLMDYGFHGPTMSWPVPGTLMIEPTESESKAELDRFCDALISIREEISQIEKGNADPNNNVLKGAPHPPSLLMADTWKKPYSREYAAFPAPWLRSSKFWPTTGRVDNVYGDRNLVCTLQPANEEQAAAAVSA

SEQ ID NO: 2962 - DNA, 2919 bp, Azoarcus sp
  CDS (1)..(2919): transl_table=11
atgccgaatgcttcccctgcttcgcccctgaacgcgccgctcgccgagctcgagcaacgcgacgcgttcatcggccgccacgtcggtccgaacgcgaccgaaatcgccacgatgcttgccgccgtgggcgcccccgacctcgatacgctgatcgaccagaccgtgccgccggcgatccggctcgccgcgccgctgccgctcgaagggccgaagcccgagcacgaggcccttgcggacctgcgcgcgatcgcggcgaagaacgtcatcaggaaatcgctgatcggcatgggctactacggcacccatacgccggcggtgatcctgcgcaacgtcatggaaaacccaggctggtacaccgcctacacgccgtaccaggccgagatcgcgcagggccggctcgaagcgctgctgaactaccagcagatggtcatcgacctgaccgggctggaactcgcgaatgcctcgctgctcgacgaagcgacggcggcggccgaggcgatgacgatggcgcggcgcgtagccaagtcgaaatcgaacgtcttctacgtcgatgaagcgtgcttcccgcagacgatcgacgtgctgcgcacgcgggccgggttgttcggcttcgagctgaagttcggcccggcgcacgacgccgcgaacgcggacgctttcggcgcgctgttgcagtatccgaacgagcgcggcgagatcatcgacctcagcggcacggtcgctgcgctgaaagcgaaaggcgccgtcgtcgcaatcgcttccgacctgatggcgctggtgctgctgaaatctcccggcacgatgggcgcggacatcgcgctcggctcggcgcagcgcttcggcgtgccgatgggcttcggcggcccgcacgcggcattcttcgcgacgcgcgaagcgaacgtgcgcgcgatgcccgggcgcatcatcggcgtgtcgaaggacgcgcgcggcaagacggcgctgcgcatgacgctgcagacgcgtgaacagcacatccgccgcgagaaggcgaactccaacatctgcacgtcgcaagtgctgctcgcgaatatgtcgggcttctacgccgtctatcacggcccgcagggcttgcgcacgatcgccgcgcgcatccaccggctcgccgcgattcttgcgcaagggctgcgtgacgccggcttcaacgtgccggccggcgcgttcttcgacacgctgcaggtcgataccggcgcccgcacggcagagctcctcgccgcttgcgacgcggcgggtttcaacctgcggccggtgtcggatacggtactggggctgtcggtcgatgagacgacgacgggcgacgacgttgcgacgctgctgcgtctgttcggcgcttcgggcgaactcgcagcgcttgacgcgaaagtcggcgcggccggcggcgcgatccccgctgcgctgctgcgcgacgacgcgatcctcacgcacccggtattcaacacgcatcacaccgagcacgagatgctgcgctatctgaagaagctgcagaaccgcgacctcgcgctcgaccattcgatgatttcgctcggctcgtgcacgatgaagctcaacgcgacgagcgaaatgatcccgatcacgtgggcagagttcgcgaacctgcatccgttcgcgccgcgcgaacaggtccgcggctatctcgagatgatcgacggcctcgccggctacctgaaagcggtcaccggtttcgccgcgatctcgatgcagccgaactccggcgcgcagggcgaatacgccggcctcgtcgcgatccgccgctaccacgacagccgcggcgacacgcatcgccgcgtgtgcctgatcccgaagtcggcgcacggcacgaacccggcgagtgcgcagatgtgcggcatggacgtggtcgtcgtcgcgtgcgacgaacgcggcaatgtggacctcgccgatctcgaggcgaaagtcgcccagcatgccgaccggctcgccgcgctgatgatcacgtacccgtcgacgcacggcgtgttcgaggaatcaatccgcgagatttgcgccagcgtgcatcgccacggcggccaggtgtacatggacggcgcgaacctcaacgcgcaggtcggcctgacttcacccgcgacgatcggcgccgacgtcagccacatgaacctgcacaagaccttctgcatccctcacggcggcggcggaccgggcatggggccgatcgggctcgccgcgcacctcgccccgttcatggccgaccacgtcgtcgcggcgaccggcgatgaaacgcgcccgaacaagggccagggtgcggtgagcgcagcgcccttcggctcggcgagcatcctgccgatctcgtggatgtacatcgcgatgatgggcgacaccgggctcaagcttgccaccgaggttgcgatcctcaacgcgaactacgtcgcgaaccgcctcgccgagcattacccggtgctctacactggttcgcagggccgggtcgcgcacgagtgcatcctcgacatccgtccgatcaaggcgaataccggcatcagcgaggtcgatatcgccaagcggctgatggattacggcttccacgcgccgacgatgtcgttcccggtcgccggcacgatcatgatcgaaccgaccgaatccgaggatctcggcgagctcgatcgtttcatcgcggcgatgatcacgatccgcaacgagatccgcgaagtcgagaacggcgcgtggccgacggacgacaacccactgaagaacgcgccgcacacgcaggcggatttcatcgctgccgacggcgcgcaatggagccgcccgtacagccgcgagcaggcggttttcccgctgccgtgggtcgccgaaaacaagttctggccgagcgtcaaccgcatcgacgacgtctatggcgaccgcaatcttttctgcgcctgcgtgcccatagaggactacgcgagctag

SEQ ID NO: 2963 - protein, 972 aa, Azoarcus sp
MPNASPASPLNAPLAELEQRDAFIGRHVGPNATEIATMLAAVGAPDLDTLIDQTVPPAIRLAAPLPLEGPKPEHEALADLRAIAAKNVIRKSLIGMGYYGTHTPAVILRNVMENPGWYTAYTPYQAEIAQGRLEALLNYQQMVIDLTGLELANASLLDEATAAAEAMTMARRVAKSKSNVFYVDEACFPQTIDVLRTRAGLFGFELKFGPAHDAANADAFGALLQYPNERGEIIDLSGTVAALKAKGAVVAIASDLMALVLLKSPGTMGADIALGSAQRFGVPMGFGGPHAAFFATREANVRAMPGRIIGVSKDARGKTALRMTLQTREQHIRREKANSNICTSQVLLANMSGFYAVYHGPQGLRTIAARIHRLAAILAQGLRDAGFNVPAGAFFDTLQVDTGARTAELLAACDAAGFNLRPVSDTVLGLSVDETTTGDDVATLLRLFGASGELAALDAKVGAAGGAIPAALLRDDAILTHPVFNTHHTEHEMLRYLKKLQNRDLALDHSMISLGSCTMKLNATSEMIPITWAEFANLHPFAPREQVRGYLEMIDGLAGYLKAVTGFAAISMQPNSGAQGEYAGLVAIRRYHDSRGDTHRRVCLIPKSAHGTNPASAQMCGMDVVVVACDERGNVDLADLEAKVAQHADRLAALMITYPSTHGVFEESIREICASVHRHGGQVYMDGANLNAQVGLTSPATIGADVSHMNLHKTFCIPHGGGGPGMGPIGLAAHLAPFMADHVVAATGDETRPNKGQGAVSAAPFGSASILPISWMYIAMMGDTGLKLATEVAILNANYVANRLAEHYPVLYTGSQGRVAHECILDIRPIKANTGISEVDIAKRLMDYGFHAPTMSFPVAGTIMIEPTESEDLGELDRFIAAMITIRNEIREVENGAWPTDDNPLKNAPHTQADFIAADGAQWSRPYSREQAVFPLPWVAENKFWPSVNRIDDVYGDRNLFCACVPIEDYAS

SEQ ID NO: 2964 - DNA, 2850 bp, Bacteroides fragilis
  CDS (1)..(2850): transl_table=11
atgaaaaccgatttattagcctgccgccacatcggcgtcaacaaagcggatgccgaagtaatgctccggaaaattggagttgcttcgctcgacgaactgatcgataaaaccattccggccaacatccggctcaaagcacctctggcactacccgcaccgatgaccgaatacgagtttgcccgccacatcgctgaactggcaggcaaaaacaaactgttcaccacttatatcggtatgggatggtacaacacgatcacccctgcagtcatccagcgaaatgtattcgagaatccggtctggtatacttcttatactccttaccagacagaagtttcgcaaggaagactggaagccctgatgaacttccaaactgccgtatgtgacctgaccgccatgcccttggccaactgttcactgctggacgaagccaccgctgccgccgaagctgtgacgatgatgtatggcttgcgttcacgcaaccagcagaaggcgggagccaacgtggtgtttatcgacgaaaatatcttcccgcagaccttggcggtcatcaccactcgcgccatcccgcaaggcattgaaatccgtaccggaaagttccgggatcttgaatttacagatgacctctttgcctgcgtcctgcaatatcctaatgcaaacggtaatgcggaagactaccgagaatttaccgaaaaagcacatacagccaactgcaaggtagctgtggctgccgatatcctgagtcttgcactacttacccctccgggcgaatggggagcggacattgtattcggtaccacacaacgtttgggtactcccatgttctacggtggtccttcggccggttatttcgctacccgcgacgaatacaaacgcaacatgccgggacgtatcatcggatggtcgaaagataaatatggcaaactctgttaccgcatggcactccagacacgcgaacagcatatcaaacgggaaaaagcgacttccaatatctgtaccgctcaggcactgctcgctaccatggcaggattctataccgtctatcacggacaggaaggtatccgtaacatcgcttcacgcatccatagcattaccgttttcctggaaaagagtatcggtaaactgggattcaagcaagtgaacaaacagtatttcgataccctccggttcattttgcccgacagcgtatcggcacagcagattcgcaccatcgctctgagcaaagaggtgaacctgcgctattttgataatggagacgtgggactgagtattgacgaaacaaccgacgtagcagctgccaacattctactgtctatctttgccatcgctgccggaaaagacttccagaaagtggatgacatccccgaagcaactatcatcagcgaggaattgaaacgccagaccccttacctcacacacgaagtattctctaaatatcataccgaaacggaaatgatgcgctacatcaagcgtctcgaccggaaggatatttcattggcacaatcgatgatttcactcggttcctgcaccatgaaactgaatgcggcagccgaaatgttacctctgagctgtgctgagtttatgtgcatgcacccgcttgttccggaggatcaggcggccggataccgcgaactgattcacaacctgagtgaagagctgaaagtcatcaccggatttgccggagtaagcctgcaacccaattccggtgctgccggtgagtatgccggtctgcgcaccatccgtgcctatcttgaaagcatcggacaaggacaccgcaacaaagtattgatccccgcatctgcacacggcaccaatcccgcatcagccatccaggccggattcaccactgtaacttgtgcatgtgacgaacatggaaacgtagatatggatgacctccgtgccaaagctgaagaaaataaggatgacctggccgcactgatgatcacctatccctcgacacacggtatctttgaaacggaaatcgtagagatctgccaaatcattcacgcctgtggagctcaggtatatatggatggagccaacatgaatgcacaggtaggactgacgaatccgggatttatcggagcggacgtctgtcacctgaatctgcataaaacctttgcatctccccacggaggaggcggccccggcgtaggcccgatctgtgtagcggaacatctggtaccgttccttccgggacacggactgtttggcaactcacagaacgaagtatccgccgcaccgtttggcagtgccggtattctgcctatcacctacggctatatccgtatgatgggtgccgaaggactgacaatggcaaccaagacagccattctcaatgcaaactatctggctgcttgcctgaaagatacgtatggcattgtataccggggagccaacggctttgtgggacacgagatgattctggaatgtcgcaaggtatacgaagaaaccggtatcagcgaaaatgatattgccaaacgcctgatggactacggctatcatgctcctaccctctccttccccgtgcacggcacactgatgatcgagcccactgaaagcgaaagcctctccgaactggataacttcgtccttacgatgttgaccatctggaatgaaattcaggaagtgaaaaacggtgaagccgataaggaagacaatgtactgataaatgctccgcaccctgaatatgaagtagtaagcgatcagtgggaacactgctatacgcgtgaaaaagccgcatatccgatagagagtgtgcgtgagaataagttctgggtaaatgtagcccgtgtagataatacgctgggcgatcgcaaactgctgcccacatgctacggctgcttcgactga

SEQ ID NO: 2965 - protein, 949 aa, Bacteroides fragilis
MKTDLLACRHIGVNKADAEVMLRKIGVASLDELIDKTIPANIRLKAPLALPAPMTEYEFARHIAELAGKNKLFTTYIGMGWYNTITPAVIQRNVFENPVWYTSYTPYQTEVSQGRLEALMNFQTAVCDLTAMPLANCSLLDEATAAAEAVTMMYGLRSRNQQKAGANVVFIDENIFPQTLAVITTRAIPQGIEIRTGKFRDLEFTDDLFACVLQYPNANGNAEDYREFTEKAHTANCKVAVAADILSLALLTPPGEWGADIVFGTTQRLGTPMFYGGPSAGYFATRDEYKRNMPGRIIGWSKDKYGKLCYRMALQTREQHIKREKATSNICTAQALLATMAGFYTVYHGQEGIRNIASRIHSITVFLEKSIGKLGFKQVNKQYFDTLRFILPDSVSAQQIRTIALSKEVNLRYFDNGDVGLSIDETTDVAAANILLSIFAIAAGKDFQKVDDIPEATIISEELKRQTPYLTHEVFSKYHTETEMMRYIKRLDRKDISLAQSMISLGSCTMKLNAAAEMLPLSCAEFMCMHPLVPEDQAAGYRELIHNLSEELKVITGFAGVSLQPNSGAAGEYAGLRTIRAYLESIGQGHRNKVLIPASAHGTNPASAIQAGFTTVTCACDEHGNVDMDDLRAKAEENKDDLAALMITYPSTHGIFETEIVEICQIIHACGAQVYMDGANMNAQVGLTNPGFIGADVCHLNLHKTFASPHGGGGPGVGPICVAEHLVPFLPGHGLFGNSQNEVSAAPFGSAGILPITYGYIRMMGAEGLTMATKTAILNANYLAACLKDTYGIVYRGANGFVGHEMILECRKVYEETGISENDIAKRLMDYGYHAPTLSFPVHGTLMIEPTESESLSELDNFVLTMLTIWNEIQEVKNGEADKEDNVLINAPHPEYEVVSDQWEHCYTREKAAYPIESVRENKFWVNVARVDNTLGDRKLLPTCYGCFD

SEQ ID NO: 2966 - DNA, 2850 bp, Bacteroides fragilis
  CDS (1)..(2850): transl_table=11
atgaaaaccgatttattagcctgccgccacatcggcgtcaacaaagcggatgccgaagtaatgctccggaaaattggagttgcttcgctcgacgaactgatcgataaaaccattccggccaacatccggctcaaagcacctctggcactacccgcaccgatgaccgaatacgagtttgcccgccacatcgctgaactggcaggcaaaaacaaactgttcaccacttatatcggtatgggatggtacaacacgatcaccccggcagtcatccaacgaaatgtattcgagaatccggtctggtatacttcttatactccttaccagacagaagtttcgcaaggaagactggaagccctgatgaacttccaaactgccgtatgtgacctgaccgccatgcccttggccaactgttcactgctggacgaagccaccgctgccgccgaagctgtgacgatgatgtatggcttgcgttcacgcaaccagcagaaggcgggagccaacgtggtgtttatcgacgaaaatatcttcccgcagaccttggcggtcatcaccactcgcgccatcccgcaagacattgaaatccgtaccggaaagttccgggatcttgaatttacagatgacctctttgcctgcgtcctgcaatatcctaatgcaaacggtaatgcggaagactaccgagaatttaccgaaaaagcacatacagccaactgcaaggtagctgtggctgccgatatcctgagtcttgcactacttacccctccgggcgaatggggagcggacattgtattcggtaccacacaacgtttgggtactcccatgttctacggtggtccttcggccggttatttcgctacccgcgacgaatacaaacgcaacatgccgggacgtatcatcggatggtcgaaagataaatatggcaaactctgttaccgcatggcactccagacacgcgaacagcatatcaaacgggaaaaagcgacttccaatatctgtaccgctcaggcactgctcgctaccatggcaggattctataccgtctatcacggacaggaaggtatccgtaacatcgcttcacgcatccatagcattaccgttttcctggaaaagagtatcagtaaactgggattcaagcaagtgaacaaacagtatttcgataccctccggttcattttgcccgacagcgtatcggcacagcagattcgcaccatcgctctgagcaaagaggtgaacctgcgctattttgataatggagacgtgggactgagtattgacgaaacaaccgacgtagcagctgccaacattctactgtctatctttgccatcgctgccggaaaagacttccagaaagtggatgacatccccgaagcaactatcatcagcgaggagttgaaacgccagaccccttacctcacacacgaagtattctctaaatatcataccgaaacggaaatgatgcgctacatcaagcgtctcgaccggaaggatatttcattggcacaatcgatgatttcactcggttcctgcaccatgaaactgaatgcagcagccgaaatgttacctctgagctgtgctgagtttatgtgcatgcacccgcttgttccggaggatcaggcggccggataccgcgaactgattcacaacctgagtgaagaactgaaagtcatcaccggatttgccggagtaagcctgcaacccaattccggtgctgccggtgagtatgccggtctgcgcaccatccgtgcctatcttgaaagcatcggacaaggacaccgcaacaaagtattgatccccgcatctgcacacggcaccaatcccgcatcagccatccaggccggattcaccactgtaacttgtgcatgtgacgaacatggaaacgtagatatggatgacctccgtgccaaagctgaagaaaataaggatgacctggccgcactgatgatcacctatccctcgacacacggtatctttgaaacagaaatcgtagagatctgccaaatcattcacgcctgtggagctcaggtatatatggatggagccaacatgaatgcacaggtaggactgacgaatccgggatttatcggagcggacgtctgtcacctgaatctgcataaaacctttgcatctccccacggaggaggcggccccggcgtaggcccgatctgtgtagcggaacatctggtaccgttccttccgggacacggactgtttggcaactcacagaacgaagtatccgccgcaccgtttggcagtgccggtattctgcctatcacctacggctatatccgtatgatgggtgccgaaggactgacaatggcaaccaagacagccattctcaatgcaaactatctggctgcttgcctgaaagatacgtatggcattgtataccggggagccaacggctttgtgggacacgagatgattctggaatgtcgcaaggtatacgaagaaaccggtatcagcgaaaatgatattgccaaacgcctgatggactacggctatcatgctcctaccctctccttccccgtgcacggcacactgatgatcgagcccactgaaagcgaaagcctctccgaactggataacttcgtccttacgatgttgaccatctggaacgaaattcaggaagtgaaaaacggtgaagccgataaggaagacaatgtactgataaatgctccgcaccctgaatatgaagtagtaagcgatcagtgggaacactgctatacgcgtgaaaaagccgcatatccgatagagagtgtgcgtgagaataagttctgggtaaatgtagcccgtgtagataatacgctgggcgaccgcaaactgctgcccacatgctacggctgcttcgactga

SEQ ID NO: 2967 - protein, 949 aa, Bacteroides fragilis
MKTDLLACRHIGVNKADAEVMLRKIGVASLDELIDKTIPANIRLKAPLALPAPMTEYEFARHIAELAGKNKLFTTYIGMGWYNTITPAVIQRNVFENPVWYTSYTPYQTEVSQGRLEALMNFQTAVCDLTAMPLANCSLLDEATAAAEAVTMMYGLRSRNQQKAGANVVFIDENIFPQTLAVITTRAIPQDIEIRTGKFRDLEFTDDLFACVLQYPNANGNAEDYREFTEKAHTANCKVAVAADILSLALLTPPGEWGADIVFGTTQRLGTPMFYGGPSAGYFATRDEYKRNMPGRIIGWSKDKYGKLCYRMALQTREQHIKREKATSNICTAQALLATMAGFYTVYHGQEGIRNIASRIHSITVFLEKSISKLGFKQVNKQYFDTLRFILPDSVSAQQIRTIALSKEVNLRYFDNGDVGLSIDETTDVAAANILLSIFAIAAGKDFQKVDDIPEATIISEELKRQTPYLTHEVFSKYHTETEMMRYIKRLDRKDISLAQSMISLGSCTMKLNAAAEMLPLSCAEFMCMHPLVPEDQAAGYRELIHNLSEELKVITGFAGVSLQPNSGAAGEYAGLRTIRAYLESIGQGHRNKVLIPASAHGTNPASAIQAGFTTVTCACDEHGNVDMDDLRAKAEENKDDLAALMITYPSTHGIFETEIVEICQIIHACGAQVYMDGANMNAQVGLTNPGFIGADVCHLNLHKTFASPHGGGGPGVGPICVAEHLVPFLPGHGLFGNSQNEVSAAPFGSAGILPITYGYIRMMGAEGLTMATKTAILNANYLAACLKDTYGIVYRGANGFVGHEMILECRKVYEETGISENDIAKRLMDYGYHAPTLSFPVHGTLMIEPTESESLSELDNFVLTMLTIWNEIQEVKNGEADKEDNVLINAPHPEYEVVSDQWEHCYTREKAAYPIESVRENKFWVNVARVDNTLGDRKLLPTCYGCFD

SEQ ID NO: 2968 - DNA, 2850 bp, Bacteroides thetaiotaomicron
  CDS (1)..(2850): transl_table=11
atgaaaacagatttgttagctagccgtcacatcggcatcaatgaagaagacacagctgtgatgctccgcaaaataggcgtagactcactggatgaactgatcaacaaaaccatccctgccaacatccgactgaaggaaccgctggcactggccaagccgttgacggaatacgaatttggaaaacacattgccgacctggcaagtaaaaacaaactgtatacgacatacatcggattggggtggtataatacgattactcctgccgttatccaacggaatgtattcgaaaatcccgtatggtatacttcttacacgccttatcagacagaagtgtcgcaaggaagactggaagcgttgatgaatttccagactgccgtctgtgacctcaccgctatgccgctcgccaactgctcactgctggatgaagcgactgccgccgccgaagccgtaaccatgatgtatgctctgcgttcgcgtacccagcaaaaagcaggtgccaacgtagtctttgtggacgaaaacatcttcccgcagaccttggcagtaatgaccacacgtgccattccacaaggcatcgaattgcgggtaggcaaatacaaagagtttgaaccctcaccggaaatcttcgcctgcatcctgcaatatcctaactccagcggtaatgtggaagactatgccgacttcacaaagaaggcacatgaagcagactgcaaagttgccgttgccgccgatattctgagtcttgccctgctgactcctccgggagaatggggagcggatatcgtattcggtacaacacagcgactgggtacaccgatgttttacggcgggccttcggcaggctacttcgccacacgtgacgagtacaagcggaatatgccgggacgcatcatcggatggtccaaagacaaatacggcaagctctgctaccgaatggctttgcagacacgcgaacagcatatcaaacgcgaaaaagccacttccaatatttgtacggctcaggcattactcgctacgatggcaggtttctacgctgtatatcacggacaggaaggaatcaaaacgattgcttcgcgtattcatagcatcactgtcttcctcgacaagcaattaaagaaattcggatatacgcaagtcaatgcacaatatttcgatacgctgcgtttcgagttgccggaacacgtttcggcgcagcagattcgcacgatcgcactgagcaaggaagtgaacctgcgctattatgaaaacggtgacgtaggctttagcatcgatgagacaacggacatagcagctacgaacgtgctgctttccatcttcgccattgccgccggcaaggattatcagaaggtagaggacgtgccggaaaagagcaatattgacaaagcactgaaacgtaccacgcctttcctcacgcacgaggtgttctccaactatcatacggaaacggaaatgatgcgctacatcaagcgtctggaccggaaggatatttcattggcccagtccatgatttccctcggatcgtgcacgatgaagctcaacgcagccgctgaaatgcttcctttaagccgtccggaatttatgagcatgcatccgttggtgccggaagatcaggcggaaggatatcgtgaattgatcagcaatttgagtgaggacttgaaggttattaccggatttgctggtgtcagcctgcaaccgaactcgggtgctgcgggagaatatgccggtctgcgagttatccgtgcctatcttgaaagcatcggtcagggacatcgcaacaaaatattgattccggcttcggcacacggtacgaatccggcatctgccatacaggccggatttgaaaccgtcacctgcgcttgcgacgagcaaggaaacgtggatatgggcgacctacgtgccaaagccgaagagaacaaggaagcactggctgcactgatgatcacctatccgtcaacgcatggtatcttcgagacggaaataaaggaaatctgtgaaatcatccacgcttgtggcgcacaagtatatatggacggtgccaacatgaatgcacaggtaggattgaccaatccgggatttataggtgcagacgtttgtcacttgaatttgcacaagacatttgcttcaccgcacggtggcggcggtccgggtgtaggtcctatctgtgtagctgagcatctggttccattcttaccgggacattcgatcttcggcagtacgcaaaatcaggtttccgcagctccgttcggcagtgcgggtatcttgcctatcacatacggctacatccggatgatgggtaccgaaggcttgacccaagctactaaaatagccattctcaatgccaactatctggctgcttgtctgaaagatacttatggcattgtttatcggggagctaccggtttcgtaggacacgaaatgattttggaatgccgcaaagtacatgaagaaacgggtatctcagaaaatgacattgcgaagcgtctgatggactatggttatcatgcaccgactctctctttccctgttcacggcacattaatgattgaacctaccgaaagcgaaagcctggcggagttggacaactttgtagacgtcatgctgaatatatggaaagaaattcaggaagtgaagaacgaagaagcggataagaatgataatgtgttaatcaatgccccgcatccggaatatgaaattgtgaatgacaactgggaacattcctacacacgtgagaaagcagcgtatccgatagaaagtgtgcgtgagaataagttctgggtgaatgtggctcgcgtagacaatacgttgggagaccggaaattattgccgacccgctacggaacgttcgaataa

SEQ ID NO: 2969 - protein, 949 aa, Bacteroides thetaiotaomicron
MKTDLLASRHIGINEEDTAVMLRKIGVDSLDELINKTIPANIRLKEPLALAKPLTEYEFGKHIADLASKNKLYTTYIGLGWYNTITPAVIQRNVFENPVWYTSYTPYQTEVSQGRLEALMNFQTAVCDLTAMPLANCSLLDEATAAAEAVTMMYALRSRTQQKAGANVVFVDENIFPQTLAVMTTRAIPQGIELRVGKYKEFEPSPEIFACILQYPNSSGNVEDYADFTKKAHEADCKVAVAADILSLALLTPPGEWGADIVFGTTQRLGTPMFYGGPSAGYFATRDEYKRNMPGRIIGWSKDKYGKLCYRMALQTREQHIKREKATSNICTAQALLATMAGFYAVYHGQEGIKTIASRIHSITVFLDKQLKKFGYTQVNAQYFDTLRFELPEHVSAQQIRTIALSKEVNLRYYENGDVGFSIDETTDIAATNVLLSIFAIAAGKDYQKVEDVPEKSNIDKALKRTTPFLTHEVFSNYHTETEMMRYIKRLDRKDISLAQSMISLGSCTMKLNAAAEMLPLSRPEFMSMHPLVPEDQAEGYRELISNLSEDLKVITGFAGVSLQPNSGAAGEYAGLRVIRAYLESIGQGHRNKILIPASAHGTNPASAIQAGFETVTCACDEQGNVDMGDLRAKAEENKEALAALMITYPSTHGIFETEIKEICEIIHACGAQVYMDGANMNAQVGLTNPGFIGADVCHLNLHKTFASPHGGGGPGVGPICVAEHLVPFLPGHSIFGSTQNQVSAAPFGSAGILPITYGYIRMMGTEGLTQATKIAILNANYLAACLKDTYGIVYRGATGFVGHEMILECRKVHEETGISENDIAKRLMDYGYHAPTLSFPVHGTLMIEPTESESLAELDNFVDVMLNIWKEIQEVKNEEADKNDNVLINAPHPEYEIVNDNWEHSYTREKAAYPIESVRENKFWVNVARVDNTLGDRKLLPTRYGTFE

SEQ ID NO: 2970 - DNA, 2796 bp, Bartonella henselae
  CDS (1)..(2796): transl_table=11
atgttagagcgtccttttttttctcgccatattgggcttcgtcctgatgaaaaacaaaaaatgcttgatattgtagcagtcgattctattgatacattagtttctcaagctcttcctcactctattcatttgggacgaccgcttaatcttccaaaggcagtgagtgaagggcaagctttggaagaactctccaagatgatggagcgtaattatctgcacaaaagctttattgggcagggatatcatggaacttatgttcctcccgttattttgcggaatctttttgaaaatccagcttggtatactgcttatacgccttatcaggcagaaattagtcagggtcgtttagagcttttattttattttcagacattgattagtgaactcacaggtttgcctgttgcagctgcttcacttcttgatgaagcaaccgctttagctgaagctattacagtggctttccgctttacgcgtgagaaaaaaatgaagatttctcttcagagtcttttacatccgcagatcttaagcgttgtacaaacgcgtgctgaaacacaaggtcttcaagttagcaaaaatagcgaaatttgttctgatacagctgcgattgttttgtcttggccagatacaaaaggctcttttaatgattatagtgaagtcattaaagaagcaaaagcaaaaggagcactggtgattgtggttgctgatcctttggcacttacccttatggaagcaccagcaaaatggggagctgatattgttgtcggctctatgcagcgttatggcgttccaatgggatttggggggccgcatgctggttaccttgctgtcagtgatgcgctcacacgtctcattccaggacgcattgttggtcaatctgtggatacgaaaggacgtgttggttttcgtttagcattgcaaacacgtgaacaacatatccggcgcgataaagcgacgtcaaatatttgtacagcacaggctctgttagcaaatatggcaacggcttatgctgtttggcatggtccacaaggtttacaggaaattgctcagcgcgttcatcatttaacatgtcgtttcgttggtggtttagaggcagtaggtatctcttgtgaaggggaatatttttttgattgtgtcagcattgttgtgaagggaaaagcacgggagattgcttgtcaggcaaaagctggtgggcgtcttatccgtgttcttgatgatgatagggttgttatcaattttgatgaattatcaacacaagaagatgcccatgctttagcacagctttttggtgcagggttagttgatcaggcttctccaagacttatgggaaaggggcgggatactacttttctttcgcagccctttttccatgcggttcattcagagacggatatgatgcgctttttgcgtcgtttgtcagataaggatttggcattagatcgggcaatgattcctcttggctcttgtacaatgaagcttaatgcggcagctgaactgatgcctgtgagttggcctacggtagccaatatacacccttttgcttcgcgagaagatgcggtgggttatcaggaaatgattcatcagttaaatgcgtggttgtgtgaaattacagggtttgcacaagtttcttttcagccaaactctggtgctcaaggggaatatgctgggcttttggcaattcgtaggtatcaccaatcgcggggtgaacatcaacgcacgctttgtcttattcctgcatctgcgcatggtaccaatccagcttcagcacatatggccggtatggaagttgttgtggtgaaatgcttgaacgatggtgatgtggatcttgatgatctcaaaatgaaagcacaattgtataaggagcgtttagctgctctcatgatcacttatccttcaacacacggtgtttatgaggaaagtattaaggatatttgttctcttatccatgaaaatggagggcaagtttattttgatggtgccaatttaaatgcacttgttggccttgctcgtccggcagatattggggcggatgtttgtcatatgaaccttcataaaacatttgctattcctcatggtggcggtggtcctggtgtggggccaattggagtggtagagcatctcaaaccatttttgccaggtcatgaacaagaggggacaacacatgcagtttctgcagctccttatggaagcgcatctattctcgttattacttggatgtatattcggatgatgggcgctgagggtttgaaatatgcaacacaaacagcaattttgaatgccaattatattgctgcacgtctttcacaggtttattccattctttatcgaggcaaacatggacgtgttgctcacgaatgtatcgtggatacacgtgtgttgaaagagcagtatggggtgagtgttgatgatattgcaaaacgtctcattgattatgggtttcatgcgcccacgatgtcttttcctgttcctggaactttgatgattgagccaactgaatcagagccaaaagcagagattgatcgtttttgtgatgctttgctctctattgctgaggaagctaagaaaatcggtagtggtgtttggccaaaagatgataatccattggttcatgcaccacatacattggtcgatacattagatgatacttgggcgcggccttattcacgacaagaagctgcttttcccaattgctctcttgatccagcgaataaatattggcctcctgtttcacgtattgataatgttgcaggagacagaatgcttatttgttcttgtccgcccttgggaaacacttattaa

SEQ ID NO: 2971 - protein, 931 aa, Bartonella henselae
MLERPFFSRHIGLRPDEKQKMLDIVAVDSIDTLVSQALPHSIHLGRPLNLPKAVSEGQALEELSKMMERNYLHKSFIGQGYHGTYVPPVILRNLFENPAWYTAYTPYQAEISQGRLELLFYFQTLISELTGLPVAAASLLDEATALAEAITVAFRFTREKKMKISLQSLLHPQILSVVQTRAETQGLQVSKNSEICSDTAAIVLSWPDTKGSFNDYSEVIKEAKAKGALVIVVADPLALTLMEAPAKWGADIVVGSMQRYGVPMGFGGPHAGYLAVSDALTRLIPGRIVGQSVDTKGRVGFRLALQTREQHIRRDKATSNICTAQALLANMATAYAVWHGPQGLQEIAQRVHHLTCRFVGGLEAVGISCEGEYFFDCVSIVVKGKAREIACQAKAGGRLIRVLDDDRVVINFDELSTQEDAHALAQLFGAGLVDQASPRLMGKGRDTTFLSQPFFHAVHSETDMMRFLRRLSDKDLALDRAMIPLGSCTMKLNAAAELMPVSWPTVANIHPFASREDAVGYQEMIHQLNAWLCEITGFAQVSFQPNSGAQGEYAGLLAIRRYHQSRGEHQRTLCLIPASAHGTNPASAHMAGMEVVVVKCLNDGDVDLDDLKMKAQLYKERLAALMITYPSTHGVYEESIKDICSLIHENGGQVYFDGANLNALVGLARPADIGADVCHMNLHKTFAIPHGGGGPGVGPIGVVEHLKPFLPGHEQEGTTHAVSAAPYGSASILVITWMYIRMMGAEGLKYATQTAILNANYIAARLSQVYSILYRGKHGRVAHECIVDTRVLKEQYGVSVDDIAKRLIDYGFHAPTMSFPVPGTLMIEPTESEPKAEIDRFCDALLSIAEEAKKIGSGVWPKDDNPLVHAPHTLVDTLDDTWARPYSRQEAAFPNCSLDPANKYWPPVSRIDNVAGDRMLICSCPPLGNTY

SEQ ID NO: 2972 - DNA, 2796 bp, Bartonella quintana
  CDS (1)..(2796): transl_table=11
atgcaagaacgctcttttttttctcggcatattgggcttcgttccgatgaaacacaaaaaatgcttgatgttttgggacttgattgtatcgatacactcgtttctcaagctattcctcactctatccatttgggacgggtgcttaatctcccaaaggcagtgagtgaaggacaagctctagaagaactctccaagattatggggcgtaatcatgtgcacaaaagttttattgggcaggggtatcatggaacatgtgtgcctccggttattttgcggaatctttttgaaaatccagcttggtatactgcttatacgccttatcaggccgaaattagccaaggccgtttagagcttttattttattttcagacattgattagtgaactcaccggtttgcctgttgcagctgcttcacttcttgatgaagcaacagctttagccgaagccaatgcggtagctgtacgttttgcgcgtgaaaagaaaacaaaaatttcccttcagagtcttttgcatcctcaaattttgagtgtcgtacaaacgcgtgctgaaacacaaggcatttccattagtgaaaatagcgaaatttgttctaatacagctgcgatcgttttgtcttggccagatacaaaaggcttttttaacgattacagtgaagtcattaaagaggcaaaggcaaaaggagccctggtgatcgttgttgctgatcctttggcgcttacgcttatggaaccgccagctcaatggggggctgatattgttgttggctctatgcagcgctatggagttccgatgggatttggtggtccacatgctggttatcttgcggtcagtgatgcgctaatacgtctcattccagggcgtattgttggtcaatcagtggatacaaaagggcgtgttggttttcgtttagcgttgcaaacacgtgaacaacatatccggcgcgataaagcaacgtcaaacatttgtacagcacaagctttgttggcaaatatggcaacagcttatgctgtttggcatgggccacaaggcttacaggaaattgctcagcggattcattctttaacatgccgttttatgggtggtttagaggcagcaggtatcccttgtgaaggagagtcctttttcgattgtgtaagcgtcgttgtgaagggaaaagctcaagagattgcgcgccaagcgaaagcaggtggacgccttgttcgtattcttgatgatgacagagttgcggtcaattttgatgaattgtcaacagaagaggatgcttgtactttagcacagctttttggggcacaactcgttgatcaggtttctccacgactttggggtaaaggacgtgatgccgcttttctttcacagcctttctttcatgtggttcattcagagacggacatgatgcgctttttgcgtcgtttgtcagataaggatttggcattggaccgggcaatgattccgcttggttcttgtacaatgaagcttaatgcggccgctgaattgatgcctgtaagttggcctacggtagccaatatacacccctttgttcctaaagaggatgcggcaggttatcaggaaatgattaatcagttaaatgcgtggttgtgtgaaattacagggtttgcacaggtttcttttcagccaaactctggtgcacaaggtgaatatgccgggcttttggctatccgccggtattatcagtcacgtggggaaaatcaacgcacactttgtcttgttcctgcatcagcacatggtaccaatccggcttcagcccatatggcgggtatggaagttgttgtggtgaaatgcttaagtgatggtgatgttgatattgatgatctcaaaatgaaagcacaattgcataaggatcgtttagccgctttaatgatcacctatccttcaacacacggtgtttatgaggaaaatattaaggacatttgctcgcttatccatgaaaatggaggacaagtttattttgatggtgctaatctcaatgcacttgttgggcttactcgtccggcagatattggggcggatgtttgtcatatgaaccttcataaaacatttgcaattccccatggtggtggtggtcctggtgttggcccgattggagtagctgaacatctaaagccatttttaccaggacatgcacaaaacggaacaacacatgcggtttccgcagccccttatggaagtgcatcgattcttgtgattacatggatgtatattcggatgatgggtgctaagggcttgaaatatgcgacgcaaacagcaattttgaatgccaattatatcgctgagcgtctttcacaggcttattccattctttaccggggcaagcatggacgtgttgcacacgaatgtattgtggatacacgcgtattgaaagagcagtatggagtaagtgttgatgatatcgcaaaacgtctcatagattatggattccatgcgccgacgatgtcgtttccagttcccgggactttgatgattgaaccaacagaatcagagccaaaagcagagattgatcgcttttgtgatgctttgctttctattgctgaagaagctaagaaagttggtgcaggtgtttggccaaaagatgataatccattggtcaatgcaccacatacattggtggatacactagatgatgcttgggtacatccttattcgcgacaagaggctgcttttcccaatcatcatcttgatccaacgaataaatattggcctcctgtttcccgtattgataatgttgcgggggacagagtactcatttgttcttgtccgccattgggaaacacctcttaa

SEQ ID NO: 2973 - protein, 931 aa, Bartonella quintana
MQERSFFSRHIGLRSDETQKMLDVLGLDCIDTLVSQAIPHSIHLGRVLNLPKAVSEGQALEELSKIMGRNHVHKSFIGQGYHGTCVPPVILRNLFENPAWYTAYTPYQAEISQGRLELLFYFQTLISELTGLPVAAASLLDEATALAEANAVAVRFAREKKTKISLQSLLHPQILSVVQTRAETQGISISENSEICSNTAAIVLSWPDTKGFFNDYSEVIKEAKAKGALVIVVADPLALTLMEPPAQWGADIVVGSMQRYGVPMGFGGPHAGYLAVSDALIRLIPGRIVGQSVDTKGRVGFRLALQTREQHIRRDKATSNICTAQALLANMATAYAVWHGPQGLQEIAQRIHSLTCRFMGGLEAAGIPCEGESFFDCVSVVVKGKAQEIARQAKAGGRLVRILDDDRVAVNFDELSTEEDACTLAQLFGAQLVDQVSPRLWGKGRDAAFLSQPFFHVVHSETDMMRFLRRLSDKDLALDRAMIPLGSCTMKLNAAAELMPVSWPTVANIHPFVPKEDAAGYQEMINQLNAWLCEITGFAQVSFQPNSGAQGEYAGLLAIRRYYQSRGENQRTLCLVPASAHGTNPASAHMAGMEVVVVKCLSDGDVDIDDLKMKAQLHKDRLAALMITYPSTHGVYEENIKDICSLIHENGGQVYFDGANLNALVGLTRPADIGADVCHMNLHKTFAIPHGGGGPGVGPIGVAEHLKPFLPGHAQNGTTHAVSAAPYGSASILVITWMYIRMMGAKGLKYATQTAILNANYIAERLSQAYSILYRGKHGRVAHECIVDTRVLKEQYGVSVDDIAKRLIDYGFHAPTMSFPVPGTLMIEPTESEPKAEIDRFCDALLSIAEEAKKVGAGVWPKDDNPLVNAPHTLVDTLDDAWVHPYSRQEAAFPNHHLDPTNKYWPPVSRIDNVAGDRVLICSCPPLGNTS

SEQ ID NO: 2974 - DNA, 2877 bp, Bdellovibrio bacteriovorus
  CDS (1)..(2877): transl_table=11
atgaaaatcgctgatctttctcctacgaatgagtttatcccccgtcacattggtcccacagattcagacatccacgagatgctgaaaactctgggttttaattccctggatcaaatggctgacaaagtgatcccggcacaaatccgcacaacccacgcttacgcagatgtgggcaacggcatttctgagcacggtcttttgaatcatctgaaacagatggtttccaaaaacaaagtttacaaaaactatatcggcatgggttaccacgacaccatcactccgacggtgattcaaagaaacatctttgaaaatccagtgtggtacacagcctacactccttatcagccagagatctctcaaggccgtctggaagctctgttgaacttccaaacgatgatcgctgatctgaacggcatggaaatcgccaacgcctctttgcttgatgaaggcacggccgcggctgaagcgatgttcatggcgcactctctttgcaaaaacaaagcaaacgcctttgtcgtatccccggacatgcacccgcatgtgatcgaggttatcggcactcgtgcagagccgctgggctttgagatgatcgtgatggatccggcgaaatatgatttcgcaaaacctgtgttcggtgtgttcttccagtatccaaacaccaacggcacggttgaagactatgctgccatcgcaaaaaaatacaaagaccatggcgcgctggtgacggcttccacggatcttctggcgatgacattgctgactcctccgggtgaatggggtgcagacatggtggtgggtaattcccagcgctttggtgtgccactgggcttcggtggtcctcacgccggtttcctggcaacgaaagacgctttcaagcgtttgatgccgggccgtctggtgggtgtcagcgtggattctcaaggcaagtccgctttgcgtctggctttgcaaactcgcgaacaacacatccgtcgtgaaaaagcgacttccaatatctgtacggctcaggtgcttctggcgaacatggcttccatgtacgcggtttaccacggccctgcaggcttgaagaaaatcgctctgcgcgttcagcgtctgacggcgatcctttctgcgggtcttaaaaaattgaatcttgaagttggtgcgggtcacgtgtttgacaccgtgacagtgaaaactgacaaagcggcagagatcatcgctcaggctgaaaagatgcaaatgaacttccgcaactacggtggtggcaagctgggtgtttccctgaacgaagcaacgactttggaagacgttgaacaaatctgggctgccttcaaccttggcaaagccgcaggcttcacagccttgtctgtggatgagtctttggccgatgtcactttgccagcgaatttgactcgctctacagcttacatgactcatcaggtgtttaactctcaccacagcgaaacagaaatgcttcgctacattcaccatctgcaaaacaaggatctgacgctgactcattccatgattccgctgggttcttgtacgatgaaactgaatgcgacaacagagcttgtgccggtttcatggcctgaaatcagcaagctgcacccgtttgcgccaactgcgcaagccgtgggcctgattgaaatgatccatgatcttgagaaaaaactttgcgacatcactggttttgcagcagtcagcctgcagccgaacgcgggttctcaaggtgaatacgcgggccttttggtgatccgcaagtaccaccaatcccgcggtcagggtcatcgtaacatctgcttgatcccgtcttctgcgcacggaaccaatccggcgtcagcagcactggtgaacatgcaggttgtggtagtggcgtgtgacgatcagggtaacgtcgatgtggcggatctgaaagccaaagccgaacagcacaaagacaatctggcagcattgatgatcacttacccttccacacacggcgtgttcgaggaaggtatcgtggaaatctgcaagatcatccacgacaacggcggtcaggtttacatggacggcgcgaacatgaatgctttggttggcatgtgccgcccaggcgtgttcggtccggacgtttcccacatgaatctgcacaagaccttctcgatccctcacggtggtggcggtccgggtgtcggtcctatcggtgtgggcgcacacttggcagaattcctgccgaaacactctttggtgcctgaagcgggtcctgccaacgggatctctgcaacgacttcggctccttggggcagcgccagcatcctgccaatctcttgggcttacatcaccatgatgggcgctcaaggtctgcgcaaagccactttggtcagcatcctgagtgcgaactacatcgcaaagaaactggaagctcattaccctgttctttacaaaggtaaaaacggtctggtggcgcacgagtgtatcgtggatgttcgcgagatcaaaaagacctctggcattgacgtgactgacgttgcaaaacgtctgatggactttggtttccatgctccgaccatgagcttcccggtagcgggcactttgatgatcgagccaactgaatctgaatccaaaaaagaactggatcgtttcattgaatccatggtgaccatccgcaaagaaatcgctgcggttgaaaccggcaagatggacaaagaaaacaatgcgcttaaaaacgctcctcacacagcgcagatgctgatgaaacctgaatggaatcatccgtacagccgtgaagaggccgtgtacccggtggaatggttgcgtggtaacaagttctggccggttgttggccgtgtcgacaacgcttacggtgacagaaacctgatttgctcctgcccttcgatcgaagactatcaggcgtaa

SEQ ID NO: 2975 - protein, 958 aa, Bdellovibrio bacteriovorus
MKIADLSPTNEFIPRHIGPTDSDIHEMLKTLGFNSLDQMADKVIPAQIRTTHAYADVGNGISEHGLLNHLKQMVSKNKVYKNYIGMGYHDTITPTVIQRNIFENPVWYTAYTPYQPEISQGRLEALLNFQTMIADLNGMEIANASLLDEGTAAAEAMFMAHSLCKNKANAFVVSPDMHPHVIEVIGTRAEPLGFEMIVMDPAKYDFAKPVFGVFFQYPNTNGTVEDYAAIAKKYKDHGALVTASTDLLAMTLLTPPGEWGADMVVGNSQRFGVPLGFGGPHAGFLATKDAFKRLMPGRLVGVSVDSQGKSALRLALQTREQHIRREKATSNICTAQVLLANMASMYAVYHGPAGLKKIALRVQRLTAILSAGLKKLNLEVGAGHVFDTVTVKTDKAAEIIAQAEKMQMNFRNYGGGKLGVSLNEATTLEDVEQIWAAFNLGKAAGFTALSVDESLADVTLPANLTRSTAYMTHQVFNSHHSETEMLRYIHHLQNKDLTLTHSMIPLGSCTMKLNATTELVPVSWPEISKLHPFAPTAQAVGLIEMIHDLEKKLCDITGFAAVSLQPNAGSQGEYAGLLVIRKYHQSRGQGHRNICLIPSSAHGTNPASAALVNMQVVVVACDDQGNVDVADLKAKAEQHKDNLAALMITYPSTHGVFEEGIVEICKIIHDNGGQVYMDGANMNALVGMCRPGVFGPDVSHMNLHKTFSIPHGGGGPGVGPIGVGAHLAEFLPKHSLVPEAGPANGISATTSAPWGSASILPISWAYITMMGAQGLRKATLVSILSANYIAKKLEAHYPVLYKGKNGLVAHECIVDVREIKKTSGIDVTDVAKRLMDFGFHAPTMSFPVAGTLMIEPTESESKKELDRFIESMVTIRKEIAAVETGKMDKENNALKNAPHTAQMLMKPEWNHPYSREEAVYPVEWLRGNKFWPVVGRVDNAYGDRNLICSCPSIEDYQA

SEQ ID NO: 2976 - DNA, 2865 bp, Bordetella bronchiseptica
  CDS (1)..(2865): transl_table=11
atgtcgcgcgcccctgacacccattccgatttcattccccgccatatcggcccctccgacgaggaccaggccaccatgctggccgccatcggcgcagccagcctggatgccctgatcgacgaagtcgtgccgccccgcatccgcagccgcgcgccgctggcgctgcccgccgcgcgcagcgaaacggatgtgctgcaggacctgaagcggatggccgcgcgcaaccagatctaccgcaactacatcggccagggttactacggcacgcacacgcccaacgtggtgttgcgcaacgtgctcgagaacccggcctggtacactgcctacacgccgtatcagcccgaaatctcgcagggccgcctggaggcgctgctcaattaccagaccatggtcgccgacctgaccggcctggacatctccaacgcctcgctgctggatgaaggcaccgccgcggccgaggccatgacgctggcgcgccgcggcagccgttcgtccagcccggtgttcttcgtgtcgcagcactgccacccgcagacgctcgaagtggtgcgcacgcgtgccgagggcctgggcatcgaactggtgatcggcgacgagtcgcgcgggctgcccgaatgcttcggcgtgctgctgcagtatccgcacagcctgggcggcgtggccgattaccgcgaactggcgcaagccgcgcacgcgcagggcgccgtggtcgcctgcgtgactgacctgctggcgctggcgctgatcgagccgccggggcaatggggcgccgacatcgccgtgggttcggcgcagcgcttcggcgtgccgttcggcttcggcggcccgcacgccggcttcatgtcctgccgcgatgcgtacaagcgcaacatgcccggccgcctggtcggcgtctcgaaggacgcccagggcaacccggcgctgcgcctggccctgcagacgcgcgagcagcacatccgccgcgagaaagcgacctccaacatctgcaccgcccaggtgctgctggccgtgatggccggcctgtacgccgtgtggcatggcccgcgcggcgtgcgccgcatcgccgagcgcgtgcaaagcctcaccggcgcgctgcgcgccgcgctggccgggctgggcgtgaaagtcgccaacgacacctggttcgacacgctgttgctggaaaccggcgtggccaccccggccatcctggccgccgcggattgcgcccggatcaacctgcgccaggtcgatggcgcgcgcctggcggtgtcgctggacgaaaccgtgaccctcgccgacctgcaggccctggtcaacgtgttcgccgccggcctgggcaaggacgaggtggcgctgccggcgccgcaggcgtcgctggacggcatcccggcggcggtgcgccgccaggggcccatcctgtcgcacccggtgttctccagcgtgcagtccgagaccgacatgctgcgctacctgcgcaagctggccgacaaggacctggcgctggaccgcaccatgatcccgctgggttcgtgcaccatgaagctgaacgccacggccgaaatgatccccatcacctggccggagttcgcgctgatccacccgttcgcgccggcctcgcagacgccgggctatcgcgagctgatcgacggcctgtcggcgcagctgtgcgaaatcaccggctacgacggcatcagcctgcagcccaactcgggcgcgcagggcgaatacgccggcctgctggcgatccgcgcctaccaccaggccaatggccagccccagcgcaatgtctgcctgatcccggcctcggcgcacggcaccaacccggcgtcggcccagctggccggcatggacgtggtggtggtggcgtccgacgccaacggcaacgtcgacctggccgacctgcgcgccaggatcgcgcaagtgggcgaacgcctggcggcgctgatgatcacctatccctcgacgcacggcgtgttcgaggaagccgtgaccgaaatctgcgacgcggtgcacgaggccggcgggcaggtctacctggacggcgccaacatgaacgccatggtcggcgtggcgcagcccggcaagttcggctccgacgtctcgcacctgaacctgcacaagaccttctgcatcccgcacggcggcggcgggccgggcgtgggcccggtggcggtgcgcgcgcacctggcgccctacctgccgggcgtgctcgacgcccagggccgcctggaccccgaggccaaggtcggcccggtctcggccgcgccgtatggctcggccggcatcctgccgattccctacgtgtacatcgcgttgatgggcgccgagggcctgcgccgcgccaccgaggtggccatcctcaacgccaactacatcgccgcgcgcctgcgcgaccactacccggtgctgtatgcgggccgcaacggccgcgtggcgcacgagtgcatcctggacgtgcggcccctgaaggaaaccagcggcatcagcgccgaggacatcgccaagcgcctgatggactacgggttccacgcgccgaccatgagcttcccggtggccggcacgctgatggtcgagcccaccgaatccgaaggcctggccgagctggagcgcttcatcgaggccatgatcgccatccgcgccgagatcgcacagatcgaaagcggcgaacgcgaccgcgacgacaacgtgctgcgcaatgcgccccatacggcccagatgctgctggccgaggaatggcaccacgactatccgcgccagcaggccgcctatccggtggcgtcgctgcgcgagaacaagtactggccgccggtggcgcgggtggacaacgcctatggcgaccgcaacctggtgtgcgcctgcctgccggtggaagcctacgcgtaa

SEQ ID NO: 2977 - protein, 954 aa, Bordetella bronchiseptica
MSRAPDTHSDFIPRHIGPSDEDQATMLAAIGAASLDALIDEVVPPRIRSRAPLALPAARSETDVLQDLKRMAARNQIYRNYIGQGYYGTHTPNVVLRNVLENPAWYTAYTPYQPEISQGRLEALLNYQTMVADLTGLDISNASLLDEGTAAAEAMTLARRGSRSSSPVFFVSQHCHPQTLEVVRTRAEGLGIELVIGDESRGLPECFGVLLQYPHSLGGVADYRELAQAAHAQGAVVACVTDLLALALIEPPGQWGADIAVGSAQRFGVPFGFGGPHAGFMSCRDAYKRNMPGRLVGVSKDAQGNPALRLALQTREQHIRREKATSNICTAQVLLAVMAGLYAVWHGPRGVRRIAERVQSLTGALRAALAGLGVKVANDTWFDTLLLETGVATPAILAAADCARINLRQVDGARLAVSLDETVTLADLQALVNVFAAGLGKDEVALPAPQASLDGIPAAVRRQGPILSHPVFSSVQSETDMLRYLRKLADKDLALDRTMIPLGSCTMKLNATAEMIPITWPEFALIHPFAPASQTPGYRELIDGLSAQLCEITGYDGISLQPNSGAQGEYAGLLAIRAYHQANGQPQRNVCLIPASAHGTNPASAQLAGMDVVVVASDANGNVDLADLRARIAQVGERLAALMITYPSTHGVFEEAVTEICDAVHEAGGQVYLDGANMNAMVGVAQPGKFGSDVSHLNLHKTFCIPHGGGGPGVGPVAVRAHLAPYLPGVLDAQGRLDPEAKVGPVSAAPYGSAGILPIPYVYIALMGAEGLRRATEVAILNANYIAARLRDHYPVLYAGRNGRVAHECILDVRPLKETSGISAEDIAKRLMDYGFHAPTMSFPVAGTLMVEPTESEGLAELERFIEAMIAIRAEIAQIESGERDRDDNVLRNAPHTAQMLLAEEWHHDYPRQQAAYPVASLRENKYWPPVARVDNAYGDRNLVCACLPVEAYA

SEQ ID NO: 2978 - DNA, 2865 bp, Bordetella parapertussis
  CDS (1)..(2865): transl_table=11
atgtcgcgcgcccctgacacccattccgatttcattccccgccatatcggcccctccgacgaggaccaggccaccatgctggccgccatcggcgcagccagcctggatgccctgatcgacgaagtcgtgccgccccgcatccgcagccgcgcgccgctggcgctgcccgccgcgcgcagcgaaacggatgtgctgcaggacctgaagcggatggccgcgcgcaaccagatctaccgcaactacatcggccagggttactacggcacgcacacgcccaacgtggtgttgcgcaacgtgctcgagaacccggcctggtacaccgcctacacgccgtatcagcccgaaatctcgcagggccgcctggaggcgctgctcaattaccagaccatggtcgccgacctgaccggcctggacatctccaacgcctcgctgctggatgaaggcaccgccgcggccgaggccatgacgctggcgcgccgcggcagccgttcgtccagcccggtgttcttcgtgtcgcagcactgccacccgcagacgctcgaagtggtgcgcacgcgtgccgagggcctgggcatcgaactggtgatcggcgacgagtcgcgcgggctgcccgaatgcttcggcgtgctgctgcagtatccgcacagcctgggcggcgtggccgattaccgcgaactggcgcaagccgcgcacgcgcagggcgccgtggtcgcctgcgtgactgacctgctggcgctggcgctgatcgagccgccggggcaatggggcgccgacatcgccgtgggttcggcgcagcgcttcggcgtgccgttcggcttcggcggcccgcacgccggcttcatggcctgccgcgatgcgtacaagcgcaacatgcccggccgcctggtcggcgtctcgaaggacgcccagggcaacccggcgctgcgcctggccctgcagacgcgcgagcagcacatccgccgcgagaaagcgacctccaacatctgcaccgcccaggtgctgctggccgtgatggccggcctgtacgccgtgtggcatggcccgcgcggcgtgcgccgcatcgccgagcgcgtgcaaagcctcaccggcgcgctgcgcgccgcgctggccgggctgggcgtgaaagtcgccaacgacacctggttcgacacgctgttgctggaaaccggcgtggccaccccggccatcctggccgcggcggattgcgcccggaccaacctgcgccaggtcgatggcgcgcgcctggcggtgtcgctggacgaaaccgtgaccctcgccgacctgcaggccctggtcaacgtgttcgccgccggcctgggcaaggacgaggtggcgctgccggcgccgcaggcgtcgctggacggcatcccggcggcggtgcgccgccaggggcccatcctgtcgcacccggtgttctccagcgtgcagtccgagaccgacatgctgcgctacctgcgcaagctggccgacaaggacctggcgctggaccgcaccatgatcccgctgggttcgtgcaccatgaagctgaacgccacggccgaaatgatccccatcacctggccggagttcgcgctgatccacccgttcgcgccggcctcgcagacgccgggctatcgcgagctgatcgacggcctgtcggcgcagctgtgcgaaatcaccggctacgacggcatcagcctgcagcccaactcgggcgcgcagggcgagtacgccggcctgctggcgatccgcgcctaccaccaggccaatggccagccccagcgcaatgtctgcctgatcccggcctcggcgcacggcaccaacccggcgtcggcccagctggccggcatggacgtggtggtggtggcgtccgacgccaacggcaacgtcgacctggccgacctgcgcgccaggatcgcgcaagtgggcgaacgcctggcggcgctgatgatcacctatccctcgacgcacggcgtgttcgaggaagccgtgaccgaaatctgcgacgcggtgcacgaggccggcgggcaggtctacctggacggcgccaacatgaacgccatggtcggcgtggcgcagcccggcaagttcggctccgacgtctcgcacctgaacctgcacaagaccttctgcatcccgcacggcggcggcgggccgggcgtgggcccggtggcggtgcgcgcgcacctggcgccctacctgccgggcgtgctcgacgcccagggccgcctggaccccgaggccaaggtcggcccggtctcggccgcgccgtatggctcggccggcatcctgccgattccctacgtgtacatcgcgttgatgggcgccgagggcctgcgccgcgccaccgaggtggccatcctcaacgccaactacatcgccgcgcgcctgcgcgaccactacccggtgctgtatgcgggccgcaacggccgcgtggcgcacgagtgcatcctggacgtgcggcccctgaaggaaaccagcggcatcagcgccgaggacatcgccaagcgcctgatggactacgggttccacgcgccgaccatgagcttcccggtggccggcacgctgatggtcgagcccaccgaatccgaaggcctggccgagctggagcgcttcatcgaggccatgatcgccatccgcgccgagatcgcacagatcgaaagcggcgaacgcgaccgcgacgacaacgtgctgcgcaatgcgccccatacggcccagatgctgctggccgaggaatggcaccacgactatccgcgccagcaggctgcctatccggtggcgtcgctgcgcgagaacaagtactggccgccggtggcgcgggtggacaacgcctatggcgaccgcaacctggtgtgcgcctgcctgccggtggaagcctacgcgtaa

SEQ ID NO: 2979 - protein, 954 aa, Bordetella parapertussis
MSRAPDTHSDFIPRHIGPSDEDQATMLAAIGAASLDALIDEVVPPRIRSRAPLALPAARSETDVLQDLKRMAARNQIYRNYIGQGYYGTHTPNVVLRNVLENPAWYTAYTPYQPEISQGRLEALLNYQTMVADLTGLDISNASLLDEGTAAAEAMTLARRGSRSSSPVFFVSQHCHPQTLEVVRTRAEGLGIELVIGDESRGLPECFGVLLQYPHSLGGVADYRELAQAAHAQGAVVACVTDLLALALIEPPGQWGADIAVGSAQRFGVPFGFGGPHAGFMACRDAYKRNMPGRLVGVSKDAQGNPALRLALQTREQHIRREKATSNICTAQVLLAVMAGLYAVWHGPRGVRRIAERVQSLTGALRAALAGLGVKVANDTWFDTLLLETGVATPAILAAADCARTNLRQVDGARLAVSLDETVTLADLQALVNVFAAGLGKDEVALPAPQASLDGIPAAVRRQGPILSHPVFSSVQSETDMLRYLRKLADKDLALDRTMIPLGSCTMKLNATAEMIPITWPEFALIHPFAPASQTPGYRELIDGLSAQLCEITGYDGISLQPNSGAQGEYAGLLAIRAYHQANGQPQRNVCLIPASAHGTNPASAQLAGMDVVVVASDANGNVDLADLRARIAQVGERLAALMITYPSTHGVFEEAVTEICDAVHEAGGQVYLDGANMNAMVGVAQPGKFGSDVSHLNLHKTFCIPHGGGGPGVGPVAVRAHLAPYLPGVLDAQGRLDPEAKVGPVSAAPYGSAGILPIPYVYIALMGAEGLRRATEVAILNANYIAARLRDHYPVLYAGRNGRVAHECILDVRPLKETSGISAEDIAKRLMDYGFHAPTMSFPVAGTLMVEPTESEGLAELERFIEAMIAIRAEIAQIESGERDRDDNVLRNAPHTAQMLLAEEWHHDYPRQQAAYPVASLRENKYWPPVARVDNAYGDRNLVCACLPVEAYA

SEQ ID NO: 2980 - DNA, 2865 bp, Bordetella pertussis
  CDS (1)..(2865): transl_table=11
atgtcgcgcgcccctgacacccattccgatttcattccccgccatatcggcccctccgacgaggaccaggccacgatgctggtcgccatcggcgcagccagcctggatgccctgatcgacgaagtcgtgccgccccgcatccgcagccgcgcgccactggcgctgcccgccgcgcgcagcgaaaccgatgtgctgcaggacctgaagcggattgccgcgcgcaaccagatctatcgcaactacatcggccagggttactacggcacgcacacgcccaacgtggtgttgcgcaatgtgctcgagaacccggcctggtacaccgcctacacgccgtatcagcccgaaatctcgcagggccgcctggaggcgctgctcaattaccagaccatggtcgccgacctgaccggcctggacatctccaacgcctcgctgctggatgaaggcaccgccgcggccgaggccatgacgctggcgcgccgcggcagccgttcgtccagtccggtgttcttcgtgtcgcagcactgccacccgcagacgctcgaagtggtgcgcacgcgcgccgagggcctgggcatcgaactggtgatcggcgacgagtcgcgcgggctgcccgaatgcttcggcgtgctgctgcagtatccgcacagcctgggcggcgtggccgattaccgcgaactggcgcaagccgcgcacgcgcagggcgccgtggtcgcctgcgtgacggacctgctggcgctggcgctgatcgagccgccgggacaatggggcgccgacatcgccgtgggttcggcgcagcgcttcggcgtgccgttcggcttcggcggcccgcacgccggcttcatggcctgccgcgatgcgtacaagcgcaacatgcccggccgcctggtcggcgtctcgaaggacgcccagggcaacccggcgctgcgcctggccctgcagacgcgcgagcagcacatccgccgcgagaaggcgacctccaacatctgcaccgcccaggtgctgctggccgtgatggccggcctgtacgccgtgtggcatggcccgcgcggcgtgcgccgcatcgccgagcgcgtgcaaagcctcaccggcgcgctgcgcgccgcgctggccgggctgggcgtgaaagtcgccaacgacacctggttcgacacgctgtcgctggaaaccggcgcggccaccccggccatcctggccgccgcggattgcgcccggatcaacctgcgccaggtcgatggcgcgcgcctggcggtgtcgctggacgaaaccgtgaccctcgccgacctgcaggccttggtcaatgtgttcgcggccggcctgggcaaggacgaggtggcgctggcgccgccgcaggcgtcgctggacggcatccccgcggcggtacgccgccaggggcccatcctgtcgcatccggtgttctccagcgtgcagtccgagaccgacatgctgcgctacctgcgcaagctggccgacaaggacctggcgctggaccgcaccatgatcccgctgggctcgtgcaccatgaagctgaacgccacggccgagatgatccccatcacctggcccgagttcgcgctgatccacccgttcgcgccggcctcgcagacgccgggctatcgcgagctgatcgagggcctgtcggcgcagctgtgcgagatcaccggttacgacggcatcagcctgcagcccaactcgggcgcgcagggcgagtacgccggcctgctggcgatccgcgcctaccaccaggccaatggccagccccagcgcaatgtctgcctgatcccggcctcggcgcacggcaccaacccggcgtcggcccagctggccggcatggacgtggtggtggtggcgtccgacgccaacggcaacgtcgacctggccgacctgcgcgccaggatcgcgcaagtgggcgaacgcctggcggcgctgatgatcacctatccctcgacgcacggcgtgttcgaggaagccgtgaccgaaatctgcgatgcggtgcacgaggccggcgggcaggtctacctggacggcgccaacatgaacgccatggtcggcgtggcgcagcccggcaagttcggctccgacgtctcgcacctgaacctgcacaagaccttctgcattccgcacggcggcggcgggccgggcgtgggcccggtggcggtgcgcgcgcacctggcgccctacctgccgggcgtgctcgacgcccggggccgcctggaccccgaggccaaggtcggcccggtctcggccgcgccgtacggctcggccggcatcctgccgattccctacgtgtacatcgcgttgatgggcgccgagggcctgcgccgcgccaccgaggtggccatcctcaacgccaactacatcgccacgcgcctgcgcggccactacccggtgctgtatgcgggccgcaacggccgcgtggcgcacgagtgcatcctggacgtgcggcccctgaaggaaaccagcggcatcagcgccgaggacatcgccaagcgcctgatggactacgggttccatgcgccgaccatgagcttcccggtggccggcacgctgatggtcgagcccaccgaatccgaaggcctggccgagctggagcgcttcatcgaggccatgatcgccatccgcgccgagatcgcacaggtcgaaagcggcgaacgcgaccgcgacgacaacgtgctgcgcaatgcgccccatacggcccagatgctgctggccgaggaatggcaccacgactatccgcgccagcaggccgcctatccggtggcgtcgctgcgcgagaacaagtattggccgccggtggcgcgggtggacaacgcctatggcgaccgcaacctggtgtgcgcctgcctgccggtggaagcctacgcgtaa

SEQ ID NO: 2981 - protein, 954 aa, Bordetella pertussis
MSRAPDTHSDFIPRHIGPSDEDQATMLVAIGAASLDALIDEVVPPRIRSRAPLALPAARSETDVLQDLKRIAARNQIYRNYIGQGYYGTHTPNVVLRNVLENPAWYTAYTPYQPEISQGRLEALLNYQTMVADLTGLDISNASLLDEGTAAAEAMTLARRGSRSSSPVFFVSQHCHPQTLEVVRTRAEGLGIELVIGDESRGLPECFGVLLQYPHSLGGVADYRELAQAAHAQGAVVACVTDLLALALIEPPGQWGADIAVGSAQRFGVPFGFGGPHAGFMACRDAYKRNMPGRLVGVSKDAQGNPALRLALQTREQHIRREKATSNICTAQVLLAVMAGLYAVWHGPRGVRRIAERVQSLTGALRAALAGLGVKVANDTWFDTLSLETGAATPAILAAADCARINLRQVDGARLAVSLDETVTLADLQALVNVFAAGLGKDEVALAPPQASLDGIPAAVRRQGPILSHPVFSSVQSETDMLRYLRKLADKDLALDRTMIPLGSCTMKLNATAEMIPITWPEFALIHPFAPASQTPGYRELIEGLSAQLCEITGYDGISLQPNSGAQGEYAGLLAIRAYHQANGQPQRNVCLIPASAHGTNPASAQLAGMDVVVVASDANGNVDLADLRARIAQVGERLAALMITYPSTHGVFEEAVTEICDAVHEAGGQVYLDGANMNAMVGVAQPGKFGSDVSHLNLHKTFCIPHGGGGPGVGPVAVRAHLAPYLPGVLDARGRLDPEAKVGPVSAAPYGSAGILPIPYVYIALMGAEGLRRATEVAILNANYIATRLRGHYPVLYAGRNGRVAHECILDVRPLKETSGISAEDIAKRLMDYGFHAPTMSFPVAGTLMVEPTESEGLAELERFIEAMIAIRAEIAQVESGERDRDDNVLRNAPHTAQMLLAEEWHHDYPRQQAAYPVASLRENKYWPPVARVDNAYGDRNLVCACLPVEAYA

SEQ ID NO: 2982 - DNA, 2868 bp, Bradyrhizobium japonicum
  CDS (1)..(2868): transl_table=11
atgatgaccgcgcaccgcaaatccaacggcgacaccaccaatttcgctcgccgccacatcggcccgtcggcgcgcgacgtcgccgcgatgctggagaccgtcggcgccaaaagcgtcgacgcgctgatggcggagacgctgccggcctcgatccggcaggccgccccgctcgatctcggcaagccgctgagcgagaccgaggcgatcgcgcatatgggcgagctcgctgcccaaaaccaggtcttcacctcgctgatcggccaaggctattccggcacgatcctgcccgcggtgatccagcgcaacatcctggagaatccggcctggtacacggcctacacgccctaccagcccgagatcagccagggccggctggaggcgctgttcaacttccagaccatgatctgcgacctcaccgggctcgacgtcgccaacgcctcgctgctcgacgaggccaccgcggccgccgaggcgatggcgctggcggagcggcactcgcgggtcgaagcaaaggccttcttcgtcgacaaggacgtgcatccgcagacgctggctgtgatgcgcacccgcgccgagccgctgggttggaatttgatcgtcggcgatcccctcaccgatctcgacaaggccgacgtgctcggcgcgctgctgcaatatccgggctcatcgggcgcgttgcgcgacctcaggcccgcgatcgcggcgttgaaggccaagggcgcacttgcgatcgttgccgccgacctgctggccctgacactgctcgcctcgcccggcgagctcggtgccgacatcgccatcggttcggcgcagcgcttcggcgtgccgatgggctatggcggaccgcacgcggcctatatggcggtgcgcgatgcgctgaagcgttcgctgcccggccgcatcgtcggcctctccgtggattcgcgcgggatgccggcctatcgcctcgcgctgcagacccgcgagcagcacatccgccgcgagaaggcgacctccaacatctgcaccgcgcaggtgctgctcgccgtgatcgccgcgatgtatgcggtctatcacggccccgaggggctttcgcagatcgcgcgccaggtgcatcgccgcgctgcggtgctcgccgcgggcctgcgcaagctcggctttgcgccgcactccgacagcttctttgacacgctcagcgtcgatgccggcgccaaacgcgccgagatcgtcgcgcgcgcggcggccgagaagatcaatctcggcgtcggtgaaaccgcgctgcgcatcgcgctcgacgagaccaccacgccggcgaccgtcgaggcggtctggcgcgccttcggcggccagctcgcttacgccgagttggacgcgaccacgcgcgaggcgctgccggaggcgctgaagcgcacgaccgcgttcctcacccacccggtgttccacgcgcatcgctcggagaccgagatgctgcgctacatgcgcaagctcagcgaccgcgacctcgcgctcgaccgcgccatgatcccgctcggctcctgcacgatgaagctgaacgcgaccaccgagatgatgccgctgacctggccggaattcggcagcctgcacccgttcgccccgcgcgagcaggccaagggctatcacgcgctgttcgcgcggctggagaagtggctgtgcgacatcaccggctatgacgcgatctcgctgcagccgaattccggcgcgcaaggcgaatatgccgggctgctcgcgatccgcggctatcatgctgcgcgcggcgaggcgcatcgcaagatctgcctgatcccctcctccgcccacggcaccaacccggcctcggccgcgatggtcggcatggacgtggtggtggttgcctgcgagaagaacggcgacgtcgacgtcaacgatctccgcgccaaggccgacaagcacgcgaatgacctcgccgcgatcatgatcacctatccctcgacccacggcgtgttcgaggagcatatccgcgagatctgcgacatcgtccacggccatggcggccaagtctatctggacggcgccaacctcaacgcgcaggtcggcctgtcccggcccggcgattacggcgccgacgtcagccacctcaatctgcacaagaccttctgcatcccgcatggcggcggcggcccgggcatgggcccgatcggcgtgaaggcgcatctcgccccgttcctgccgggccatccggcgacgcgaggcgacgcaccggtcggcccggtctcggccgcgccgttcggctcggcctcgatcctgaccatctcctacatctacatcctgatgatgggcggcgaaggcctgaagcgcgccaccgagatcgcaatcctcaacgccaactacatcgccgcacggctcgatgcgcatttcccggtgctctacaagaacgcgaggggccgcgtcgcgcatgagtgcatcgtcgatccgcgtgcgctgaagacgaccagcggcgtcaccgtggacgacatcgccaaacggctgatcgattacggcttccacgcgccgaccatgagcttcccggtgccgggcacgctgatgatcgagccgaccgaatcggaatcgaaggcggagctggatcgcttctgcgacgccatgatcgcgatccggaaggagatcggcgaggtcgaggccggccgcttcaagatcgaggcctcgcccttgcgccacgccccgcacaccgtgcacgacatcgcggacgatgcgtgggcccgcgcctatagccgtgccgagggctgcttccccgacggcgtctcgcgcaccgacaaatactggagcccggtcggacgcgtcgacaacgtctatggcgaccgcaatttggtgtgctcgtgcccaccggtgagcgactacgcggaagcggcggagtaa

SEQ ID NO: 2983 - protein, 955 aa, Bradyrhizobium japonicum
MMTAHRKSNGDTTNFARRHIGPSARDVAAMLETVGAKSVDALMAETLPASIRQAAPLDLGKPLSETEAIAHMGELAAQNQVFTSLIGQGYSGTILPAVIQRNILENPAWYTAYTPYQPEISQGRLEALFNFQTMICDLTGLDVANASLLDEATAAAEAMALAERHSRVEAKAFFVDKDVHPQTLAVMRTRAEPLGWNLIVGDPLTDLDKADVLGALLQYPGSSGALRDLRPAIAALKAKGALAIVAADLLALTLLASPGELGADIAIGSAQRFGVPMGYGGPHAAYMAVRDALKRSLPGRIVGLSVDSRGMPAYRLALQTREQHIRREKATSNICTAQVLLAVIAAMYAVYHGPEGLSQIARQVHRRAAVLAAGLRKLGFAPHSDSFFDTLSVDAGAKRAEIVARAAAEKINLGVGETALRIALDETTTPATVEAVWRAFGGQLAYAELDATTREALPEALKRTTAFLTHPVFHAHRSETEMLRYMRKLSDRDLALDRAMIPLGSCTMKLNATTEMMPLTWPEFGSLHPFAPREQAKGYHALFARLEKWLCDITGYDAISLQPNSGAQGEYAGLLAIRGYHAARGEAHRKICLIPSSAHGTNPASAAMVGMDVVVVACEKNGDVDVNDLRAKADKHANDLAAIMITYPSTHGVFEEHIREICDIVHGHGGQVYLDGANLNAQVGLSRPGDYGADVSHLNLHKTFCIPHGGGGPGMGPIGVKAHLAPFLPGHPATRGDAPVGPVSAAPFGSASILTISYIYILMMGGEGLKRATEIAILNANYIAARLDAHFPVLYKNARGRVAHECIVDPRALKTTSGVTVDDIAKRLIDYGFHAPTMSFPVPGTLMIEPTESESKAELDRFCDAMIAIRKEIGEVEAGRFKIEASPLRHAPHTVHDIADDAWARAYSRAEGCFPDGVSRTDKYWSPVGRVDNVYGDRNLVCSCPPVSDYAEAAE

SEQ ID NO: 2984 - DNA, 2799 bp, Brucella melitensis
  CDS (1)..(2799): transl_table=11
atgaccgaatttcttccctttgtggcccgccatatcgggccgagacatgaagacgagcgcgccatgctggcagcgctcggccttccttccatggaaaccctcataacgcaggcggttccggcctccattcgcctcaaccgcgcgctgaacctgccagcggcgctcagcgaagcggacgcacttgcggaactgggcacgatcatgggccgcaacgtggtgaagaagagcttcatcggcgcgggctatcacggtgttcacacgccgccggtcatccagcgcaacctgtttgaaaacccggcctggtacacggcttatacgccctaccagtcggaaatcagccagggccgccttgagcttctgttccacttccagacactggttgccgaactgaccggcctgccggttgcctgtgcctcgctgctcgacgaggcgactgccgttgccgaagccatcggcgttgcctgccgccatcatcgcgacaagcgcagccgcattctgcttgctggcgaactgcatccgcagacggtcgatgtggtgaacacccgcgctgaaccgctcggctgggagatcgccaccggcagcgatgttgacgacaacaccgccgcaatcgtggttccatggccggatacgcgcggcgtctatggcgattttgccaaggtcattgccgatgccaaggccaagggcgcgctggttatcgccgttgccgatccgctggcgctcaccatcatggaagcgcctgccaggtggggcgcggacatggccgtcggctccatgcagcgctatggcgtgccgatgggctttggcggcccgcacgcggcttatcttgcagtgtccgaggcgctcactcgcattattccgggccgcatcgtcggccagtcggtcgatgcgcatggccgcgcggcctatcgtctggcgctccagacccgcgagcagcacatccgccgcgacaaggcgacctccaatatctgcaccgcgcaggcgcttctggccaacatggccgcagctttcgccatctggcatggcccggctggcttgcaggcgattgcaacgcgcgtggccgctctggccgcccgttttgctgccgcgctcaaggctgccggtgttgaaattgcgggcgaaagcctgttcgatacggtaacggccaaggttccgggcaaagccgcggcaatcgcagccgaagccgacaagggcggccgcctgatccgcatcatcgatgcggatacggtcggcgtcactttcgacgaaacctcgacggaagaggatctgacggccctggcatcgctcttcggtgcgaagctggttggcggcgacacagttcttgttccgggcaaggaacgcggggaaggtttcctcacgcaggaagtattccattcacatcgttccgaaaccgagatgatgcgcttcctgcgtcgtctggccgacaaggatctggcgctcgaccgcgcgatgatcccgcttggttcctgcacgatgaagctcaatgcggcggcagaaatgatgccggtgagctggaatacggttgcaaacctgcatccttttgcgcctgccgagcaggtgcagggttatgcgaaaatgacgtccgatctggaagcatggctttgcgaaatcaccggttttgcgggcgtttcattgcagccaaatgccggtagtcagggtgaatatgccggccttatggccatccgccactatcatcaggcgcgggggcagggccatcgcaacatctgccttatcccgtcctcggcgcatggcaccaatccggccagcgcctccatggcgggcatgagcgtcgtcgtcgtcaattgccgcccggatggcgacatcgatattgatgatctcaaggccaaggcggaaaagcatcgcgataatctcgccgccttcatgattacctatccgtccacctatggcgtgttcgaggaaggcatcaaagccttctgcgagattgtgcatgacaatggcggccaggtctatttcgacggcgcgaacctcaatgcgcttgtcggtctggcgcggcctgccgatatcggcgcggacgtctgccacatgaatctgcacaagaccttctgcatcccgcatggcggcggtggtccgggtgttggcccgattggcgtggcgaaacatctggtgccttatctgccgggccatgtggaagccggttccgaacacgctgttgccgcagcgcagttcggcagcgcatccattctggtcattacgtggatgtatatccgcatgatgggcggggccggtttgaagaaggcgacggaagctgcaatcctcaatgccaattatattgcgcatcgtctgaagggtgtttacccgatcctttataccggcgcgcatgaccgcgtggcgcatgaatgcatcgtggatacgcgcgtattgaaggacagtgcgggcattaccgtggaagacgtggccaagcgcctgatcgactatggtttccatgcgccgaccatgtcatggccggttgccggaacgctgatgatcgagccgaccgagtccgagcccaagctggagatcgaccgtctttgcgatgcgatgatcgcgattgcaggcgaggcgaagaaggttgccgatggcgtctggcctgcggatgacaatccgcttgccaatgcgccgcatacggcgagcgatacgctggcaacggaatggaagcatccctatacccgtgaggaagccgtattccccggcggtgctttcgatccgacggcaaaatattggccgccggtcagccgcgtggataatgtcggcggcgaccggaacctcatctgctcctgcccgcctgtcgcagcctatggctga

SEQ ID NO: 2985 - protein, 932 aa, Brucella melitensis
MTEFLPFVARHIGPRHEDERAMLAALGLPSMETLITQAVPASIRLNRALNLPAALSEADALAELGTIMGRNVVKKSFIGAGYHGVHTPPVIQRNLFENPAWYTAYTPYQSEISQGRLELLFHFQTLVAELTGLPVACASLLDEATAVAEAIGVACRHHRDKRSRILLAGELHPQTVDVVNTRAEPLGWEIATGSDVDDNTAAIVVPWPDTRGVYGDFAKVIADAKAKGALVIAVADPLALTIMEAPARWGADMAVGSMQRYGVPMGFGGPHAAYLAVSEALTRIIPGRIVGQSVDAHGRAAYRLALQTREQHIRRDKATSNICTAQALLANMAAAFAIWHGPAGLQAIATRVAALAARFAAALKAAGVEIAGESLFDTVTAKVPGKAAAIAAEADKGGRLIRIIDADTVGVTFDETSTEEDLTALASLFGAKLVGGDTVLVPGKERGEGFLTQEVFHSHRSETEMMRFLRRLADKDLALDRAMIPLGSCTMKLNAAAEMMPVSWNTVANLHPFAPAEQVQGYAKMTSDLEAWLCEITGFAGVSLQPNAGSQGEYAGLMAIRHYHQARGQGHRNICLIPSSAHGTNPASASMAGMSVVVVNCRPDGDIDIDDLKAKAEKHRDNLAAFMITYPSTYGVFEEGIKAFCEIVHDNGGQVYFDGANLNALVGLARPADIGADVCHMNLHKTFCIPHGGGGPGVGPIGVAKHLVPYLPGHVEAGSEHAVAAAQFGSASILVITWMYIRMMGGAGLKKATEAAILNANYIAHRLKGVYPILYTGAHDRVAHECIVDTRVLKDSAGITVEDVAKRLIDYGFHAPTMSWPVAGTLMIEPTESEPKLEIDRLCDAMIAIAGEAKKVADGVWPADDNPLANAPHTASDTLATEWKHPYTREEAVFPGGAFDPTAKYWPPVSRVDNVGGDRNLICSCPPVAAYG

SEQ ID NO: 2986 - DNA, 2799 bp, Brucella suis
  CDS (1)..(2799): transl_table=11
atgaccgaatttcttccctttgtggcccgccatatcgggccgagacatgaagacgagcgcgccatgctggcagcgctcggccttccttccatggaaaccctcataacgcaggcggttccggcctccattcgcctcaaccgcgcgctgaacctgccagcggcgctcagcgaagcggacgcacttgcggaactgggcacgatcatgggccgcaacgtggtgaagaagagcttcatcggcgcgggctatcacggtgttcacacgccaccggtcatccagcgcaacctgtttgaaaacccggcctggtacacggcttatacgccctaccagtcggaaatcagccagggccgccttgagcttctgttccacttccagacactggttgccgaactgaccggcctgccggttgcctgtgcctcgctgctcgacgaggcgactgccgttgccgaagccatcggcgttgcctgccgccatcatcgcgacaagcgcagccgcattctgcttgctggcgaactgcatccgcagacggtcgatgtggtgaacacccgcgctgaaccgctcggctgggagatcgccaccggcagcgatgttgacgacaacaccgccgcaatcgtggttccatggccggatacgcgcggcgtctatggcgattttgccaaggtcattgccgatgccaaggccaagggtgcgctggttatcgccgttgccgatccgctggcgctcaccatcatggaagcgcctgccaggtggggcgcggacatggccgtcggctccatgcagcgctatggcgtgccgatgggctttggcggcccgcacgcggcttatcttgcagtgtccgaggcgctcactcgcattattccgggccgcatcgtcggccagtcggtcgatgcgcatggccgcgcggcctatcgtctggcgctccagacccgcgagcagcacatccgccgcgacaaggcgacctccaatatctgcaccgcgcaggcgcttctggccaacatggccgcagctttcgccatctggcatggcccggctggcttgcaggcgattgcaacgcgcgtggccgctctggccgcccgttttgctgccgcgctcaaggctgccggtgttgaaattgcgggcgaaagcctgttcgatacggtaacggccaaggttccgggcaaagccgcggcaatcgcagccgaagccgacaagggcggccgcctgatccgcatcatcgatgcggatacggtcggcgtcactttcgacgaaacctcgacggaagaggatctgacggccctggcatcgctcttcggtgcgaagccggttggcggcgacacagttcttgttccgggcaaggaacgcggggaaggtttcctcacgcaggaagtattccattcacatcgttccgaaaccgagatgatgcgcttcctgcgtcgtctggccgacaaggatctggcgctcgaccgcgcgatgatcccgcttggttcctgcacgatgaagctcaatgcggcggcagaaatgatgccggtgagctggaatacggttgcaaacctgcatccttttgcgcctgccgagcaggtgcagggttatgcgaaaatgacttccgatctggaagcatggctttgcgaaatcaccggttttgcgggcgtttcattgcagccaaatgccggtagtcagggtgaatatgccggccttatggccatccgccactatcatcaggcgtgggggcagggccatcgcaacatctgccttatcccgtcctcggcgcatggcaccaatccggccagcgcctccatggcgggcatgagcgtcgtcgtcgtcaattgccgcccggatggcgacatcgatattgatgatctcaaggccaaggcggaaaagcatcgcgataatctcgccgccttcatgattacctatccgtccacctatggcgtgttcgaggaaggcatcaaagccttctgcgagattgtgcatgacaatggcggccaggtctatttcgacggcgcgaacctcaatgcgcttgtcggtctggcgcggcctgccgatatcggcgcggacgtctgccacatgaatctgcacaagaccttctgcatcccgcatggcggcggtggtccgggtgttggcccgattggcgtggcgaaacatctggtgccttatctgccgggccatgtggaagccggttccgaacacgctgttgccgcagcgcagttcggcagcgcatccattctggtcattacgtggatgtatatccgcatgatgggcggggccggtttgaagaaggcgacggaagctgcaatcctcaatgccaattatattgcgcatcgtctgaagggtgtttacccgatcctttataccggcgcgcatgaccgcgtggcgcatgaatgcatcgtggatacgcgcgtattgaaggacagtgcgggcattaccgtggaagacgtggccaagcgcctgatcgactatggtttccatgcgccgaccatgtcatggccggttgccggaacgctgatgatcgagccgaccgagtccgagcccaagctggagatcgaccgtctttgcgatgcgatgatcgcgattgcaggcgaggcgaagaaggttgccgatggcgtctggcctgcggatgacaatccgcttgccaatgcgccgcatacggcgagcgatacgctggcaacggaatggaagcatccctatacccgtgaggaagccgtattccccggcggtgctttcgatccgacggcaaaatattggccgccggtcagccgcgtggataatgtcggcggcgaccggaacctcatctgctcctgcccgcctgtcgcagcctatggctga

SEQ ID NO: 2987 - protein, 932 aa, Brucella suis
MTEFLPFVARHIGPRHEDERAMLAALGLPSMETLITQAVPASIRLNRALNLPAALSEADALAELGTIMGRNVVKKSFIGAGYHGVHTPPVIQRNLFENPAWYTAYTPYQSEISQGRLELLFHFQTLVAELTGLPVACASLLDEATAVAEAIGVACRHHRDKRSRILLAGELHPQTVDVVNTRAEPLGWEIATGSDVDDNTAAIVVPWPDTRGVYGDFAKVIADAKAKGALVIAVADPLALTIMEAPARWGADMAVGSMQRYGVPMGFGGPHAAYLAVSEALTRIIPGRIVGQSVDAHGRAAYRLALQTREQHIRRDKATSNICTAQALLANMAAAFAIWHGPAGLQAIATRVAALAARFAAALKAAGVEIAGESLFDTVTAKVPGKAAAIAAEADKGGRLIRIIDADTVGVTFDETSTEEDLTALASLFGAKPVGGDTVLVPGKERGEGFLTQEVFHSHRSETEMMRFLRRLADKDLALDRAMIPLGSCTMKLNAAAEMMPVSWNTVANLHPFAPAEQVQGYAKMTSDLEAWLCEITGFAGVSLQPNAGSQGEYAGLMAIRHYHQAWGQGHRNICLIPSSAHGTNPASASMAGMSVVVVNCRPDGDIDIDDLKAKAEKHRDNLAAFMITYPSTYGVFEEGIKAFCEIVHDNGGQVYFDGANLNALVGLARPADIGADVCHMNLHKTFCIPHGGGGPGVGPIGVAKHLVPYLPGHVEAGSEHAVAAAQFGSASILVITWMYIRMMGGAGLKKATEAAILNANYIAHRLKGVYPILYTGAHDRVAHECIVDTRVLKDSAGITVEDVAKRLIDYGFHAPTMSWPVAGTLMIEPTESEPKLEIDRLCDAMIAIAGEAKKVADGVWPADDNPLANAPHTASDTLATEWKHPYTREEAVFPGGAFDPTAKYWPPVSRVDNVGGDRNLICSCPPVAAYG

SEQ ID NO: 2988 - DNA, 2928 bp, Burkholderia mallei
  CDS (1)..(2928): transl_table=11
atgaagctcgaacacccggaccgcctgatgaaccgcacgcccctctcgctcgccgcgctcgaaacgcacgacgcgttcgccgaacgccatatcggccccgacgccgccagccagcaggccatgctcgacacgctcggcttcgcgacgcgcgccgcactgatcgacgccgtgatccccgcgtcgatccgccgcgccgaaacgctgccgctcggcccgttcgcgcagccgaagagcgaagccgaagcgctcgccgcgctgcgcgcgctcgcggacaagaaccaggtgttccgctcgtacatcggccaaggctactacgacacccacaccccggcggtgatcctgcgcaacgtgctcgaaaacccggcgtggtacaccgcgtacacgccgtaccaacccgaaatctcgcagggccgcctcgaggcgctgctgaacttccagcagatggtcgccgacctgacgggcctcgagatctccaacgcgtcgctgctcgacgaagccacggccgcagccgaagcgatgacgctgctgcaacgcgtcggcaagccgcagtcgaacgtgttctacgtcgccgacgacgtgctgccgcaaacgctcgaagtgatcaagacgcgcgcgaagccgatcggcatcgaagtgaagtcgggcccggccgccgacgccgccgccgcgaacgcgttcggcgtgctgctgcaatatccgggcgcgaacggcgacgtgcgcgactaccgcgcgctcgccgacgcgatccacgccgcgggcggccacgtcgtcgtcgcggccgacatcctcgcgctcaccgtgctcatgccgcccggcgaatggggcgcggacgtcgccgtcggcaacacgcagcgcttcggcgtgccgatgggcttcggcggcccgcacgccgcatacatggcggtgcgcgacgaattcaagcggcagatgccgggccgcctcgtcggcgtgaccgtcgacgcgcagggcaagcccgcgctgcgcctcgcgctgcaaacgcgcgagcaacacatccgccgcgagaaggcaacgtcgaacgtctgcaccgcgcaggcgctgctcgcgatcatggcgagcatgtacgcggtctaccacggcccgcgcggcctgaagacgatcgcgctgcgcgtgaaccgcatcgcggcgctcctcgccgcgggcatcaggcatctcggctacgcaaccgtcaacgacacgttcttcgacacgctgacgatcgacaccggcgcgcgcaccgcgcaactccatgcgttcgcgcaagcgaagcgcatcaacctgcgccgcgcgggcgacacgcgagtcggcgtgtcggtcgacgaaacgacgacgcgcgccgatctcgccgatctgctcacgatcttcgcgcaggccgcgggcgcgacggcgcccgacatcgacgcgctcgacgccgggctcctccccgcgcccgcgctgccgccgagcctcgagcgcacgagcgcgtacctgacgcaccacgtgttcaaccgccaccattcggaaacggaaatgctgcgctacctgcgcagcctgtcggacaaggatctcgcgctcgaccgctcgatgatcccgctcggctcgtgcacgatgaagctgaacgcgacctccgaaatgctgcccgtcacgtggcccgaattcggccggatccacccgttcgcgcccgccgagcagaccgtcggctatcgcgagatgatcgaccagctcgagcagatgctcgtcgcggcaacgggctacgcggccgtgtcgctgcagccgaacgccggctcgcagggcgagtacgcgggcctgctcatcatccatgcgtatcacgaatcgcgcggcgaaagccaccgcgatgtctgcctgattccggcgtccgcgcacggcacgaacccggcgtcggcgcacatggccggcatgaaggtcgtggtggtcgcgtgcgacgcgcaaggcaacgtcgacatcgccgacctgaaggcgaaggccgacgcgcattcgcacgacctcgcggcgatcatgatcacgtatccgtcgacgcacggcgtgttcgagcagaacgtgcgcgagatctgcgagatcgtccacgcgcacggcggccaggtgtacgtcgacggcgcgaacatgaacgcgatggtcggcctcaccgcgcccggccagttcggcggcgacgtgtcgcacttgaacctgcacaagaccttctgcatcccgcacggcggcggcggcccgggcgtcggcccggtcgcggtcggcccgcacctcgcgaaattcctgccgaaccagcgctcgacgggctacgcgcgcggcgaagacggcatcggcgcggtgtcggcggcgccttacggctcggcgtcgatcctgccgatctcgtggatgtacatcgcgatgatgggcgcgaagaatttgaccgcggcgaccgaaaccgcgatcctcaacgcgaactacatcgcgaagcgcctcgcgccgcactatccggtgctgtattcgggcccgggcgggctcgtcgcgcacgaatgcattctcgatctgcgcccgatcaaggattcgagcggcatcaccgtcgacgacgtcgccaagcgcctgatggactacggctttcacgcaccgacgatgagcttcccggtgccgggcacgctgatggtcgagccgaccgaatcggaatcgcaggaggaactggaccgcttcatcgcggcgatgatcgcgatccgcgacgaaatccgcgcagtcgaggaaggccgcgccgaccgcgaggacaacccgctgcgtcacgcgccgcacacggcagccgtcgtcaccgcgaacgaatggccgcacgcgtactcgcgcgagcaggccgcgttcccggtcgcgtcgctcgtcgcgaacaagtactggccgcccgtcggccgcgcggacaacgcatatggcgaccgcaatctgttctgctcctgcgtgccggtatcggattacgcctga

SEQ ID NO: 2989 - protein, 975 aa, Burkholderia mallei
MKLEHPDRLMNRTPLSLAALETHDAFAERHIGPDAASQQAMLDTLGFATRAALIDAVIPASIRRAETLPLGPFAQPKSEAEALAALRALADKNQVFRSYIGQGYYDTHTPAVILRNVLENPAWYTAYTPYQPEISQGRLEALLNFQQMVADLTGLEISNASLLDEATAAAEAMTLLQRVGKPQSNVFYVADDVLPQTLEVIKTRAKPIGIEVKSGPAADAAAANAFGVLLQYPGANGDVRDYRALADAIHAAGGHVVVAADILALTVLMPPGEWGADVAVGNTQRFGVPMGFGGPHAAYMAVRDEFKRQMPGRLVGVTVDAQGKPALRLALQTREQHIRREKATSNVCTAQALLAIMASMYAVYHGPRGLKTIALRVNRIAALLAAGIRHLGYATVNDTFFDTLTIDTGARTAQLHAFAQAKRINLRRAGDTRVGVSVDETTTRADLADLLTIFAQAAGATAPDIDALDAGLLPAPALPPSLERTSAYLTHHVFNRHHSETEMLRYLRSLSDKDLALDRSMIPLGSCTMKLNATSEMLPVTWPEFGRIHPFAPAEQTVGYREMIDQLEQMLVAATGYAAVSLQPNAGSQGEYAGLLIIHAYHESRGESHRDVCLIPASAHGTNPASAHMAGMKVVVVACDAQGNVDIADLKAKADAHSHDLAAIMITYPSTHGVFEQNVREICEIVHAHGGQVYVDGANMNAMVGLTAPGQFGGDVSHLNLHKTFCIPHGGGGPGVGPVAVGPHLAKFLPNQRSTGYARGEDGIGAVSAAPYGSASILPISWMYIAMMGAKNLTAATETAILNANYIAKRLAPHYPVLYSGPGGLVAHECILDLRPIKDSSGITVDDVAKRLMDYGFHAPTMSFPVPGTLMVEPTESESQEELDRFIAAMIAIRDEIRAVEEGRADREDNPLRHAPHTAAVVTANEWPHAYSREQAAFPVASLVANKYWPPVGRADNAYGDRNLFCSCVPVSDYA

SEQ ID NO: 2990 - DNA, 2928 bp, Burkholderia sp
  CDS (1)..(2928): transl_table=11
atgaagctcgaacacccggaccgcctgatgaaccgcacgcccctctcgctcgccgcgctcgaaacgcacgacgcgttcgccgaacgccacatcggccccgacgccgccagccagcaggccatgctcgacacgctcggcttcgcgtcgcgcgccgccctgatcgacgccgtgatcccggcctcgatccgccgcgccgaaacgctgccgctcggcccgttcgcgcagccgaagagcgaggccgaagccctcgccgcactgcgggttctcgcggacaagaacgaggtgttccgctcgtatatcggtcagggttaccacgacacgcacacgccggccgtcatcctgcgcaacgtgctcgaaaacccggcgtggtacacggcctacacgccgtaccagcccgaaatttcccagggccgcctcgaggcgctcctgaacttccagcagatggtcgccgacctgacgggcctcgcgatctcgaacgcgtcgctgctcgacgaagccaccgccgccgccgaagcgatgacgctgctgcagcgcaccggcaagccgacgtcgaacgtgttctacgtcgccgacgacgtgctgccgcaaacgctcgaagtgatccgcacgcgcgcgctgccggtcggcatcgaggtcaagacgggcccggccgccgacgctgcgcaagccaatgcattcggcgtgctgctgcagtacccgggcgtgaacggcgacgtgcgcgactaccgcgcgctcaccgaagcgatccatgcggccggtggccacgtggtcgttgcggccgacctgctcgcactcaccgtgctgacgccgccgggcgactggggcgcggacgtcgcgatcggcaacacgcagcgcttcggcgtgccgatgggcttcggcggcccgcacgccgcgtatctcgcggtgcgtgacgaattcaagcgccagatgccgggccgcctcgtcggcgtcacggtcgacgcgcagggcaagcccgcgctgcgcctcgcgctgcagacgcgcgaacagcacatccgccgcgagaaggccacgtcgaacgtgtgtactgcgcaggcactgctcgcgatcatggccagcatgtacgcggtctaccacggcccgcacggcctgaagacgatcgcgctgcgcgtgaaccgcatcgcggcgctgctcgccgccggcgtgaagcagctcggcttcgcgaccgtcaacgacacgttcttcgacacgctgacgatcgacaccggcgcgcgcaccgcgcaggttcacgaattcgcgaaggcgaagcgcatcaacctgcgccgcgtgagcgacacgcaagtcggcgtatcggtcgatgaaacgacgacgcgcgacgacctcgccgatctcctcgccgtgttcgcgcaagccgcgggcggcaccgcaccggccgtcgacgcgctggacgcgggcctcgccggcgtcgccgcgctgccggccggcctcgagcgcacgagcgcatacctgacgcaccacgtgttcaaccgccaccattccgaaaccgaaatgctgcgctacctgcgcagcctgtcggacaaggatctcgcgctcgaccgctcgatgatcccgctcggctcgtgcacgatgaagctgaacgcgacgtcggaaatgctgcccgtcacgtggcccgaattcggcggcatccacccgttcgcaccggccgagcagaccgtcggctaccgcgagatgatcgaccagctcgagcagatgctcgtcgcggccaccggctacgcagccgtgtcgctgcaaccgaacgcgggctcgcagggcgagtacgcgggcctgctgatcatccacgcctaccacgcctcgcgcggcgaagcgcaccgcgacgtgtgcctgatcccggcgtccgcccacggcacgaacccagcatcggcgcacatggccggcatgaaggtcgtggtcgttgcatgcgacgcgcagggcaacgtcgacattgccgacctgaaggcgaaggccgacgagcacgcgaaggacctcgcggcgatcatgatcacgtatccgtcgacgcacggcgtgttcgagcagaacgtccgcgagatctgcgagatcgtccatgcgcacggcggccaggtgtacgtcgacggcgcgaacatgaacgcgatggtcggcctgaccgcgccgggccagttcggcggcgacgtgtcgcacctgaacctgcacaagaccttctgcatcccgcacggcggtggcggcccgggcgtcggcccggtcgcggtcggcgcgcacctcgcgaagttcctgccgaaccagcgttcgaccggctacacgcgtgaagaagacggcatcggcgcggtatcggccgcgccgtacggctcggcgtcgatcctgccgatctcgtggatgtacatcgcgatgatgggcgcgaagaacctgaccgccgcgacggaaaccgcgatcctcaacgcgaactacatcgcgaagcgcctcgcgccgcactacccggtgctgtattcgggcccgggcgggctggttgcgcacgagtgcattctcgacctgcgtccgatcaaggaatcgagcggcatcagcgtcgacgacgtcgcgaagcgcctgatggactacggcttccacgcgccgacgatgagcttcccggtgccgggcacgctgatggtcgaaccgaccgaatcggaatcgcaggaagaactcgaccgcttcatcgccgcgatgatcgcgatccgcgacgaaatccgtgccgtcgaggaaggccgcgccgaccgcgaggacaacccgctgcgtcatgcaccgcacacggcggccgtcgtcaccgcgaacgaatggctgcacgcgtactcgcgcgagcaggctgcgtacccggtcgcgtcgctcggcacgaacaagtactggccgccggtcggccgcgcggacaacgtctacggcgaccgcaacctgttctgctcgtgcgtgccgatgtcggaatacgcataa

SEQ ID NO: 2991 - protein, 975 aa, Burkholderia sp
MKLEHPDRLMNRTPLSLAALETHDAFAERHIGPDAASQQAMLDTLGFASRAALIDAVIPASIRRAETLPLGPFAQPKSEAEALAALRVLADKNEVFRSYIGQGYHDTHTPAVILRNVLENPAWYTAYTPYQPEISQGRLEALLNFQQMVADLTGLAISNASLLDEATAAAEAMTLLQRTGKPTSNVFYVADDVLPQTLEVIRTRALPVGIEVKTGPAADAAQANAFGVLLQYPGVNGDVRDYRALTEAIHAAGGHVVVAADLLALTVLTPPGDWGADVAIGNTQRFGVPMGFGGPHAAYLAVRDEFKRQMPGRLVGVTVDAQGKPALRLALQTREQHIRREKATSNVCTAQALLAIMASMYAVYHGPHGLKTIALRVNRIAALLAAGVKQLGFATVNDTFFDTLTIDTGARTAQVHEFAKAKRINLRRVSDTQVGVSVDETTTRDDLADLLAVFAQAAGGTAPAVDALDAGLAGVAALPAGLERTSAYLTHHVFNRHHSETEMLRYLRSLSDKDLALDRSMIPLGSCTMKLNATSEMLPVTWPEFGGIHPFAPAEQTVGYREMIDQLEQMLVAATGYAAVSLQPNAGSQGEYAGLLIIHAYHASRGEAHRDVCLIPASAHGTNPASAHMAGMKVVVVACDAQGNVDIADLKAKADEHAKDLAAIMITYPSTHGVFEQNVREICEIVHAHGGQVYVDGANMNAMVGLTAPGQFGGDVSHLNLHKTFCIPHGGGGPGVGPVAVGAHLAKFLPNQRSTGYTREEDGIGAVSAAPYGSASILPISWMYIAMMGAKNLTAATETAILNANYIAKRLAPHYPVLYSGPGGLVAHECILDLRPIKESSGISVDDVAKRLMDYGFHAPTMSFPVPGTLMVEPTESESQEELDRFIAAMIAIRDEIRAVEEGRADREDNPLRHAPHTAAVVTANEWLHAYSREQAAYPVASLGTNKYWPPVGRADNVYGDRNLFCSCVPMSEYA

SEQ ID NO: 2992 - DNA, 2853 bp, Chromobacterium violaceum
  CDS (1)..(2853): transl_table=11
atgtcgctcaccgaactcttcaaccgtcacgaattcctcgcccgccacatcggcccgtccgacgccgagcgcgccgagatgctggccgccgtcggcgcgccgtcgatcgacgcgctggtcgaccagacgctgccggccgacatccgcctgaaccgccgcctggacctgccgtcgccgcagccggaggccgaggcgctggcggcgctgaaggccgtcgcatccaagaacgtggtcaacaagtccttcatcggcctcggctactacccggtgctgacgcccaccgtcatcctgcgcaatgtgctggaaaacccgggctggtacaccgcctacaccccgtaccaggccgagatcgcccagggccggctggaagcgctgctgaacttccagcagatggtcatcgacctgaccggcctggaaatggccaacgcctcgctgctggacgaagccaccgccgccgccgaggcgatggcgatggcggggcgcgtgtccaagtccaagtccacccgcttcttcgtcgacagccgcgtgctgccgcagacgctggacgtgatgaagacccgcgccaagtacttcggcttcgagctggtgcagggccatccggaagaggccggcaacggcgactacttcggcgccttgttccagtatccgggcgaggccggcgacctgctcgatctaaccccgcacatcgccgccgtcaaggccaagggcggcgtggtggccgtcgccgccgacgtgatggcgctggtggccttgaagtcaccggccgagatgggcgccgacatcgcgctgggcaacacccagcgcttcggcgtgccgatgggcttcggcggcccgcacgccgcttatttcgcgttcaaggacgagatgaagcgctcggcgccgggccgcatcatcggcgtgtccatcgacgccaagggcaagaccgcgctgcgcatggcgctgcaaacccgcgagcagcacatccgccgcgagaaggccaactccaacatctgcaccagccaggtgctgctggccaatatcgccggcctgtacgccgtttaccacggtgcggagggcgtgcggcgcatcgccgcccgcatccaccgtctggcggccatcttcgcccacgcggtgaaggaagccggaggcaagctggtgttcgaccgcttcttcgacaccgtgcaggtggacgcgcccaaggccgacgccatctacgccgccgcgctggccgccggctacaatctgcgccgcgtcggcaagaccgtgctgggcgtggccttccacgaggccgccaccgagtcggacctggccaagctgatcgagctgttcaccggcaagccggccgacatcgccgccctggacgccgccgccctggacgcgatcccggccgcgctcaagcgcgagtcggccatcctgacccacccggtgttcaacacccatcatagcgagcacgagatgctgcgctatatgaagaagctggaaaaccgcgacctggcgatgaaccactcgatgatctcgctgggcagctgcaccatgaagctgaacgccaccagcgagatgatcccgatcacctggccggaattcgccaatatgcacccgttcgcgccgcgcgagcagaccgtgggctatctggagctgatcgagggcctgcagaagcagttgaaggcgatcaccggcttcgacgcgatctcgatgcagccgaattccggcgcccagggcgagtacgccggcctgctggcgatcagccgctaccacgagtcgcgcggcgaagcgcatcgcaatatctgcctgattccgcaatcggcgcacggcaccaatccggccaccgcgcagatgatgaatatgcaggtggtggtggtgaagtgcgacgaggccggcaacgtcgacgtggccgacctgaaggccaaggccgagcagcacgccgccaatctggccgcgctgatgatcacctatccgtccacccacggcgtgttcgagcagggcatcaaagagatctgcgagatcgttcatgcccacggcggccaggtctacatggacggcgccaacctgaatgcccaggtggggctgactcgcccggccgacatcggcgccgacgtgtcgcacatgaacctgcacaagaccttctgcatcccgcacggcggcggcggaccgggcatgggcccgatcggcctgaaggcccacctggcgccgttcatcgccaaccacgtggtggcgccggtgccgggcgcggtggaaggccagaccgcggtgtcggccgcgccgttcggctccgcctccatcctgcccatctcctatatgtacatcgcgatgatgggcgcggagggcatgaagcaggcgaccgagaacgccttgctgtccgccaactacctggccacccgcctctccgagcacttcccggtgttgtacaccggcgccaacggccgcgtcgcccacgagtgcatcatcgacctgcgcccgctgaaggccgcctccggcgtcaccgaggtggacgtggccaagcgcctgatggactacggcttccacgcgccgaccatgagcttcccggtgccgggcacgctgatgatcgaaccgaccgaatccgagcccaaggcggagctcgaccgcttcatcgcggcgatggccgccatccgcgccgagatcgaccgggtgcagagcggcgcatggccggcggacaataatccgctggtcaacgcgccgcacagcaaggccgacatcgcaggcgactgggaccgcccttacagccgcgagcagggtctgttcccgctgccctacgtgctggaaaacaagttctggccgagcgtgaaccgcatcgacgatgtgtatggcgaccgcaacgtggtgtgcagctgcccgagcacggaaagctatatgtaa

SEQ ID NO: 2993 - protein, 950 aa, Chromobacterium violaceum
MSLTELFNRHEFLARHIGPSDAERAEMLAAVGAPSIDALVDQTLPADIRLNRRLDLPSPQPEAEALAALKAVASKNVVNKSFIGLGYYPVLTPTVILRNVLENPGWYTAYTPYQAEIAQGRLEALLNFQQMVIDLTGLEMANASLLDEATAAAEAMAMAGRVSKSKSTRFFVDSRVLPQTLDVMKTRAKYFGFELVQGHPEEAGNGDYFGALFQYPGEAGDLLDLTPHIAAVKAKGGVVAVAADVMALVALKSPAEMGADIALGNTQRFGVPMGFGGPHAAYFAFKDEMKRSAPGRIIGVSIDAKGKTALRMALQTREQHIRREKANSNICTSQVLLANIAGLYAVYHGAEGVRRIAARIHRLAAIFAHAVKEAGGKLVFDRFFDTVQVDAPKADAIYAAALAAGYNLRRVGKTVLGVAFHEAATESDLAKLIELFTGKPADIAALDAAALDAIPAALKRESAILTHPVFNTHHSEHEMLRYMKKLENRDLAMNHSMISLGSCTMKLNATSEMIPITWPEFANMHPFAPREQTVGYLELIEGLQKQLKAITGFDAISMQPNSGAQGEYAGLLAISRYHESRGEAHRNICLIPQSAHGTNPATAQMMNMQVVVVKCDEAGNVDVADLKAKAEQHAANLAALMITYPSTHGVFEQGIKEICEIVHAHGGQVYMDGANLNAQVGLTRPADIGADVSHMNLHKTFCIPHGGGGPGMGPIGLKAHLAPFIANHVVAPVPGAVEGQTAVSAAPFGSASILPISYMYIAMMGAEGMKQATENALLSANYLATRLSEHFPVLYTGANGRVAHECIIDLRPLKAASGVTEVDVAKRLMDYGFHAPTMSFPVPGTLMIEPTESEPKAELDRFIAAMAAIRAEIDRVQSGAWPADNNPLVNAPHSKADIAGDWDRPYSREQGLFPLPYVLENKFWPSVNRIDDVYGDRNVVCSCPSTESYM

SEQ ID NO: 2994 - DNA, 2892 bp, Dechloromonas aromatica
  CDS (1)..(2892): transl_table=11
atgccgttgaatcttcccctttcagccctggagcagcacgacgagttcatcggccgccacatcggcccatgctcgaccgaaatggctaccatgctgaccgccatcggtgccgacagcctggagcagctgatcgaccagaccgttcccgccgccatccgtttgccggctgatctgccgctgcccgccccgcgccgcgaacacgaagcgctggccgacctcaaggccatggccagcaagaatgtcgtcaacaagtcctgcatcggcatgggctattacgacacactgacgcccaaggtcatcctgcgcaacgtcatggaaaacccgggctggtatacggcctacacgccctaccaggctgaaatcgcccagggccgcctggaagcgctgatgaacttccagcaaatggtcatcgacctgaccggactggaaatcgccaacgcctcactgctcgacgaagccaccgccgccgctgaagcgatgaccatggcgcgccgtgtttcgaagtcgaaatccaaccgtttcctggtcgatgccaactgtttcccgcagagtatcgacgtggtcaagacccgcgccgcctatttcggcttcgagttggtcatcggcaacatcgacgcgcacaaggacggtgacttcttcggcgccctgctccagtacccgggcgacaacggcgaagtccgtgacctgaccgacgtgatcgccggcctgaaggccaagggcacgaccgttgctgtcgcctccgacctgatggcactggtgctactcaaatcccccggtgccatgggtgccgacatcgcgcttggctccagccagcgcttcggcattccgatgggcttcggcgggccgcatgctgccttcttcgccacccgcgaagccttcgttcgctcgatgcccggccgcatcatcggcatctccaaggatgcgcgcggcaacaccgcttaccgcatggcattgcagactcgcgaacagcacatccgccgcgaaaaggccaactccaacatctgtacctcgcaggtactgctcgccaacatggccggcatgtacgtggtctatcatggcgccgaaggtctgcgtaccatcgccggtcgcatccaccgcctgaccgcgatcctggccgaaggcctcaagcgtgccagcgtcaatctgctgaccaagcagttctacgataccgtgcattttgatcttggcgcccgcgccgaatcggtttacaacgacgcgctcgccgccggttacaacctgcgccgcgtctcggccggtgtgcttggtatttccttcgacgaaaccaccacgcgagacgatgtcgccaccctgttcaagctgatcgcccaaaccacgctcgacgttgctaccatcgatgcgcaagtcgccgcagccgactccgctctgcccgacagcctgatccgcagcgatgccgtgctgcagcacccggtgttcaacacgcaccacaccgagcacgagatgctgcgctacctgaagtcgctgcagaacaaggacctggcgctcgaccactcgatgatctcgctcggctcctgcaccatgaagctgaacgcgaccagcgagatgatcccggtcacttggccggaattcggcgggatacacccgttcgcgccgcgcgatcaggccgttggctatctggaaatgatcaccagcctgaccgagtggctgaagaccgtcaccggcttcgacgccatctgcatgcagccgaactccggggcgcagggtgaatacgccggtctggtcgctatcgaccgtttccacgccagccgtggtgaagagcaccgcaacgtctgcctgattcccaaatcggcccacggcaccaacccggccaccgcccagatggccaacatgaaggtggtggttgtcgattgtgacgagaacggcaatgtcgatgtcgccgatctcaaggccaaggccgaagagcacaaggacgacctggcctgcctgatgatcacttacccgtcgacgcacggcgtgttcgaggaagccattcgcgacatctgcgccatcgtgcatgccaacggcggccaggtgtatatggacggtgccaacctcaacgcccaggtcggcctgacctcgcccggcttcatcggcgccgatgtcagccacatgaacctgcacaagaccttcgccatcccgcacggcggcggtggaccgggcatgggcccgatcggcctcaaggctcacttggcaccgttcatggccgaccacgttgtccagccaaccggcgacgccaaccgcgtcaacgccggccagggagcagtctccgcagcgcctttcggctcggcctcgatcctgaccatttcgtggatgtacctggccatgttgggcggcgccggcgtcaagaaggcgacgcaggttgccatcctcaacgccaactacgtcgccaagcagctcaacgcgcactacccggtgctctacgtcggcaagaacggccgcgtggcgcacgagtgcattctcgacatccgcccgatcaaggccgctaccggcatcgccgagatcgacatcgccaagcgcctgatggactacggtttccatgcgccgacggtctccttcccggtcgctggcacgatcatggtcgagccgacggaatccgaatcgaaggccgaactggatcgcttcatcggcgccatgatcgccatccgtgaggaaatccgccagatcgaaaatggcgtttggacggccgacaacaatccgttgaagaatgccccgcattcgcaggcggacgtcatggatgccgaatggaagcatccgtacagccgtcagcaggccgtcttcccgctgccttgggtggcggccaacaagttctggccgagcgtcaatcgcatcgacgatgtgtatggcgatcgcaacctgaactgcgcctgcccgccgatggaagcctacgccgactga

SEQ ID NO: 2995 - protein, 963 aa, Dechloromonas aromatica
MPLNLPLSALEQHDEFIGRHIGPCSTEMATMLTAIGADSLEQLIDQTVPAAIRLPADLPLPAPRREHEALADLKAMASKNVVNKSCIGMGYYDTLTPKVILRNVMENPGWYTAYTPYQAEIAQGRLEALMNFQQMVIDLTGLEIANASLLDEATAAAEAMTMARRVSKSKSNRFLVDANCFPQSIDVVKTRAAYFGFELVIGNIDAHKDGDFFGALLQYPGDNGEVRDLTDVIAGLKAKGTTVAVASDLMALVLLKSPGAMGADIALGSSQRFGIPMGFGGPHAAFFATREAFVRSMPGRIIGISKDARGNTAYRMALQTREQHIRREKANSNICTSQVLLANMAGMYVVYHGAEGLRTIAGRIHRLTAILAEGLKRASVNLLTKQFYDTVHFDLGARAESVYNDALAAGYNLRRVSAGVLGISFDETTTRDDVATLFKLIAQTTLDVATIDAQVAAADSALPDSLIRSDAVLQHPVFNTHHTEHEMLRYLKSLQNKDLALDHSMISLGSCTMKLNATSEMIPVTWPEFGGIHPFAPRDQAVGYLEMITSLTEWLKTVTGFDAICMQPNSGAQGEYAGLVAIDRFHASRGEEHRNVCLIPKSAHGTNPATAQMANMKVVVVDCDENGNVDVADLKAKAEEHKDDLACLMITYPSTHGVFEEAIRDICAIVHANGGQVYMDGANLNAQVGLTSPGFIGADVSHMNLHKTFAIPHGGGGPGMGPIGLKAHLAPFMADHVVQPTGDANRVNAGQGAVSAAPFGSASILTISWMYLAMLGGAGVKKATQVAILNANYVAKQLNAHYPVLYVGKNGRVAHECILDIRPIKAATGIAEIDIAKRLMDYGFHAPTVSFPVAGTIMVEPTESESKAELDRFIGAMIAIREEIRQIENGVWTADNNPLKNAPHSQADVMDAEWKHPYSRQQAVFPLPWVAANKFWPSVNRIDDVYGDRNLNCACPPMEAYAD

SEQ ID NO: 2996 - DNA, 2850 bp, Deinococcus radiodurans
  CDS (1)..(2850): transl_table=11
atgaccaaatccctctctgatctcctccagaccaacgacttcacccgccggcacatcggccccagcgaggctgagcaggccgagatgctgggcgtgctgggcgtctccagcctggacgagctgacccagaccacgctgcccgccgccattcaattcgacggcgaactgcacaccggccccggcatgaccgaggcgcaggcactggccgagctgaaggccgtggcgcagaagaacaaggtgttccgctcctacatcggcatggggtacgccggcacggacgttccgccggtcattctgcgcaacatgctggaaaatcccggctggtacaccgcctacacgccctatcaggccgagatttcgcaggggcggctggaaatgctgctcaactttcagcagaccgtccaggacatgacgggtatgccagtcagcaacgcctcgctgctggacgaggccaccgccgccgccgaagcgatgactctggccaagcgccagagcaagaacaagggcagcaacgtctttttcgtggccgacaacgtgcatccgcagacgatggatgtggtgaagacccgcgccgagtacttcgggttcgaggtgcagacgggaagcgcggacgccatccccgagggagctttcggggcgctggtgcagtatcccggcacccacggcgaagtgctgaacctcgcgccgattgccgagaaggcccacacccagggcgccgccctgattgtcgccaccgacctgctggcctgcgccctgctgacccctcccggtgagcaaggcgccgacatcgtggtgggcagcgctcagcgcttcggcgtgccgatgggcttcggcgggccgcacgcggcattcctggcctgtcagaagggcttcgagcgttccatgccgggccgcgtgatcggcgtgagcaaggacgtgcgcggcaacaccgccctgcgaatggcgatgcagacccgcgagcagcacatccgccgcgagaaggccacctccaacatctgcaccgcgcaggcgctgctggcgaacatggccgccgcctacgccgtgtggcacgggccggaagggattaagaccattgccgagcgcgtgcataggctgaccggcattctggcgaaggcactgcaagacgccggcatcaaggccaacgaaactttcttcgacaccctgacctttgaggggcaggacgacctgggggcccgcgccgaggcgaagggcatcaacttccgccttgacggcggcaaggtggggatcagcctggacgaaaccgtcaccccgcaggacctcgcggacatcatcgaagtggtgacgggcaagggagtggacgtgcagaagctagatgccgaagccgttgacggcatccccgccccgctcaagcgccagtcggacttcctgacccacccggtcttcaacacgcaccactccgagcacggcatgttgcgttacctcaaacagctcgaaaacaaggactacagccttacgcacggcatgattccgctgggcagctgcaccatgaagctcaacgccaccaccgagatgattccggtgacgtggcccgagttcggcggccttcaccccttcgcgcccgagtcgcagacgcagggctacgctgagatgctagccgagttggagcgctggctggccgacatcaccggctacgacgccgtgtccatgcagcccaactccggggcacagggcgagtacgcgggcctgctggtcatccgcaagtaccacgaggctcgcggcgaggcccaccgcaacatctgcctgattcccgcctccgcgcacggcaccaaccccgccagcgccgccatgatggggatgcaggtcgtggtggtcaagaccgacgaacagggcaacatcgacttcgacgacctcaaggcgcaggccgaggcgcacagcgaccacctcgccgcgctgatgattacctacccctccacgcacggggtgtacgaggagaacgtgcgggacgtgtgcgacctgattcaccagcatggcgggcaggtgtacctcgacggcgccaacatgaacgcgatggtcggggtcgccaagccggggctgatcggcggcgacgtgagccacctcaacctccacaagaccttcgccattccgcacggcggcggcgggccgggcatggggccgattggcgtgaaggcccacctcgcgcccttcctgcccaaccacgccgttgcgcccaccagcgacagccacaccggagccgtgagcgccgcaccgtatggcagcgccagcatcctgcccatctcgtacctctacatcaagctgctgggcgccgctggcctgcgccagagcacccaggtcgcgctgctgaatgccaactacattgccaagcggctctccggcgccttcccggtgctctacagcggcaaggggggccgggtcgcgcacgagtgcatcctcgacattcgcccgctcaagcaggagagcggcgtcagcgaggaagacatcgccaagcgcctgatggactacggcttccacgcgcccaccatgtccttcccggtgcccggcaccctgatgatcgagcccaccgagtccgagccgaaagccgaactcgaccgttttgtggacgccatgctgaacatccgccgcgagattcaggacgtgcaggacggcaccatcagcgccgccgacagcccgctgaagcacgcgccgcacacgctgaaagacctgatggacagcgagtggacccgcgcctacagccgcgaaacgggcgccttccccagtgccgcgcagaaggcgtggaagtactggcccgccgtgaaccgcgtggacaacgtgtacggcgatagaaactttgtgtgctcctgcccgccgattgaggattacatcggcgcttga

SEQ ID NO: 2997 - protein, 949 aa, Deinococcus radiodurans
MTKSLSDLLQTNDFTRRHIGPSEAEQAEMLGVLGVSSLDELTQTTLPAAIQFDGELHTGPGMTEAQALAELKAVAQKNKVFRSYIGMGYAGTDVPPVILRNMLENPGWYTAYTPYQAEISQGRLEMLLNFQQTVQDMTGMPVSNASLLDEATAAAEAMTLAKRQSKNKGSNVFFVADNVHPQTMDVVKTRAEYFGFEVQTGSADAIPEGAFGALVQYPGTHGEVLNLAPIAEKAHTQGAALIVATDLLACALLTPPGEQGADIVVGSAQRFGVPMGFGGPHAAFLACQKGFERSMPGRVIGVSKDVRGNTALRMAMQTREQHIRREKATSNICTAQALLANMAAAYAVWHGPEGIKTIAERVHRLTGILAKALQDAGIKANETFFDTLTFEGQDDLGARAEAKGINFRLDGGKVGISLDETVTPQDLADIIEVVTGKGVDVQKLDAEAVDGIPAPLKRQSDFLTHPVFNTHHSEHGMLRYLKQLENKDYSLTHGMIPLGSCTMKLNATTEMIPVTWPEFGGLHPFAPESQTQGYAEMLAELERWLADITGYDAVSMQPNSGAQGEYAGLLVIRKYHEARGEAHRNICLIPASAHGTNPASAAMMGMQVVVVKTDEQGNIDFDDLKAQAEAHSDHLAALMITYPSTHGVYEENVRDVCDLIHQHGGQVYLDGANMNAMVGVAKPGLIGGDVSHLNLHKTFAIPHGGGGPGMGPIGVKAHLAPFLPNHAVAPTSDSHTGAVSAAPYGSASILPISYLYIKLLGAAGLRQSTQVALLNANYIAKRLSGAFPVLYSGKGGRVAHECILDIRPLKQESGVSEEDIAKRLMDYGFHAPTMSFPVPGTLMIEPTESEPKAELDRFVDAMLNIRREIQDVQDGTISAADSPLKHAPHTLKDLMDSEWTRAYSRETGAFPSAAQKAWKYWPAVNRVDNVYGDRNFVCSCPPIEDYIGA

SEQ ID NO: 2998 - DNA, 2874 bp, Erwinia carotovora subsp
  CDS (1)..(2874): transl_table=11
atgacccagacactcagtcaactcgaacatgacggcgcgtttatcgagcgccatatcggcccttctgtcagccagcagcagcacatgctgtcggtggtgggggcgacgtcgctggatgcgctgattcgccagattgttccggcggacattcaactacctagcccaccagcggtgggggaagctgtgacggagcatgaggcgctagctgagctgaaggccattgcaggacgcaatcaacgttacaagagctatatcggcatgggctacagtgcggtgctgatgccgccagtgattttacgcaacgtgctggaaaacccaggttggtacaccgcttatacgccgtaccagccagaagtctctcaggggcgtcttgaagcgctgctgaatttccagcaggttacacaggatttaaccggattggatctggcttccgcttcgctgctagatgaagctactgccgcggcggaagcgatggcgatggcaaaacgcatcagtaaactcaaacaggccgagcgtttcttcgttgccgatgatgtacacccgcaaacgctggacgtggtgcgcacccgtgcggaaacgttcggttttgaaattgtggtcggcaaggctgaagaggcgctgaaagacgatgcggtgtttggcgtactgctgcaacaggcaggaaccacgggcgaactgcacgattacagcgacctgatggccgcactgaaagcgcgtaaggtcgtcagctgtgtggcgtcggatatcatggcgttggtactgctgaccgcaccgggcaagcagggcgcggatatcgtcttcggttccgcacagcgtttcggcgtgccgatgggctacggcggcccacacgcggcgttcttcgcctgccgtgatgaacataaacgtgccatgccgggccgtattatcggcgtgtcgcgcgatgcggcgggcaataccgcgtttcgcatggcgatgcagacgcgtgaacagcatattcgccgcgagaaggcgaactccaatatttgtacttcgcaggtgttgctggccaacattgcggggatgtatgcggtattccacgggccggaagggctcaaacgtattgcggggcgtatccatcgtctgactgacattctggcggcaggattaacgcagggcgggctgctgctgcgccatcgcagctggttcgacacgctaactattgaggttgcggacaaggacgtggtactgagccgcgcattaagttttggcatcaatctgcgcagcgatttggcgagtgctgtgggtatcacgctggatgaagcgaccacgcgtgaagacgtgctggcgctgttcgcggtgctattaggtgacgatcacgggctggatattgaagcgcttgatgcgtccatcgctcaagaggtcgcgacgatcccggctgggttgctgcgtcatgatgcgatcctgtcgcatccggttttcaaccggtatcacagcgaaaccgagatgatgcgctatctgcaccgtctggcgcgtaaggatctggcgctgaatcaagcgatgatcccgctcggttcttgcaccatgaagcttaatgcggcggcggaaatgctgccgattacctggccggaatttgccgaactgcacccattctgcccgccggaacaggcgctgggctatcgccagatgatcgagcagttatcgggttggctggtgcaactgacgggttatgatgcagtttgcatgcagcccaattcgggcgcacagggtgaatatgcggggctgctggcgatccgtcgctatcatgaaagccgtaatgaagcgggtcgtcatctctgcctgatccctagctctgcgcacggaactaacccagcatcggcgcagatggcggggatggaagtggtggtagttgcctgtgacaaacagggcaacatcgacctgcacgatctgcgtgagaaggcgcaggcagcgggcgaacagctttcctgcatcatggtgacctatccgtctacccacggcgtctatgaagagacgattcgcgaagtgtgccagatcgtgcatcaatacggcggtcaggtgtatctggatggcgcgaatatgaacgcacaggtcggcattacgacgccgggctacattggcgcggacgtatcgcacctgaacctgcataaaaccttctgtattccgcacggtggtggtggcccgggtatggggccgattggcgtgaaagcgcatctggcaccatttgtgccgggtcatcaggtggtcaaaattgacggtgtgctgacggagcaaggggctgtctctgcggcgccgttcggcagcgcttctatcctgccgattagctggatgtacatccgtatgatgggtgcggaagggctgaaacaagccagccagatggcgatcctgaacgccaactacattgcgacgcgcttgcagcaggcctatccggtgctttataccggccgtgacggtcgtgtcgcgcacgagtgtattctggatattcgtccactcaaggaaagtacgggcatcagcgaaatggatattgccaagcgtctgattgattacggtttccatgcgccaactatgtcgttcccagtagcgggtacgctgatggtggaacctacggaatcagaaagtcaggtggagatcgaccgctttattgatgcgatgctggcgatccgttccgaaatcaatcgcgttgcgcagggcgaatggccgctggacgacaacccgctggtcaatgccccgcacacgcaggcagagctggtggctgactgggcgcatccatacagccgtgagctagcggtattcccggcaggtagcgaacacaaatactggccgagcgtgaagcgtctggacgatgtttacggcgaccgtaacctgttctgctcgtgtgtgccgatgagcgactatgcgtaa

SEQ ID NO: 2999 - protein, 957 aa, Erwinia carotovora subsp
MTQTLSQLEHDGAFIERHIGPSVSQQQHMLSVVGATSLDALIRQIVPADIQLPSPPAVGEAVTEHEALAELKAIAGRNQRYKSYIGMGYSAVLMPPVILRNVLENPGWYTAYTPYQPEVSQGRLEALLNFQQVTQDLTGLDLASASLLDEATAAAEAMAMAKRISKLKQAERFFVADDVHPQTLDVVRTRAETFGFEIVVGKAEEALKDDAVFGVLLQQAGTTGELHDYSDLMAALKARKVVSCVASDIMALVLLTAPGKQGADIVFGSAQRFGVPMGYGGPHAAFFACRDEHKRAMPGRIIGVSRDAAGNTAFRMAMQTREQHIRREKANSNICTSQVLLANIAGMYAVFHGPEGLKRIAGRIHRLTDILAAGLTQGGLLLRHRSWFDTLTIEVADKDVVLSRALSFGINLRSDLASAVGITLDEATTREDVLALFAVLLGDDHGLDIEALDASIAQEVATIPAGLLRHDAILSHPVFNRYHSETEMMRYLHRLARKDLALNQAMIPLGSCTMKLNAAAEMLPITWPEFAELHPFCPPEQALGYRQMIEQLSGWLVQLTGYDAVCMQPNSGAQGEYAGLLAIRRYHESRNEAGRHLCLIPSSAHGTNPASAQMAGMEVVVVACDKQGNIDLHDLREKAQAAGEQLSCIMVTYPSTHGVYEETIREVCQIVHQYGGQVYLDGANMNAQVGITTPGYIGADVSHLNLHKTFCIPHGGGGPGMGPIGVKAHLAPFVPGHQVVKIDGVLTEQGAVSAAPFGSASILPISWMYIRMMGAEGLKQASQMAILNANYIATRLQQAYPVLYTGRDGRVAHECILDIRPLKESTGISEMDIAKRLIDYGFHAPTMSFPVAGTLMVEPTESESQVEIDRFIDAMLAIRSEINRVAQGEWPLDDNPLVNAPHTQAELVADWAHPYSRELAVFPAGSEHKYWPSVKRLDDVYGDRNLFCSCVPMSDYA

SEQ ID NO: 3000 - DNA, 3105 bp, Flaveria anomala
  CDS (1)..(3105)
atggagcgtgcacgcaggctagctatgctggggcgccttgtgtcacaaaccaaacacaacccatcaatatcatcccctgctctgtgttcaccttcacggtatgtttcctctttatccccttatgtatgtggtggcacaaacgttagatcagatagaaaccttaatgggtttggttcacaagttagaaccatatcagttgaagctttgaaaccaagtgacactttcccacgtcgccataactcagccacccctgaagaacaaaccaaaatggctgaattcgtcggcttttcgaatcttgattcactcattgatgcaactgtgcctaagtcaatccgtcttgattcaatgaagtactcgaagtttgatgaggggttgactgaatctcaaatgattgcacatatgcaagatttagcttctaagaacaagatctttaagtcctttattggtatgggctattacaacacatctgtgcctactgttatattaagaaacattatggagaacccgggttggtatactcagtacacaccataccaggctgaaattgcgcaggggcggctcgagtccctgctcaatttccagaccatgattactgatctaacaggtttgccgatgtcgaatgcttcattgcttgatgaagggactgcagctgctgaagctatggctatgtgtaataatattcagaagggtaaaaagaagacctttattattgcaagtaactgtcacccacaaacaattgatatttgtaaaactcgtgcggatgggtttgacctgaaagtggtcacttctgatcttaaagattttgattactcatctggtgatgtttgtggagttttggttcagtatccaggtactgagggtgagttgttggactacagtgagttcatcaagaatgctcatgcaaatggggtgaaagtggtcatggctagtgatttgttggctttgactattttgaagccacctggtgaacttggggctgatattgtggtgggttcggctcaacggtttggggttccaatgggttatggtggtccgcatgcagcttttcttgcaacgtcccaagagtataagagaatgatgcctggaagaattattggtgttagtgttgattcttctggaaaaccagctttacgtatggcgatgcagacccgtgagcaacatatcaggagagataaagcaactagtaacatttgtacagctcaggcattgcttgcaaacatggctgctatgtatggtgtttaccatgggccagaaggcctaaagaccattgccaaacgggtccatggtctagctggcacatttgctgcaggtttgaagaagttagggacagtacaagtccaagatctccccttttttgacactgtgaaagtaacttgtgctgattcaaaggcaattgctgaagaagcctgcaagcataaaatgaatcttcgcattgtcgacaagaacactatcactgtcgcgttcgatgagacaacaacgattgaagatgttgatactttgttcaaagtttttgcattagggaaacctgtgccattcactgctgcatctattgcaccagaggttcaagatgctatcccatctgggcttgtaagggagactccatatttgacacatcctattttcaacatgtatcatacggagcatgagctactaagatacattagtaaattgcaatcaaaggacctctcattatgccacagtatgattccattgggatcatgtacgatgaagcttaatgcaactacagaaatgatgcctgtgacatggcccgcatttgcagatatacatccttttgctcctaccgaacaggcacagggttatcaggaaatgttcaagaacttgggtgacttgttgtgtaccattactggatttgattctttctccttgcaaccaaatgctggtgctgctggagaatatgccgggctgatggttatccgagcataccatatggcaagaggtgatcatcacaggaatgtatgcattatccctgtgtctgcacatggaacaaatcctgctagtgctgctatgtgtggaatgaaaattattactgtgggaacagactccaaaggtaacataaatatagaagaattacgcaaggctgcagaggcaaacaaagagaatttatctgctcttatggttacctatccttcgactcatggagtttatgaagagggtattgatgaaatctgcaaaatcattcacgacaacggaggtcaagtttacatggatggagcaaacatgaatgcacaggttggtttgacaagcccagggtggattggtgctgatgtgtgtcatctaaacctgcacaagacattttgtattcctcatggcggaggtggtcccggaatgggtcccattggtgtgaagaaacacttggcaccatacttgccttcacaccctgtggtcccgactggtggcataccagcccccgaagaaagtcagccacttggtaccattgctgcagccccttggggttcggctcttatcttgcctatatcatacacatacattgccatgatgggatctcaaggaataaccaatgcatcaaagatagctatcctgaatgcaaattatatggcaaaacgtctagagaatcactatcctattcttttccgtggggtcaatggaacggttgcccatgaattcattgttgatttgagaccattgaagactactgctggaattgaaccagaagatgttgctaagcgtcttatagattatgggttccatggtccaacaatgtcatggcctgtcccaggaacactcatgattgaaccaactgaaagtgaaagcaaggcggagttggacaggttttgtgatgctttaatctccattagacaagaaatagcagagattgagaaaggaaatgttgatttcaacaacaatgtcatcaagggcgctcctcacccgccacaactactcatggctgataagtggaccaaaccgtactctagagaatatgcagcttaccctgctccctggcttcgtgctgctaaattctggcctactacatgccgtgtggacaatgtgtatggagaccgcaacctcatctgcactcttcagccaccacaggagtatgaggagaaagcagaagctactgcttaa

SEQ ID NO: 3001 - protein, 1034 aa, Flaveria anomala
MERARRLAMLGRLVSQTKHNPSISSPALCSPSRYVSSLSPYVCGGTNVRSDRNLNGFGSQVRTISVEALKPSDTFPRRHNSATPEEQTKMAEFVGFSNLDSLIDATVPKSIRLDSMKYSKFDEGLTESQMIAHMQDLASKNKIFKSFIGMGYYNTSVPTVILRNIMENPGWYTQYTPYQAEIAQGRLESLLNFQTMITDLTGLPMSNASLLDEGTAAAEAMAMCNNIQKGKKKTFIIASNCHPQTIDICKTRADGFDLKVVTSDLKDFDYSSGDVCGVLVQYPGTEGELLDYSEFIKNAHANGVKVVMASDLLALTILKPPGELGADIVVGSAQRFGVPMGYGGPHAAFLATSQEYKRMMPGRIIGVSVDSSGKPALRMAMQTREQHIRRDKATSNICTAQALLANMAAMYGVYHGPEGLKTIAKRVHGLAGTFAAGLKKLGTVQVQDLPFFDTVKVTCADSKAIAEEACKHKMNLRIVDKNTITVAFDETTTIEDVDTLFKVFALGKPVPFTAASIAPEVQDAIPSGLVRETPYLTHPIFNMYHTEHELLRYISKLQSKDLSLCHSMIPLGSCTMKLNATTEMMPVTWPAFADIHPFAPTEQAQGYQEMFKNLGDLLCTITGFDSFSLQPNAGAAGEYAGLMVIRAYHMARGDHHRNVCIIPVSAHGTNPASAAMCGMKIITVGTDSKGNINIEELRKAAEANKENLSALMVTYPSTHGVYEEGIDEICKIIHDNGGQVYMDGANMNAQVGLTSPGWIGADVCHLNLHKTFCIPHGGGGPGMGPIGVKKHLAPYLPSHPVVPTGGIPAPEESQPLGTIAAAPWGSALILPISYTYIAMMGSQGITNASKIAILNANYMAKRLENHYPILFRGVNGTVAHEFIVDLRPLKTTAGIEPEDVAKRLIDYGFHGPTMSWPVPGTLMIEPTESESKAELDRFCDALISIRQEIAEIEKGNVDFNNNVIKGAPHPPQLLMADKWTKPYSREYAAYPAPWLRAAKFWPTTCRVDNVYGDRNLICTLQPPQEYEEKAEATA

SEQ ID NO: 3002 - DNA, 3105 bp, Flaveria trinervia
  CDS (1)..(3105)
atggagcgtgcacgcaggctagctatgttggggcgccttgtgtcacaaaccaaacacaacccatcaatatcatcctctgctctgtgttcaccttcacggtatgtttcctctttatccccttatgtatgcagtggcacaaacgttagatcagatagaaaccttaatgggtttggttcacaagttagaaccatatcagttgaagctttgaaaccaagtgacactttcccacgtcgccataactcagccacccctgaagaacaaaccaaaatggccgaattcgtcggcttttcgaatcttgattcactcattgatgcaactgtgcccaaggcaatccgtcttgattcaatgaagtactctaagtttgatgagggcttgactgaatctcaaatgattgcacatatgcaagatttagcttctaagaacaagatctttaagtcctttattggtatgggatattacaacacatctgtgcctactgttatattaagaaacattatggagaaccctggttggtatactcagtacacaccataccaggctgaaattgcgcaggggcggctggagtccctgctcaatttccagaccatgattactgatctaacaggtttgccgatgtcgaatgcttcattgcttgatgaagggactgcagctgctgaagctatggctatgtgtaataatattcagaagggtaaaaagaagacctttattattgcaagtaactgtcacccacaaacaattgatatttgtaaaactcgtgccgatgggtttgacctgaaagtggtcacttctgatcttaaagactttgattactcatctggtgatgtttgtggagttttggttcagtatccagggactgagggtgagttgttggactacagtgagttcatcaagaatgctcatgcaaatggggtgaaagtggtcatggctagtgatttgttggctttgactattttgaagccacctggtgaacttggggctgatatcgtggtgggttcggctcagcggtttggggttccaatgggttatggtggtccgcatgcagcttttcttgcaacgtcccaagagtataagagaatgatgcctggaagaattattggcgttagtgttgattcttctggaaaaccagctttacgtatggcgatgcagacccgtgagcaacatatcaggagagataaagcaactagtaacatttgtacagctcaggcattgcttgcaaacatggctgctatgtacggtgtttaccatgggccagaaggcctaaagaccattgccaaacgggtccatggtctagctggcacatttgctgcaggtttgaagaagttagggacagtacaagtccaagatctccccttttttgacactgtgaaagtaacttgtgctgattcaaaggcaattgctgaagaagcctacaagcataaaatgaatcttcgcattgtcgacaagaacactatcactgttgcgttcgatgagacaacaacgattgaagatgttgatactttgttcaaagtttttgcattagggaaacctgtgacattcaccgctgcatctattgcaccagaggttcaggatgctatcccatctgggcttgtaagggagactccatatttgacacatcctattttcaacatgtatcatacggagcatgagctactaagatacattagtaaattgcaatcaaaggacctctcattatgccacagtatgattccattgggatcatgtacgatgaagctaaatgcaactacagaaatgatgcctgtgacatggcccgcatttgcagacatacatccttttgctcctaccgaacaggcacagggttatcaggaaatgttcaagaacttgggtgacttgttgtgtaccattactggatttgattctttctccttgcaaccaaatgctggtgctgctggagaatatgcagggctgatggttatccaagcataccatatggcaagaggtgatcatcacaggaaagtatgcattatccccgtgtctgcacatggaacaaatcctgctagtgctgctatgtgtggaatgaaaattattactgttggaacagactccaaaggtaacataaatatagaagaattacgcaaggctgcagaggcaaacaaagagaatttatctgctcttatggttacctatccttcaactcatggagtttatgaagagggtattgatgaaatctgcaaaatcattcacgacaatggaggtcaagtttacatggatggagcaaacatgaatgcacaggttggtttgacaagcccagggtggattggtgctgatgtgtgtcatctaaacctgcacaagacattttgcattcctcatggcggaggtggtcccggaatgggtcccattggtgtgaagaaacacttggcaccatacttgccttcacaccccgtggtcccgactggtggcataccagcccccgaacaaagtcagccacttggtaccattgctgcagccccttggggttcggctcttatcttgcctatatcatacacatacattgccatgatgggatcgcaaggaataaccaatgcatcaaagatagctatcctgaatgcaaattatatggcaaaacgtctagagaatcactatcctattcttttccgtggggtcaatggaacagttgcccatgaattcattgttgatttgagaccattgaagactactgctggaatcgaaccagaagatgttgctaagcgtctaatagattatgggttccatggtccaacaatgtcatggcctgttccaggaacactcatgattgaaccaactgaaagtgaaagcaaggcggagttggacaggttttgtgatgctttaatctccattagacaagaaatagcagagattgagaaaggaactgttgatttcaacaacaatgtcatcaagggcgctcctcacccgccacaactactcatggctgataagtggaccaaaccgtactctagagaatatgcagcttaccctgctccctggcttcgtgctgctaaattctggcctactacatgtcgtgtggacaatgtgtatggagaccgcaacctcatctgcactcttcaaccaccacaggagtatgaagagaaagcggaagctactgcttaa

SEQ ID NO: 3003 - protein, 1034 aa, Flaveria trinervia
MERARRLAMLGRLVSQTKHNPSISSSALCSPSRYVSSLSPYVCSGTNVRSDRNLNGFGSQVRTISVEALKPSDTFPRRHNSATPEEQTKMAEFVGFSNLDSLIDATVPKAIRLDSMKYSKFDEGLTESQMIAHMQDLASKNKIFKSFIGMGYYNTSVPTVILRNIMENPGWYTQYTPYQAEIAQGRLESLLNFQTMITDLTGLPMSNASLLDEGTAAAEAMAMCNNIQKGKKKTFIIASNCHPQTIDICKTRADGFDLKVVTSDLKDFDYSSGDVCGVLVQYPGTEGELLDYSEFIKNAHANGVKVVMASDLLALTILKPPGELGADIVVGSAQRFGVPMGYGGPHAAFLATSQEYKRMMPGRIIGVSVDSSGKPALRMAMQTREQHIRRDKATSNICTAQALLANMAAMYGVYHGPEGLKTIAKRVHGLAGTFAAGLKKLGTVQVQDLPFFDTVKVTCADSKAIAEEAYKHKMNLRIVDKNTITVAFDETTTIEDVDTLFKVFALGKPVTFTAASIAPEVQDAIPSGLVRETPYLTHPIFNMYHTEHELLRYISKLQSKDLSLCHSMIPLGSCTMKLNATTEMMPVTWPAFADIHPFAPTEQAQGYQEMFKNLGDLLCTITGFDSFSLQPNAGAAGEYAGLMVIQAYHMARGDHHRKVCIIPVSAHGTNPASAAMCGMKIITVGTDSKGNINIEELRKAAEANKENLSALMVTYPSTHGVYEEGIDEICKIIHDNGGQVYMDGANMNAQVGLTSPGWIGADVCHLNLHKTFCIPHGGGGPGMGPIGVKKHLAPYLPSHPVVPTGGIPAPEQSQPLGTIAAAPWGSALILPISYTYIAMMGSQGITNASKIAILNANYMAKRLENHYPILFRGVNGTVAHEFIVDLRPLKTTAGIEPEDVAKRLIDYGFHGPTMSWPVPGTLMIEPTESESKAELDRFCDALISIRQEIAEIEKGTVDFNNNVIKGAPHPPQLLMADKWTKPYSREYAAYPAPWLRAAKFWPTTCRVDNVYGDRNLICTLQPPQEYEEKAEATA

SEQ ID NO: 3004 - DNA, 2856 bp, Gluconobacter oxydans
  CDS (1)..(2856): transl_table=11
atgccagagaacctgcctgtgacgaccttgtggcctgcccagaccgaagatttcagctcccgccatatcggcccgcgcccttccgaaatcggagagatgctgcgtgtcgtaggggcttccagccttgatgacctgatcgacaagaccattccggccgccattctcgatcgcggggatcacgggattggtgctgccctgaccgaacaggatgcactggcgcgtttgcggcagatcgcctcgcgcaatcaggttctgacgtccatgatcgggcagggctattacgatacggtcctgccgccggtcatccagcggaatatcctggaaaatccggcctggtacacggcttacacgccgtatcagcccgagatcagccaaggacgtcttgaggcgctgctgaacttccagacgctggtggcggatctgacggggctcgacatcgccaatgcgtctctgctggacgagggcacggcctgtgcggaagccatggcgctggcgcagcgcgtgggcaagtcgaaggcgacggcgttctttgtggatgccgatacgcacccgcagacgatcgccgtgatccgcacgcgggccgagccgctgggctgggatgttgtcgtgggtgatccggaaacggatctggatgcatcctctgtgttcggggcgctgctgtcctatccgggatcttcggggcaggtacgggatccgcgcaaggtgattgcggcgctgcatgaaaagggtgcgattgcggctctggcctgtgatccgctggctctggtcctgctggaaagcccgggcgcgctgggcgcggatatcgcgatcggttcgatgcagcgttatggcgtgccgatgggggccggtggcccgcatgcggcattcatggcgacgcgcgatgcgttcaagcggcacatgccggggcgtctggtcggcgtgtcgcgcgacagtgcgggcaagccggcctatcggctggcgcttcagacgcgcgagcagcatatccgccgcgaaaaggcgacgtccaacatctgcacggcgcaggccttgctggcgattatcgcatccatgtatgcggtttatcacggtccggaagggctgaaggcgattgccgcacgcacgcatcggatggcggcaatcctgtccgccgggctgaagacgctgggtgcgacggtcgagacggatgtattcttcgacaccatcaccgttcaggctggcgcgtctgcgccgcaggttctggcgcgtgccgtggcgtctggcatcaatctgcgtgatgcaggggatggtcggatcggcatgtcctgtgacgagaccacgacgccggagacgatccgtgcagtctgggccgcgttcgcgggcgagggtgcggatctgtcggccatcgagcaggcgctggatgtggctgatgcgctgccggaaggcctgtcgcggacggcaccgctgctgacgcatccggtgttccatgcgcaccgctccgagacggatctgctgcgctatatgcgcgcgctggccgacaaggatctggcgctggatcggacgatgatcccgctgggctcctgcacgatgaagctcaatgcgacggcggagatgatccccatcacctggccggaattcgcgcggattcatcccttcgcgcctgcggatcaggttcaaggttataccgagctgttcgcctatctggagcgtacgctctgcgccatttcgggctatgacgccgtctcgcttcagccgaattccggcgcgcagggcgaatatgccgggcttctggccattcgtggctatcaccgcgcgcgtggggacgagaaccgggatgtgtgcctgattccggcctccgcacacgggaccaatccggcgtcggcccagatggccggaatgcgggttgtcgtcgtggcctgcgacgagaacggcaatgtcgatgtcgaggatctgaaggccaagatcgcgcagcatgacgggcgtgtggcggccatcatgattacgtatccgtccacgcatggcgtgttcgaggaacggatcgtcgagatctgcgaattggttcatgccgcgggcgggcaggtctatctggatggcgcgaacctcaatgcgcaggtcggactggcgcggccgggtctgtatggcgcggatgtctcgcatttcaacctgcacaagacgttctgcattccgcatggcggcggcgggccgggcatgggaccgatcggtgtgggcaagcacctcgcgccgtatctgccgggacggcatggcattgcggtgtctgcggcgccttttggatcggcgtccattctgccgatttctgccgcttacatcatgatgatgggcgatgaagggctgcgtcaggcgacgacgatggcgatcctgaatgcgaactacatcgcctcgcgtctggaagggcattatccggttctgtatcgcggcacgaacggctttacggcgcatgaatgcatcgtggatctgcggtcgctgaaggatgcagtcggtgtgacagtggacgatattgccaagcgtttgatcgatcacgggttccatgcgccaacggtcagcttcccggtggcggggacgttcatgatcgagccgacggaatccgaaggcaagggtgagctggaccgcttctgcgatgcgatgatcgccatccgtgcggaaattgccgaggtcgaagccgggcgcgtcgggatggaagacagcccgctgcgctttgcgccgcatacgacggcggatctggcgggggactgggagcgttcctacagccgtgaggccgggtgcttccccggtggtgtagatacggcgaaatactggtcgccggtcgggcgtctggacaatgcctggggggaccggaatcttgtctgttcctgcccggatatttcgacctacgtcgaaggctga

SEQ ID NO: 3005 - protein, 951 aa, Gluconobacter oxydans
MPENLPVTTLWPAQTEDFSSRHIGPRPSEIGEMLRVVGASSLDDLIDKTIPAAILDRGDHGIGAALTEQDALARLRQIASRNQVLTSMIGQGYYDTVLPPVIQRNILENPAWYTAYTPYQPEISQGRLEALLNFQTLVADLTGLDIANASLLDEGTACAEAMALAQRVGKSKATAFFVDADTHPQTIAVIRTRAEPLGWDVVVGDPETDLDASSVFGALLSYPGSSGQVRDPRKVIAALHEKGAIAALACDPLALVLLESPGALGADIAIGSMQRYGVPMGAGGPHAAFMATRDAFKRHMPGRLVGVSRDSAGKPAYRLALQTREQHIRREKATSNICTAQALLAIIASMYAVYHGPEGLKAIAARTHRMAAILSAGLKTLGATVETDVFFDTITVQAGASAPQVLARAVASGINLRDAGDGRIGMSCDETTTPETIRAVWAAFAGEGADLSAIEQALDVADALPEGLSRTAPLLTHPVFHAHRSETDLLRYMRALADKDLALDRTMIPLGSCTMKLNATAEMIPITWPEFARIHPFAPADQVQGYTELFAYLERTLCAISGYDAVSLQPNSGAQGEYAGLLAIRGYHRARGDENRDVCLIPASAHGTNPASAQMAGMRVVVVACDENGNVDVEDLKAKIAQHDGRVAAIMITYPSTHGVFEERIVEICELVHAAGGQVYLDGANLNAQVGLARPGLYGADVSHFNLHKTFCIPHGGGGPGMGPIGVGKHLAPYLPGRHGIAVSAAPFGSASILPISAAYIMMMGDEGLRQATTMAILNANYIASRLEGHYPVLYRGTNGFTAHECIVDLRSLKDAVGVTVDDIAKRLIDHGFHAPTVSFPVAGTFMIEPTESEGKGELDRFCDAMIAIRAEIAEVEAGRVGMEDSPLRFAPHTTADLAGDWERSYSREAGCFPGGVDTAKYWSPVGRLDNAWGDRNLVCSCPDISTYVEG

SEQ ID NO: 3006 - DNA, 2889 bp, Idiomarina loihiensis
  CDS (1)..(2889): transl_table=11
atgagcagtactaccctgacgcaattagagcaccacgatgaattcattagccgccatattggcccaagtgctgatgagcaaaaagccatgctggctgagctgggtgtagattctttagaagcattaaccaaagacactgtgcctggtgcgattctgcgtgaaccgttcctgcagacaggggagccgcaaactgaacgcgaagctctggctcgtcttaaaaacatcgcgaaaaagaaccaaatttgtacctcgtacattggtatgggctactacgacaccgtagtgccgaacgttattttgcgtaacgtgctggaaaacccgggttggtataccgcgtacacgccgtatcagccggaaattgctcagggccgtttagaagcactgcttaacttccagcaaatgaccatggacttaaccggcttagatttagccagcgcctcattgctggacgaagcgactgccgctgccgaagctatggccatggcgaagcgggtttctaaaaacaaaaaatccaacgcgtttttcattgctgacaacgtttacacgcaaaccatcgacgtggtgaaaacccgtgccgagtactttggtttcgacattattgtcggaccggcgcgtgaagcttccgatcatgacgtgtttggtgcgttattacagtacccggacaaacaaggccagctgcacaacattgaacagttaatcggcgagttgcaggagaagaaggccattgttgccgttgcttctgacttaatgagcctgttaatggtgaagtcaccgggcgaaatgggcgcggacatggtgttcggtaacgcgcaacgctttggtgtgccaatgggctatggtggtcctcacgccgcgttcttcgctacccgtgacaaatttaagcgctctttgcctggccgtattattggtgtttctaaagactcgcgcggacgccctgcattgcgtatggccatgcagacccgtgagcagcacatacgccgtgaaaaagcgaactcgaacatttgtaccgcgcaggttctgctggcgaacatggcgtcgttttacgctgtgtaccatggccctgacggcttgcgtcgtattgccaaccgcattcaccgtttaaccgacattgtcgccttaggcatgcaggacaaaggcgtgaagctggtgaacagccactggtttgacaccctaacctttgaaatgaaagaaaacgccgcagacgtattggcgcgcagcaaagcgctgggtcttaacctacgcgttgacggcgaaggcatgttcggtatcagcctggacgaagccaaaacgcgtgacgacgttgaaagcttatttgccgcgctgtttggcgacaaccacggtttagatatcgacgtattagacagccgtgttgccggtggtgacgtagaatctattccagctgacttagttcgtcagtctcagtatttacagcatccggtgtttaacgagtaccattcagaaaccgaaatgctgcgttatattaaaaagctggaaaacaaagacttagccctgaaccactcaatgatttctctgggctcgtgcaccatgaagcttaacgccaccgccgagatgattccggtgacatggcctgagtttggtcagttgcacccgttctgcccggcagagcaggcgcagggttattacgagttagtttccactttgtcggaatggttaattgacgtaaccggttacgacgctatgtctatgcaaccgaactctggtgcgcagggtgagtacgcaggcctgttggctattcagaagtatcatgaaagccgcggcgatgggcaccgcaacatttgccttattccaagctctgcccacggtaccaacccagcttcagctcagatgatgaacatgaaagtagtggtggttgactgtgacaagcacggcaacgtggatatggacgacttaaaagccaaagcagaagaagctggcgaaaacctgtcgtgcattatggtgacttacccttcaacgcacggcgtttacgaagaaggcattaaagacatttgtgacctggttcataactacggtggtcaggtttacatggacggcgccaacatgaacgcacaggttggcgtaacctcaccgggttacattggctcggacgtatcgcacctgaacctgcacaaaaccttctgtattccgcacggtggcggcggccctggcatgggtcctattggtgtgaagcagcacctggctgaattcctgccaaaccactccattgtgaatatagacgggcctaaagccggtaacggcgcggtatctgcagcgcagtttggtagtgccagcattctgaccatctcgtggatgtacattgccatgatgggcggccgcggcttacgtgaagcgtcagaaaccgctattttgaatgccaactacctggctgagaagctgagtaagcacttcaaaattctgtatcgtggtcgcaacaaccgtgtcgcgcacgaatgcattatcgacttgcgcccaatgaaagacgccgccggcattgctgaaattgatgtggctaagcgcctgcaggactacggcttccactcgccaaccatgagcttcccggtagcgggtactattatggttgagccgaccgagtctgagtctaaagctgagctggaccgctttattgaagctttggttagtattaaagccgaagccgagaaagtagccgccggtgaatggccaaaagacaacaacccgctggtaaatgcaccgcatacactggccgatattaccgacgcagaatgggaccgcccatacgacagaaaaacggcaacctacccggttgaagccgttggttacgacaagttctggccaacagtaaaccgtatagatgacgtattcggcgaccgtaacctgatgtgctcatgcccgagcattgaagagtatcggtag

SEQ ID NO: 3007 - protein, 962 aa, Idiomarina loihiensis
MSSTTLTQLEHHDEFISRHIGPSADEQKAMLAELGVDSLEALTKDTVPGAILREPFLQTGEPQTEREALARLKNIAKKNQICTSYIGMGYYDTVVPNVILRNVLENPGWYTAYTPYQPEIAQGRLEALLNFQQMTMDLTGLDLASASLLDEATAAAEAMAMAKRVSKNKKSNAFFIADNVYTQTIDVVKTRAEYFGFDIIVGPAREASDHDVFGALLQYPDKQGQLHNIEQLIGELQEKKAIVAVASDLMSLLMVKSPGEMGADMVFGNAQRFGVPMGYGGPHAAFFATRDKFKRSLPGRIIGVSKDSRGRPALRMAMQTREQHIRREKANSNICTAQVLLANMASFYAVYHGPDGLRRIANRIHRLTDIVALGMQDKGVKLVNSHWFDTLTFEMKENAADVLARSKALGLNLRVDGEGMFGISLDEAKTRDDVESLFAALFGDNHGLDIDVLDSRVAGGDVESIPADLVRQSQYLQHPVFNEYHSETEMLRYIKKLENKDLALNHSMISLGSCTMKLNATAEMIPVTWPEFGQLHPFCPAEQAQGYYELVSTLSEWLIDVTGYDAMSMQPNSGAQGEYAGLLAIQKYHESRGDGHRNICLIPSSAHGTNPASAQMMNMKVVVVDCDKHGNVDMDDLKAKAEEAGENLSCIMVTYPSTHGVYEEGIKDICDLVHNYGGQVYMDGANMNAQVGVTSPGYIGSDVSHLNLHKTFCIPHGGGGPGMGPIGVKQHLAEFLPNHSIVNIDGPKAGNGAVSAAQFGSASILTISWMYIAMMGGRGLREASETAILNANYLAEKLSKHFKILYRGRNNRVAHECIIDLRPMKDAAGIAEIDVAKRLQDYGFHSPTMSFPVAGTIMVEPTESESKAELDRFIEALVSIKAEAEKVAAGEWPKDNNPLVNAPHTLADITDAEWDRPYDRKTATYPVEAVGYDKFWPTVNRIDDVFGDRNLMCSCPSIEEYR

SEQ ID NO: 3008 - DNA, 2895 bp, Leptospira interrogans serogroup Icterohaemorrhagiae serovar
  CDS (1)..(2895): transl_table=11
atgaactcgactctacagaaccaaacaaaaaccaatcttgaaaaggtgggaacagatcctttggatacttttccaagaagacatatcggaccgaacttacaacaaaccgccgaaatgctgaaggaattgggactctcttctgtagaagagttgatagataaagccgttcctgtaggaattcgattaaaaaaatctttggatctgccaaaagcgtccactgaacataagattcttcagaacttaaaaggaattgcttctcaaaatcaggtttttcgctcttatattggtgcgggttatcattcctgtatcattccaggtgtaattcaaagaaacattttagaaaacccgggttggtacaccgcttacactccttatcaagccgaaatttctcaaggtcgtttagaagctttattgaatttccaaacgatgatcattgatctgactggccttgaaatttcgaacgcttctcttttggacgaagggaccgccgccgccgaagcgatgtttcttgcctactccgttcgtaaaaacgaaaccgctaaaaaattctttgtgtcggaactttgtcatccacaaactatagacgttgtcgttacaagagccaatcctttaggaattgaagttcaaatcggaaaccatgaatctatcgaacttaatgaggattttttcggtgttcttcttcaatatcccgcgacagacggaaaaataatcgattatacttcttttattcaaagatcacataacgtaggtgcaatttccacggtagctgcagatcttttagctcttacacttcttaaatctccaggagaaatgggagctgatattgctgtaggttcttctcaaaggttcggacttcctcttggatttggaggtccacacgctggctactttgccaccaaggacgaatttaaacgcagtatgccaggaagattgatcggagtttctaaagattctcagggaaattccggccttagactttctcttcaaactagagaacagcacattcgaagagataaagcgactagtaatatttgtaccgctcaggttttacttgccgtcatctcatctatgtatgcagtttatcacggaccagaaggacttaaaaatatcgcgactcggatttataaattcacttccatttttgcaaatgtgttgaaaaacgccggtttttcgattacgaacgagtttttctttgacacgattacgatccaggccggaaccaaagtccaggaaattttaaacagagcctattctaaaaaaatcaattttagagaatacaaagatggaaaaattggaattacattagacgaaacagtaaacctggaagatttaaaagatttattagaaatttttgaaatcaaaaatacagacattgaaaaacttttcgtggatgtatcaaacgttcctgattcttttaaaagaaaaacttcttatcttacacatcctgtatttcaatcccatcataccgaaacaaaaatgcttcgttatattcgtaaattagaatccagagatctttcacttactacttctatgattcctctcggttcttgtacaatgaaactcaatgcgaccacggaaatgtatcccgtcacttggccggagtttggtgcgattcacccatttgctcccgcagatcaaacgaaaggttataaaatcatttttgaacaattggaaaaatggctctgcgaaatcaccggatttgcaggagtttccttacaaccaaacgccggttcccaaggggaatatgctgggcttttagcaattcgcagataccatgaaagtagaaacgaatcttacagaaacgtttgtctgattcctatctctgcccacggaaccaatccagcaagcgccgcaatggctggctttcaagttgtggtagtttcttgtgacccaaacggaaacgtggatttagaagatttaaaagcaaaagctgaagaacataaaaaggatcttgcagctttaatgattacgtatccttctactcatggagtatttgaagaatccgttaaagagatttgtcaaattgttcattcttgcggcggccaagtctatatggacggagccaacatgaacgctcaagtcggtttaacaagtccgggtgaaattggtgcagacgtttgtcatctcaatctacataagactttttgcatacctcacggtggaggtggtccgggagttggtccaatcggagtcgccaaacatctcgttccatttttaccggggcacgtgttagtggacaacgcaaccggtaatgaacacggcgcggtatcggcggctccttggggaagtgcgagtatcgttttaatttcttgggtttacattgcactcatgggatcggaaggtcttacaaacgcgacccgcaattctattttaaacgcgaattatatcgctaaacgtttagaaaaagtgtatcctgttctttataaaggaaagaatggttttgttgctcacgaatgtattttagatctaagaccgtttaaaaaatccgcagggatcgaagtagaagatgttgccaaaagattaatcgactatggctttcacgctcctacaatgtctttcccagttcctggaactttgatgattgaaccaaccgaatccgaatccttagaagagctagatcgtttttgcgaagcaatgcttttgatttatcaagaaatcttggacgttcaaagtggaacattagataaaactgataatcctttaaaaaattctcctcatactgctgctatggtgacttcggatcgttgggatcatttatatccgagagaacgcgcagcttatcccgcttcttggctaaaagatcataaattttggccttatgtgggaagagtggataacgtatatggagatcgaaatttagtttgttcttgtcttccaatagaaagttatcagtga

SEQ ID NO: 3009 - protein, 964 aa, Leptospira interrogans serogroup Icterohaemorrhagiae serovar
MNSTLQNQTKTNLEKVGTDPLDTFPRRHIGPNLQQTAEMLKELGLSSVEELIDKAVPVGIRLKKSLDLPKASTEHKILQNLKGIASQNQVFRSYIGAGYHSCIIPGVIQRNILENPGWYTAYTPYQAEISQGRLEALLNFQTMIIDLTGLEISNASLLDEGTAAAEAMFLAYSVRKNETAKKFFVSELCHPQTIDVVVTRANPLGIEVQIGNHESIELNEDFFGVLLQYPATDGKIIDYTSFIQRSHNVGAISTVAADLLALTLLKSPGEMGADIAVGSSQRFGLPLGFGGPHAGYFATKDEFKRSMPGRLIGVSKDSQGNSGLRLSLQTREQHIRRDKATSNICTAQVLLAVISSMYAVYHGPEGLKNIATRIYKFTSIFANVLKNAGFSITNEFFFDTITIQAGTKVQEILNRAYSKKINFREYKDGKIGITLDETVNLEDLKDLLEIFEIKNTDIEKLFVDVSNVPDSFKRKTSYLTHPVFQSHHTETKMLRYIRKLESRDLSLTTSMIPLGSCTMKLNATTEMYPVTWPEFGAIHPFAPADQTKGYKIIFEQLEKWLCEITGFAGVSLQPNAGSQGEYAGLLAIRRYHESRNESYRNVCLIPISAHGTNPASAAMAGFQVVVVSCDPNGNVDLEDLKAKAEEHKKDLAALMITYPSTHGVFEESVKEICQIVHSCGGQVYMDGANMNAQVGLTSPGEIGADVCHLNLHKTFCIPHGGGGPGVGPIGVAKHLVPFLPGHVLVDNATGNEHGAVSAAPWGSASIVLISWVYIALMGSEGLTNATRNSILNANYIAKRLEKVYPVLYKGKNGFVAHECILDLRPFKKSAGIEVEDVAKRLIDYGFHAPTMSFPVPGTLMIEPTESESLEELDRFCEAMLLIYQEILDVQSGTLDKTDNPLKNSPHTAAMVTSDRWDHLYPRERAAYPASWLKDHKFWPYVGRVDNVYGDRNLVCSCLPIESYQ

SEQ ID NO: 3010 - DNA, 2895 bp, Leptospira interrogans
  CDS (1)..(2895): transl_table=11
atgaactcgactctacagaaccaaacaaaaaccaatcttgaaaaggtgggaacagatcctttggatacttttccaagaagacatatcggaccgaacttacaacaaaccgccgaaatgctgaaggaattgggactctcttctgtagaagagttgatagataaagccgttcctgtaggaattcgattaaaaaaatctttggatctgccaaaagcgtccactgaacataagattcttcagaacttaaaaggaatcgcttctcaaaatcaggtttttcgctcttatattggtgcgggttatcattcctgtatcattccaggtgtaattcaaagaaacattttagaaaacccgggttggtacaccgcttacactccttatcaagccgaaatttctcaaggtcgtttagaagctttattgaatttccaaacgatgatcattgatctgactggccttgaaatttcgaacgcttctcttttggacgaaggaaccgccgccgccgaagcaatgtttcttgcctactccgttcgtaaaaacgaaaccgctaaaaaatttttcgtgtcggaactttgtcatccacaaactatagacgttgtcgttacaagagccaatcctttaggaattgaagttcaaatcggaaaccatgaatctatcgaacttaatgaggatttttttggtgttcttcttcaatatcccgcgacagacggaaaagtaatcgattatacttcttttattcaaagatcacataacgtaggtgcaatttccacggtggctgcagatcttttagctcttacacttcttaaatctccaggagaaatgggagctgatattgctgtaggttcttctcaaaggttcggacttcctcttggatttggaggtccacacgctggctactttgccaccaaggacgaatttaaacgcagtatgccaggaagattgatcggagtttctaaagattctcagggaaattccggccttagactttctcttcaaactagagaacagcacattcgaagagataaagcgactagtaatatttgtaccgctcaagttttacttgccgtcatctcatctatgtatgcaatttatcacggaccagaaggacttaaaaatatcgcgactcggatttataaattcacttccatttttgcaaatgtgttgaaaaacgccggtttttcgattacgaacgagtttttctttgacacgattacgatccaggccggagccaaagtccaggaaattttaaacagagcctattctaaaaaaatcaattttagagaatacaaagatggaaaaattggaattacgttagacgaaacagtaaacctggaagatttaaaagatttattagaaatttttgaaatcaaaaatacagacattgaaaaacttttcgtggatgtatcaaacgttcctgattcttttaaaagaaaaacttcttatcttacacatcctgtatttcaatcccatcataccgaaacaaaaatgcttcgttatattcgtaaattagaatccagagatctttcacttactacttctatgattcctctcggttcttgtacaatgaaactcaatgcgaccacggaaatgtatcctgtcacttggccggagtttggtgcgattcacccatttgctcccgcagatcaaacgaaaggttataaaatcatttttgaacaattggaaaaatggctctgcgaaatcaccggatttgcaggagtttccttacaaccaaacgccggttcccaaggggaatatgctgggcttttagcaattcgcagataccatgaaagtagaaacgaatcttacagaaacgtttgtctgattcctatctctgcccacggaaccaatccagcaagcgccgcaatggctggctttcaagttgtggtagtttcttgtgacccaaacggaaacgtggatttagaagatttaaaagcaaaagctgaagaacataaaaaggatcttgcggctttaatgattacgtatccttctactcatggagtatttgaagaatccgttaaagagatttgtcaaattgttcattcttgcggcggccaagtctatatggacggagccaacatgaacgctcaagtcggtttaacaagtccgggtgaaattggtgcagacgtttgtcatctcaatctacataagactttttgcatacctcacggtggaggtggtccgggagttggtccaatcggagtcgccaaacatctcgtcccatttttaccggggcacgtgttagtgaacaacgcaaccggtaatgaacacggcgcggtatcggcggctccttggggaagtgcgagtatcgttttaatttcttgggtttacattgcactcatgggatcggaaggtcttacaaacgcgacccgcaattctattttaaacgcgaattatatcgctaaacgtttagaaaaagtgtatcctgttctttataaaggaaagaatggttttgttgctcacgaatgtattttagatctaagaccgtttaaaaaatccgcagggatcgaagtagaagatgttgccaaaagattaatcgactatggctttcacgctcctacaatgtctttcccagttcctggaactttgatgattgaaccaaccgaatccgaatccttagaagagctagatcgtttttgcgaagcaatgcttttgatttatcaagaaatcttggacgttcaaaatggaacattagataaaactgataatcctttaaaaaattctcctcatactgctgctatggtgacttcggatcgttgggatcatttgtatccaagagaacgtgcagcttatcccgcttcttggctgaaagatcataaattttggccttatgtgggaagagtggataacgtatatggagatcgaaatttagtttgttcttgtcttccaatagaaagttatcagtga

SEQ ID NO: 3011 - protein, 964 aa, Leptospira interrogans
MNSTLQNQTKTNLEKVGTDPLDTFPRRHIGPNLQQTAEMLKELGLSSVEELIDKAVPVGIRLKKSLDLPKASTEHKILQNLKGIASQNQVFRSYIGAGYHSCIIPGVIQRNILENPGWYTAYTPYQAEISQGRLEALLNFQTMIIDLTGLEISNASLLDEGTAAAEAMFLAYSVRKNETAKKFFVSELCHPQTIDVVVTRANPLGIEVQIGNHESIELNEDFFGVLLQYPATDGKVIDYTSFIQRSHNVGAISTVAADLLALTLLKSPGEMGADIAVGSSQRFGLPLGFGGPHAGYFATKDEFKRSMPGRLIGVSKDSQGNSGLRLSLQTREQHIRRDKATSNICTAQVLLAVISSMYAIYHGPEGLKNIATRIYKFTSIFANVLKNAGFSITNEFFFDTITIQAGAKVQEILNRAYSKKINFREYKDGKIGITLDETVNLEDLKDLLEIFEIKNTDIEKLFVDVSNVPDSFKRKTSYLTHPVFQSHHTETKMLRYIRKLESRDLSLTTSMIPLGSCTMKLNATTEMYPVTWPEFGAIHPFAPADQTKGYKIIFEQLEKWLCEITGFAGVSLQPNAGSQGEYAGLLAIRRYHESRNESYRNVCLIPISAHGTNPASAAMAGFQVVVVSCDPNGNVDLEDLKAKAEEHKKDLAALMITYPSTHGVFEESVKEICQIVHSCGGQVYMDGANMNAQVGLTSPGEIGADVCHLNLHKTFCIPHGGGGPGVGPIGVAKHLVPFLPGHVLVNNATGNEHGAVSAAPWGSASIVLISWVYIALMGSEGLTNATRNSILNANYIAKRLEKVYPVLYKGKNGFVAHECILDLRPFKKSAGIEVEDVAKRLIDYGFHAPTMSFPVPGTLMIEPTESESLEELDRFCEAMLLIYQEILDVQNGTLDKTDNPLKNSPHTAAMVTSDRWDHLYPRERAAYPASWLKDHKFWPYVGRVDNVYGDRNLVCSCLPIESYQ

SEQ ID NO: 3012 - DNA, 2826 bp, Mycobacterium bovis
  CDS (1)..(2826): transl_table=11
gtgtccgaccattcgacgttcgcagaccggcacatcggtctggacagccaggccgtcgcgaccatgctcgccgtgatcggggtggattcgctcgatgacctggcagtcaaggcggtcccggcgggcatcctagacacactcaccgacaccggagccgcaccgggtttggacagtctgccaccggctgccagcgaagccgaggcgctggccgagctgcgagcgctggccgacgctaacaccgtcgccgtgtcgatgatcgggcaaggctactacgacacacacacccccccggtgctgttgcgcaacatcatcgagaacccggcctggtataccgcctacacgccgtaccagcccgagattagtcagggtcggctggaagccttgctgaacttccagaccctggtcaccgatctgaccggcctcgagatcgcgaacgcgtcgatgctcgacgagggcaccgcggcggccgaggccatgactttgatgcaccgcgcggcccgcgggccggtgaagagggtggtcgtggacgccgacgtgttcacccagaccgcggcggtgctggccacccgcgccaagccgctgggtatcgagatcgtcacggccgacctgcgcgccggtctgcccgacggcgaatttttcggcgccatcgcccagctgcccggggccagcggccggatcaccgactggtctgccctggtgcaacaggcccacgaccgtggcgcactggtggccgtcggcgccgacttgttggcgctgacgctgatcgcgccgcccggagagatcggcgctgacgtcgcctttggcaccacacaacggttcggagtgccgatggggtttggcggcccgcatgccgggtaccttgcggtgcacgccaagcatgcgcgtcagctgcccggccggctggtcggtgtgtccgtcgacagtgacggcacgccggcctatcggttggcgctgcagactcgcgagcaacacatccgccgcgacaaggccaccagcaacatctgcaccgcacaagtgctgttggcggtgcttgccgcgatgtacgcgagctaccacggcgcgggcgggctgaccgccatcgcacgccgggtgcatgcccacgccgaggctatcgccggtgcactgggcgatgcgttggtgcacgacaagtacttcgacacggtgttggcccgggtgcccggtcgtgccgacgaggtgctggccagggccaaggccaacggcatcaacctgtggcgtgtcgacgccgaccatgtgtcggtagcctgcgacgaagccaccactgacacccacgtggcggtcgttctggacgcgttcggtgtagcggccgccgcacccgcccatgcggacatcgcaacgcgcacatcggagttcctgacgcatccagcgttcacgcaataccgcaccgagacgtcgatgatgcggtacttgcgtgcgctggcggataaggatattgccctcgaccgcagcatgattccgctcggctcgtgcacgatgaaactcaacgccgccgccgagatggagtcgattacctggcctgaattcgggcgtcagcatccatttgccccggcatctgataccgctgggctgcgtcaacttgttgccgacctacagagttggctggtgctgatcaccggttatgacgcggtgtcgctgcaacctaacgcgggctcgcaaggcgagtatgcgggcctattggcgatccacgagtaccacgccagccggggtgaaccgcatcgcgacatctgcctgatcccgtccagcgcgcacggcaccaatgccgcgtcagccgccttggccggcatgcgcgtggtggtggtggactgccacgacaacggcgacgtcgacctcgatgacctgcgcgctaaggtcggggagcatgccgagcggttgtcggcgctaatgatcacctacccgtccactcacggcgtgtacgaacacgacatcgccgagatctgcgctgccgtgcacgacgcgggcggccaggtatacgtcgacggagccaacctcaacgccctggtcggcctggcccggccgggcaagttcggcggtgacgtcagtcacctcaacctacacaagacattctgcattccgcacggcggcggtggcccaggcgtcggcccggtggcggtgcgggcgcacctggcaccgtttctgccaggtcaccccttcgcccccgagctgcccaagggctatccggtgtcgtcggcaccatatgggtcggcttcgattcttccgatcacctgggcatacatccggatgatgggggctgagggactgcgggcggcatcgctgacagcgatcacgtcggctaactacattgcgcgccgccttgacgagtattacccggtgctgtacaccggcgagaacggcatggtcgcccacgagtgcatcctggacttgcgcggtatcactaagttgaccggtatcaccgtcgacgatgttgcaaaacggctggcagactatggttttcacgcaccaacgatgagttttccggtggccggtacgctcatggtggagcccaccgagagcgagagcctggccgaagtggacgccttctgcgaggccatgatcggcatccgcgccgagatcgacaaagtcggggccggggagtggcctgtcgacgacaatccgctgcgcggcgcaccgcacaccgcgcagtgcctgctggcgtctgattgggaccacccgtatacgcgggaacaggccgcctacccgctcggcaccgcattccgacccaaggtttggcccgcggtacgtcgcatcgacggcgcctacggggatcgcaacctggtctgctcatgcccgccggtagaggcttttgcctaa

SEQ ID NO: 3013 - protein, 941 aa, Mycobacterium bovis
MSDHSTFADRHIGLDSQAVATMLAVIGVDSLDDLAVKAVPAGILDTLTDTGAAPGLDSLPPAASEAEALAELRALADANTVAVSMIGQGYYDTHTPPVLLRNIIENPAWYTAYTPYQPEISQGRLEALLNFQTLVTDLTGLEIANASMLDEGTAAAEAMTLMHRAARGPVKRVVVDADVFTQTAAVLATRAKPLGIEIVTADLRAGLPDGEFFGAIAQLPGASGRITDWSALVQQAHDRGALVAVGADLLALTLIAPPGEIGADVAFGTTQRFGVPMGFGGPHAGYLAVHAKHARQLPGRLVGVSVDSDGTPAYRLALQTREQHIRRDKATSNICTAQVLLAVLAAMYASYHGAGGLTAIARRVHAHAEAIAGALGDALVHDKYFDTVLARVPGRADEVLARAKANGINLWRVDADHVSVACDEATTDTHVAVVLDAFGVAAAAPAHADIATRTSEFLTHPAFTQYRTETSMMRYLRALADKDIALDRSMIPLGSCTMKLNAAAEMESITWPEFGRQHPFAPASDTAGLRQLVADLQSWLVLITGYDAVSLQPNAGSQGEYAGLLAIHEYHASRGEPHRDICLIPSSAHGTNAASAALAGMRVVVVDCHDNGDVDLDDLRAKVGEHAERLSALMITYPSTHGVYEHDIAEICAAVHDAGGQVYVDGANLNALVGLARPGKFGGDVSHLNLHKTFCIPHGGGGPGVGPVAVRAHLAPFLPGHPFAPELPKGYPVSSAPYGSASILPITWAYIRMMGAEGLRAASLTAITSANYIARRLDEYYPVLYTGENGMVAHECILDLRGITKLTGITVDDVAKRLADYGFHAPTMSFPVAGTLMVEPTESESLAEVDAFCEAMIGIRAEIDKVGAGEWPVDDNPLRGAPHTAQCLLASDWDHPYTREQAAYPLGTAFRPKVWPAVRRIDGAYGDRNLVCSCPPVEAFA

SEQ ID NO: 3014 - DNA, 2859 bp, Mycobacterium leprae
  CDS (1)..(2859): transl_table=11
gtgtcggtaccgaactcatcgaacaagcagacctgctttacagcccggcatattggccctaacagcgaggacgttgcgaccatgcttgcagtcatcggcgtcgaatcgctagacgatctggcagctaaggcagttcctagcgacattctcgataatgtcaccgacaccggcgttgcaccgggcctggaccggttgccgccgccggctaccgagtccgagacgctagccgagctaggtgcgcttgctcgtgctaataccgttgccgtatcgatgatcgggcagggctactacgacaccctcacgccagcggtgctgtcgcgcaacatcttggagaacccggcctggtatactccctatacgccgtaccagcccgaaatcagtcagggtcggctggaagcgttgctgaatttccagactctggtcagcgatcttactggcttggagatcgcaaacgcatcgatgctcgacgagggcacagcagcagccgaggccatgacattgatgtaccgtgctgcccgcagtacggcgagccgggtggtcgttgacgtcgacgtgtttgcccagactgtcgcagtgttcgccactcgggccaaaccgttaggcatcgacatcgttgtggccgacctacgcgaaggactaccggacggtgagttctttggcgtcatcacccaacttcccggagccagcggccggattaccgactggaccgctttaatcgcccaggcccacagccgcggcgcattggtcgctgtcggtgccgatctgttagcgctgacgttgattacgccaccgggcgagatcggcgccgacgtcgcattcggtactactcagaggttcggcgtgccaatgggatttggtggcccgcatgctggatacctcgccctgcacactaagcatgcccgtcagctgccgggtcggttggtaggtgtttctgtcgacagcgacggcacaccggcctaccggttggcgctgcagacccgcgagcaacatatccgccgagacaaggcgacaagcaacatctgcaccgcacaggtgctgttggcggtgatggctgcgatgtacgccagttaccatggtgccgagggattgaccggtatcgcgcggcgggtgcatgcacaggcacgcgccctggcggccggtctgtccgcagccggtgttgaggtggtacaccaggcgttcttcgacaccgtgctggcccgggtacccggccggacggtgcaaattcagggcgctgcgaaggagcgcggtatcaatgtctggctcgtggacggcgaccatgtttcggtggcctgtgacgaggccaccaccgatgagcacatcacggccgtgttggcggcgttcgcagcgacgccggcgcgggcgagcttcgccggtccggatatcgcgacccgaacctcggcgttcctgacgcatccgacatttaccaagtaccgcaccgaaacttcaatgatgcggtacttgcgtgccttggcggataaggatatcgctctggaccgcagcatgattccgctcggttcgtgcacgatgaagctcaacgccgccgccgagatggagtcgattacctggcaggaattcacgcgccagcatccattcgcaccagtatcagacacccccgggctgcgtcgtctcattagcgacttggagagctggctggtgcagattaccggctacgatgcggtttccttgcagcccaacgcgggctctcagggggagtacgctggtctgttggcgattcacgactaccacgtcagccgaggggaaccgcaccgcaacgtctgtttgattccgtcaagcgcgcatggcaccaacgccgcatcggcggcgttggtcggtatgcgcgtggtcgtggtgggttgccacgataacggtgacgttgatcttgacgatctacgtatcaagctcagcgagcatgccaaccggctgtccgtgttaatgatcacctatccgtccacacacggcgtctatgagcatgacattgccgagatctgcgcggcggtgcatgacgccggtggtcaagtttatgtcgatggggccaacctcaacgcgctggtcggcctggcccggccgggcaagtttggtggcgacgtcagccacctgaacctgcacaaaacgttttgcatcccgcacggtggcggaggaccaggagtcgggccggtggcggttcgttcgcatttggtctcgtttctgccgggtcacccctttgctcccgaactgccgcaaggtcagccggtgtcgtcggcgccgtatgggtccgcctcactcctgccgatcacgtgggcctatatcaggatgatgggcgccgacggtctgcgaacggcatcgctgaccgcaatcgcctcggccaactacatagcccgtcggctcgacaaatacttcccggtgctgtacaccggcgagaacggaatggtcgcccacgagtgcatcctggacttgcgaccgatcaccaagtcggttggtgtgactgtcgacgatgttgctaaacgcttggcggattatggttttcacgcgcccacgatgagcttcccggtgcccggaacgctgatggtggaacccaccgagagtgagagcctggccgaaattgatgcattttgcgaggccatgatcgccatccgtggcgagatcgcccgcgtcggtgcaggggagtggtctgttgaggacaacccactacgcggcgcaccgcacaccgctgagtgcctgctggcctccgactgggatcatccgtatacccgagaagaggccgcttatccgcttggcaaagcgttccggccgaaggtgtggccgccggtgcgtcgtatcgacggtgtctacggcgaccgcaatttggtgtgctcgtgcctgccggtggaggcgttcgtctga

SEQ ID NO: 3015 - protein, 952 aa, Mycobacterium leprae
MSVPNSSNKQTCFTARHIGPNSEDVATMLAVIGVESLDDLAAKAVPSDILDNVTDTGVAPGLDRLPPPATESETLAELGALARANTVAVSMIGQGYYDTLTPAVLSRNILENPAWYTPYTPYQPEISQGRLEALLNFQTLVSDLTGLEIANASMLDEGTAAAEAMTLMYRAARSTASRVVVDVDVFAQTVAVFATRAKPLGIDIVVADLREGLPDGEFFGVITQLPGASGRITDWTALIAQAHSRGALVAVGADLLALTLITPPGEIGADVAFGTTQRFGVPMGFGGPHAGYLALHTKHARQLPGRLVGVSVDSDGTPAYRLALQTREQHIRRDKATSNICTAQVLLAVMAAMYASYHGAEGLTGIARRVHAQARALAAGLSAAGVEVVHQAFFDTVLARVPGRTVQIQGAAKERGINVWLVDGDHVSVACDEATTDEHITAVLAAFAATPARASFAGPDIATRTSAFLTHPTFTKYRTETSMMRYLRALADKDIALDRSMIPLGSCTMKLNAAAEMESITWQEFTRQHPFAPVSDTPGLRRLISDLESWLVQITGYDAVSLQPNAGSQGEYAGLLAIHDYHVSRGEPHRNVCLIPSSAHGTNAASAALVGMRVVVVGCHDNGDVDLDDLRIKLSEHANRLSVLMITYPSTHGVYEHDIAEICAAVHDAGGQVYVDGANLNALVGLARPGKFGGDVSHLNLHKTFCIPHGGGGPGVGPVAVRSHLVSFLPGHPFAPELPQGQPVSSAPYGSASLLPITWAYIRMMGADGLRTASLTAIASANYIARRLDKYFPVLYTGENGMVAHECILDLRPITKSVGVTVDDVAKRLADYGFHAPTMSFPVPGTLMVEPTESESLAEIDAFCEAMIAIRGEIARVGAGEWSVEDNPLRGAPHTAECLLASDWDHPYTREEAAYPLGKAFRPKVWPPVRRIDGVYGDRNLVCSCLPVEAFV

SEQ ID NO: 3016 - DNA, 2826 bp, Mycobacterium paratuberculosis
  CDS (1)..(2826): transl_table=11
gtgcccgaccacaccactttcgccgcccggcacatcggcccggaccctcaggccgtcgcggccatgctcgacgtcatcggtgtcggctcgttggacgagctggccgccaaggccgttccggccggcatccgcgaccggctctcggccgacgggatcgcgccgggcctggaccggctgccgccgccggccagcgaaaccgaggcgctggccgagctgcgcggcctggccgaggccaacaccgtcgccgtgtccatgatcgggcagggctactacgacacgctgaccccgccggtgttgctgcgcaacatcctggagaaccccgcctggtacaccgcctacacgccgtatcagccggagatcagccagggccggctggaggcgctgctgaacttccagaccatggtggccgatttgaccggcctcgagatcgccaacgcctcgatgctcgacgagggcaccgcggctgccgaggcgatgacgctgatgcgccgcgcatctcgcggcaagtccaaccggctggcggtggacgccgacgtgttcgcccagaccgcggccatcgtggccacccgggcccggccgctgggcatcgagatcgtcaccgccgacctgcgcgacgggctgcccgacggcgacttcttcggcgtcatcgcccagctgcccggcgccagcggcgcgatcaccgattgggccgccctggtggcgcaggcgcacgagcgcggcgcgctggtggcgctcggcgccgacttgctggccttgaccctgatcaccccgcccggcgagatcggcgccgacgtggccttcggcaccacccaaagattcggtgtgccaatgggattcggcggcccgcacgcgggatacctggcggtgcacgccaaccacgcccggcagctgccgggccggctggtcggtgtctcgctggacgccgacggttcgccggcctaccggttggcgctgcagacccgcgagcagcacatccgccgcgacaaggcgaccagcaacatctgcaccgcgcaggtgctgctggcggtgatggccgccatgtacgccagctaccacggcgctgaggggctgaccgcgatcgcacgccgcgtgcacgggcacgccgaggcgatcgcggccgcgctgggcaccgcggtggtgcacgacaggtacttcgacaccgtgctggcgcgggtgccgggccgggccgacgaggtgatcgccgcggccaaggccaggggcatcaacctgtggcgggtcgacgacgaccacgtctcggtggcctgcgacgaggccaccaccgacgaacacgtcgccgcggtgctcgaggcgttcggcgtcgcacccgccgagcccgtcgccagcgaaatcgctacccgcactgcggaattccttacccatcccgccttcacccagtaccgcaccgagacggcgatgatgcgctacctgcgcaccctggccgacaaggatattgcgttggaccgcagcatgattccactcggctcgtgcaccatgaaactcaacgccgccgccgagatggagccgatcacctggccggagttcgcacgtcagcaccccttcgccccggcgtccgacacgccggggctgcgccggctcatcggcgacctggagaactggctggtggccatcaccggctacgacgccgtctcgctgcaacccaacgccgggtcgcagggcgagtacgccggcctgctggccatccacgactaccacgccagccgcggggaaccgcaccgcgacatctgcctcatcccgtccagcgcgcacggcacgaatgccgcgtcggcggccctggccgggatgcgggtggtggtcgtgggctgccacgacaacggcgacgtcgacctcgacgacctgcgcgcgaaggtcaccgaacaccgcgaccggctgtcgacgctgatgatcacctacccgtccacgcacggcgtctacgagcacgacatcgccgagatctgcgcggccgtccacgacgcgggcggccaggtgtacgtcgacggcgccaacctcaacgcgctggtcgggttggcccggccgggcaagttcggcggcgacgtcagccacctgaacctgcacaagacgttctgcatcccgcacggcggcggcgggccgggggtggggccggtggcggtgcgctcgcacctggcgccgttcttgcccgggcatccgcacgccccggagctgccgcaggggcatccggtgtcctcggcgccctacggctcggcgtcgatcctgccgatcagctgggcctacatcaggatgatgggcgccgacggcctgcgcgcggcgtcgctgaccgcgatcacctcggccaactacatcgcccggcggctcgacgaatactttccggtgctctacaccggcgagaacggcatggtggcccacgagtgcatcctggacctgcgtcccatcaccaaggccaccggcgtgaccgtcgacgatgtcgcaaaacggttggcggactacggttttcacgctcccaccatgagcttcccggtggccggcacgctgatggtggagcccaccgagagcgaaaccctcaccgaggtggacgccttctgcgacgccatgatcgccatccgcggcgagatcgaccgggtgggtgcgggggagtggccggtggaggacaatccgctgcgcggcgccccgcacaccgcggagtgcctggtgaccaccgactgggaccacccgtacagccgcgaacaggcggcctatccgctgggcaaggacttccgacccaaggtgtggccgccggtgcggcgcatcgacggcgcctacggcgaccgcaacctggtgtgctcgtgcccgccggtcgaggcgttcgcctga

SEQ ID NO: 3017 - protein, 941 aa, Mycobacterium paratuberculosis
MPDHTTFAARHIGPDPQAVAAMLDVIGVGSLDELAAKAVPAGIRDRLSADGIAPGLDRLPPPASETEALAELRGLAEANTVAVSMIGQGYYDTLTPPVLLRNILENPAWYTAYTPYQPEISQGRLEALLNFQTMVADLTGLEIANASMLDEGTAAAEAMTLMRRASRGKSNRLAVDADVFAQTAAIVATRARPLGIEIVTADLRDGLPDGDFFGVIAQLPGASGAITDWAALVAQAHERGALVALGADLLALTLITPPGEIGADVAFGTTQRFGVPMGFGGPHAGYLAVHANHARQLPGRLVGVSLDADGSPAYRLALQTREQHIRRDKATSNICTAQVLLAVMAAMYASYHGAEGLTAIARRVHGHAEAIAAALGTAVVHDRYFDTVLARVPGRADEVIAAAKARGINLWRVDDDHVSVACDEATTDEHVAAVLEAFGVAPAEPVASEIATRTAEFLTHPAFTQYRTETAMMRYLRTLADKDIALDRSMIPLGSCTMKLNAAAEMEPITWPEFARQHPFAPASDTPGLRRLIGDLENWLVAITGYDAVSLQPNAGSQGEYAGLLAIHDYHASRGEPHRDICLIPSSAHGTNAASAALAGMRVVVVGCHDNGDVDLDDLRAKVTEHRDRLSTLMITYPSTHGVYEHDIAEICAAVHDAGGQVYVDGANLNALVGLARPGKFGGDVSHLNLHKTFCIPHGGGGPGVGPVAVRSHLAPFLPGHPHAPELPQGHPVSSAPYGSASILPISWAYIRMMGADGLRAASLTAITSANYIARRLDEYFPVLYTGENGMVAHECILDLRPITKATGVTVDDVAKRLADYGFHAPTMSFPVAGTLMVEPTESETLTEVDAFCDAMIAIRGEIDRVGAGEWPVEDNPLRGAPHTAECLVTTDWDHPYSREQAAYPLGKDFRPKVWPPVRRIDGAYGDRNLVCSCPPVEAFA

SEQ ID NO: 3018 - DNA, 2826 bp, Mycobacterium tuberculosis
  CDS (1)..(2826): transl_table=11
gtgtccgaccattcgacgttcgcagaccggcacatcggtctggacagccaggccgtcgcgaccatgctcgccgtgatcggggtggattcgctcgatgacctggcagtcaaggcggtcccggcgggcatcctagacacactcaccgacaccggagccgcaccgggtttggacagtctgccaccggctgccagcgaagccgaggcgctggccgagctgcgagcgctggccgacgctaacaccgtcgccgtgtcgatgatcgggcaaggctactacgacacacacacccccccggtgctgttgcgcaacatcatcgagaacccggcctggtataccgcctacacgccgtaccagcccgagattagtcagggtcggctggaagccttgctgaacttccagaccctggtcaccgatctgaccggcctcgagatcgcgaacgcgtcgatgctcgacgagggcaccgcggcggccgaggccatgactttgatgcaccgcgcggcccgcgggccggtgaagagggtggtcgtggacgccgacgtgttcacccagaccgcggcggtgctggccacccgcgccaagccgctgggtatcgagatcgtcacggccgacctgcgcgccggtctgcccgacggcgaatttttcggcgtcatcgcccagctgcccggggccagcggccggatcaccgactggtctgccctggtgcaacaggcccacgaccgtggcgcactggtggccgtcggcgccgacttgttggcgctgacgctgatcgcgccgcccggagagatcggcgctgacgtcgcctttggcaccacacaacggttcggagtgccgatggggtttggcggcccgcatgccgggtaccttgcggtgcacgccaagcatgcgcgtcagctgcccggccggctggtcggtgtgtccgtcgacagtgacggcacgccggcctatcggttggcgctgcagactcgcgagcaacacatccgccgcgacaaggccaccagcaacatctgcaccgcacaagtgctgttggcggtgcttgccgcgatgtacgcgagctaccacggcgcgggcgggctgaccgccatcgcacgccgggtgcatgcccacgccgaggctatcgccggtgcactgggcgatgcgttggtgcacgacaagtacttcgacacggtgttggcccgggtgcccggtcgtgccgacgaggtgctggccagggccaaggccaacggcatcaacctgtggcgtgtcgacgccgaccatgtgtcggtagcctgcgacgaagccaccactgacacccacgtggcggtcgttctggacgcgttcggtgtagcggccgccgcacccgcccatacggacatcgcaacgcgcacatcggagttcctgacgcatccagcgttcacgcaataccgcaccgagacgtcgatgatgcggtacttgcgtgcgctggcggataaggatattgccctcgaccgcagcatgattccgctcggctcgtgcacgatgaaactcaacgccgccgccgagatggagtcgattacctggcctgaattcgggcgtcagcatccatttgccccggcatctgataccgctgggctgcgtcaacttgttgccgacctacagagttggctggtgctgatcaccggttatgacgcggtgtcgctgcaacctaacgcgggctcgcaaggcgagtatgcgggcctattggcgatccacgagtaccacgccagccggggtgaaccgcatcgcgacatctgcctgatcccgtccagcgcgcacggcaccaatgccgcgtcagccgccttggccggcatgcgcgtggtggtggtggactgccacgacaacggcgacgtcgacctcgatgacctgcgcgctaaggtcggggagcatgccgagcggttgtcggcgctaatgatcacctacccgtccactcacggcgtgtacgaacacgacatcgccgagatctgcgctgccgtgcacgacgcgggcggccaggtatacgtcgacggagccaacctcaacgccctggtcggcctggcccggccgggcaagttcggcggtgacgtcagtcacctcaacctacacaagacattctgcattccgcacggcggcggtggcccaggcgtcggcccggtggcggtgcgggcgcacctggcaccgtttctgccaggtcaccccttcgcccccgagctgcccaagggctatccggtgtcgtcggcaccatatgggtcggcttcgattcttccgatcacctgggcatacatccggatgatgggggctgagggactgcgggcggcatcgctgacagcgatcacgtcggctaactacattgcgcgccgccttgacgagtattacccggtgctgtacaccggcgagaacggcatggtcgcccacgagtgcatcctggacttgcgcggtatcactaagttgaccggtatcaccgtcgacgatgtcgcaaaacggctggcagactatggttttcacgcaccaacgatgagttttccggtggccggtacgctcatggtggagcccaccgagagcgagagcctggccgaagtggacgccttctgcgaggccatgatcggcatccgcgccgagatcgacaaagtcggggccggggagtggcctgtcgacgacaatccgctgcgcggcgcaccgcacaccgcgcagtgcctgctggcgtctgattgggaccacccgtatacgcgggaacaggccgcctacccgctcggcaccgcattccgacccaaggtttggcccgcggtacgtcgcatcgacggcgcctacggggatcgcaacctggtctgctcatgcccgccggtagaggcttttgcctaa

SEQ ID NO: 3019 - protein, 941 aa, Mycobacterium tuberculosis
MSDHSTFADRHIGLDSQAVATMLAVIGVDSLDDLAVKAVPAGILDTLTDTGAAPGLDSLPPAASEAEALAELRALADANTVAVSMIGQGYYDTHTPPVLLRNIIENPAWYTAYTPYQPEISQGRLEALLNFQTLVTDLTGLEIANASMLDEGTAAAEAMTLMHRAARGPVKRVVVDADVFTQTAAVLATRAKPLGIEIVTADLRAGLPDGEFFGVIAQLPGASGRITDWSALVQQAHDRGALVAVGADLLALTLIAPPGEIGADVAFGTTQRFGVPMGFGGPHAGYLAVHAKHARQLPGRLVGVSVDSDGTPAYRLALQTREQHIRRDKATSNICTAQVLLAVLAAMYASYHGAGGLTAIARRVHAHAEAIAGALGDALVHDKYFDTVLARVPGRADEVLARAKANGINLWRVDADHVSVACDEATTDTHVAVVLDAFGVAAAAPAHTDIATRTSEFLTHPAFTQYRTETSMMRYLRALADKDIALDRSMIPLGSCTMKLNAAAEMESITWPEFGRQHPFAPASDTAGLRQLVADLQSWLVLITGYDAVSLQPNAGSQGEYAGLLAIHEYHASRGEPHRDICLIPSSAHGTNAASAALAGMRVVVVDCHDNGDVDLDDLRAKVGEHAERLSALMITYPSTHGVYEHDIAEICAAVHDAGGQVYVDGANLNALVGLARPGKFGGDVSHLNLHKTFCIPHGGGGPGVGPVAVRAHLAPFLPGHPFAPELPKGYPVSSAPYGSASILPITWAYIRMMGAEGLRAASLTAITSANYIARRLDEYYPVLYTGENGMVAHECILDLRGITKLTGITVDDVAKRLADYGFHAPTMSFPVAGTLMVEPTESESLAEVDAFCEAMIGIRAEIDKVGAGEWPVDDNPLRGAPHTAQCLLASDWDHPYTREQAAYPLGTAFRPKVWPAVRRIDGAYGDRNLVCSCPPVEAFA

SEQ ID NO: 3020 - DNA, 2853 bp, Neisseria gonorrhoeae
  CDS (1)..(2853): transl_table=11
atgaaactgtccgaactgttcaaccccaacgaatttgccgcgcggcatttgagtttcggcgacgaagcggcgttgcttgccgctgtcggcgagaagagcatggacgaatttgtcggcaacaccttgccgcaaagcatccgtatgccgtccgaactcgatttgcccgaagccctgaccgaggcggacgcattggcgaaattgaaaggcatcgcgtctaaaaacgtgatcaacaagtcctatatcggtttgggttattacccgacccgcgtgccgaacgtgattttgcgcaacgtattggaaaacccgggctggtacaccgcctacacgccgtatcaggcggagattgcccaaggtcgtttggaagcgttgttgaacttccagcaggtgtgcatcgatttgaccggtttccctgtggcaggcgcgtctttgttggacgaagcgaccgccgccgccgaagcgatggcgatggcgcaccgcgtgggcaaagtgaaatccgagcgtttctttgtggatgcgcgcgtgtatccgcaaactttggacgtgatgaaaacccgcgccaaatatttcggcttcgagctggtggtcagcgattttgcccaagcggatgaaggcgaatacttcggcgcgctgttccaatacgtcggtaaagacggcgacgtgcaagacttgcaggacgttatcggccgtctgaaagccaaaggcacaatcgttgctgttgccgccgacatcatgagcttggttttgctgaagtctccggctgaattgggcgcggatattgctttgggcaacacccaacgtttcggcgtaccgatgggctttggtggtccgcacgccgcttatttcgcgtttaaagacgagttcaaacgctccgccccgggccgcatcatcggcgtatccaaagacgcatcgggcaaacctgccttgcgcatggctttgtccacccgcgaacaacacatccgccgcgaaaaagcgacatccaatatttgtaccgcacaggcattgctggcgaacttggcgggcatgtacgccgtttatcacggccccaaaggcgtaaaacgcatcgccaaccgcattcacacactggcttccgtctttgccgacgcgctggtttcagacggcctcaaagtggttcacgaagtcttcttcgataccgttaccgtcgatttcggcagcaaagagaaagcagaccaagtgtttgccgctgctttggagtcgggttacaacctgcgcagcgtcaacaatactcaagttgcggctgcattccatgaaacgtcggtatacgaagatttggccgatttgtaccgcgcgtttaccggcaaggatacgttcacatttgccgatgatgtcaaaggccgtctgaatgccgaattactgcgtcaagacgacattctgcaacatcctgtgtacaacagttaccacaccgaacacgaaatgttgcgctacctgaaaaaactcgaagaccgcgacttggctatgaaccgcagcatgatttcgctcgggagctgcaccatgaagctcaatgcgactgcggaaatgttgccgattacttggactgagttctccgacatccacccttacgctcccgaagcgcaaaccgccggctaccgcgaattgcttgctgatatggaaaacagcctgaaagccatcaccggctttgacgcgatttccttccagcccaactccggcgcacaaggcgaatacagcggtatgctcgccatccgccgttatcaggaagcccaaggcgaagcacaccgcaacatctgcctgattcccaaatccgcccacggcaccaaccccgccaccgccgccatgctcggtttgaaagtcgtcgtcgtcgataccgacgaacacggcaacgtcaatattgacgatttgaaagccaaagccgaacaacaccgcgatgccttgtccgccatcatgattacctatccgtccacacacggcgtgtacgaagaaggcatccgcgacatctgccggatcattcacgaaaacggcggacaggtttacatggacggcgcaaacctcaatgcccaaatcggcatcatgcagcccgccgaagtcggcgcggacgtgttgcacatgaacctgcacaaaaccttctgtatccctcacggcggcggcggcccgggcatgggtccgattggcttgaaagcccacctcgccccgttcgcaccggggcataccctgaccgacacccacagcgcaagtgccgggcaaacctccgttgccgccgcagccttcggttctgcatccatcctgccgattacttggatgtacctgaccatgatgggcaaacaaggcatggaacaggcaacacgctgggcattgctcaacgccaactatgtcgctaaacgcttgagcgaagactatccgattctgtatacaggcaaaaacggccgcatcgcgcacgaatgcatcgtcgatttgcgtccgctcaaagccgaaagcggcatcaccgaaaccgacatcgccaaacgcctgatggactacggcttccacgcgccgacggtttccttccctgttgccggcacgctgatgatcgaaccgaccgagagcgaaagcaaagccgaactcgaccgcttcatcgccgccctgaaatccattcgccgcgaagtgcagaaagtcatcgacggcgaatggccgaaagacgacaacccactggtcaacgcgccgcacaccgccgcagatataaccggcgaatgggcgcatccgtactctcgcgaagaagccgtcttcccgctgcccttcgtgcgcgaacacaagttctggcccttcgtcaaccgcgtggacgacgtgtacggcgaccgcaacctcgtgtgcagctgcccgccgatggaaaattatgaagactga

SEQ ID NO: 3021 - protein, 950 aa, Neisseria gonorrhoeae
MKLSELFNPNEFAARHLSFGDEAALLAAVGEKSMDEFVGNTLPQSIRMPSELDLPEALTEADALAKLKGIASKNVINKSYIGLGYYPTRVPNVILRNVLENPGWYTAYTPYQAEIAQGRLEALLNFQQVCIDLTGFPVAGASLLDEATAAAEAMAMAHRVGKVKSERFFVDARVYPQTLDVMKTRAKYFGFELVVSDFAQADEGEYFGALFQYVGKDGDVQDLQDVIGRLKAKGTIVAVAADIMSLVLLKSPAELGADIALGNTQRFGVPMGFGGPHAAYFAFKDEFKRSAPGRIIGVSKDASGKPALRMALSTREQHIRREKATSNICTAQALLANLAGMYAVYHGPKGVKRIANRIHTLASVFADALVSDGLKVVHEVFFDTVTVDFGSKEKADQVFAAALESGYNLRSVNNTQVAAAFHETSVYEDLADLYRAFTGKDTFTFADDVKGRLNAELLRQDDILQHPVYNSYHTEHEMLRYLKKLEDRDLAMNRSMISLGSCTMKLNATAEMLPITWTEFSDIHPYAPEAQTAGYRELLADMENSLKAITGFDAISFQPNSGAQGEYSGMLAIRRYQEAQGEAHRNICLIPKSAHGTNPATAAMLGLKVVVVDTDEHGNVNIDDLKAKAEQHRDALSAIMITYPSTHGVYEEGIRDICRIIHENGGQVYMDGANLNAQIGIMQPAEVGADVLHMNLHKTFCIPHGGGGPGMGPIGLKAHLAPFAPGHTLTDTHSASAGQTSVAAAAFGSASILPITWMYLTMMGKQGMEQATRWALLNANYVAKRLSEDYPILYTGKNGRIAHECIVDLRPLKAESGITETDIAKRLMDYGFHAPTVSFPVAGTLMIEPTESESKAELDRFIAALKSIRREVQKVIDGEWPKDDNPLVNAPHTAADITGEWAHPYSREEAVFPLPFVREHKFWPFVNRVDDVYGDRNLVCSCPPMENYED

SEQ ID NO: 3022 - DNA, 2853 bp, Neisseria meningitidis serogroup A
  CDS (1)..(2853): transl_table=11
atgaaactgtccgaactgttcaaccccaacgaatttgccgcgcgccatttgagtttcggcgacgaagcggcgttgcttgccgctgtcgacgagaagagcatggacgaatttgtcggcaataccgtgccgcaaagcatccgtatgccgtccgaactcgatttgcccgaggccttgaccgaagcggacgcgttggcaaaattgaaaggcattgcgtcgaaaaacatgatcaacaaatcctatatcggtttaggctattacccgacccgcgtgccgaacgtgattttgcgtaacgtattggaaaatccgggttggtacaccgcctacacgccgtatcaggcggaaattgcccagggtcgtttggaagctttgttgaacttccaacaagtgtgcatcgatttgaccggttttcccgtggcgggcgcgtctttgctggacgaggcaactgccgccgccgaagcgatggcgatggcgcaccgcgtgggcaaggtaaaatccgagcgtttcttcgtggacgagcgcgtgtatccgcagactttggacgtgatgaaaacccgcgccaaatatttcggctttgaactggtggtcggcgattttgcccaagccgacgaaggcgaatacttcggcgcgctgttccaatacgtcggcaaagacggcgatgtgcaagacttgcaggacgttatcggccgtctgaaagcaaaaggcacgatcgtggccgttgccgccgacatcatgagtttggttttgctgaagtctccggctgaattgggcgcggacattgcgttgggcaacactcaacgcttcggtgtgccgatgggcttcggtggtccgcacgctgcttatttcgcgtttaaagacgagttcaaacgttccgctccaggccgcatcatcggcgtatccaaagacgcatcgggcaaacctgccttgcgcatggcgttgtccacccgcgagcaacacatccgccgcgaaaaagcgacatccaatatttgtaccgcgcaggcattgctggcgaacttggccggtatgtatgccgtttaccacggccccaaaggcgtgaaacgcatcgccgaccgcattcacgcgctggcttctgcctttgccgatgcgctggtttcagacggcctgaatgtggttcataaggtcttcttcgataccgttaccgtcgatttcggcaacaaagagaaagcagaccaagtgtttgccgctgctttggaatcgggctataacctgcgccgcgttaacgatactcaagttgcggctgcattccacgaaacatcggcatgcgaagatttggttgatttgtaccgcgcgtttaccggcaaggatacgttcgcatttgccgatgatgtcaaaggccgtctgaatgcagaattgctgcgtcaggacgatattctgcaacatcctgtgttcaacagttaccacaccgaacacgaaatgctgcgctacctgaaaaaactcgaagaccgcgatttggcgatgaaccgcagcatgatttcgctcggtagctgcaccatgaagctcaatgcgactgcggaaatgctgccgattacttgggcggagttctccgacatccatccctacgctcccgaagcgcaaaccgcgggctaccgcgaattgctcgccgatatggaaaacagcctgaaagccatcaccggctttgacgcgatttccctgcagccgaactccggcgcacaaggcgaatataccggtatgctctctatccgccgttatcaagaagcccaaggcgaagcgcaccgcaacatctgcctgattccaaaatcagcccacggtaccaaccctgcgactgcggccatgctgggcttgaaagtcgtcgttgtcgacaccgacgaacacggtaacgtcaacattgacgatttgaaagccaaagccgagcaacaccgcgacgctttgtctgccatcatgattacctatccgtccacccacggcgtgtacgaagaaggcatccgcgacatctgccgcattattcacgagaacggcggacaggtttacatggacggcgccaacctcaacgcccaaatcggcatcatgcagcctgccgaggtcggcgcggacgtgttgcacatgaacctgcacaaaaccttctgtatccctcacggcggcggcggcccgggcatgggtccgattggcttgaaagcccatctggctccgttcgcaccgggacacactttgaccgacacccacagcgcaagtgccgggcaaactgccgtggctgccgcagcatatggttctgcgtccatcctgccgattacttggatgtacctgaccatgatgggcaaacaaggcatggaacaggcgacacgctgggcattgctcaacgccaactacgtcgccaaacgtctgagcgaagactatccgatcctgtatacaggcaaaaacggccgcgtcgcgcacgaatgtatcgtcgacttgcgtccgctcaaagccgaaagcggcattaccgaaaccgacatcgccaaacgcctgatggactacggcttccacgccccgaccgtctccttccccgttgccggcacgctgatgatcgaaccgaccgaaagcgagagcaaagccgaactcgaccgcttcatcgccaccctgaaatccattcgccgcgaagtgcagaaagtcatcgacggcgaatggccgaaagacgataatccgctggtgaatgctccgcacaccgccgcagatataaccggcaactgggcgcatccgtattcccgcgaagaagccgtcttcccgttgccgttcgtccgcgaacacaagttttggcccttcgtcaaccgcgtggacgacgtgtacggcgaccgcaatctcgtgtgcagctgcccaccgatggaaaattatgaagactga

SEQ ID NO: 3023 - protein, 950 aa, Neisseria meningitidis serogroup A
MKLSELFNPNEFAARHLSFGDEAALLAAVDEKSMDEFVGNTVPQSIRMPSELDLPEALTEADALAKLKGIASKNMINKSYIGLGYYPTRVPNVILRNVLENPGWYTAYTPYQAEIAQGRLEALLNFQQVCIDLTGFPVAGASLLDEATAAAEAMAMAHRVGKVKSERFFVDERVYPQTLDVMKTRAKYFGFELVVGDFAQADEGEYFGALFQYVGKDGDVQDLQDVIGRLKAKGTIVAVAADIMSLVLLKSPAELGADIALGNTQRFGVPMGFGGPHAAYFAFKDEFKRSAPGRIIGVSKDASGKPALRMALSTREQHIRREKATSNICTAQALLANLAGMYAVYHGPKGVKRIADRIHALASAFADALVSDGLNVVHKVFFDTVTVDFGNKEKADQVFAAALESGYNLRRVNDTQVAAAFHETSACEDLVDLYRAFTGKDTFAFADDVKGRLNAELLRQDDILQHPVFNSYHTEHEMLRYLKKLEDRDLAMNRSMISLGSCTMKLNATAEMLPITWAEFSDIHPYAPEAQTAGYRELLADMENSLKAITGFDAISLQPNSGAQGEYTGMLSIRRYQEAQGEAHRNICLIPKSAHGTNPATAAMLGLKVVVVDTDEHGNVNIDDLKAKAEQHRDALSAIMITYPSTHGVYEEGIRDICRIIHENGGQVYMDGANLNAQIGIMQPAEVGADVLHMNLHKTFCIPHGGGGPGMGPIGLKAHLAPFAPGHTLTDTHSASAGQTAVAAAAYGSASILPITWMYLTMMGKQGMEQATRWALLNANYVAKRLSEDYPILYTGKNGRVAHECIVDLRPLKAESGITETDIAKRLMDYGFHAPTVSFPVAGTLMIEPTESESKAELDRFIATLKSIRREVQKVIDGEWPKDDNPLVNAPHTAADITGNWAHPYSREEAVFPLPFVREHKFWPFVNRVDDVYGDRNLVCSCPPMENYED

SEQ ID NO: 3024 - DNA, 2805 bp, Nocardia farcinica
  CDS (1)..(2805): transl_table=11
gtgacccgatccttcgccgaccgccacatcggacccgacgccgccgaactgtcccggatcctcgaggtcgtcggggtcgactccctcgacgcgctggccgcggccgcgctgcccgcgagcatcctcgacgacgcaggcgcgggcccgctggccgcattgccgcccgcggtgagcgagcacgaggcgctggccgaactggccgccctcgcgcagtccaacaccgtgacgacctcgatgatcggcctcggctactacgacacgctgactccgccggtgctggtgcgcaacctgctggagaaccccgcgtggtacaccgcctacaccccgtaccagcccgagatcagccagggcaggctcgaggcactgctcaacttccagacgatggtgtcggatctgaccgggatggaggtcgccaacgcctccatgctcgacgaggccaccgcggccgcggaagcgatgacgttgctgcgccgcgcgggccgctcccggtcgaaccggctgctgatcgatgccgacctgttcccgcagacccgcacggtgctgcacacccgtgccgagccgctgggcatcgagatcgtcgaggcggacctggccgccgccggactgcccgagggagggttcttcggtgtgatcgtccaggtgcccggcgcgtccggccgggtggtggactggaccgcgctcatcgcggcggcccacgagcgcggcgcgctggtcgccgcgggcgccgacctgctggccatgacgctgatcgtgccgcccggtgagcagggcgccgacgtgtgcttcggcaccacccagcgcttcggcgtgccgatgggcttcggtggtccgcacgcgggctatctggcggtgcgcagcgcccacgcgcggcagttgccgggccggttggtcggtgtctccaaggacgccgacggcaatcccgcctaccgcctggccctgcagacccgcgaacagcacatccgccgggagaaggcgacctccaacatctgcaccgcccaggtgctgctggcgatcgtggccgcgatgtacgcctgctaccacggcgccgacgggctgcgcgccatcgcccgtcgggtgcacggccacgccgcgcggatcgccggggcgctcggggaggcgctggtgcacgacacctacttcgacaccgtgctggcgcgggtgcccggccacgccgaagccgtcgtcgccaaggccgccgcctgcgggatcacgttgcgcctggtcgaccccgatcacgtcgcggtcgcctgcgacgaggccaccaccgacgcgcacgtcgaggccgtgctcgacgcgttcggcgtggcgcccgccgagccggtggacgcgggcatcgccacccggacctcggagttcctgacgcatccggcgttcacccgctaccgcaccgagaccgcgatgctgcgctacctgcggtcgctgtcggacaaggacatcgccttggaccgcagcatgattccgctgggctcgtgcaccatgaagctcaacgcgaccgccgagatggagccgatcacctggcccggcttcgccaagctgcacccctacgcaccggtcgagcacgcccccggcctgctgaagctgatcggtgatctggagagctggctggccgagatcaccggctacgacgcggtgagcctgcaaccgaacgcgggcagccagggcgagtacgcgggcctgctggcgatccgccgctaccacctcgaccgcggcgacacccatcgcgacacctgcctgatcccctccagcgcgcacggcaccaacgcggcctccgccgcgatggcggggctgcgggtggaggtggtcaagtgccgcgagaacggtgacgtcgacctcgacgacctgcgcgccaagatcaccgaccacgccgagcggctggcgtgcatcatgatcacctacccgtccacgcacggcgtctacgagcacgagatcgccgaactgtgcgcgctggtgcacgacgcgggcgggcaggtctacgtcgacggcgcgaacctcaacgcgttggtcgggctggccaggccgggccggttcggcggcgacgtcagccacctgaacctgcacaagaccttctgcatcccgcacggcggcggtggtcccggtgtcgggccggtcgcggtgcgcgcgcacctggcgcagtacctgcccggcgacccgctggaatcgggctcgcacgcggtctcggcggcgcgctacggctcggcctcgatcctgccgatcacctgggcctacatccggatgatgggcgccgaggggctgcgcaaggcgacgctgacggcgatcgcctcggccaactacctggcgcgcaggctcgacgagtacttcccggtgctctacaccggcgagaacggcatggtcgcccacgagtgcatcctggatctgcgcgagctgaccaagcgcaccggcgtcaccgtcgacgatgtggcgaagcgcttggccgactacggtttccacgcaccgaccatgagcttcccggtggcgggcaccctgatggtggagcccaccgagagcgagaacctcgccgagctggacgagttcgtggcggcgatgatcgccatccgtgccgagatcgatcaggtcggcgcgggcgtgtggcccgccgaggacaacccgctgcgcggcgccccgcacaccgccgagtgcctggtcggtgagtggacgcacccgtactcgcgcgaaatcgcggtctacccacggggtctcggccacgccagggccaaggtgtggcccgcggtgcggcgcatcgacggcgcgtacggcgaccgaaacctggtgtgctcgtgcccgccgctcgaggcctacgcggaatag

SEQ ID NO: 3025 - protein, 934 aa, Nocardia farcinica
MTRSFADRHIGPDAAELSRILEVVGVDSLDALAAAALPASILDDAGAGPLAALPPAVSEHEALAELAALAQSNTVTTSMIGLGYYDTLTPPVLVRNLLENPAWYTAYTPYQPEISQGRLEALLNFQTMVSDLTGMEVANASMLDEATAAAEAMTLLRRAGRSRSNRLLIDADLFPQTRTVLHTRAEPLGIEIVEADLAAAGLPEGGFFGVIVQVPGASGRVVDWTALIAAAHERGALVAAGADLLAMTLIVPPGEQGADVCFGTTQRFGVPMGFGGPHAGYLAVRSAHARQLPGRLVGVSKDADGNPAYRLALQTREQHIRREKATSNICTAQVLLAIVAAMYACYHGADGLRAIARRVHGHAARIAGALGEALVHDTYFDTVLARVPGHAEAVVAKAAACGITLRLVDPDHVAVACDEATTDAHVEAVLDAFGVAPAEPVDAGIATRTSEFLTHPAFTRYRTETAMLRYLRSLSDKDIALDRSMIPLGSCTMKLNATAEMEPITWPGFAKLHPYAPVEHAPGLLKLIGDLESWLAEITGYDAVSLQPNAGSQGEYAGLLAIRRYHLDRGDTHRDTCLIPSSAHGTNAASAAMAGLRVEVVKCRENGDVDLDDLRAKITDHAERLACIMITYPSTHGVYEHEIAELCALVHDAGGQVYVDGANLNALVGLARPGRFGGDVSHLNLHKTFCIPHGGGGPGVGPVAVRAHLAQYLPGDPLESGSHAVSAARYGSASILPITWAYIRMMGAEGLRKATLTAIASANYLARRLDEYFPVLYTGENGMVAHECILDLRELTKRTGVTVDDVAKRLADYGFHAPTMSFPVAGTLMVEPTESENLAELDEFVAAMIAIRAEIDQVGAGVWPAEDNPLRGAPHTAECLVGEWTHPYSREIAVYPRGLGHARAKVWPAVRRIDGAYGDRNLVCSCPPLEAYAE

SEQ ID NO: 3026 - DNA, 3174 bp, Pisum sativum
  CDS (1)..(3174)
atggaacgtgctcgtagactcgcaaaccgtgcaactctgaagcgtcttctttcagaggcgaaacagaaccggaagactgaatcaacatcaacaacaacaacaacgccgcttcctttttcactctctggttcatcttcaaggtacgtttcctctgtttcaaactctattcttagaggcagaggatccaaaccagacaacaatgtttcacgacgtgttggtgggtttcttggtgttggttatccatcacaatctcgatccatctccgttgaagcgttgaaaccgagtgacacatttccgagacgccataactcagcaacaccggatgaacaaacgaaaatggctgaatcggttggtttcgatacgcttgattcactcgttgatgcaaccgtgccgaaatccattcggttgaaggaaatgaagttcaataaatttgatggtggattgacagaaggtcaaatgattgagcacatgaaggatttagcttcgaaaaacaaggttttcaaatcgtttattggtatgggatactataacactcatgttccacctgtgattttgaggaacatcatggagaatcctgcttggtatacacagtatacaccttatcaagctgagatatctcaaggccgtcttgaatctttgttgaattttcagaccatgattactgatctcactggtttgcctatgtcaaatgcttcattgcttgatgaaggtactgctgctgcggaagcaatgtctatgtgtaataatattcaaaagggtaagaagaaaactttcattattgctagtaattgtcatccacaaaccattgatatatgtcagacgagagccgatggatttgaactcaaggttgtggtgaaagatcttaaggatattgattacaaatctggtgatgtttgtggtgttcttgttcagtatcctggtactgaaggtgaggttttggattacggtgaatttattaagaaggctcatgctaacgaggttaaggttgttatggcgagtgatctgttggcattgactgtgttgaaacctccgggtgagtttggagctgatattgttgttggttcagctcagagatttggtgttccaatgggttatggtggtcctcatgctgctttcttggctacttcgcaagagtataagaggatgatgcctggaagaatcatcggtgttagtgttgattcttctggaaagcaagctttgaggatggctatgcaaactagggagcagcatatccgtagggacaaggccaccagcaacatttgcactgctcaggcactgcttgcaaacatggctgctatgtatgctgtatatcatggacccgaaggccttaaagccattgcacaaagggttcatggtcttgctggtgtgtttgctcttggattaaagaaacttgggttggaagttcaggatcttggcttctttgacactgtgaaggttaagacttcaaatgccaaagcaattgcagatgctgctatcaaaagtgaaatcaatttgcgtgttgtagatggaaacactatcaccgctgcttttgacgaaacaaccacgttagaggatgttgataagcttttcaaagttttcgctggtggcaagcctgtctcattcacagcggcatctcttgcaccagagtttcaaaatgcaattccttctggattagttagggagagtccctatttgacacaccctatctttaacacgtaccaaactgagcatgagttgctgagatacattcataggttacaatcaaaagatctctcactttgccacagtatgatcccacttggatcttgtacaatgaagctgaatgcaacaactgaaatgatgcccgtgacatggcctagctttaccgatttgcaccctttcgcaccaactgaacaggctcaagggtatcaggaaatgttcaacaatttgggtgacctgttgtgtaccatcactggatttgactccttctctttgcaaccaaatgccggtgctgccggagaatatgccggactcatggttattcgtgcatatcatttgtcaagaggtgaccaccaccgcaatgtttgcattataccagcatcagcacatggtacaaatcctgctagtgctgctatggttggaatgaaaattgttaccataggaactgatgctaagggaaacattaacattgaagagttgaagaaggctgctgaaaaacataaggacaacttatctgcatttatggtaacatatccttcaactcatggtgtttatgaagaaggtattgatgatatttgcaagattatccatgataatggtggtcaagtatacatggatggtgccaacatgaatgcacaggtaggacttacaagcccaggttggattggagcagatgtttgccatctcaatctccataagacattttgcattcctcatggaggaggtggccctggcatgggtcctattggtgtaaagaaacacctggcaccatttttaccctcacaccccgtggtgccaaccggtggaattcctgcacctgagaatcctcaaccacttggtagtatctcagctgcaccttggggatcagcactcatattgccaatctcttacacatacatagccatgatgggttctcaaggactcactgacgcgtcaaagatagccattttgaatgcaaactacatggcgaaacgattggagagttattacccagttcttttccgcggagtcaatggaacagttgctcatgaattcattattgacttaagaggatttaagaatactgctggaatagagcctgaagatgttgcgaaacgtctcatggactatggatttcatggaccaacaatgtcatggcctgtcgctggtacactcatgattgagcctactgaaagtgaaagcaaggctgagttagacaggttttgcgatgctcttatttccattagaaaggaaattgctgaggttgagaaaggaaatgctgatgttcacaacaatgttctcaagggagcccctcatccaccatcactgctcatggctgatgcatggaccaaaccatactccagggagtatgcagccttcccagctgcatggctccgtggtgcaaagttttggcctaccacaggacgtgttgataatgtgtatggtgaccgcaacctggtttgcacccttctcccagcatcacaggccgttgaagaacaagctgctgcaactgcataa

SEQ ID NO: 3027 - protein, 1057 aa, Pisum sativum
MERARRLANRATLKRLLSEAKQNRKTESTSTTTTTPLPFSLSGSSSRYVSSVSNSILRGRGSKPDNNVSRRVGGFLGVGYPSQSRSISVEALKPSDTFPRRHNSATPDEQTKMAESVGFDTLDSLVDATVPKSIRLKEMKFNKFDGGLTEGQMIEHMKDLASKNKVFKSFIGMGYYNTHVPPVILRNIMENPAWYTQYTPYQAEISQGRLESLLNFQTMITDLTGLPMSNASLLDEGTAAAEAMSMCNNIQKGKKKTFIIASNCHPQTIDICQTRADGFELKVVVKDLKDIDYKSGDVCGVLVQYPGTEGEVLDYGEFIKKAHANEVKVVMASDLLALTVLKPPGEFGADIVVGSAQRFGVPMGYGGPHAAFLATSQEYKRMMPGRIIGVSVDSSGKQALRMAMQTREQHIRRDKATSNICTAQALLANMAAMYAVYHGPEGLKAIAQRVHGLAGVFALGLKKLGLEVQDLGFFDTVKVKTSNAKAIADAAIKSEINLRVVDGNTITAAFDETTTLEDVDKLFKVFAGGKPVSFTAASLAPEFQNAIPSGLVRESPYLTHPIFNTYQTEHELLRYIHRLQSKDLSLCHSMIPLGSCTMKLNATTEMMPVTWPSFTDLHPFAPTEQAQGYQEMFNNLGDLLCTITGFDSFSLQPNAGAAGEYAGLMVIRAYHLSRGDHHRNVCIIPASAHGTNPASAAMVGMKIVTIGTDAKGNINIEELKKAAEKHKDNLSAFMVTYPSTHGVYEEGIDDICKIIHDNGGQVYMDGANMNAQVGLTSPGWIGADVCHLNLHKTFCIPHGGGGPGMGPIGVKKHLAPFLPSHPVVPTGGIPAPENPQPLGSISAAPWGSALILPISYTYIAMMGSQGLTDASKIAILNANYMAKRLESYYPVLFRGVNGTVAHEFIIDLRGFKNTAGIEPEDVAKRLMDYGFHGPTMSWPVAGTLMIEPTESESKAELDRFCDALISIRKEIAEVEKGNADVHNNVLKGAPHPPSLLMADAWTKPYSREYAAFPAAWLRGAKFWPTTGRVDNVYGDRNLVCTLLPASQAVEEQAAATA

SEQ ID NO: 3028 - DNA, 2877 bp, Photorhabdus luminescens subsp
  CDS (1)..(2877): transl_table=11
atgacccagacattaagccaactcgaaaatcagggcgagtttatccgccgtcatattggctcttccgccgaacagcaaaaagagatgttggcgacagtgggggcaagttcccttaatgatttaacacagaaaattgttcctcgtgatatcgcgttgccagagccgcccgatgttggtggcggtgcaactgaacagcaagcactagctgaattgaaagcgattgccagccaaaataaacgttaccaatcctatattggcatggggtatgcgcctgcggtgcttccgccagttattttgcgtaatttattagaaaatcctggctggtataccgcttatacaccttatcaacccgaagtttctcaaggtcgccttgaatcactgttaaatttccaacaagtgacgatcgatttgacggggttggatattgcttctgcttctttgctggatgaagccaccgcggcggctgaagcaatggcaatggcaaaacgtatcagcaaactgaaaaatgctgaccgtttctttgttgctgatgatatccatcctcaaacattagatgttgttcgtacccgcgcggaaacctttggctttgatgtgattgtggataaagcagaaaaagtcttggagctggacggtgtatttggtgtgttgttacaacaggttggcacgacaggtgaagttcatgattatgcggatctgatcgcacaactgaaacagcgcaaaatcattgtcagtgttgccgctgatttgatggcgttgctgctgctgactgcaccgggtaaacaaggcgctgacatggtgtttggttcagctcagcgttttggggtaccaatgggatatggcggtccccacgccgcattttttgccagccgtgatgaattcaaacgttctatgccgggacgtattatcggtgtttcccgagatgcggcaggtaatacggcactgcgcatggcaatgcagacccgtgagcagcatatccgtcgtgagaaagcgaattccaacatctgtacggctcaggtgttgctggcaaatatcgcggcgatgtatgcggtatatcatggttcgaaggggctgaaacgcattgcaggtcgtattcatcgtctgactgacattctggcggttgggttacagaaagctgggtttactctacgttacaaaacttggtttgatacgctgacggttgaagttgctgataaagcggcggtattagcccgggcagagaaagctgaaatcaatttgcgtaccgatacttacggcgcggtggggatcacattgagtgaagctacccgccgtgatgatgtgatcaaattgttctctgtgctgacaggcacggatgacaagctagatgttgaagcactggataaagagctgatgacggaaagtcactccattcctgcctcaatgttgcgtagtgatgaaatcctgctgcatccaaatttcaaccgttatcacagcgaaacggatatgatgcgttatatgcatcgtcttgagcgccgagatttggcactgaatcaggccatgatcccattgggttcttgcaccatgaaacttaatgccgcggcagaaatgttgccgatctcttggcctgaatttaatgaactacacccattttgtccgccagagcaagcgcagggttatcagcaaatgatcagccaattatctcactggctggtgcaactgacaggttacgatgtcgtttgtatgcaaccaaactccggtgcacagggtgaatatgcgggtctgcttgctattcgccgttaccatgaaagtcgtggagaagggcatcgtcatatctgtttgatccccagttctgctcatggtaccaacccggcatctgctcatatggcaggcatgaccgttgtggtggtgagttgcgataaagagggcaacattgatctagttgacctgcgtgaaaaagcggaagaatcaggtaatgagctttcctgcatcatggtgacttacccatcgacccacggcgtatatgaagaaactattcgtcaggtgtgtgaaatcattcaccagtatggtggtcaggtttaccttgatggtgcgaatatgaatgcgcaggttggtatcaccgcgcccggttttatcggagctgatgtttcgcacctcaacctgcataaaacattctgtatcccacacggcggtggtggcccaggtatggggccgattggcgtaaaagcccatttggccccgttcttaccgggacactcggtagttcaaatggatggccttactgaacagagagctgtctcagcggcaccatttggtagtgcttctattttgccgattagctggatgtatatccgtatgatgggctcgcaagggttgaagcaggcaagccagacggcgattttgaatgctaactatattgctgctcgcttaaagaatgattatgacgtgttgtatacgggtcataacggttatgtggcacatgaatgtattctggatattcgaccgttgaaagaagagtttggtatcagtgagatggatattgccaagcgcttgattgactatggcttccatgcgccaaccatgtcattcccggttgccggcacgctgatggtggaacccacggaatcagaaagcaaagtggaaattgatcgctttgtggatgccatgctggcgatccgtgctgaaattggcaaagtggcaaaaggtgagtggtcattagaagataacccattggttaacgcgcctcacgtacaagctgaactggtttctgactggagccatagttacagccgtgaaactgcggttttcccaaccttggaaaccaaagccaataaatattggcctgcggttaaacgccttgatgatgtttacggtgatcgtaatctgcattgctcttgtgcacctgtcagtgattatcaataa

SEQ ID NO: 3029 - protein, 958 aa, Photorhabdus luminescens subsp
MTQTLSQLENQGEFIRRHIGSSAEQQKEMLATVGASSLNDLTQKIVPRDIALPEPPDVGGGATEQQALAELKAIASQNKRYQSYIGMGYAPAVLPPVILRNLLENPGWYTAYTPYQPEVSQGRLESLLNFQQVTIDLTGLDIASASLLDEATAAAEAMAMAKRISKLKNADRFFVADDIHPQTLDVVRTRAETFGFDVIVDKAEKVLELDGVFGVLLQQVGTTGEVHDYADLIAQLKQRKIIVSVAADLMALLLLTAPGKQGADMVFGSAQRFGVPMGYGGPHAAFFASRDEFKRSMPGRIIGVSRDAAGNTALRMAMQTREQHIRREKANSNICTAQVLLANIAAMYAVYHGSKGLKRIAGRIHRLTDILAVGLQKAGFTLRYKTWFDTLTVEVADKAAVLARAEKAEINLRTDTYGAVGITLSEATRRDDVIKLFSVLTGTDDKLDVEALDKELMTESHSIPASMLRSDEILLHPNFNRYHSETDMMRYMHRLERRDLALNQAMIPLGSCTMKLNAAAEMLPISWPEFNELHPFCPPEQAQGYQQMISQLSHWLVQLTGYDVVCMQPNSGAQGEYAGLLAIRRYHESRGEGHRHICLIPSSAHGTNPASAHMAGMTVVVVSCDKEGNIDLVDLREKAEESGNELSCIMVTYPSTHGVYEETIRQVCEIIHQYGGQVYLDGANMNAQVGITAPGFIGADVSHLNLHKTFCIPHGGGGPGMGPIGVKAHLAPFLPGHSVVQMDGLTEQRAVSAAPFGSASILPISWMYIRMMGSQGLKQASQTAILNANYIAARLKNDYDVLYTGHNGYVAHECILDIRPLKEEFGISEMDIAKRLIDYGFHAPTMSFPVAGTLMVEPTESESKVEIDRFVDAMLAIRAEIGKVAKGEWSLEDNPLVNAPHVQAELVSDWSHSYSRETAVFPTLETKANKYWPAVKRLDDVYGDRNLHCSCAPVSDYQ

SEQ ID NO: 3030 - DNA, 2880 bp, Photobacterium profundum
  CDS (1)..(2880): transl_table=11
atgaccgacatgactcttctaaatgctttaagcgacgaccaagattttgcgggtcgccacaatggccccaatgctgcacaacaaaatattatgctgaaagcaatttcagcagaaagcgttgagcagctaatagcacaaacagttccagcggatattcgtctgccagaacctatgaagctggatcctgcacaaagtgaagcagacatgctgacttctcttaaagcgattgcaagtaagaacatcattaatcgtagctatatcggtcaaggttactataacaacctaacgccaaatgttgtgcttcgtaacgtgcttgaaaatccaggttggtacactgcgtacacaccttaccagccagaaatctctcaaggtcgccttgaatctctgcttaattaccagcagatgattatggacctaacaagcatggaactggcaaacgcctctttgcttgatgaagcaacagcagcagcagaagcaatgacactgtgtttgcgagcaggtaagagtaagagcaaagctttctttgtttctaacgacctacaccctcaaacagttgatgttgttcgcacacgagcagaatacattggtattgaaatcatcacaggttcagttgaagaactggataaccacgatgtatttggtgctttggtacaatacccaggtacaacgggttcaattactgatttaactgacataattgaaaaagcacatgcgaaaaaaacactggttgctgtagcgtctgatctactagcactaacactgcttaaagcacctggtgaaatgggcgcagacgtagtgattggtagtgcacagcgcttcggtgtaccaatgggattcggcggtccacacgctggtttcatggcaacaaaagacaagcacaagcgtactatgccaggccgtgtaatcggtgtttctaaagatgcgagaggcaaccaatctcttcgtatggcaatgcaaacgcgtgagcagcacattcgtcgtgaaaaagcgacatcgaacatctgtaccgcacaggcgctattagccaatatggctgcattctatgccctgtaccacggtcctgaaggccttcgtaaaattggccgtcgtgttcaccacctaacagcgattcttgctgcaggtttacgtaattcaggtatcgagctagcaagtgatacattcttcgatacgattacgcttaacactggcaagaaaactgacgatttctacaaaaaagcactagctgctggtatcaacctgcgtaagtttgacgttcagctgggtatcagcctagatgagaccacgaaggtttctgacgttgaagagctactggctatctttactggcaacaaattaaaagcatcgatgttcacagcagatattgctgctgacgaatttgctgcaattccagaaagctgccgtcgtacaagtaagtacctaacacaccctgttttcaacgagcaccacagtgaaacgcaaatgatgcgttacatgaagaagcttgaaaacaaagactactcgctgacacacggtatgatcccgctaggcagctgtacaatgaagttgaatgcagcagcagagatgattcctatcacttggcctgaattcggttcattgcacccatttgcacctgcagatcaaactaaaggctatcaagagcttgcctctaagctttctgaaatgctgtgttctgtaacaggttacgatgcgttttctctacagccaaactctggcgcgcaaggtgaatatgccggtcttatcgcgattcagcgttaccaccagcacaatggcgacagccaccgtaatgtttgtttaattccaagttctgcacacggtactaaccctgcatcagcggcaatggtatcaatgaaagttgtggttgtaggttgtgatgaaaaaggcaacgtcgatgttgaagatctgaaagttaagatcgaaaaacaccgcgataacctatcatgcatcatgatcacctacccttctacacacggtgtatacgaagaagcagtacgtgaagtctgtgaccttgtacacgatgctggcggtcaggtttaccttgatggtgcaaacatgaacgcacaggttggtttaactaacccaggctttatcggttcagatgtttcgcaccttaacctacacaaaacattctgtattccacacggtggcggcggtcctggtatgggtcctatcggtgttaaatcgcacctagcacctttcctacctggtcacgttcaatcgacttctgatgaaggccagcagtacgcagtttctgcagcagagctaggttcagcttctattctacctatctcatacgcttacatcgcgatgatgggtgaagaagggcttactgaagcgacgaagcttgctatcttgaacgctaactacgtaatggaacgtctacgcccacactaccctgttctttaccgtggtactgaaggccgtattgctcacgaatgtattatcgacattcgcccactaaaagaagcctctggcatttctgaagaagatgtagcgaagcgcttaatggattacggtttccatgcgccaacaatgtctttccctgttgccggtacgctgatgattgaaccgactgaatctgaagatttagccgagcttgatcgtttctgtgacgcgatgattgcaattcgtcaagaaattgcacgcgttcaagaaggtgaatggccaatcgacgacaacccgttggtacatgcgccgcatacacaggcagatctaatggaaactgagtggaaccgtgcttacagccgcgaaattgcttgcttcccaacagatcacactcgagcatctaagtactggccgacagtaaaccgcgttgataacgtattcggtgaccgtaacttaatctgttcttgcccaagcatcgacagctacatcgaagattaa

SEQ ID NO: 3031 - protein, 959 aa, Photobacterium profundum
MTDMTLLNALSDDQDFAGRHNGPNAAQQNIMLKAISAESVEQLIAQTVPADIRLPEPMKLDPAQSEADMLTSLKAIASKNIINRSYIGQGYYNNLTPNVVLRNVLENPGWYTAYTPYQPEISQGRLESLLNYQQMIMDLTSMELANASLLDEATAAAEAMTLCLRAGKSKSKAFFVSNDLHPQTVDVVRTRAEYIGIEIITGSVEELDNHDVFGALVQYPGTTGSITDLTDIIEKAHAKKTLVAVASDLLALTLLKAPGEMGADVVIGSAQRFGVPMGFGGPHAGFMATKDKHKRTMPGRVIGVSKDARGNQSLRMAMQTREQHIRREKATSNICTAQALLANMAAFYALYHGPEGLRKIGRRVHHLTAILAAGLRNSGIELASDTFFDTITLNTGKKTDDFYKKALAAGINLRKFDVQLGISLDETTKVSDVEELLAIFTGNKLKASMFTADIAADEFAAIPESCRRTSKYLTHPVFNEHHSETQMMRYMKKLENKDYSLTHGMIPLGSCTMKLNAAAEMIPITWPEFGSLHPFAPADQTKGYQELASKLSEMLCSVTGYDAFSLQPNSGAQGEYAGLIAIQRYHQHNGDSHRNVCLIPSSAHGTNPASAAMVSMKVVVVGCDEKGNVDVEDLKVKIEKHRDNLSCIMITYPSTHGVYEEAVREVCDLVHDAGGQVYLDGANMNAQVGLTNPGFIGSDVSHLNLHKTFCIPHGGGGPGMGPIGVKSHLAPFLPGHVQSTSDEGQQYAVSAAELGSASILPISYAYIAMMGEEGLTEATKLAILNANYVMERLRPHYPVLYRGTEGRIAHECIIDIRPLKEASGISEEDVAKRLMDYGFHAPTMSFPVAGTLMIEPTESEDLAELDRFCDAMIAIRQEIARVQEGEWPIDDNPLVHAPHTQADLMETEWNRAYSREIACFPTDHTRASKYWPTVNRVDNVFGDRNLICSCPSIDSYIED

SEQ ID NO: 3032 - DNA, 2985 bp, Propionibacterium acnes
  CDS (1)..(2985): transl_table=11
atgactgaccacgctgagaatcggtgcggcctcgaagggccgcgccctttctcgagccgccacgttggatccgtcgaagatgacctgcgatacatcgccgagaccatcggggtaacgagtcccgagcagatcattcgcgacgccatcccagcctctgtgctcgactccaatgagggggactcctccgttcgcaccccgagctttccccctgccgccgacgaaacgaccgctcgcgctgaactcgtcgagatcgcctcaggaaaccgtgttactcgtgccctcattgggcgtggctattacggcacgcttaccccgccggtgattcgccgcaacatcctggagaatccctcctggtacaccgcctataccccgtaccagcccgaaatctcccagggccgactcgagatgctgacgatctaccagcagctcatcaccgatcttactgggctcgccctggcaaactcttctctcctcgatgaggcaaccgccgcttccgaggggatgctgctagcccgtcgtgccgctcgcaaggtaaagtccaaccgcttcttggtgcatactcacctctttgaccaggtgcgagacgtcgtcttaggccacgctgaagcaactggaattgaggttgttgagactgaccttcgtgacccacagtcgtggcgccccgaggttgaggccggctgcttcggcgtcctcgccccctatcccgacagcactggcgcactgtggaacccctctgaagtattcgacgctgttcacaaagttggcggtatcaccatcgccgagtgtgacctgctctcgctaactctgctggctccgccgggtgagctaggtgctgacgtcgccgtcggctcgtcgcaacgcttcggcgtcccgatgggtaatggcggaccgcacgcggcttacatgtcggttcgctctggcctggagcgtcagatcccgggacgactcgtcggtgtgtcaactgatgccgacgggaaccccgcttaccggctggccttgcagacccgtgaacagcacatccgccgtgacaaggccacgagcaatatctgtaccgctcaggtgctcctcgctgtagtcgccgctgcctatgccgtgtggcacgggccgacgggactaacacgtatcgccagacaagtcaccgatagagcccatcagcttgctagcgccttgcgcgcagcgggtcttgacgtcgccgatcagcagtttttcgacaccatccgcatacgcacgaagggcggagcgaaggagctgtggaaccgagcccgcgaaggtgggtacaccctcgatctcgttgacggggacatcctccagatatcggttgacgagaccgtcaccgacgacgagcttcgggaactcacccagctcctgggtggcagcactgacgagattcgtggcccggccgacagggcgtggccggaggatctacgccgcacttcctccttcatgacgcatccggtcttttctagctaccacaccgagaccaccatgatgcgctatctcaagcgtttggcggaccacgattatggtctggaccgcggcatgatcccgctcggttcgtgcacgatgaaactcaatgccgctgccgagatggaggctatgacctggccggctttctcgcagatgcaccccttcgccccggtcgaggaccaagccggtagcctgcgcctcatccgtgacctcgagatctggttagccgagctcaccggctatgacactgtctccctgcagcccaatgcaggttcccagggcgagtacaccggtctggcagccatccgtagctatcacgtctctcgcggtgatactgagcgtaatgtgtgcctggttccagcgtccgcgcatggcactaatgccgcctctgccgcttcggcaggcctcagggttgtcgtcgtcaagtcaaatgacgacggcactatcgaccgtgatgatctggctgccaagattgctgctaacgaggggcgcatcgccgcgatcatgatcacctacccgtcaactcacggcgtctatgaagacggcgtgcgacaggtctgcgacatggtccacgaggcaggcggacaggtctacatcgacggagcaaactttaatgccctcgtcggatggggacagttcgcccgcatcggcggtgacgtgagccacctcaacctgcacaagaccttcgccatcccgcatggaggcggcggtcctggtgttggaccggttgcagccaaggctcacctagctcccttcctgcccggccatcccctcaacccgcgcaacgagcatccactcaatgacggcgggacagttacccacgacggacatgccgtatctgctgcgccgtttgggtcggtgtccgtacttcctatttcctgggcgtatctacggctcatgggcctaaaaggattgcaattcgcgactgaggtggcggttctcaatgccaactacatcgcccaccggctccacgacaagatcccgatcctctacaccggacagaatggctacgtggctcacgaatgcattcttgatctacgtccgttgactaccgagacagggatcaccgtcgacgacgtcgccaagcgcctcatcgactacggattccacgccccgacgatgagcttcccggtagctgggaccctcatggtcgagcccaccgaatcggaagacctcgccgagctggaccgcttctgcgacgccatgctagcgatcgtcgaagaagcccgaatggtgcagtcgggccactggccggctaacgacaacccgttgattaatgctccgcatccagcggctcgtctggtagccgacgagtggaaccacccttactcccgcgagttgggctgctaccccggtatgcgtttggggatccagcgtgaccaagaacgtggcctggacgtcaacaccgtcacccgcatccaagctaagtactggccgccggtgggtcgtgtcgacaacacctacggtgaccgccacctggtgtgctcttgcccgcctccggaggcattcgaagactga

SEQ ID NO: 3033 - protein, 994 aa, Propionibacterium acnes
MTDHAENRCGLEGPRPFSSRHVGSVEDDLRYIAETIGVTSPEQIIRDAIPASVLDSNEGDSSVRTPSFPPAADETTARAELVEIASGNRVTRALIGRGYYGTLTPPVIRRNILENPSWYTAYTPYQPEISQGRLEMLTIYQQLITDLTGLALANSSLLDEATAASEGMLLARRAARKVKSNRFLVHTHLFDQVRDVVLGHAEATGIEVVETDLRDPQSWRPEVEAGCFGVLAPYPDSTGALWNPSEVFDAVHKVGGITIAECDLLSLTLLAPPGELGADVAVGSSQRFGVPMGNGGPHAAYMSVRSGLERQIPGRLVGVSTDADGNPAYRLALQTREQHIRRDKATSNICTAQVLLAVVAAAYAVWHGPTGLTRIARQVTDRAHQLASALRAAGLDVADQQFFDTIRIRTKGGAKELWNRAREGGYTLDLVDGDILQISVDETVTDDELRELTQLLGGSTDEIRGPADRAWPEDLRRTSSFMTHPVFSSYHTETTMMRYLKRLADHDYGLDRGMIPLGSCTMKLNAAAEMEAMTWPAFSQMHPFAPVEDQAGSLRLIRDLEIWLAELTGYDTVSLQPNAGSQGEYTGLAAIRSYHVSRGDTERNVCLVPASAHGTNAASAASAGLRVVVVKSNDDGTIDRDDLAAKIAANEGRIAAIMITYPSTHGVYEDGVRQVCDMVHEAGGQVYIDGANFNALVGWGQFARIGGDVSHLNLHKTFAIPHGGGGPGVGPVAAKAHLAPFLPGHPLNPRNEHPLNDGGTVTHDGHAVSAAPFGSVSVLPISWAYLRLMGLKGLQFATEVAVLNANYIAHRLHDKIPILYTGQNGYVAHECILDLRPLTTETGITVDDVAKRLIDYGFHAPTMSFPVAGTLMVEPTESEDLAELDRFCDAMLAIVEEARMVQSGHWPANDNPLINAPHPAARLVADEWNHPYSRELGCYPGMRLGIQRDQERGLDVNTVTRIQAKYWPPVGRVDNTYGDRHLVCSCPPPEAFED

SEQ ID NO: 3034 - DNA, 2895 bp, Prochlorococcus marinus
  CDS (1)..(2895): transl_table=11
gtgagaaacactaaagcttcaaaattttcagatcgtcatcttggtctcatagaagaggctcaagtagagattttgaatgctttaggacatgccgatataaatgattttatttcttctgttgttcctgaggaaattcttgatgctcaacctccagatgaattgttgccaaaggcattgaatgaaatcgaggcgttagaagaattgcgatcaattgctaagaagaaccaaattaaacgctctttgattggtcttggatattacgggacatacacacctgcagtgattcagcgacatgtttttgaaaaccccgcttggtatacctcatatactccttatcaagctgaaattgcacagggcagattagaagctctctttaattttcagactttaattactgaattaacaggtttacctattgctaatgcttcacttttagatgaaggtactgctgcagctgaggcaatgagccttagttttgcagtaaataagcaaactaaagctcgtaaatttattgttgatgatcaggtacttcctcagacacttgcagttcttaaaacacgagcagagcctttggagttagatatagaggtagttaatcttacagatttagttattaatgaaactgtttttggtctactcattcaattgccagggaaaagtggacaactttgggatccttcttcgctaatcgctcaagctcatgaatttaatgctttagtaactgtagctatagatcctttggcacaggttttaattgctcctatgggtcaacttggcgttgatattgctataggcagttctcagcgttttggagtgcctataggctttggcggccctcatgctgcgttctttgctattaaagaggaatataagcgactagttccaggcagattagtcggtcaatctatagattccaaaggtcattctgcgttgcgattggctttacaaactagagaacagcatattcgcagagataaagctacaagtaatatttgcactgcacaagctctattagcgaccattgcttctttttatgctgtttatcatggaccgcatggtttagaagagatagctaaaaatattatttacctgcgatcacaattagaattatatttaaaagaatttggatatacttttgctcctgactgtcgttttgacacattagaaattcattgcttagaagcaccagaaattcatagattatcaatattaagtggttttaatttaagaattcttcctttaggtgcttctatagaaaaatctaaaggttttgcagtatcttttgatgagttaagcactacaaaagaattatataaattatgcaaaatttttgcagatgtcaaagataagaatttcgagcctagagaaaatactaattttaattttaaggagtctttaacatctttacctttaagaactactccttggttaaagcagcaagtttttaataactatagaactgaaactgagttaatgcggtatatccaaaaattagccagtcgagatttttcattagtcaatggaatgattcctttgggcagttgcacaatgaaattaaatgccacagctgaattgttaccaattacgtggaaagaattttcttcaattcatccttttgttccatctgatcaagcaaaaggttatggatacttgtcagaacaattagaaggttggttgtgtgctcttacaggttttgatggtgtttcgcttcaaccaaatgccggatcccaaggagagtttgcaggcttgctggtaatacgtgcttggcataaagctattaatcaggccgataggaatatttgtttgattcctaaaagtgctcatggaacaaatcccgcaagtgcagtgatggcagggtttaaagttgtagccgtagagtgtgatgaatatggaaatattgattttgaagatcttgttttgaaagtagaaacatattcttctgaattaggggctttaatgattacttatccatctacacatggtgtatttgagcccaatattcggcagatttgcgatcaagttcatctacatggtggtcaagtgtatttagatggagctaatttaaatgcacaagttggactttgtcggccaggtgcgtttggggctgatgtatgccatttaaacttacataagacgttttgcattccccatggaggtggaggcccaggtattggtccaattgctgtggcaaagcatctagttgcttttttaccatcaaagaattttcatgcttctgataataatgctgcaataggagctatatctgcttcacctttaggaagcgcaagtattttgcctattagttggatgtatatacgaatgatgggcgcagatggcctacgtcaagcaagctctttagcaattctttcagcaaattatattgctaataaattagatccttattttcaagttttatttaaagcacctaatgggaaagttgcacatgaatgcattttggacttgagatcaattaaacgtattactggaatcgaagtggatgatgtcgctaagagattaatggattatggattccatgctccaactattagctggccagtggctggtactttgatgattgaaccaacagaaagtgaaagttttgaggaaatcaatcgtttttgtgaggcgatgatttctataaggtcagaaattgatgcgattgagtctggaattactgatttaagtaataaccctttgcgtttggcccctcacacaatggaaacagtcactgctgaaatttgggatagaccatatactcgccaacaggctgcttttccattaaaagatcagtttatgaacaagttttggccagctgtttcaagaatagataatgcttttggtgataggaatttagtttgttcttgtagcactttagaagaactttcagaaacctaa

SEQ ID NO: 3035 - protein, 964 aa, Prochlorococcus marinus
MRNTKASKFSDRHLGLIEEAQVEILNALGHADINDFISSVVPEEILDAQPPDELLPKALNEIEALEELRSIAKKNQIKRSLIGLGYYGTYTPAVIQRHVFENPAWYTSYTPYQAEIAQGRLEALFNFQTLITELTGLPIANASLLDEGTAAAEAMSLSFAVNKQTKARKFIVDDQVLPQTLAVLKTRAEPLELDIEVVNLTDLVINETVFGLLIQLPGKSGQLWDPSSLIAQAHEFNALVTVAIDPLAQVLIAPMGQLGVDIAIGSSQRFGVPIGFGGPHAAFFAIKEEYKRLVPGRLVGQSIDSKGHSALRLALQTREQHIRRDKATSNICTAQALLATIASFYAVYHGPHGLEEIAKNIIYLRSQLELYLKEFGYTFAPDCRFDTLEIHCLEAPEIHRLSILSGFNLRILPLGASIEKSKGFAVSFDELSTTKELYKLCKIFADVKDKNFEPRENTNFNFKESLTSLPLRTTPWLKQQVFNNYRTETELMRYIQKLASRDFSLVNGMIPLGSCTMKLNATAELLPITWKEFSSIHPFVPSDQAKGYGYLSEQLEGWLCALTGFDGVSLQPNAGSQGEFAGLLVIRAWHKAINQADRNICLIPKSAHGTNPASAVMAGFKVVAVECDEYGNIDFEDLVLKVETYSSELGALMITYPSTHGVFEPNIRQICDQVHLHGGQVYLDGANLNAQVGLCRPGAFGADVCHLNLHKTFCIPHGGGGPGIGPIAVAKHLVAFLPSKNFHASDNNAAIGAISASPLGSASILPISWMYIRMMGADGLRQASSLAILSANYIANKLDPYFQVLFKAPNGKVAHECILDLRSIKRITGIEVDDVAKRLMDYGFHAPTISWPVAGTLMIEPTESESFEEINRFCEAMISIRSEIDAIESGITDLSNNPLRLAPHTMETVTAEIWDRPYTRQQAAFPLKDQFMNKFWPAVSRIDNAFGDRNLVCSCSTLEELSET

SEQ ID NO: 3036 - DNA, 2889 bp, Prochlorococcus marinus
  CDS (1)..(2889): transl_table=11
gtgaggcacattgggcccagcttggaagaccagcagcaaatgctgctggagcttggtcatcgtgatcttcagagctttgttgctgctgtagttcctccagacattctcgagacaacggcacccagcagttcccttcctgagggctgtggtgaagttcaggctatggaggaactgcgtctcatcgcggcggcgaatcgggtgaggcgttctttaattgggcttggctattacggcacagcaacgcctgcgttgattcagcgacaggtgcttgaaaatcctgcttggtataccgcttacaccccttatcaggctgagatctctcaaggacggcttgaggctctgttcaactttcagacgctgatcagtgagctcacggggttgccgatcgccaatgcttccttgcttgatgagggaacggcagctgctgaggcgatgagcctcagctttgcgatttgcaagcgccctgcggcccatcgttttctcgtggatgcggaggttcttccccagactcttgccgtgttgagaactcgggctgaacctctgggcattgatctcgaggtggccgagccgatgacctttcagtttgatgctgaggtctttggtgttttgcttcagttgcctggacgtagcggcaggctctgggaccccacgacctccattcaggctgctcatgaggtaggggccctggcaactgttgccattgatcctcttgctcaggttttgcttgctccagtggctgaatttggagctgatattgctgttggcagtgttcaacggtttggggtgccaatgggctttgggggacctcacgccgccttttttgccacccttgagatcttcaagcgccaggtccctggacgtctagtcggccagtctgtggatgcggaggggcaaccggctttgcgattggcgttgcagacccgggagcaacacatccgccgagacaaggccaccagcaatatctgcacggcgcaggtcttattggctgtgatggcgtcgttctatgcagtgcaccatggacccgatgggctcgctgcaatcgctagacgagtcctgcgtttacgggctcaactggagaggggattgcaccagttgggctatccagtccagtcgatagctcgctttgacacgattgaggtgatctgtcgtgaagcccctgctgttcatcaggcagccgctttggcgggatttaacctacgggtgttgcctttgggtgttgctccagaggcagcccatggatttggcattagttttgatgagctcagcaccgatcaggagctgaagtcgatcctccagattttggctgaggctgcaggtcagcctgtgccagttctcgaagaccctggaaaccctcaccttgaggagcttgttggcttgccgttgcgccagcgaccttggttgcagcagcaggtgttccatcgctatcgcagcgaaaccgagctgcttcgttacctccagcgattggtgggccgcgatctttcattggtgcacgggatgatccccctgggtagttgcacgatgaagctcaatgctgcagctgaactgatccccattagttggagggagtttgcggcgctgcatccttttgctcctcaggatcagtgccaggggtatcagagattggttcaggacctggaacattggtttgcagacattactggctttgccggggtgtctttgcagccgaatgccggctctcagggggaattagctggcttgttagtgattcgcgcttggcatcattcccgcggagagcagcagagagatgtttgtctgattcccaccagtgcccatggcaccaatccagccacatgcgtgatggcgggtttgcgggtggtgcctgtggcttgtgatgcagacgggaacgtggatctcaatgatttggccagcaaggcagaggcccatgctcctcagctggcagccctgatggtcacctatccctcaacccatggtgtctttgaaccgcagattcgtgaaatctgtgagctcgttcatggtcacggtggtcaggtgtatctcgatggcgccaatctcaatgcgcagatcggtttttgtcgtcctgggacttatggcgctgatgtttgtcatatcaatctgcacaaaacattttgtatcccccatggcggtggtggaccaggggttggtccgatcgcggtgtctgctcatttgatgcccttccttccaggtcatcccctcgctgcctgcggcggcgagcagggaatcggcgcaatttcggctgcgccatggggcagtgcaggcatcctgccgatcagctggatgtacctgcgcatgatgggtgcggagggattacggcaggccagtgctgttgcactgttatctgctaattacctagcccatcggttgcatcctcattacccggtgctgtttcggggtcaagcagggttggttgcccatgaatgcatcctcgacctgcgcccccttaagcgaagtgcaggcttggaggtggatgacattgcaaagcggttgatggactacggctttcatgccccaaccgtgagctggccggtggcagggactgtgatggtggaacccactgagagcgagagcttggaggagctcaaccgcttctgcgacgccatgattgccatacgggaagaaacggcagcgattgagtcaggccagatcgatcctcagaacaacccgctgcgacgggcgcctcataccttggcggccgtcacagcagaggtttgggatcgtccatactcccgcgccgaagctgctttcccattggctgagcagcgccaaagcaagttttggcctgcggtttcgcgaattgataatgcctatggcgatcgcaatttgctgtgtagctgcccatcggttgaggagcttgctgataacgctgttcttaaacctcccctggtgtga

SEQ ID NO: 3037 - protein, 962 aa, Prochlorococcus marinus
MRHIGPSLEDQQQMLLELGHRDLQSFVAAVVPPDILETTAPSSSLPEGCGEVQAMEELRLIAAANRVRRSLIGLGYYGTATPALIQRQVLENPAWYTAYTPYQAEISQGRLEALFNFQTLISELTGLPIANASLLDEGTAAAEAMSLSFAICKRPAAHRFLVDAEVLPQTLAVLRTRAEPLGIDLEVAEPMTFQFDAEVFGVLLQLPGRSGRLWDPTTSIQAAHEVGALATVAIDPLAQVLLAPVAEFGADIAVGSVQRFGVPMGFGGPHAAFFATLEIFKRQVPGRLVGQSVDAEGQPALRLALQTREQHIRRDKATSNICTAQVLLAVMASFYAVHHGPDGLAAIARRVLRLRAQLERGLHQLGYPVQSIARFDTIEVICREAPAVHQAAALAGFNLRVLPLGVAPEAAHGFGISFDELSTDQELKSILQILAEAAGQPVPVLEDPGNPHLEELVGLPLRQRPWLQQQVFHRYRSETELLRYLQRLVGRDLSLVHGMIPLGSCTMKLNAAAELIPISWREFAALHPFAPQDQCQGYQRLVQDLEHWFADITGFAGVSLQPNAGSQGELAGLLVIRAWHHSRGEQQRDVCLIPTSAHGTNPATCVMAGLRVVPVACDADGNVDLNDLASKAEAHAPQLAALMVTYPSTHGVFEPQIREICELVHGHGGQVYLDGANLNAQIGFCRPGTYGADVCHINLHKTFCIPHGGGGPGVGPIAVSAHLMPFLPGHPLAACGGEQGIGAISAAPWGSAGILPISWMYLRMMGAEGLRQASAVALLSANYLAHRLHPHYPVLFRGQAGLVAHECILDLRPLKRSAGLEVDDIAKRLMDYGFHAPTVSWPVAGTVMVEPTESESLEELNRFCDAMIAIREETAAIESGQIDPQNNPLRRAPHTLAAVTAEVWDRPYSRAEAAFPLAEQRQSKFWPAVSRIDNAYGDRNLLCSCPSVEELADNAVLKPPLV

SEQ ID NO: 3038 - DNA, 2907 bp, Prochlorococcus marinus
  CDS (1)..(2907): transl_table=11
atgtcaaaagcagaattaaaggatttcacttttaagtctcgccatataggtccaactaacgaagatgaagctttaatgcttcaacatcttggttatgagaatgcggaagaatttatatcttctgtcattcccaatgaaatatttgattcagaaaacaatggtgtttctatcccagatgggtgtgatcaaaataaagcgttaacagaaatcaatataatttcaaagaaaaatgttgaacatcgttcgctgattggtctgggttatcattcgactgttatacctccagttatacaaagaaatgttctagaaaatcctaattggtatacagcttatactccttatcaagcagaaatatctcaaggcagattagaagctttatttaattttcagacgttaataagtgaattaacaggcttacccatatcaaatgcgtctttacttgatgaagccactgcggcagctgaggcaattagtttgagtttgactgttagaaaaaataaaaatgctaataagtttttagtagatcaagaaattttgcctcaaacacttgatgtattaaaaacccgatgcgaaccgctaggcatttcccttgagatgtttgataacaataattttgaaatcgataaaaatgtttttggaattcttattcagttaccaggaaaaaatggtcgtatttgggacccaaccaaaataattaatgacgcacataaatgtaatgcaattgtgaccattgcaattgatcctttagctcaagttttgattaaacctatgggcgaatttggtgcagatattgtagttggaagtgcacaaagatttggagttccaattgcttttggtggaccacatgccgctttttttgcaactaaagaaatatataaaagacaaatacccggaaggatagttgggcaatcagttgacgtagaaggaaatcaagcattgaggcttgcacttcaaactagagagcaacatattcgaagagataaagcaacaagtaatatttgcacagctcaagttttactagctgttctttcttctttttatgcagtacatcacggcccaaaaggtcttaagcaaatagcagaaaatgtggtcaaatatagatcaaattttgaatccatattaatgaatttagaataccctatagaaaaatattcagcatttgacagtgttgatgtttattgttcagaagcatcggaagttattcagctagcgtctgaagaaggatataacttaagagttcttcctatcggatcagattttgaaaatgctaagggttttggtgtgacttttgatgaattaacatgtgatgaagaaatttataaattgcatcaaatacttgcacaagttaaaggaaaaaaaactcatgatctttccaattttatttttgagaatgcttcactaattgatattccactccgagaaaaatcttggcttgaacaatcggtatttaatcaatatcaaagtgagactgatttaatgagatacatacattgcttagtatcgaaagatttttctttagttcaaggaatgattcctcttgggagttgcacaatgaaattgaatgcagctgcggaacttttacccattgaatggagagagttttcctctattcatccttttgctcctcatactcaattaactggattccacgaaataattaacgaccttgaaaattggctgtctgctttaacaggctttcagggagtttctcttcagccaaatgcaggttctcaaggagaatttgctggtttgcttgtaatacgttcatggcatcagtctctgggagagggccataggaatatttgcttgattccaacaagtgctcacggtaccaatccagctagtgcggtaatgtctggctttaaagttgtttctgttaaatgtgatgaatatggcaatgttgatttagaagacttaaagaataaatcaaaaattcattcaaagaatttggctgcattgatggttacctacccatcaactcatggagtatttgagccaaatatccgtgaaatgtgccaagtcattcatcaagagggtggtcaggtctatttggatggagcaaatttgaatgctcaggtaggtatttgcaggcctggatcttatggaatagatgtgtgccatttaaatcttcataaaactttttccattcctcatggtggaggcggccccggagtaggtcctatagctgtagcagatcatttggttccttatctgcctggacattcaattatcaagtgcggaggccaaaaggctatttcggcagtatctgcagctccatttggtagcgctggaatattgcccatcagttggatgtacatccgaatgatgggtagcgatgggttacgcaaagcgagttctatagcaattctctctgctaattatttagcaaaaagacttgatccttattatccagttttatttaaagatcccaatgggctagtagctcatgaatgcatattagatttacgaccattaaagagtcagttaggcatagaagtagaggatgttgccaagagattgatggattatggatttcatgcaccaacaataagttggcctgttgctggaactttgatggttgaaccaacagagagtgaaagtttgcctgaattagatcgtttttgtgacgcgatgataggaatacgagaagaaattgaacaaataaaattaggaaagattgatccaataaataatcctttaaaacaatctccacatactttaaaaacagttacctcggatgattgggatagaccttattctcgtaaagaagctgcttatccattgcctgatcaagaaaaatataaattttggccatcagtttcacgtattaataatgcttatggagacaggaatttgatttgtagttgtccttcagttcaagatttagaagatattaattctgtttga

SEQ ID NO: 3039 - protein, 968 aa, Prochlorococcus marinus
MSKAELKDFTFKSRHIGPTNEDEALMLQHLGYENAEEFISSVIPNEIFDSENNGVSIPDGCDQNKALTEINIISKKNVEHRSLIGLGYHSTVIPPVIQRNVLENPNWYTAYTPYQAEISQGRLEALFNFQTLISELTGLPISNASLLDEATAAAEAISLSLTVRKNKNANKFLVDQEILPQTLDVLKTRCEPLGISLEMFDNNNFEIDKNVFGILIQLPGKNGRIWDPTKIINDAHKCNAIVTIAIDPLAQVLIKPMGEFGADIVVGSAQRFGVPIAFGGPHAAFFATKEIYKRQIPGRIVGQSVDVEGNQALRLALQTREQHIRRDKATSNICTAQVLLAVLSSFYAVHHGPKGLKQIAENVVKYRSNFESILMNLEYPIEKYSAFDSVDVYCSEASEVIQLASEEGYNLRVLPIGSDFENAKGFGVTFDELTCDEEIYKLHQILAQVKGKKTHDLSNFIFENASLIDIPLREKSWLEQSVFNQYQSETDLMRYIHCLVSKDFSLVQGMIPLGSCTMKLNAAAELLPIEWREFSSIHPFAPHTQLTGFHEIINDLENWLSALTGFQGVSLQPNAGSQGEFAGLLVIRSWHQSLGEGHRNICLIPTSAHGTNPASAVMSGFKVVSVKCDEYGNVDLEDLKNKSKIHSKNLAALMVTYPSTHGVFEPNIREMCQVIHQEGGQVYLDGANLNAQVGICRPGSYGIDVCHLNLHKTFSIPHGGGGPGVGPIAVADHLVPYLPGHSIIKCGGQKAISAVSAAPFGSAGILPISWMYIRMMGSDGLRKASSIAILSANYLAKRLDPYYPVLFKDPNGLVAHECILDLRPLKSQLGIEVEDVAKRLMDYGFHAPTISWPVAGTLMVEPTESESLPELDRFCDAMIGIREEIEQIKLGKIDPINNPLKQSPHTLKTVTSDDWDRPYSRKEAAYPLPDQEKYKFWPSVSRINNAYGDRNLICSCPSVQDLEDINSV

SEQ ID NO: 3040 - DNA, 2865 bp, Pseudomonas syringae pv
  CDS (1)..(2865): transl_table=11
atgactgaccgtattgaactgaccactgccaacgaattcatcgcccgtcacattggcccgcgcgctgccgacgaacaggccatgttacagacgctgggtttcgactccattgaagcgctgagcgaaagcgttatcccggaaagcatcaagggcaccagcgtgctgaacctgcctgccgggcagagcgaagccgatgcgctggcgtccatcaaggccatcgccagcaagaatcaactgttcaagacctacatcggccagggttactacaacacccacacgccggcaccgatcctgcgcaatctgctggaaaacccggcctggtacaccgcctacacgccctatcagccggagatttcccaaggtcgtctggagtcgctgctcaattttcagacgctgatcagcgacctgaccggcctgccgattgccaacgcgtccttgctcgacgaagcgaccgctgctgccgaagcaatgaccttttgcaaacgcttgagcaagaacaaaggcagccagcagtttttcgcctccagccactgccacccgcagacacttgatgtgttgcgtacccgtgccgagccattgggtatcaccgttgtggtggcggacgaagccgagttgggcgacgtcagcgattactttggtgcgttgctgcaatacccggccagcaacggcgacgtgttcgattaccgcgagctggtcgaacgtttccatgctgccaacgcgctggtcgccgtggctgccgacttgctggcactgacgttgctgaccccgccaggcgaatttggcgccgacgtggccatcggcagcgcacaacgcttcggtgtaccgctgggcttcggcggcccgcatgcggcttacttctcaacccgcgatgccttcaagcgcgacatgccgggccgcctggtcggcgtatcggtggaccggcacggcaagcaggccctgcgtcttgccatgcagacccgcgaacagcatattcgtcgcgagaaggccaccagcaacatttgcactgcacaggtcctgctggccaacatcgccagcatgtacgccgtctaccatggcccgcgcggcctgacacagatcgccaaacgcgttcaccagttgaccgcgatccttgccgaaggcttgagcacgctgggtctgaaggccgagcaggcattcttcttcgacagcctgaccctgaacaccggcagcaggaccgcggcgctgcacgcagcggctcgcgccaggcacatcaacctgcgtgaaatcgacgaccagcacctgggtctgtcactggacgaaaccacctcgcaatcggcagttgaaacgctgtgggaaatcttcgccagcgacggtcagaacctgcccgacttcaccgcactggcagccagcgtcccgtcgcgcctgcccgctacactgctgcgccagtcggcaatcctcagccacccggtgttcaaccgctaccactctgaaaccgaactgatgcgctacctgcgcaagctggctgacaaggatctggcgctggaccgcaccatgattccactgggctcgtgcaccatgaagctcaacgccgccagtgaaatgatcccggtgacctgggccgaattcggcaacctgcacccgttcgccccggccgagcagagcaccgggtatcaacaattgaccgacgagctagaggccatgctctgtgcggccaccggctatgacgcaatctcgctgcaaccgaacgccggctcccagggtgaatatgccggcctgctggccatccgcgcttatcaccagagccgtggcgatgagcatcgcgatatctgcctgatcccttcatcggcacacggcaccaacccggccacagccaacatggccggtatgcgtgtcgtggtcaccgcctgcgatgcacgtggcaacgtcgatatcgaagacctgcgcgccaagaccgttcaacaccgcgaccagcttgcggcgatcatgatcacctacccgtcgacccacggcgtgttcgaagaaggcatccgtgaaatctgcggtatcgttcacgacaacggtggccaggtctacattgacggcgccaacatgaacgccatggtcggcctgtgcgctccgggcaaattcggtggcgatgtatcgcacctcaacctgcacaagaccttctgcattccgcacggcggcggtggcccaggcgttggtccgatcggcgtcaaatcccatctcgccccgttcatgccgggccatgcacgcatggagcgcaaggaaggcgcagtctgcgcagccccgttcggcagcgccagcatcctgccaatcacctggatgtacatccgcatgatgggcggcgaaggcctgaaacgcgcttcgcaattggcgatcctcaacgccaactacatttcgcgccgcctggaagagcactacccggtgctgtacaccggcaccaacgggctggttgcccacgaatgcatccttgacctgcgccctatcaaggacagcagcggcatcagcgtcgatgacgtggccaagcgtctgatcgactttggcttccatgccccgaccatgtcgttcccggttgccgggaccttgatgatcgagccgaccgagagcgagtccagagaggaactggaccgtttctgcgacgccatgatcaagatccgtgaagaaatacgcgcggttgaaaacggcacactggacaaagacgacaacccgttgaaaaacgcaccgcacaccgctgcggaaatcgtcggccagtggagccatccttacagccgcgaacaggcggtgtatccggttgattcgttgatcgagaacaagtactggcctccggtcggccgtgtcgacaacgtcttcggcgaccgcaatctggtctgtgcctgcccgtccatcgagagctatcaggaagcctga

SEQ ID NO: 3041 - protein, 954 aa, Pseudomonas syringae pv
MTDRIELTTANEFIARHIGPRAADEQAMLQTLGFDSIEALSESVIPESIKGTSVLNLPAGQSEADALASIKAIASKNQLFKTYIGQGYYNTHTPAPILRNLLENPAWYTAYTPYQPEISQGRLESLLNFQTLISDLTGLPIANASLLDEATAAAEAMTFCKRLSKNKGSQQFFASSHCHPQTLDVLRTRAEPLGITVVVADEAELGDVSDYFGALLQYPASNGDVFDYRELVERFHAANALVAVAADLLALTLLTPPGEFGADVAIGSAQRFGVPLGFGGPHAAYFSTRDAFKRDMPGRLVGVSVDRHGKQALRLAMQTREQHIRREKATSNICTAQVLLANIASMYAVYHGPRGLTQIAKRVHQLTAILAEGLSTLGLKAEQAFFFDSLTLNTGSRTAALHAAARARHINLREIDDQHLGLSLDETTSQSAVETLWEIFASDGQNLPDFTALAASVPSRLPATLLRQSAILSHPVFNRYHSETELMRYLRKLADKDLALDRTMIPLGSCTMKLNAASEMIPVTWAEFGNLHPFAPAEQSTGYQQLTDELEAMLCAATGYDAISLQPNAGSQGEYAGLLAIRAYHQSRGDEHRDICLIPSSAHGTNPATANMAGMRVVVTACDARGNVDIEDLRAKTVQHRDQLAAIMITYPSTHGVFEEGIREICGIVHDNGGQVYIDGANMNAMVGLCAPGKFGGDVSHLNLHKTFCIPHGGGGPGVGPIGVKSHLAPFMPGHARMERKEGAVCAAPFGSASILPITWMYIRMMGGEGLKRASQLAILNANYISRRLEEHYPVLYTGTNGLVAHECILDLRPIKDSSGISVDDVAKRLIDFGFHAPTMSFPVAGTLMIEPTESESREELDRFCDAMIKIREEIRAVENGTLDKDDNPLKNAPHTAAEIVGQWSHPYSREQAVYPVDSLIENKYWPPVGRVDNVFGDRNLVCACPSIESYQEA

SEQ ID NO: 3042 - DNA, 2865 bp, Pseudomonas syringae pv
  CDS (1)..(2865): transl_table=11
atgactgaccgcattgaactgaccaccgccaacgaattcattgcccgccacattggcccgcgtgccgctgacgagctggccatgctgcacaccctgggttttgactccattgaagcactcagcgacagcgtgatcccggaaagcatcaagggcaccagcgtgctgaacctgcctgccgggcagagcgaagccgatgcactggcctccatcaaggccatcgccagcaagaaccagctgttcaagacctacatcggtcagggttactacaacacccacacacccgccccgattctgcgcaacctgctggaaaacccggcctggtataccgcctacacgccctaccagcctgagatttcccaaggccgtctggagtcgctgctcaatttccagaccctgatcagcgacctgaccggcctgccgattgccaacgcctcgctgctcgacgaagccactgccgctgccgaagcgatgacgttctgcaagcgcctgagcaagaacaaaggcagccagcagttcttcgcctccagccactgccacccgcagacactcgatgtgctgcgcactcgcgccgagccgctgggcatcaccgttgtggtggccgatgaaaccgaactgggcgatgtcagcgactactttggtgcgctgctgcagtacccggccagtaatggcgacgtattcgactaccgcgaactggccgagcgctttcacggggcaaacgcactggtggcggtcgccgccgacctgctggccctgaccctgctgaccccgccgggtgaattcggtgccgacgtggccatcggcagcgcgcaacgctttggcgtaccgctgggctttggtggcccgcacgcggcctatttctcgacgcgcgatgcgttcaagcgtgacatgccgggccgtctggttggcgtgtcggtggatcgccacggcaaacaggctctgcgcctcgccatgcagacccgcgaacaacacattcgtcgcgaaaaggccaccagcaacatctgcaccgcgcaagtgctgctggccaacatcgccagcatgtacgccgtgtatcacggcccgcgcggcctgacacagatcgccaatcgtgtgcaccacctgaccgcgatcctggccgaaggcttgagccagttgggcctcaacgccgagcaggcctatttcttcgacagcctgactttgcacactggcggccggaccgccgcgctgcacgctgccgcccgcgcccgccacatcaacctgcgcgaaatcgacgaccagcgtctgggcctgtcgcttgacgaaaccacctcgcagtcagcggtcgaagtgctctgggacattttcgccagcacgggccagactctgccggacttcaccgcattggccgccagcgtcaagtcgcgcctgccagcagccttgctgcgccagtcggcgatcctcagccacccggtgttcaaccgctatcactcggaaaccgagctgatgcgctacctgcgcaaactggccgacaaggacctggcgctggaccgcaccatgatcccgctcggctcgtgcaccatgaaactcaatgcggccagcgaaatgatcccggtaacctgggccgagttcggcaacctgcacccgttcgcccccgccgagcaaagcgccggttaccagcaactgaccgacgagttggaggccatgctctgcgccgccaccggctatgacgccatttcgctgcaacccaacgccggttcgcagggtgaatacgccggcctgctggccattcgcgcctaccaccagagccgtggcgatgaacaccgcgacatctgcctgatcccttcgtcggcccacggcaccaacccggcgaccgctaacatggccggcatgcgcgtggtggtgacagcctgcgatgcgcgcggcaacgtcgacatcgaagacttgcgggccaaggcacttcaacaccgcgagcagcttgcggcgatcatgatcacctacccgtcgacccacggcgtgttcgaagagggcattcgcgaaatctgcggcatcgttcatgacaacggcggccaggtctacatcgacggtgccaacatgaacgcgatggttggcctttgcgctccgggcaagttcggcggcgacgtgtcgcacctcaacctgcacaagaccttctgcattcctcacggcggcggcgggccgggcgtgggtccgatcggcgttaaatcgcacctcgcaccgttcatgccgggccacgcacgcatgcaacgcaaggaaggcgcggtctgcgcagcgccgttcggcagcgccagcatcctgccgatcacctggatgtacatccgcatgatgggcggcgaaggtctgaaacgcgcctcgcaattggcgatcctcaacgccaactacatttcgcgtcgcctggaagagcactacccggtgctgtacaccggcaccaacgggctggtagcccacgaatgcatccttgacctgcgcccgatcaaagacagcagcggcatcagcgtcgatgacgtggccaaacgcctgatcgacttcggcttccatgccccgaccatgtcgttcccggtcgctggaacgttgatgatcgagccgaccgaaagcgaatcccgcgaagaactggaccgtttctgcgacgccatgatcaagatccgcgaagaaatccgcgcagtcgaagacggcaccctggacaaagacgacaacccgttgaaaaacgccccgcataccgcggcggaaatcgtcggccagtggagccatccttacagccgcgagcaggcggtgtacccggtcgattcgctgatcgagaacaagtactggcctccggtcggacgcgtcgacaacgtattcggtgaccgcaatctggtctgtgcctgcccttccatcgagagctatcaggaagcctga

SEQ ID NO: 3043 - protein, 954 aa, Pseudomonas syringae pv
MTDRIELTTANEFIARHIGPRAADELAMLHTLGFDSIEALSDSVIPESIKGTSVLNLPAGQSEADALASIKAIASKNQLFKTYIGQGYYNTHTPAPILRNLLENPAWYTAYTPYQPEISQGRLESLLNFQTLISDLTGLPIANASLLDEATAAAEAMTFCKRLSKNKGSQQFFASSHCHPQTLDVLRTRAEPLGITVVVADETELGDVSDYFGALLQYPASNGDVFDYRELAERFHGANALVAVAADLLALTLLTPPGEFGADVAIGSAQRFGVPLGFGGPHAAYFSTRDAFKRDMPGRLVGVSVDRHGKQALRLAMQTREQHIRREKATSNICTAQVLLANIASMYAVYHGPRGLTQIANRVHHLTAILAEGLSQLGLNAEQAYFFDSLTLHTGGRTAALHAAARARHINLREIDDQRLGLSLDETTSQSAVEVLWDIFASTGQTLPDFTALAASVKSRLPAALLRQSAILSHPVFNRYHSETELMRYLRKLADKDLALDRTMIPLGSCTMKLNAASEMIPVTWAEFGNLHPFAPAEQSAGYQQLTDELEAMLCAATGYDAISLQPNAGSQGEYAGLLAIRAYHQSRGDEHRDICLIPSSAHGTNPATANMAGMRVVVTACDARGNVDIEDLRAKALQHREQLAAIMITYPSTHGVFEEGIREICGIVHDNGGQVYIDGANMNAMVGLCAPGKFGGDVSHLNLHKTFCIPHGGGGPGVGPIGVKSHLAPFMPGHARMQRKEGAVCAAPFGSASILPITWMYIRMMGGEGLKRASQLAILNANYISRRLEEHYPVLYTGTNGLVAHECILDLRPIKDSSGISVDDVAKRLIDFGFHAPTMSFPVAGTLMIEPTESESREELDRFCDAMIKIREEIRAVEDGTLDKDDNPLKNAPHTAAEIVGQWSHPYSREQAVYPVDSLIENKYWPPVGRVDNVFGDRNLVCACPSIESYQEA

SEQ ID NO: 3044 - DNA, 2865 bp, Pseudomonas syringae pv
  CDS (1)..(2865): transl_table=11
atgactgaccgtatcgaactgaccactgccaacgaattcattgcccgtcacattggcccgcgcgcggctgacgagctggccatgctgcaaacactgggtttcgattccatcgaagcgctgagcgaaagcgttatcccggaaagcatcaagggcaccagcgttctgaacctgcctgccgggcagagcgaagccgatgcgctggcgtccatcaaggccatcgccagcaagaaccagctgttcaagacctacatcggccagggttactacaacacccacacaccagcaccgatcctgcgcaacctgctggaaaacccggcctggtacaccgcttacacgccttaccagccagagatttcccagggccgcctggagtcactgctcaatttccagacactgatcagcgacctcaccggcctgccgattgccaacgcctctctgctcgacgaagccaccgccgccgccgaggcaatgaccttttgcaaacgcttgagcaaaaacaaggccagccagcagtttttcgcgtccagccactgccacccgcaaactctggatgtgttgcgtactcgcgccgagccgttgggcattaccgtggtcgtggccgatgagcacgagctgggcgatgtcagcgattacttcggcgcgctgctgcaatatccggccagcaatggcgacgtgttcgattaccgcgaactggtcgaacgcttccacgcggccaacgcactggttgcagtggctgccgacctgctggccctcaccctgctgaccccgccaggcgaattcggcgctgacgtagcgattggtagcgcgcaacgcttcggtgtgccactgggcttcggtggcccgcatgcggcctacttctcgacccgcgacgcgttcaagcgtgacatgccgggccgtctggtcggcgtgtcggtagaccgtcacggcaagcaggccctgcgcctggccatgcagacccgcgaacagcatattcgtcgcgaaaaggccaccagcaacatctgcaccgcacaggtgctactggccaacatcgccagcatgtacgccgtctaccatggtccgcgcggcctgacacagatcgccaatcgtgttcaccagctgaccgcgattcttgccgaaggcctgagcacgctgggcctgaacgccgagcaggcatttttcttcgacagcctgacactgcacaccggcgacagaaccgctgcactgcatgccgccgcacgcgccaggcacatcaacctgcgcgaaatcgatgaccagcgtctgggtctgtcactggacgagaccacctcgcagtcggccgtcgaaacgctgtgggcaatctttgccaacgacggccagagcctgccggacttcgccgcgctggcagacagcgtgcagtcgcgcctgccggccgggctgttgcgtcagtcagcgatcctcagtcacccggtgttcaaccgctatcactcggaaaccgagctgatgcgctacctgcgcaagctggccgacaaggacctggcgctggatcgcaccatgattccgctgggctcgtgcaccatgaagctcaacgccgccagcgaaatgatcccggtgacctgggccgagttcggcaacctgcacccgtttgccccggccgagcaaagcgccggttaccagcaactgaccgatgagctggaggccatgctctgtgcggccaccggttacgacgcgatctcgctgcaaccgaacgccggctcgcagggcgaatacgccggattgctggctatccgcgcctatcaccagagccgtggcgacgaacatcgcgacatctgcctgatcccttcctcggcgcacggtaccaacccggcgactgccaacatggccggtatgcgcgtcgtggtgaccgcctgcgatgcacgcggcaacgtcgacatcgaagacctgcgcgccaaggccgttcagcatcgcgaccagcttgcggcgatcatgatcacctacccgtcgacccacggcgtgttcgaagaaggcattcgcgaaatctgcggcatcgttcatgacaacggtggccaggtctatatcgatggcgcaaacatgaacgccatggttggcctgtgcgcaccgggcaagttcggcggcgacgtatcgcacctcaacctgcacaagactttctgcatcccccacggcggtggcggcccgggcgttggcccgatcggcgtgaaatcccatctcgccccgttcatgcccggtcatgcccgcatggagcgcaaggaaggcgcggtctgcgcggcaccgttcggcagcgccagcattctgcccattacctggatgtacatccgcatgatgggcggtgaaggcctcaagcgcgcttcgcaactggcgattctcaacgccaactacatctcgcgccgtctggaggagcattacccggtgctctacaccggcagcaacggcctggtcgcgcacgagtgcattctcgacctgcgcccgatcaaggacagcagcggcatcagcgtcgacgacgtggccaagcgcctgatcgacttcggcttccatgccccgaccatgtcgttcccggtcgccggaacactgatgatcgagccgaccgagagtgaatcccgagaagaactggaccgcttctgcgatgccatgatcaagatccgcgaagaaatccgcgcagttgaaaacggcaccctggacaaggatgacaacccgctgaaaaacgcgccgcacaccgctgccgaaatcgtcggccagtggagccatccttacagccgcgaacaggcggtgtacccggtcgattcactgatcgagaacaagtactggcctccggtcggtcgtgtcgacaacgtcttcggcgaccgcaacctggtatgcgcctgcccgtccatcgagaactatcaggaagcgtga

SEQ ID NO: 3045 - protein, 954 aa, Pseudomonas syringae pv
MTDRIELTTANEFIARHIGPRAADELAMLQTLGFDSIEALSESVIPESIKGTSVLNLPAGQSEADALASIKAIASKNQLFKTYIGQGYYNTHTPAPILRNLLENPAWYTAYTPYQPEISQGRLESLLNFQTLISDLTGLPIANASLLDEATAAAEAMTFCKRLSKNKASQQFFASSHCHPQTLDVLRTRAEPLGITVVVADEHELGDVSDYFGALLQYPASNGDVFDYRELVERFHAANALVAVAADLLALTLLTPPGEFGADVAIGSAQRFGVPLGFGGPHAAYFSTRDAFKRDMPGRLVGVSVDRHGKQALRLAMQTREQHIRREKATSNICTAQVLLANIASMYAVYHGPRGLTQIANRVHQLTAILAEGLSTLGLNAEQAFFFDSLTLHTGDRTAALHAAARARHINLREIDDQRLGLSLDETTSQSAVETLWAIFANDGQSLPDFAALADSVQSRLPAGLLRQSAILSHPVFNRYHSETELMRYLRKLADKDLALDRTMIPLGSCTMKLNAASEMIPVTWAEFGNLHPFAPAEQSAGYQQLTDELEAMLCAATGYDAISLQPNAGSQGEYAGLLAIRAYHQSRGDEHRDICLIPSSAHGTNPATANMAGMRVVVTACDARGNVDIEDLRAKAVQHRDQLAAIMITYPSTHGVFEEGIREICGIVHDNGGQVYIDGANMNAMVGLCAPGKFGGDVSHLNLHKTFCIPHGGGGPGVGPIGVKSHLAPFMPGHARMERKEGAVCAAPFGSASILPITWMYIRMMGGEGLKRASQLAILNANYISRRLEEHYPVLYTGSNGLVAHECILDLRPIKDSSGISVDDVAKRLIDFGFHAPTMSFPVAGTLMIEPTESESREELDRFCDAMIKIREEIRAVENGTLDKDDNPLKNAPHTAAEIVGQWSHPYSREQAVYPVDSLIENKYWPPVGRVDNVFGDRNLVCACPSIENYQEA

SEQ ID NO: 3046 - DNA, 2931 bp, Ralstonia eutropha
  CDS (1)..(2931): transl_table=11
atgaacgccccgcttcccatgaccgccacccaaggtaaccggcccacgctggccgaactggaggcgcgcgacgccttcgccgcccgccatatcggacccgacacccccgaacagcagcacatgctcaaggtgctcggctatgacagccgcgccgcgctgatcgacgctgtgatccccgaggccatccgccgccgcgacggcatgccgatgggcgagttcaccgagccgctgcccgaggaagccgcgctggcgaagctgcgcaagctcgctggcaagaacaaggtcctgaagagctttatcggccagggctactacaacacgctgaccccggccgtggtcctgcgcaatatcttcgagaaccccgcctggtacaccgcctacacgccctaccagccggaaatctcgcaaggccgtctggaagcgatgctgaacttccagcaaatggtcaccgacctgactggcctggacatcgccaacgcgtcgatgctcgacgaaggcaccgccgcggccgaagccatgacgctgctgcagcgcgtgaacaagcatgcgtcgaacacgttctacgtggctgacgatgtactgccgcagacgctggaagtggtacgcacccgagccaagccgctgggcattgaagtcaaggtcggccccgctgccgatgctgctgccgcccacgcgttcggcgtgctgctgcaatacccgggcgtcaatggtgacgtcacggactaccgcgccattgccgatgccgtgcacgcggccggcggcctggtggtggctgccgccgacctgctcgcgctgacgctgattacggcgccgggcgaatggggcgccgacgtcgccgtgggcaactcgcagcgttttggcgtgccgctcggttttggcggcccgcacgctggctacatggccgtcaaggacgcgttcaagcggtcgatgccgggccgcctcgtcggcgtgaccgtcgatgcgcagggcaacaaggcctatcgcctggccctgcagacgcgcgaacagcatatccgccgcgaaaaggccacttccaacatctgtaccgcgcaggtgctgctggccgtgatggcgtcgatgtacgctgtgtaccacggcccgcaaggcctcaagcgcattgcgcagcgcgtgcatcgcctgaccgccacgctggccgccggcctgcagaccctgggcttcacgcgcaccaacgcgacgttcttcgacacgctgacgttcgagaccggcttcaacaccgacgcgatccacgctgccgcaaccgcacgcggcatcaacctgcgccatgcgggcgcgacgcgcattggcgtatcgctcgacgaaaccgcgacgcgcgatgatgtcgtggcgctgtgggaaatcttctcgcacggcaagccgctgcccgcctcgctgacgttcgatgcaatcgaagccgcggccgaggatgcgttcccggccaatcttgcccgcaccagcgcatacctgacgcacccggtcttcaacacgcaccacgccgagcatgagatgctgcgctacctgcgcatgctggcggacaaggacctggcgctggaccgcaccatgattccgctcggttcgtgcacgatgaagctgaacgcgaccagcgagatgatcccggtgacctggcccgagttcagccagatccacccgttcgcaccgctggaccagaccgtgggctaccgcgagatgatcgaccagctcgaggccatgctgtgcgcggccaccggctacgcggccgtgagcctgcagccgaacgccggctcgcagggcgagtacgcgggcctgctgatcatccacgcctaccacgcgagccgcggcgagagccatcgcgacatctgcctgattccgtcgtcggcgcacggcaccaacccggcgtcggcgcagatggccggcatgaaggttgtcgtcgtcgcgtgcgatgaaaacggcaacgtcgacctggaagacctggcgaagaaggccgaactgcacagcaagaacctggcggccatcatgatcacctacccgtccacgcatggcgtgttcgagcagggcgtgcagcagatttgcgagatcgtgcaccagcacggcggccaggtgtatgtcgacggcgccaacatgaacgcgatggtaggcacggcggcgccgggccacttcggcggcgacgtgtcgcacctgaacctgcacaagaccttctgcattccgcacggcggtggcggccccggcgtgggccccgtggcagtcggcgcgcacctggctgatttcctgccgaaccaggacagcgtcggctatcgtcgcgacgacaacggcattggtggcgtatcggccgcgccgttcggctcggccagcatcctgccgatctcgtggatgtacatcgcgatgatgggctcggccggcctgaccgccgcgaccgagaacgcgatcctgaccgccaactatgtcgccaagcgcctgtcgccgcactacccggtgctgtacacgggccagcacggcctggtggcgcacgaatgcatcctggatctgcgcccgctgcagaaggaaaccggcatcagcaacgaagacgtcgccaagcgcctgatggactacggcttccacgcgccgaccatgagcttcccggtgccgggcacgctgatgatcgagccgaccgagagcgaagcactgcacgaactcgaccgcttcatcgacgccatgatcgccatccgcaaggaaatcggccgcgtcgaagacggcagcttcgaccgtgacgacaacccgctcaagcacgcgccgcacaccgcggccgtggtcacggccaacgagtggacgcgcaaatacacacgtgaagaagccgcctatccggtggcatcgctgcgcacgcagaagtactggccgcccgtcggccgtgccgacaacgtgtatggcgaccgcaacctgttctgcagctgcgtgccgatgagcgagtacgcgcaggactga

SEQ ID NO: 3047 - protein, 976 aa, Ralstonia eutropha
MNAPLPMTATQGNRPTLAELEARDAFAARHIGPDTPEQQHMLKVLGYDSRAALIDAVIPEAIRRRDGMPMGEFTEPLPEEAALAKLRKLAGKNKVLKSFIGQGYYNTLTPAVVLRNIFENPAWYTAYTPYQPEISQGRLEAMLNFQQMVTDLTGLDIANASMLDEGTAAAEAMTLLQRVNKHASNTFYVADDVLPQTLEVVRTRAKPLGIEVKVGPAADAAAAHAFGVLLQYPGVNGDVTDYRAIADAVHAAGGLVVAAADLLALTLITAPGEWGADVAVGNSQRFGVPLGFGGPHAGYMAVKDAFKRSMPGRLVGVTVDAQGNKAYRLALQTREQHIRREKATSNICTAQVLLAVMASMYAVYHGPQGLKRIAQRVHRLTATLAAGLQTLGFTRTNATFFDTLTFETGFNTDAIHAAATARGINLRHAGATRIGVSLDETATRDDVVALWEIFSHGKPLPASLTFDAIEAAAEDAFPANLARTSAYLTHPVFNTHHAEHEMLRYLRMLADKDLALDRTMIPLGSCTMKLNATSEMIPVTWPEFSQIHPFAPLDQTVGYREMIDQLEAMLCAATGYAAVSLQPNAGSQGEYAGLLIIHAYHASRGESHRDICLIPSSAHGTNPASAQMAGMKVVVVACDENGNVDLEDLAKKAELHSKNLAAIMITYPSTHGVFEQGVQQICEIVHQHGGQVYVDGANMNAMVGTAAPGHFGGDVSHLNLHKTFCIPHGGGGPGVGPVAVGAHLADFLPNQDSVGYRRDDNGIGGVSAAPFGSASILPISWMYIAMMGSAGLTAATENAILTANYVAKRLSPHYPVLYTGQHGLVAHECILDLRPLQKETGISNEDVAKRLMDYGFHAPTMSFPVPGTLMIEPTESEALHELDRFIDAMIAIRKEIGRVEDGSFDRDDNPLKHAPHTAAVVTANEWTRKYTREEAAYPVASLRTQKYWPPVGRADNVYGDRNLFCSCVPMSEYAQD

SEQ ID NO: 3048 - DNA, 2949 bp, Ralstonia solanacearum
  CDS (1)..(2949): transl_table=11
atgaacgctccgcaccccgcttccgcggccctgacccagaccctcgccgcacgccccaccctggccgagctggaggcgcgcgacgccttcgccgaacgccacatcggcccgtcgcccgatgagcaggccgcgatgcttgccaccctcggctacgctagccgcgccgcgctgatcgacgccgtgatcccgcccgccatccgccgccaggacggcatgccgctgggcgagttcacccagccgctgacggaagaagcggcgctggccaagctgcgcggcatcgccggccagaaccgcgtggtcaggagcctgatcggccagggctactacggcacccatacgccgggcgtgatcctgcgcaacattctcgagaacccggcctggtacaccgcctacacgccctaccagcccgagatctcgcaaggccgcctggaagcgatgctgaacttccagcagatggtgatggacctgacggcgatggatatcgccaacgcgtcgatgctcgacgaagccaccgccgccgccgaagcgatgacgctgctgcagcgcgtgggcaagcacccgtccaacgtcttcttcgtggctgacgacgtgctgccgcagacgctggacgtggtgcgcacgcgcgccgagccgatcggcgtacaggtcgtgaccggtccggccgccgacgccgccaagcacaacgccttcggcgtgctgctgcagtatccgggcaccggcggcgcgctgctgggtgggctgtcgacgtaccaggcgctgaccgacgccgtgcacgctgccggcggcctggtcgttgccgcggccgacctgctggcgctgacgctgctggccgctccgggcgaatggggcgccgacgtggtgatcggcaacacgcagcgcttcggcgtgccgttcggcttcggcggcccgcacgccggctacatggccgtgcgcgatgcgttcaagcgctcaatgcccggccgcctggtgggcgtgacggtcgatgcgcagggcaacccggcctaccgcctcgcgctgcagacgcgcgagcagcacatccgccgcgagaaggccacctccaatatctgcaccgcgcaggtgctgctgggcgtgatggcgtcgatgtacgccgtctaccacggcccgcagggcctcaagcgcatcgcccagcgcgtgcaccgcctgaccgccacgctggccgccggcctgcgccagatcggctacacgctggaggccggtgccttcttcgacacgctgaccgtcgccaccggcccgcgcaccgccaacctgcacatcgccgcgcaggcgcacgggttcaacctgcgccagatcgatgacggccgcctgggcgtctcgctggacgagaccgtcacgcgcgccgaagtggtggcgctgtgggagatcttcgcgcacgccgcccatgcgggcgcaccggatttcgaccaggtcgaggccggcatcgccgatgccttccccgcctcgctggcgcgccagagcgcgtacctgacgcaccccgtcttcaacgcgcaccactccgaacacgaaatgctgcgctacctgcgcagcctggccgacaaggacctggcgctggaccgcaccatgatcccgctcggctcgtgcacgatgaagctcaacgccaccgccgagatgctgccggtgacgtggcccgagtttgccaacatccacccgttcgcgccggccgaccagaccgtgggctaccgcgagatgatcgaccagctcgagcagatgctgtgcgccgccaccggctatgcggccgtgagcctgcagccgaacgccggctcgcagggcgagtacgccggcctgctgatcatccacgcctaccacgccagccgtggcgagagccatcgcgacgtgtgcctgatcccgtcgtccgcgcacggcaccaacccggcctcggcacagatggccggcatgaaggtggtggtggtcgcgtgcgacgagcgcggcaacgtggacctggccgacctggaaaagaaagcggccgagcacagcgccaacctggcggccatcatgatcacctacccgtccacgcacggcgtgttcgaggaaggtgtgaagcgcgtctgcgagatcgtgcacagccacggcggccaggtgtacgtggacggcgccaacatgaacgccatggtcggcaccgccgcgccgggccacttcggcggcgacgtgtcgcacctgaacctgcacaagacgttctgcattccgcacggcggcggcggcccgggcgtgggcccggtggcggtgggcgcgcacctcgcgccgttcctgcccggccgcgcggcctcgggcgaagacgccagccagaacatcggcgcggtgtcggcggccccgttcggctccgcgtcgatcctgccgatctcgtggatgtacatcgccatgatgggcgcggccggcctgaccgccgccaccgaggcggccatcctgtcggccaattacgtggcccgccgcctctcgccgtactacccggtgctgtacaccggcgcgcacggcctggtggcgcacgagtgcattctcgacatccgcccgctgcagaaggagtcgggcatcagcaacgaagacatcgccaagcgcctgatggacttcggcttccacgcgccgaccatgagtttcccggtgccgggcacgctgatgatcgagccgaccgagagcgagcccaaggtggaactcgaccgcttcatcgacgcgatgatcgccatccgcggcgaagtcgaccaggtgatctcgggcgcgttcgaccgcgaagacaacccgctcaagcacgcgccgcacaccgcccaggtggtgatggccgacgactggtcgcaccggtacacgcgcgagcaggccgcctacccggtggcctcgctgcgcacgcgcaagtactggccgccggtcggccgcgccgacaacgtctacggcgaccgcaacctgttctgcgcctgcgtgccgatgagcgagtacgcgcaggactga

SEQ ID NO: 3049 - protein, 982 aa, Ralstonia solanacearum
MNAPHPASAALTQTLAARPTLAELEARDAFAERHIGPSPDEQAAMLATLGYASRAALIDAVIPPAIRRQDGMPLGEFTQPLTEEAALAKLRGIAGQNRVVRSLIGQGYYGTHTPGVILRNILENPAWYTAYTPYQPEISQGRLEAMLNFQQMVMDLTAMDIANASMLDEATAAAEAMTLLQRVGKHPSNVFFVADDVLPQTLDVVRTRAEPIGVQVVTGPAADAAKHNAFGVLLQYPGTGGALLGGLSTYQALTDAVHAAGGLVVAAADLLALTLLAAPGEWGADVVIGNTQRFGVPFGFGGPHAGYMAVRDAFKRSMPGRLVGVTVDAQGNPAYRLALQTREQHIRREKATSNICTAQVLLGVMASMYAVYHGPQGLKRIAQRVHRLTATLAAGLRQIGYTLEAGAFFDTLTVATGPRTANLHIAAQAHGFNLRQIDDGRLGVSLDETVTRAEVVALWEIFAHAAHAGAPDFDQVEAGIADAFPASLARQSAYLTHPVFNAHHSEHEMLRYLRSLADKDLALDRTMIPLGSCTMKLNATAEMLPVTWPEFANIHPFAPADQTVGYREMIDQLEQMLCAATGYAAVSLQPNAGSQGEYAGLLIIHAYHASRGESHRDVCLIPSSAHGTNPASAQMAGMKVVVVACDERGNVDLADLEKKAAEHSANLAAIMITYPSTHGVFEEGVKRVCEIVHSHGGQVYVDGANMNAMVGTAAPGHFGGDVSHLNLHKTFCIPHGGGGPGVGPVAVGAHLAPFLPGRAASGEDASQNIGAVSAAPFGSASILPISWMYIAMMGAAGLTAATEAAILSANYVARRLSPYYPVLYTGAHGLVAHECILDIRPLQKESGISNEDIAKRLMDFGFHAPTMSFPVPGTLMIEPTESEPKVELDRFIDAMIAIRGEVDQVISGAFDREDNPLKHAPHTAQVVMADDWSHRYTREQAAYPVASLRTRKYWPPVGRADNVYGDRNLFCACVPMSEYAQD

SEQ ID NO: 3050 - DNA, 2814 bp, Rhizobium loti
  CDS (1)..(2814): transl_table=11
atgatgaccacagcacttacccccttctcggcccgtcatatcggtcctggcgtgaacgatgtcagagccatgcttgcggtgatcggcgttccctccgtcgagacgctgatcagccaggccgtaccgcagtcgattcgcctcgacctgccgctgaccttgcccgcgccggccagcgaagccgaagcactggccgaattgtcggccatcatggcgaagaacacggtgctgaagagcttcatcggcgccggctatcacggcgtccacgtgccgccggtcatccagcgcaatctgttcgagaatccggcctggtacacggcctacacgccctatcaggccgagatcagccagggccgtctggaaatgctgttcaacttccagaccttggtcaccgaattgaccgggctgccggtggcatccgcctcgctgctcgatgaggccaccgctgtcgccgaagcggtcggcattgcgctgcgccaccaccgcgacaagcgcaccaaggtggcgttcgccggcacgccgcacccgcagacgctggatgtggtgcgcacccgtgccgaaccgctcggcatcgagattgacggcgagacgatcgacgacaacaccgctgccctgctcgtctcctggcccgacacccttggcgtctatggcgaccacaaggccgcgatcgacaaggcccgcgccgctggcgcgctggtcgtcttcatcgccgatccactcggcctgacgctgaccgatgcgccggcgaaactcggcgccgacatcgccgtcgggccgatgcagcgctttggcgtgccgatgggctttggcggcccgcacgccgcctattgcgccgtttccgacaggctgacccggctgatgcccggccgcctcgtcggccagtcgaccgacagcaagggccggcccggctaccgcctggccttgcagacgcgagaacagcatatccgccgcgacaaggcgacctccaacatctgcaccgcgcaggcgctgctcgccaacatggcaacggcctatgccatctggcacggcccggccgggctgcaggcgattgccgggcgcatccacgcgctggccaaccgcctggcgagcggcctcaaggcggcgggcgtttcggtgctcggcgccagccgcttcgacacggtgacggtggaggcgaaaggcaaggccgcggagatcgccgaagccgccgaaaagaccggccggttgctgcgcgtcctcgacgccgaccatgtcggcatcgccttcgacgagacctcgaccgatgcggatctcgatgcaatcgcttccctgttcggtgccaaggctgccccctcggccgacagcaccgtccctggcaagccgcgcggaaaagagtttctgacccagcccgtcttcaacgagaacaagtcggaaaccgacatgatgcgcctgctgcgccggttggccgacaaggatctggcgctcgaccgctccatgatcccgctcggatcctgcaccatgaagcttaacgcggcggccgaaatgatgccggtgagctggccaagcatcgccgatctgcatcccttcgcgccggccagccattcggccggctatcgcgccatgatcggcgaactggaaggctggctgtccgaaatcaccggcttcgacgcggtcagcctgcagcccaatgccggcagccagggcgaatatgccggcctgctcgccatccgcgcctatcaccgctcgcgcggcgaagggcatcgcacggtctgcctgatcccctcctccgcgcatggcaccaatccggcaagcgcggcgatggccggcatgagcgttgttgtcgtgcgctgcctggaggacggtaacatcgacatggacgatatgcgggccaaagccaacgagcattccaagaatctcgccgcgctgatgttcacctatccctcgacacatggcgtctacgaagaaggcgcccgccatctctgcgccctgatccatgagcatggcggccaggtctatttcgacggcgccaacctcaacgcgctggtcgcgctcgcccgacccgccgatatcggcgccgatgtctgccatatgaacctgcacaagaccttctgcattccgcatggcggcggtggccccggcgtcggcccgatcggcgtcaaggcacatctgaagccttatctgccgggccatgtcacagaaggctcggcgcatgccgtgtctgcggcaccgttcggcagcgcttccatcctgccgatcacctggatgtatatccgcatgatgggcgccgctggactgaagcaggcaacggagaccgccatcatctcggccaactacgtggcgacacggctcgcgccgcacttcccgctgctctacaagggccggcacgatcgcatcgcgcatgaatgcatcctcgacacccgcgtgctcaaggagagcgcaggcatcagcgtcgacgatatcgccaagcgcctcatcgactatggcttccacgcgccgaccatgtcgtttccggtcgccggcacgttgatggtcgagccgacggaatccgagccgaagcgcgaactcgaccgcttctgcgaggcgatgatcgccattgccggcgaagccgcgaaagtcgccaggggtgactggcccttggccgacaacccgctggtcaacgcgccgcacaccgccgccgagacactggccggccagtggacccatccctactcgcgcctggaagcggcctatcccgcgggcgacgccgatacggcggccaagtactggccgccggtgtcgcgcatcgacaatgtcgccggcgaccgcaatctggtctgctcctgcccgcctttgtcggattatctgggagcagccgaatag

SEQ ID NO: 3051 - protein, 937 aa, Rhizobium loti
MMTTALTPFSARHIGPGVNDVRAMLAVIGVPSVETLISQAVPQSIRLDLPLTLPAPASEAEALAELSAIMAKNTVLKSFIGAGYHGVHVPPVIQRNLFENPAWYTAYTPYQAEISQGRLEMLFNFQTLVTELTGLPVASASLLDEATAVAEAVGIALRHHRDKRTKVAFAGTPHPQTLDVVRTRAEPLGIEIDGETIDDNTAALLVSWPDTLGVYGDHKAAIDKARAAGALVVFIADPLGLTLTDAPAKLGADIAVGPMQRFGVPMGFGGPHAAYCAVSDRLTRLMPGRLVGQSTDSKGRPGYRLALQTREQHIRRDKATSNICTAQALLANMATAYAIWHGPAGLQAIAGRIHALANRLASGLKAAGVSVLGASRFDTVTVEAKGKAAEIAEAAEKTGRLLRVLDADHVGIAFDETSTDADLDAIASLFGAKAAPSADSTVPGKPRGKEFLTQPVFNENKSETDMMRLLRRLADKDLALDRSMIPLGSCTMKLNAAAEMMPVSWPSIADLHPFAPASHSAGYRAMIGELEGWLSEITGFDAVSLQPNAGSQGEYAGLLAIRAYHRSRGEGHRTVCLIPSSAHGTNPASAAMAGMSVVVVRCLEDGNIDMDDMRAKANEHSKNLAALMFTYPSTHGVYEEGARHLCALIHEHGGQVYFDGANLNALVALARPADIGADVCHMNLHKTFCIPHGGGGPGVGPIGVKAHLKPYLPGHVTEGSAHAVSAAPFGSASILPITWMYIRMMGAAGLKQATETAIISANYVATRLAPHFPLLYKGRHDRIAHECILDTRVLKESAGISVDDIAKRLIDYGFHAPTMSFPVAGTLMVEPTESEPKRELDRFCEAMIAIAGEAAKVARGDWPLADNPLVNAPHTAAETLAGQWTHPYSRLEAAYPAGDADTAAKYWPPVSRIDNVAGDRNLVCSCPPLSDYLGAAE

SEQ ID NO: 3052 - DNA, 2865 bp, Rhizobium meliloti
  CDS (1)..(2865): transl_table=11
atgagcatgcccaaggactttaccttcaccgattacaagccttacgacttcgccaatcgacgtcacatcggcccttcgccggccgagatggacgagatgctgaaggtcgtcggctatccgagcctcgacgcgctcatagacgacaccgtgccgccgtcgatccgccagcggacgccgcttgcctggggcgcgccgatgaccgagcgcgaggcactcgacaagctgcgcgagacggcgaaccgcaaccggaagctcgtctccctgatcggtcagggctactacgggaccatcaccccgccggtcatccagcgcaatatcctcgagaatccggcctggtacaccgcctatacgccctatcagccggaaatcagccaggggcggctggaagccctgctcaactaccagaccatggtttgcgatttgaccggcctggacgtcgcgaacgcctcgttgctcgacgaggcgacggcggcagccgaagcaatggccattgccgagcgcgtcgcaaagtccaaggcgaaggcgtttttcatcgatgagaactgccatccccagacgattgcgctcctgaagacccgggcggagccgctcggctggcagatcgtcctcggcgatccgttcgaggatctggacgctgccggcgtcttcggcgcgattttccagtaccccggtacctacggccatgtccgcgacttctcgggcctgatcgccaaactccatgggcagggggcaatcgccgccgtagcagccgatccgctggcgctggcgcttctgaagtctccgggtgaaatgggcgccgacatcgcgatcggttcgacccagcgcttcggcgttccggtcggctacggcggaccgcacgccgcctatatggcggtcaaggatgcctataagcgctccatgcccggccgcctcgtgggcgtgtcggtcgatgcgcggggcaaccgcgcctaccggctgtcgctccagacccgtgaacagcatatccggcgcgaaaaggcgacatcgaacatctgtaccgcgcaggtgctgcttgccgtcatggcctccatgtatgcggtcttccacggtccggacggaataaaggcgatcgcccagagcgtgcaccagaagacggtccggcttgccatgggattggagaagctcggctataccgtcgagccggatgtcttcttcgatacgatcaccgtcgaagtcggcaagctgcaaggcatcatcctcaaagccgccgtggccgaggaggtaaaccttcgcaagatcggcacgaccaggatcggcatcagtctcgacgagcgttcgaggccggtcacgctcgaggccgtctggcgcgccttcgggggcgatttcaaggtcgaggagttcgagccggactaccgcctgccgcaggaactgctgcgcaccagcgcctatctcacccatccgatcttccatatgaaccgcgccgagagcgagatgacgcgttacatgcgccgcctcgccgatcgcgatcttgcgctcgaccgcgcgatgatcccgctcggctcctgcacgatgaagctcaacgcgaccgcggagatgctgccgatcacctggccggagttctcggaaatccatcccttcgtgccggccgaccaggcactcggctatcagcatctcatcgaagacctgtcgcaaaagctctgcgcgatcaccggctacgatgcgatctcgatgcagccgaactcgggtgcccagggtgaatatgccggtctgctcgcgatccgcgcctaccatatcgccaacggcaacgagcatcgcgacgtctgcctgataccgacctcggcgcacggcaccaacccggcctcggcgcagatggccggcatgaaggtggtggtcgtcaaggtgagcgacgccggcgagatcgatatggacgatttccgcgccaaagcggagcagtatgcggacaccctctcctgctgcatgatcacctatccctcgacgcacggcgtgttcgaggagaacgtccgcgaagtctgcgaggtcgtgcataagcacggtggccaggtctatctggacggcgccaacatgaatgcgatggttggcctttcccgccctggcgacatcggctcggatgtcagccatttgaacctgcacaagaccttctgcattccgcatggcggcggcggtcccggcatgggcccgatcggcgtcaagtcgcatctcgcccccttccttccgggacacccgcagaccgacgggcacgagggcgccgtatccgccgcaccgttcgggtcggcctcgatcctgccgatctcctggagctactgcctgatgatgggcggcgaaggcctgacgcaagcgaccaaggtggcgatcctcaacgccaattacgtcgccgcccggctgaagggtgcctatgacgtgctctacaagtcggcgaaaggccgggtcgcgcatgaatgcatcatcgatacccgtccgctcgccgaaagcgccggcgtcacggtcgatgacgtcgccaagcgcctgatcgactgcggcttccatgcaccgacgatgagctggccggtcgcgggcacactgatgatcgaacccacggaatcggaaacgaaggccgagctcgaccgcttctgcgacgccatgctggcaatccgcgaagaggcccgcgccatcgaggacggccggatggacaaggtcaacaatccgctgaagaacgcgccgcatacggtcgaggacctcgtcggcgactgggaccggccctattcgcgcgagcaggcctgcttcccaccgggcgccttccgcgtggacaaatactggtcgccggtcaaccgtgtcgacaatgtctatggcgaccgcaatctcgtctgcacctgcccgccgatcgagagctacgcggaagcggcggaatga

SEQ ID NO: 3053 - protein, 954 aa, Rhizobium meliloti
MSMPKDFTFTDYKPYDFANRRHIGPSPAEMDEMLKVVGYPSLDALIDDTVPPSIRQRTPLAWGAPMTEREALDKLRETANRNRKLVSLIGQGYYGTITPPVIQRNILENPAWYTAYTPYQPEISQGRLEALLNYQTMVCDLTGLDVANASLLDEATAAAEAMAIAERVAKSKAKAFFIDENCHPQTIALLKTRAEPLGWQIVLGDPFEDLDAAGVFGAIFQYPGTYGHVRDFSGLIAKLHGQGAIAAVAADPLALALLKSPGEMGADIAIGSTQRFGVPVGYGGPHAAYMAVKDAYKRSMPGRLVGVSVDARGNRAYRLSLQTREQHIRREKATSNICTAQVLLAVMASMYAVFHGPDGIKAIAQSVHQKTVRLAMGLEKLGYTVEPDVFFDTITVEVGKLQGIILKAAVAEEVNLRKIGTTRIGISLDERSRPVTLEAVWRAFGGDFKVEEFEPDYRLPQELLRTSAYLTHPIFHMNRAESEMTRYMRRLADRDLALDRAMIPLGSCTMKLNATAEMLPITWPEFSEIHPFVPADQALGYQHLIEDLSQKLCAITGYDAISMQPNSGAQGEYAGLLAIRAYHIANGNEHRDVCLIPTSAHGTNPASAQMAGMKVVVVKVSDAGEIDMDDFRAKAEQYADTLSCCMITYPSTHGVFEENVREVCEVVHKHGGQVYLDGANMNAMVGLSRPGDIGSDVSHLNLHKTFCIPHGGGGPGMGPIGVKSHLAPFLPGHPQTDGHEGAVSAAPFGSASILPISWSYCLMMGGEGLTQATKVAILNANYVAARLKGAYDVLYKSAKGRVAHECIIDTRPLAESAGVTVDDVAKRLIDCGFHAPTMSWPVAGTLMIEPTESETKAELDRFCDAMLAIREEARAIEDGRMDKVNNPLKNAPHTVEDLVGDWDRPYSREQACFPPGAFRVDKYWSPVNRVDNVYGDRNLVCTCPPIESYAEAAE

SEQ ID NO: 3054 - DNA, 2973 bp, Rhodopseudomonas palustris
  CDS (1)..(2973): transl_table=11
atgacgccgctgagatttccgagcaacctgcctttgcgggccgttgcatttgacgaggaccagagcatgccgcatcgccgaccgatcgacgccgctaacgacttcgtgcgtcggcatatcgggccctcgccgcaggatatcgcggcgatgctggcgacggccggcgccggcagtctggagcagctcgtcgccgagacgctgccttatgcgatccggcatcgcgaaccgctgaagctcggcgcgccgctgaccgagagcgaagcgctggcgcatatgagcgagcttggcgcccagaaccaagtgttcacctcgctgattggacaaggctattacggcacgatcctgccgaccgtgatccagcgcaatattctggaaaatcccgcctggtacacggcctatacgccgtatcagccggagatcagccagggccggctggaagcgctgttcaacttccagaccatgatctgcgacctcaccgggctcgatgtcgccaacgcctcgctgctcgacgaaggcactgcggcggcggaagcgatggcgctcgccgagcgcgcggccgccaagaacgccaaggcattcttcgtcgacgccgacacccatccgcagaccatcgctgtgctgcgcacccgcgccgagccgctcggctggcggatcatcgtcggcaatcccgagaccggactggaaggcgccgacgtgttcggcgcgctgctgcaatatcccggctcgtcggggcgtttgagcgatccgcgcgcggtgatcgcagcactgcgcaagaagggcgcgctggcggtggtcgcggccgatctcttggcgctgacgctgatcaccccgccgggcgaactcggcgccgacattgcgatcggctcggcgcagcgcttcggcgtgccgatggggtatggcggcccgcatgccgcctatatggcggtgcgcgacagcctcaagcgcagcctgcccggccgcatcgtcgggctgtcgatcgacagccacggccagccggcctaccggctggcgctgcagacccgcgaacagcacatccgccgcgaaaaggcgacctcgaatatctgcaccgcgcaggtgctgctggcggtgatcaacgcgatgtacgcggtctatcacggtcccgatggcctcgccgcgatcgcgcgccgcgtccaccggcgcaccgcggtgctggcggccggcctgcagcaactcggcttcgccccgacccacggcaactacttcgacacgctgacgatcgaggtgggcgatcgccgcgacgctatcgtggcacgcgccgaggccgagaacatcaacctgcggatcaacgcctcctcgctcggcatctcgctcgacgagaccaccacgccggccaccgtcgaagcgctgtggcgggcgttcggcggctcactcgactacgccgccgtggaacgagacgcaggcgacgcgctcggcactgcgcttcccgcggcgctgaaacggaccagtgactacctgacccagccggcgttccaggactatcgctcggaaaccgagctgctgcgctacatgcgcaagctgtcggaccgcgatctcgcgctcgaccgcgcgatgatcccgctcggctcctgcaccatgaagctgaacgccaccaccgaaatgatgccgctgacctggcccgagttcggcagcctgcatccgttcgtgccgaaggcgcaggccgccggctatcacgcgctgtttgagcggctggagacctggctcgccgagatcaccggctatgacgcggtgtcgctgcagccgaactccggcgcgcagggcgaatatgccggcctgctcacgatccgcggctatcacctgtcgcgcggcgagccgcaccgcaaagtgtgcctgatcccgtcgtcggcgcacggcaccaatccggcatcggccgcgatggccggcatggacgtcgtggtggtcgcctgcgacgcgcatggcgacgtcgatgtcgacgatctgcgcgccaaggcggaagcgcattcggccgatctggccgcggtgatgatcacctatccgtcgactcatggcgtgttcgaggagcacatccgcgagatctgcgacatcgtccatgcccacggcggtcaggtctatctcgacggcgccaatctcaatgcccaggtcggcctcgcccggcccggcagctacggcgccgacgtcagccacctcaacctgcacaagacgttctgcattccgcacggcggcggcggcccgggaatgggcccgatcggcgtcaaggcgcatctggcgccgttcctgcccggccatccggccgagggcgagccgttgaacggcggcctgcacggcggcggcacggtgtcggcggcgccgtggggctcggcgtcgatcctgacgatttcctacatctacatcctgatgatgggcgctgccggcctgaagcgcgccaccgagatcgcgatcctcaacgccaactacatcgcggcgaaactgcacccgcactttccggtgctgtaccgcaacccgcgcgggcgggtcgcgcacgagtgcatcatcgatccgcgggcgcttaagacttccaccggcgtcaccgtcgacgacatcgcgaagagactgatcgactacggcttccacgcgccgaccatgagcttcccggtgcccggcacgctgatgatcgagccgaccgaatcggaatccaaggccgagatcgaccggttctgcgacgcgatgatcgcgatccgccgcgagatcgcgcaagtcgaagccggccgctatccgatcgagcagtcgccgctgcgccacgcgccgcacaccgcgcatgacgtcacgagtgcggagtggacgcggccctatccgcgcaccgaaggctgcttcccggcgccgaactcgcgcaccgacaaatattggagcccggtcggccgcgtcgacaacgtctatggcgaccgcaatctgatctgctcgtgcccgccggtcgaagactacgcgctcgctgccgactacgcgcgggccgcggaataa

SEQ ID NO: 3055 - protein, 990 aa, Rhodopseudomonas palustris
MTPLRFPSNLPLRAVAFDEDQSMPHRRPIDAANDFVRRHIGPSPQDIAAMLATAGAGSLEQLVAETLPYAIRHREPLKLGAPLTESEALAHMSELGAQNQVFTSLIGQGYYGTILPTVIQRNILENPAWYTAYTPYQPEISQGRLEALFNFQTMICDLTGLDVANASLLDEGTAAAEAMALAERAAAKNAKAFFVDADTHPQTIAVLRTRAEPLGWRIIVGNPETGLEGADVFGALLQYPGSSGRLSDPRAVIAALRKKGALAVVAADLLALTLITPPGELGADIAIGSAQRFGVPMGYGGPHAAYMAVRDSLKRSLPGRIVGLSIDSHGQPAYRLALQTREQHIRREKATSNICTAQVLLAVINAMYAVYHGPDGLAAIARRVHRRTAVLAAGLQQLGFAPTHGNYFDTLTIEVGDRRDAIVARAEAENINLRINASSLGISLDETTTPATVEALWRAFGGSLDYAAVERDAGDALGTALPAALKRTSDYLTQPAFQDYRSETELLRYMRKLSDRDLALDRAMIPLGSCTMKLNATTEMMPLTWPEFGSLHPFVPKAQAAGYHALFERLETWLAEITGYDAVSLQPNSGAQGEYAGLLTIRGYHLSRGEPHRKVCLIPSSAHGTNPASAAMAGMDVVVVACDAHGDVDVDDLRAKAEAHSADLAAVMITYPSTHGVFEEHIREICDIVHAHGGQVYLDGANLNAQVGLARPGSYGADVSHLNLHKTFCIPHGGGGPGMGPIGVKAHLAPFLPGHPAEGEPLNGGLHGGGTVSAAPWGSASILTISYIYILMMGAAGLKRATEIAILNANYIAAKLHPHFPVLYRNPRGRVAHECIIDPRALKTSTGVTVDDIAKRLIDYGFHAPTMSFPVPGTLMIEPTESESKAEIDRFCDAMIAIRREIAQVEAGRYPIEQSPLRHAPHTAHDVTSAEWTRPYPRTEGCFPAPNSRTDKYWSPVGRVDNVYGDRNLICSCPPVEDYALAADYARAAE

SEQ ID NO: 3056 - DNA, 2871 bp, Rhodobacter sphaeroides
  CDS (1)..(2871): transl_table=11
atgagcttcacccccacggactataacgcctacgatttcgccaaccgccggcacatcggcccatcgccctccgaaatggaagagatgctgcgcgtggtgggggtgtcctcgctcgaccagctgatcgaggagacggtgcccgcctcgatccggcaggagacgccgctcgactgggcgccgctcgccgagcatgagctgctcgcccggatgcgcgaggtggctgccaagaaccgcgtgatgacctcgctcatcgggcagggctattacggcacggtcacgccgcctgccatccagcgcaacatcctcgagaatccggcctggtacacggcctatacgccctaccagcccgagatcgcgcaggggcggctcgaggcgctcttgaactaccagaccatggtcgcggacctcaccggcctgccggtcgccaatgcctcgcttctcgacgaggcgacggcggcggccgaggccatgaccatggccgagcgggcctcgaagtcgaaggcgcgggccttcttcgtcgatgccgactgccatccgcagacgatctcggtcatccgcacccgcgccgagccgctgggcatcgaggtgatcgtgggccatcccgcgcagctcgtgcccgaggatgtgttcggcgcgctgttccagtatcccggcacttacgggctcgtgcgcgacttcacccgcgatattgcggcgctgcacgaggcgaaggcgctggccgtggtggcgaccgaccttctggcgctctgcctcctcaaggagccgggcgcgatgggcgccgacatcgccatcggctcgagccagcggttcggcgtgccgatgggctacggcggtccgcatgcggccttcatgtcctgcaaggacgatctgaaacggtcgatgcccggccggctcgtcggcgtttcggtcgatgcgcgcggcaacaaggcctatcgcctcgccctccagacccgcgagcagcatatccgccgcgagaaggccacctcgaacgtctgcaccgcgcaggcgcttctggcggtcatggcgagcttctatgccgtcttccacggcccccgcggcctccgcgccatcgccgagcgggtgcatctgaacaccgtccgcctcgcgaccgcgctgaaggaggcgggagcccgcgtcagccccgaggccttcttcgacacgatcaccgtcgaggtgggcgtggggcaggcggggatcctcgccgctgcgcgtcaccggggcatcaacctgcgcaaggtgggccgcgaccgggtggggatctcgctcgacgagacgaccgatgccggcgtgatcgcgcgcgtgctcgatgccttcgggatccacgagcccgcccccgcgaaggtgggcttgggcttccccgagccgctcctgcgcgagaccggctatctctcgcatccggtcttccagatgaaccgggcggaatccgagatgatgcgctacatgcgccgcctttcggaccgcgacctcgcgctggaccgggcgatgatcccgcttggctcctgcacgatgaagctgaatgccgccgccgagatgatgcccatcacctggcccgaattcggcacgctgcatccgttcgcgccggccgatcaggccgcgggctatcacgaggccatcggcgatctggcccagcggctctgccggatcaccggctacgacgccatgtcgatgcagccgaactcgggcgcgcagggcgaatatgcggggcttctcaccatcctcgcctatcaccgggcgcggggcgacgcggagcgcacgatctgcctcatcccggtctcggcgcatggcaccaacccggcctcggcgcagatggcagggatgaaggtggtcgtggtgaagtcggcgccgaacggcgacgtcgatctcgaggattttcgcgacaaggcggcggcggcgggcgaccggctcgcggcctgcatgatcacctatccctcgacccacggcgtcttcgaggagacggtgcgcgaggtctgccgcatcacccacgagcacggcggtcaggtctatatcgacggggccaacatgaacgcgatggtgggcctcgtgcagccgggcgccatcggcggcgatgtgagccacctgaacctgcacaagaccttcgccattccgcatggcggcggcggccccggcatggggcccatcggggtcaaggcgcatctcgcgccgtacctgccgggccatcccgaggtgacggggccgctgaccggaggccatgacgaggcggccgacgaggggccggtctcggccgcgccctatggctcggcctcgatcctgctcatctcctgggcctattgcctgatgatgggcggcgaggggctcacgcaggcgacgcgggtcgcgatcctgaacgcaaactatatcgcggcgcggttgcgcggggcctacaaggtgctgttcatgggcaatcgcgggcgcgtggcccacgagtgcatcctcgacacccggcccttcgccgaggcgggcgtgacggtggacgatatcgccaagcggctgatcgacaacggcttccacgcgccgaccatgagctggcccgtgccggggacgctgatggtcgagcccacggaatccgagaccaaggccgagatcgaccggttcgtggcggcgctcctggcgatccgcgaggagatccgcgcggtcgaggagggcgagatcgccgcggcggacagcccgctgcgccatgcgccgcatacggtcgaggatctggtggcggactgggatcgcaaatatccgcgcgagcagggctgcttcccgccgggctcgttccgggtcgacaaatactggccgcccgtcggccgcgtcgacaatgcgtggggcgaccgcaacctcgtctgcacctgtccgccggtggaaagctacagcatcgccgcacaatag

SEQ ID NO: 3057 - protein, 956 aa, Rhodobacter sphaeroides
MSFTPTDYNAYDFANRRHIGPSPSEMEEMLRVVGVSSLDQLIEETVPASIRQETPLDWAPLAEHELLARMREVAAKNRVMTSLIGQGYYGTVTPPAIQRNILENPAWYTAYTPYQPEIAQGRLEALLNYQTMVADLTGLPVANASLLDEATAAAEAMTMAERASKSKARAFFVDADCHPQTISVIRTRAEPLGIEVIVGHPAQLVPEDVFGALFQYPGTYGLVRDFTRDIAALHEAKALAVVATDLLALCLLKEPGAMGADIAIGSSQRFGVPMGYGGPHAAFMSCKDDLKRSMPGRLVGVSVDARGNKAYRLALQTREQHIRREKATSNVCTAQALLAVMASFYAVFHGPRGLRAIAERVHLNTVRLATALKEAGARVSPEAFFDTITVEVGVGQAGILAAARHRGINLRKVGRDRVGISLDETTDAGVIARVLDAFGIHEPAPAKVGLGFPEPLLRETGYLSHPVFQMNRAESEMMRYMRRLSDRDLALDRAMIPLGSCTMKLNAAAEMMPITWPEFGTLHPFAPADQAAGYHEAIGDLAQRLCRITGYDAMSMQPNSGAQGEYAGLLTILAYHRARGDAERTICLIPVSAHGTNPASAQMAGMKVVVVKSAPNGDVDLEDFRDKAAAAGDRLAACMITYPSTHGVFEETVREVCRITHEHGGQVYIDGANMNAMVGLVQPGAIGGDVSHLNLHKTFAIPHGGGGPGMGPIGVKAHLAPYLPGHPEVTGPLTGGHDEAADEGPVSAAPYGSASILLISWAYCLMMGGEGLTQATRVAILNANYIAARLRGAYKVLFMGNRGRVAHECILDTRPFAEAGVTVDDIAKRLIDNGFHAPTMSWPVPGTLMVEPTESETKAEIDRFVAALLAIREEIRAVEEGEIAAADSPLRHAPHTVEDLVADWDRKYPREQGCFPPGSFRVDKYWPPVGRVDNAWGDRNLVCTCPPVESYSIAAQ

SEQ ID NO: 3058 - DNA, 3054 bp, Schizosaccharomyces pombe
  CDS (1)..(3054)
atgtttcgtgcttgctcgaagttgcagtaccatggagtaaataccagcctttcgaggcatttgtttcttgctaaaagaaatttatccatttcttcagcttgtctagaagctaaaaactcccaaaagtttcctgctcttgatacttttgaacctcgacacattggaccttctaaaacggatcaacaatatcaattggagtcactagggtataaggattttgattctttcctcaaagatgtaattccagattctgtgcgaacacctgagagccaattgatggcttttgggtctgtgaatcccaacgaaaaaaatcctcctgttaactactccgaaagcgaatttacgactctggcaaacaatgtggctaatcaaaataagctgattaagagcttcattggcatgggatactataatgtaaagcttcctgctgctattcagcgtaatgttcttgagaaccctgaatggtatactcaatatactccatatcaggctgaaatttctcaagggcgtctggaatctatgatgaattatcaaaccatgattgctgatctcacaggtctcagcattagcaatgctagtttactggatgaaggaactgctgctggagaagcaatggttatgttgatggccaacgacaaaaagaagcgcaaaacgtttttagtggacaagaatatataccccaatactctgtctgttttacgtactcgtgcttctggttttggtatcaaaattgaattagacaatatcactcctgaactcattacgaagtctgctaagcatgtttttggtatctttgtgcaatacccagcggcggatggctctatttttgactatggtcatttagctgctacagcacgctcttttaatatgcacgtcgtagctgccaccgatttactagctctcactattttgaaatcgcctggggaatggggtgccgatgttgctgttggttccactcagcgctttggtctgcccatgggctatggtggcccccatgccggattctttgcttgtagtgaagaatttaaacgaaagatacccggtcgtcttattggtctcagcaaagatcgtttagaaaatcccgcataccggttggctcttcaaacaagagaacaacatattcgtcgtgaaaaggctacaagtaacatttgcacggctcaagctttgttagccaatatgtctgcattctatgctatttaccatgggccaaatggtctccaagaaattgcaaaccgtatttacgctagtacctccttcttaaaatctgctttggaatcttcaggatataaaattgttaataaaagtcatttctttgacacattaactatcgaagttgagtcggctgacaaagttcttgcgaaagcacttgatcacggttacaatttaagaaaggttgatgattcacatgttggtctttcattggacgagaccgtttgcgataaagatattcaagctttgtttagcatctttaatataaataagagtgttgatcagtattatatggaaattgcaacgtcggaacctaatggaaattctgcttcaacagtcgataatctcagcatttgttctcttcctgaaaactttagacgaacaaccctctatttacaacatcccgtgtttaacagataccattcggaaactgaacttatgcgttatattcatcatttgcagtcgaaggatctatctttagctcatgccatgaccccattgggttcgtgcacaatgaagttgaatgctgtcaccgaaatgatgccaatcacaaatccattatttgccaacattcatccatatgttccagaggaacaagctaaaggttatcgtcatgttatcgaagatttgcagttaatgttaacgaccatcaccggctttgatgctgcatgctttcaaccaaattcgggagccgctggagaatacactggcttaagtgttattcgagcatatcagcggtctattggtcaaggtcatcgcaatatttgcttaattcctgtttcggctcacggtactaatccagcttcagctgctatggctgggtttactgttattcctgtaaaatgtctcaataacggttatttggatatgcaagacttaaaagaaaaggcctctaaacacgccgacaagttagctgcctttatggtaacttatcctagtacttttggcatttttgagcctgatgttaaggaagctttggaagtaattcacgaacatggtggtcaggtttactttgatggtgctaacatgaatgcaatggttggtttatgcaaggctggtgatattggtgctgatgtttgtcacttaaatcttcataagacattttgcattcctcacggcggtggcggtcctggtgtaggtcctatttgtgtaaaaaagcatcttgctgatttcctaccatctcatcctgtagtttcatgcggcggtaagaatggtatcacatctgttagctcttctccttttggctctgctggtattttacctatctcatgggcatacatgagaatgatgggacttgccggtttgcgtgacgcttccaaagccgctctgttaaatgccaattatatggccaagcgcctgtcatctcattataaacttgtttacactaataagaacaacctctgtgctcatgagtttattctagatgctcgcgaatttaaagctactgcgggtgtagatgcaactgatatagctaaacgtttgcaagattacagtttccatgcaccaactctttcctggcctattgctaatacactgatgattgagcctaccgagtctgagagtatgtatgagatggaccgcttctgtgatgctttaatttctattcgacaagaaattcgtgaaattgaagaaggtctccagcctaaggacaataacctgctcgttaatgctccccaccctcaaaaggacattgcatctgagaaatgggatcgtccttatactcgagagcgggctgtctatcctgtgcctcttttaaaggaacggaaattctggcctagcgttgctcgattagatgatgcgtacggtgacaagaacttattttgtacttgttccccagttgtttag

SEQ ID NO: 3059 - protein, 1017 aa, Schizosaccharomyces pombe
MFRACSKLQYHGVNTSLSRHLFLAKRNLSISSACLEAKNSQKFPALDTFEPRHIGPSKTDQQYQLESLGYKDFDSFLKDVIPDSVRTPESQLMAFGSVNPNEKNPPVNYSESEFTTLANNVANQNKLIKSFIGMGYYNVKLPAAIQRNVLENPEWYTQYTPYQAEISQGRLESMMNYQTMIADLTGLSISNASLLDEGTAAGEAMVMLMANDKKKRKTFLVDKNIYPNTLSVLRTRASGFGIKIELDNITPELITKSAKHVFGIFVQYPAADGSIFDYGHLAATARSFNMHVVAATDLLALTILKSPGEWGADVAVGSTQRFGLPMGYGGPHAGFFACSEEFKRKIPGRLIGLSKDRLENPAYRLALQTREQHIRREKATSNICTAQALLANMSAFYAIYHGPNGLQEIANRIYASTSFLKSALESSGYKIVNKSHFFDTLTIEVESADKVLAKALDHGYNLRKVDDSHVGLSLDETVCDKDIQALFSIFNINKSVDQYYMEIATSEPNGNSASTVDNLSICSLPENFRRTTLYLQHPVFNRYHSETELMRYIHHLQSKDLSLAHAMTPLGSCTMKLNAVTEMMPITNPLFANIHPYVPEEQAKGYRHVIEDLQLMLTTITGFDAACFQPNSGAAGEYTGLSVIRAYQRSIGQGHRNICLIPVSAHGTNPASAAMAGFTVIPVKCLNNGYLDMQDLKEKASKHADKLAAFMVTYPSTFGIFEPDVKEALEVIHEHGGQVYFDGANMNAMVGLCKAGDIGADVCHLNLHKTFCIPHGGGGPGVGPICVKKHLADFLPSHPVVSCGGKNGITSVSSSPFGSAGILPISWAYMRMMGLAGLRDASKAALLNANYMAKRLSSHYKLVYTNKNNLCAHEFILDAREFKATAGVDATDIAKRLQDYSFHAPTLSWPIANTLMIEPTESESMYEMDRFCDALISIRQEIREIEEGLQPKDNNLLVNAPHPQKDIASEKWDRPYTRERAVYPVPLLKERKFWPSVARLDDAYGDKNLFCTCSPVV

SEQ ID NO: 3060 - DNA, 2889 bp, Shewanella oneidensis
  CDS (1)..(2889): transl_table=11
atgaccaagcaaaccctcactcagttagaacagcacgatttattcttacgtcgccatatcggcccggatagcagccaacaacaagaaatgttgaactacgttggtgctgagtctttggacgatctgaccgcgcaaatcgtgcctgagtcgatccgtttaagccaagagttgagcattggtgattcctgcggcgaagccgaaggcattgcttacattcgtggtttagccaagcaaaaccaagtcttcaaaagctacattggtatgggctactacggtacccaagtgcctaatgtgattttacgtaacgtcttagaaaatccaggttggtacacggcgtacacgccctatcaaccagagatcgcccagggccgtttagaagccattctaaacttccaacaagtgtcgatggatttaaccggtttagatttagcctctgcttcactgctggacgaagcgactgccgccgccgaagcgatggcgctggctaagcgtgtgtctaaagccaaaaaagcgaacatcttcttcgtagctgatgacgtattcccacaaaccttagacgtcgtaaaaacgcgcgctgagtgttttggttttgaagtcgtggtaggtcctgcatctgaggccgttaaccatgagctgtttggtgccctgttccaatattcaaaccgtttcggtcagatcactgacttcacagacttattcgccgaattacgcgcgaaaaacgtgattgtgactgtggctgccgacatcatgtcgttagtattactgaaatcacctggctcaatgggcgcagatgtggtctttggtagtgcgcagcgttttggtgtgccgatgggctttggtggtccacacgcggcattcttcgtggcccgtgacgagcacaaacgctctatgccaggccgtattatcggtgtgtcaaaggacacccgtggtaaccgcgccctgcgtatggcgatgcaaacccgcgagcagcatatccgccgcgaaaaagccaactcaaacatttgtaccgcgcaaattctgttagcgaacatggcgtctttctacgccgtattccacggcccacagggcctgaaaaccatcgcatcacgcatcaaccgctttgctgatatcttagccgctggcttacaagctaaaggcgtgagcttagtgaacaatacttggttcgataccatcagcatcaaaggcttagacgttgcagcagtcaatgctcgcgcgctggccgctgaaatgaacctgcgtttcgatgctgacggcatcgtcggcgtgagcttagatgaaaccacaatccgcaccgatatcgacgccctgttcgaggtgattttaggtgctggccatggtttagacgttgccgcattagatgcgcaaatcgtggcgcaaggtagccaatcgattccagcttctttagtgcgtgaagatgcgattttaagccacccaaccttcaatcgctaccaaagcgaaaccgagatgatgcgttatatcaagcgtctcgaaagcaaagacttagcactgaactactcaatgatttcattgggttcatgcaccatgaagttaaacgctgcggttgaaatgatcccagtcagctggccagaatttgccaacatgcacccattctgcccgctagatcaagccaagggttacactcaactgattgaagaactgtcttcatggttagtgaatgtcaccggttacgatgccgtgtgtatccaacctaactctggcgcacagggtgaatacgcaggtctgctggcgattcgtaagtaccacgagtcgcgcggcgaagcacacagaaacatctgcttaatcccacaatctgcccacggtactaacccagcatcggcgcaattagccggtatgcaagtcgtggtaactgcctgtgataagcaaggtaacgtcgatttagaggatctgaaggccaaagcggccgaagtggcagaaaacctgtcatgtatcatgatcacttacccatcgacccacggtgtgtacgaagaaaccgtgcgcgaaatctgcaacattgtgcatcagcacggtggtcaagtgtacttggacggcgccaacatgaacgcccaagttggcttaacttcaccaggctttatcggtgccgacgtatcgcaccttaacctgcacaaaaccttcgcgattccacacggcggcggtggtccaggtatgggtccaatcggcgtgaaagctcacttagcgccgttcgtcgctggtcacgtagtggtgaaaccaggccgcgaaagcgataacaacggtgcagtatcggccgcgccatacggcagtgctggcattctgccaatcagctggatgtacattaagttgctcggttcaaagggtcttaaaaagtcgactcaaaccgcgctgttaaacgctaactacgtgatgaagaagctgtctgaacactacccagtactgttccgtggccgtaacgatcgcgtcgcgcacgaatgtattatcgacctgcgcccaatcaaagaagcctctggcgtgaccgaaatggatatcgctaagcgtttgaacgactacggtttccacgcgccaaccatgagcttccctgttgcgggcacgctgatgattgagccaactgaatcagagtctaaggttgaactggaccgctttatcgacgctatggtgtcaatccgcgccgaaatcgcgaaggtggaagcaggcgagtggccagcggacaacaacccgctgcacaacgcaccacacactatggccgatattatggacagcgcgttcgattcacgcccatacagccgtgaagtggccgtgttcccaagtgccgcagtgcgtactaacaagttctggccaaccgtgaaccgtattgatgatgtttacggcgacaggaatttgttctgtgcgtgtgtgccgttatcagactacgagtag

SEQ ID NO: 3061 - protein, 962 aa, Shewanella oneidensis
MTKQTLTQLEQHDLFLRRHIGPDSSQQQEMLNYVGAESLDDLTAQIVPESIRLSQELSIGDSCGEAEGIAYIRGLAKQNQVFKSYIGMGYYGTQVPNVILRNVLENPGWYTAYTPYQPEIAQGRLEAILNFQQVSMDLTGLDLASASLLDEATAAAEAMALAKRVSKAKKANIFFVADDVFPQTLDVVKTRAECFGFEVVVGPASEAVNHELFGALFQYSNRFGQITDFTDLFAELRAKNVIVTVAADIMSLVLLKSPGSMGADVVFGSAQRFGVPMGFGGPHAAFFVARDEHKRSMPGRIIGVSKDTRGNRALRMAMQTREQHIRREKANSNICTAQILLANMASFYAVFHGPQGLKTIASRINRFADILAAGLQAKGVSLVNNTWFDTISIKGLDVAAVNARALAAEMNLRFDADGIVGVSLDETTIRTDIDALFEVILGAGHGLDVAALDAQIVAQGSQSIPASLVREDAILSHPTFNRYQSETEMMRYIKRLESKDLALNYSMISLGSCTMKLNAAVEMIPVSWPEFANMHPFCPLDQAKGYTQLIEELSSWLVNVTGYDAVCIQPNSGAQGEYAGLLAIRKYHESRGEAHRNICLIPQSAHGTNPASAQLAGMQVVVTACDKQGNVDLEDLKAKAAEVAENLSCIMITYPSTHGVYEETVREICNIVHQHGGQVYLDGANMNAQVGLTSPGFIGADVSHLNLHKTFAIPHGGGGPGMGPIGVKAHLAPFVAGHVVVKPGRESDNNGAVSAAPYGSAGILPISWMYIKLLGSKGLKKSTQTALLNANYVMKKLSEHYPVLFRGRNDRVAHECIIDLRPIKEASGVTEMDIAKRLNDYGFHAPTMSFPVAGTLMIEPTESESKVELDRFIDAMVSIRAEIAKVEAGEWPADNNPLHNAPHTMADIMDSAFDSRPYSREVAVFPSAAVRTNKFWPTVNRIDDVYGDRNLFCACVPLSDYE

SEQ ID NO: 3062 - DNA, 3108 bp, Solanum tuberosum
  CDS (1)..(3108)
atggagcgtgctagaaaattggcaaacagagcaattctgaaacgtttggtttcacaatcaaaacagagtcgttctaatgaaatcccatcatcatcattatacaggccttcaaggtatgtatcttcattgtcgccatacacatttcaggctagaaataatgcaaaatcttttaatacccaacaagctagatcaatttctgttgaggctttgaaaccaagtgacacattcccacgccgacataactcagccacccctgaagaacaaacaaaaatggctgagttttgtgggtttcaaagcctggatgcacttattgatgctactgtacctcaatcgattcgtagcgaatcgatgaagttacctaagtttgatagtggattgactgagtcacagatgattgagcatatgcagaatttggcatctaagaataaggtttttaagtcatatattgggatggggtattataatacttatgtaccacctgttatattgaggaatcttttggagaatcctgcttggtatactcagtatactccttatcaggctgagatttcgcagggacggcttgagtccctgctgaattatcagaccatgattacggatcttactggtttgccaatgtctaatgcatctttactagatgaagggaccgcggcagctgaggctatggctatgtgtaacaatattcttaaggggaaaaagaaaactttccttattgctagcaattgtcaccctcagactattgatatttgtaagactagagctgatggatttgatcttaaggtagttactgtagatcttaaggatattgattataagtctggtgatgtttgtggggtactagttcagtatccggggaccgaaggtgaaatcttggattatggggagtttattaagaatgcacatgctcatggagtgaaggttgttatggcatctgatcttttggccttgacaatgttgaaaccacctggtgaacttggagcagatattgttgttggttctgctcaaaggtttggagtgcctatgggttatggaggccctcatgcagctttcttggcaacttctcaagaatacaagagaatgatgcctggaagaattattggtctcagtgttgattcaacagggaaacctgctctgcgtatggcaatgcagactagggaacaacacatccgcagggacaaggctacgagtaacatttgcacagcacaggctttgcttgccaacatggctgccatgtatgctgtctatcatggacctgaggggctaaaaaccattggccaacgtgttcatggtcttgctggaacattttctgctggtctcaaaaagctaggaacagtagaagttcaggatcttccattctttgacactgtgaaggtgaagtgttctgatgcaaaggcaattgctgatgttgctaacaagaatgacattaacttgcggattgtggacaacaatactataactgtatcttttgatgaaactactaccctagaagatgtggacgatctatttaaagtttttgccttgggaaagccagtcccgttcactgctcaatcaattgcacaagaggtcgagaacctgattccttctggacttacaagggagactccatttttgactcaccaaatattcaactcgtaccatactgagcacgagttgctgagatacctccataagctgcaatcaaaggatctctccttgtgccatagcatgattcctttgggctcctgcacaatgaaattgaatgccacgacagagatgatgccggtgacatggcctagcttcgcaaatattcacccttttgcacccactgaacaggcagctggctatcaggaaatgttcgacgatttaggcgccctattgtgtacaattacaggttttgattccttctccttgcagcctaatgctggtgctgctggagaatatgctggattgatggttattcgtgcatatcatatgtcaaggggtgaccatcaccgcaatgtatgcatcattcctgtatcagcacatggaacaaatcctgcaagtgctgcaatgtgtgggatgaaaattgttgctgtcgggacagatgcaaaaggaaacattaatattgaagagttgaggaaggctgctgaggcaaataaggataaccttgctgctctcatggttacatacccatcaacacatggagtgtatgaggaaggaattgatgagatatgtaagattatccatgacaatggtggtcaggtgtacatggacggggctaacatgaatgcacaggttggtttgacaagccctggctttattggtgctgatgtttgtcatctaaatctccataaaacattctgcattcctcatggtggaggaggtcccggaatgggtccaattggagtgaagaagcacttggcaccatatttgccatcacaccctgtggtaccaactggagggatcccatcccccgacaagagtgagccacttggtgctatttctgctgcaccctggggttcagcacttattttgccgatttcatatacctacattgccatgatggggtctaagggacttacagatgcatcaaagatagctatcctgagcgcaaactacatggcgaagcgtttggagaagcactacccagtcctcttccgaggtgtcaatggaacatgtgcccatgagtttatcattgacctgaggggctttaagaacactgctgggatagaacctgaagatgttgctaaacgtcttattgactatggatttcatggacctacaatgtcttggccagttcctggtacacttatgattgaacctactgaaagtgaaagcaaggcggaactagacaggttttgtgatgcactcatctccatcagagaagaaattgctcagattgagaaagggaatgttgatattaacaacaatgttctcaagggggctcctcatccaccatcaatgctcatggcagatgcatggacaaaaccatattctcgggaatatgctgcataccctgctccctggctaaggagtgccaaattctggccaactacaggacgagtggacaatgtgtatggagatcgcaacctgatctgcacccttcttccagtgtcagaaatggctgaagaaaaagctgcaactgcttaa

SEQ ID NO: 3063 - protein, 1035 aa, Solanum tuberosum
MERARKLANRAILKRLVSQSKQSRSNEIPSSSLYRPSRYVSSLSPYTFQARNNAKSFNTQQARSISVEALKPSDTFPRRHNSATPEEQTKMAEFCGFQSLDALIDATVPQSIRSESMKLPKFDSGLTESQMIEHMQNLASKNKVFKSYIGMGYYNTYVPPVILRNLLENPAWYTQYTPYQAEISQGRLESLLNYQTMITDLTGLPMSNASLLDEGTAAAEAMAMCNNILKGKKKTFLIASNCHPQTIDICKTRADGFDLKVVTVDLKDIDYKSGDVCGVLVQYPGTEGEILDYGEFIKNAHAHGVKVVMASDLLALTMLKPPGELGADIVVGSAQRFGVPMGYGGPHAAFLATSQEYKRMMPGRIIGLSVDSTGKPALRMAMQTREQHIRRDKATSNICTAQALLANMAAMYAVYHGPEGLKTIGQRVHGLAGTFSAGLKKLGTVEVQDLPFFDTVKVKCSDAKAIADVANKNDINLRIVDNNTITVSFDETTTLEDVDDLFKVFALGKPVPFTAQSIAQEVENLIPSGLTRETPFLTHQIFNSYHTEHELLRYLHKLQSKDLSLCHSMIPLGSCTMKLNATTEMMPVTWPSFANIHPFAPTEQAAGYQEMFDDLGALLCTITGFDSFSLQPNAGAAGEYAGLMVIRAYHMSRGDHHRNVCIIPVSAHGTNPASAAMCGMKIVAVGTDAKGNINIEELRKAAEANKDNLAALMVTYPSTHGVYEEGIDEICKIIHDNGGQVYMDGANMNAQVGLTSPGFIGADVCHLNLHKTFCIPHGGGGPGMGPIGVKKHLAPYLPSHPVVPTGGIPSPDKSEPLGAISAAPWGSALILPISYTYIAMMGSKGLTDASKIAILSANYMAKRLEKHYPVLFRGVNGTCAHEFIIDLRGFKNTAGIEPEDVAKRLIDYGFHGPTMSWPVPGTLMIEPTESESKAELDRFCDALISIREEIAQIEKGNVDINNNVLKGAPHPPSMLMADAWTKPYSREYAAYPAPWLRSAKFWPTTGRVDNVYGDRNLICTLLPVSEMAEEKAATA

SEQ ID NO: 3064 - DNA, 2886 bp, Streptomyces avermitilis
  CDS (1)..(2886): transl_table=11
atgaccgcccatcgcattccgctctccgatctcgaacagggaatccccttcgagcagcgccacatcggccccgattccgaagcccgggccaagatgctcgcccaggtcggctacgggtcgctcgacgagctgaccgcgaccgccgtcccggacgtcatcaagaacgccgaggcgctggagctgccgggcgcgcgcaccgaggccgaggtgcttgccgaactgcgctccctcgccgaccgcaaccaggtcctcggttccatgatcggcctcggctactacggcaccttcacaccgccggtgatcctccggaacgtgatggagaacccggcctggtacaccgcgtacacgccgtaccagccggagatctcgcagggccggctggaggcgctgctgaacttccagaccgtcgtcgccgagctgaccgggctgccgacctccggcgcctcgctgctcgacgagggcaccgcggccgcggaggccatggcgctgtcccggcggatgggcaagaacaagaagggcctgttcctggtcgacgcggacgcgctgccgcagaccatcgccgtcatcgagacccgtgccgagccgaccggcgtcgaggtcgtcgtcgccgacctgagcgaaggcatccccgccgggatcgccgagcgcgagatcaacggcgtgctgatccagtacccgggcgcctccggtgccgtacgcgacatcaagccgctcgtcgagcaggcgcacgagctgggcgcggtcgtcaccgtcgccgccgatctgctcgcgctcacgctgctcacctcgccgggtgagctgggtgccgacatcgcggtcggtacgacgcagcggttcggtgtgccgatgggcttcggcgggccgcacgccggttacatggccgtgcgtgagaagttcgcgcgcagcctgcccggccggctcgtgggcgtgtccgtggacgccgacgggcacaaggcgtaccggctcgccctgcagacgcgggagcagcacatccgccgcgagaaggcgaccagcaacatctgtacggcccaggtgctgctcgccgtgatggccggcatgtacgccgtgtaccacgggcccgacggactgaggacgatcgcgcggcgtacgcaccggtacgccacgatcctcgccgaagggctgaaggccggcggcgtcgaggtcgtgcacggcgcgtacttcgacacgctgaccgcgcgggtgccgggccgggccgccgagatcgtcgccgccgcgcgtgagggcggggtcaacctgcacctcgtcgacgcggacctcgtgtcgatctcctgtgacgagaccaccacgcgggcccaactgggcgccgtctggaccgcgttcggcgtcgagggcgacatcgaggcgttggacgcggcggccgaggacacactgccggccgcgctcctgcgtaccgacgactacctgacccacccggtcttccaccagtaccgttccgagaccgcgatgctgcgctacctgcgcaggctctccgaccgcgactacgcgctcgaccgcggcatgatcccgctgggctcctgcaccatgaagctcaacgcgaccaccgagatggagccggtcacctggcccgagttcgggcagctgcaccccttcgcgcccgccgagcaggcgcagggctacctcacgctcatccgggaactggaggagcggctcgccgaggtcaccggctacgacaaggtgtcgctccagccgaacgccggctcccagggcgagctggccgggctgctcgccgtacgtgggtaccaccgcgccaatggcgacgagcagcgcacggtctgcctgatcccgtcctccgcgcacggcacgaacgcggcgagcgccgtgatggccggcatgaaggtcgtcgtggtgaagacggccgacgacggtgagatcgacgtcgaggacctgcgcgccaagatcgagcagtaccgcgacgagctgtcggtgctgatgatcacgtacccctcgacgcacggtgtgttcgaggagcacgtcgccgacatctgcgcccaggtgcacgaggcgggcggccaggtgtacgtcgacggagccaacctcaacgcgctggtcgggctcgccaagccgggccacttcggcggtgacgtctcgcacctcaacctgcacaagacgttctgcatcccgcacggcgggggcggtccgggcgtcgggccggtcggtgtgcgcgcccacctggcgccgtatctgccgaaccacccgctccagcccgaggccggccccgcgacgggcgtcggcccgatctcggccgcgccctggggctccgcgggcatcctgcccatctcctggtcgtacgtccggctgatgggcggcgagggcctcaagcgcgccacgcaggtggcggtgctgtccgccaactacatcgccaagcggctggagccgcactacccggtgctctacaccggtcctggcgggctcgtcgcgcacgagtgcatcatcgatctgcgtccgctgaccaaggcgaccggcgtgagtgtcgacgacatcgccaagcggctgatcgactacggcttccacgcgccgacgatgtcgttcccggtggcggggacgctgatgatcgagccgaccgagtccgaggacctgggcgagctcgaccggttctgcgaggccatgatcgccattcgtgcggaggtcgagaaggtcggctcgggcgagtggccggcggaggacaacccgctgcggaacgcgccgcacaccgcggccgcgctcggcggagagtgggagcacgcctacagccgtgaggaggccgtcttcccggcgggtgtctcggccgcggacaagtactggccgccggtgcgccgtatcgaccaggccttcggcgaccgcaacctggtctgctcctgcccgccgctggacgcttacgacgactga

SEQ ID NO: 3065 - protein, 961 aa, Streptomyces avermitilis
MTAHRIPLSDLEQGIPFEQRHIGPDSEARAKMLAQVGYGSLDELTATAVPDVIKNAEALELPGARTEAEVLAELRSLADRNQVLGSMIGLGYYGTFTPPVILRNVMENPAWYTAYTPYQPEISQGRLEALLNFQTVVAELTGLPTSGASLLDEGTAAAEAMALSRRMGKNKKGLFLVDADALPQTIAVIETRAEPTGVEVVVADLSEGIPAGIAEREINGVLIQYPGASGAVRDIKPLVEQAHELGAVVTVAADLLALTLLTSPGELGADIAVGTTQRFGVPMGFGGPHAGYMAVREKFARSLPGRLVGVSVDADGHKAYRLALQTREQHIRREKATSNICTAQVLLAVMAGMYAVYHGPDGLRTIARRTHRYATILAEGLKAGGVEVVHGAYFDTLTARVPGRAAEIVAAAREGGVNLHLVDADLVSISCDETTTRAQLGAVWTAFGVEGDIEALDAAAEDTLPAALLRTDDYLTHPVFHQYRSETAMLRYLRRLSDRDYALDRGMIPLGSCTMKLNATTEMEPVTWPEFGQLHPFAPAEQAQGYLTLIRELEERLAEVTGYDKVSLQPNAGSQGELAGLLAVRGYHRANGDEQRTVCLIPSSAHGTNAASAVMAGMKVVVVKTADDGEIDVEDLRAKIEQYRDELSVLMITYPSTHGVFEEHVADICAQVHEAGGQVYVDGANLNALVGLAKPGHFGGDVSHLNLHKTFCIPHGGGGPGVGPVGVRAHLAPYLPNHPLQPEAGPATGVGPISAAPWGSAGILPISWSYVRLMGGEGLKRATQVAVLSANYIAKRLEPHYPVLYTGPGGLVAHECIIDLRPLTKATGVSVDDIAKRLIDYGFHAPTMSFPVAGTLMIEPTESEDLGELDRFCEAMIAIRAEVEKVGSGEWPAEDNPLRNAPHTAAALGGEWEHAYSREEAVFPAGVSAADKYWPPVRRIDQAFGDRNLVCSCPPLDAYDD

SEQ ID NO: 3066 - DNA, 2886 bp, Streptomyces coelicolor
  CDS (1)..(2886): transl_table=11
atgaccgcccaccgcactccgctctccgaactcgaacaggccatgcccttcgagcagcgccacatcggccccgatcacgaggcccgggccaagatgctcgcgcaggtcggttacggttcgctcgacgaactgacggccgccgcggtgccggatgtgatcaagaacgccgaccggctggatctgccgggcgcgcgctccgaggccgaggtgctggccgagctgcgctccctggccgaccgcaaccaggtcctcgactccatgatcggcctcggctactacggcaccttcaccccgccggtcatcctgcgcaacgtcatggagaacccggcctggtacacggcgtacacgccctaccagccggagatctcccagggccgtctcgaagccctgctgaacttccagacgatggtcgccgagctcaccggactgcccacctccggcgcctcgctgctcgacgagggcaccgccgccgccgaggcgatggccctctcccggcgcatgggcaagaacaagaagggcctgttcctggtcgacgcggacgccctgccgcagaccgtcgccgtgatacggacccgcgccgagccgaccggcgtcgaggtcgtcgtcgccgacctgagcgagggcatccccgccgaggtcgccgagcgcgagatcaacggcgtcctgctccagtacccgggcgcctccggagccgtccgcgacatcaagccggtgatcgaccgggcgcacgaactcggcgcgctcgtcaccgtcgccgccgacctgctcgccctcaccctgctcacctcgcccggcgagctgggcgcggacatcgcggtgggcaccacccagcgcttcggcgtgccgatgggcttcggcggaccgcacgccggctacatggcggtgcacgagaagttcgcccgcagcctccccggccgcctggtcggcgtctccgtcgacgccgacggcaacaaggcctaccgcctggctctgcagacccgcgagcagcacatccgccgcgagaaggccaccagcaacatctgcaccgcgcaggtgctgctcgccgtcatggccggcatgtacgccgtctaccacggccccgagggcctgcgggccatcgcccgccgaacccaccggtacgccacgatcaccgccgccggcctcgccgcgggcggcgtcgagatcgtccacggctcctacttcgacaccgtcaccgcgcgggtgcccggccgggccgccgggatcgtgcacgccgcccgcgagaacggcatcaacctgcggctcgtcgacgccgaccacgtgtcgttcgcctgcgacgagaccaccacgcgcgcccaggtcggcggcgtgtggcacgccttcggcgtggagggcgacatcgagtcgctggacgcggaggccggggagacgctgcccgaggcgctgctgcgcaccgacgacttcctcacccaccccgtcttccaccagcaccgctccgagaccgcgatgctgcgctacctgcgccgcctcgccgaccgggactacgcgctggaccgcggcatgatcccgctgggctcctgcaccatgaagctcaacgcgaccaccgagatggagccggtcacctggcccgagttcggcgcgctgcaccccttcgcgcccgccgagcaggcgcagggctacctcaccctcatccgcgagctggaggagcggctcgccgaggtcaccgggtacgacaaggtctcgctccagccgaacgccgggtcgcagggcgagttcgcgggcctgctcgccgtacgcggctaccaccgggccaacggcgacgagcagcgcaccgtctgcctcatcccgtcctcggcgcacggcaccaacgccgccagcgccgtgatggccggcatgaaggtcgtcgtcgtcaagaccgccgaggacggcgagatcgacgtcgaggacctgcgcgccaagatcgacaagcaccgcgacgagctggccgtgctgatgatcacctacccgtccacgcacggcgtgttcgaggagcacgtcgccgacatctgcgcgcaggtgcacgacgcgggcggccaggtctacgtggacggcgccaacctcaacgccctggtcggcctcgccaagcccggccacttcggcggcgacgtctcccacctgaacctgcacaagaccttctgcatcccgcacggcggcggcggccccggcgtgggccccgtcggcgtacggtcgcacctggcgccgtacctgcccaaccacccgctgcagcccgcggccggtccgcagacgggcgtcggcccgatctcggcggcgccgtggggctcggccggcatcctgccgatctcctggtcctacgtccgcctgatgggcggcgagggcctcaagcgcgccacgcaggtcgccgtgctgtccgccaactacatcgccaagcgcctggagccgcacttcccggtgctctacaacggccccggcgggctggtcgcgcacgagtgcatcatcgacctgcgcccgctgaccaaggccaccggcgtgagcgtcgacgacgtcgccaagcggctgatcgactacggcttccacgcgccgacgatgtccttcccggtggccggcacgctgatgatcgagccgaccgagtccgaggacctggccgagctggaccggttctgcgaggcgatgatcgccatccgcgcggagatcgagaaggtcggctccggcgcctggcccgccgacgacaacccgctgcgcggcgccccgcacaccgcggacgcgctcggcggtgagtgggaccacgcgtacacccgcgaggaggccgtcttcccggccggggtgtccgccgccgacaagtactggccgccggtgcgccgcatcgaccaggcctacggcgaccggaacctggtctgctcctgcccgccgctggacgcgtacgaggactga

SEQ ID NO: 3067 - protein, 961 aa, Streptomyces coelicolor
MTAHRTPLSELEQAMPFEQRHIGPDHEARAKMLAQVGYGSLDELTAAAVPDVIKNADRLDLPGARSEAEVLAELRSLADRNQVLDSMIGLGYYGTFTPPVILRNVMENPAWYTAYTPYQPEISQGRLEALLNFQTMVAELTGLPTSGASLLDEGTAAAEAMALSRRMGKNKKGLFLVDADALPQTVAVIRTRAEPTGVEVVVADLSEGIPAEVAEREINGVLLQYPGASGAVRDIKPVIDRAHELGALVTVAADLLALTLLTSPGELGADIAVGTTQRFGVPMGFGGPHAGYMAVHEKFARSLPGRLVGVSVDADGNKAYRLALQTREQHIRREKATSNICTAQVLLAVMAGMYAVYHGPEGLRAIARRTHRYATITAAGLAAGGVEIVHGSYFDTVTARVPGRAAGIVHAARENGINLRLVDADHVSFACDETTTRAQVGGVWHAFGVEGDIESLDAEAGETLPEALLRTDDFLTHPVFHQHRSETAMLRYLRRLADRDYALDRGMIPLGSCTMKLNATTEMEPVTWPEFGALHPFAPAEQAQGYLTLIRELEERLAEVTGYDKVSLQPNAGSQGEFAGLLAVRGYHRANGDEQRTVCLIPSSAHGTNAASAVMAGMKVVVVKTAEDGEIDVEDLRAKIDKHRDELAVLMITYPSTHGVFEEHVADICAQVHDAGGQVYVDGANLNALVGLAKPGHFGGDVSHLNLHKTFCIPHGGGGPGVGPVGVRSHLAPYLPNHPLQPAAGPQTGVGPISAAPWGSAGILPISWSYVRLMGGEGLKRATQVAVLSANYIAKRLEPHFPVLYNGPGGLVAHECIIDLRPLTKATGVSVDDVAKRLIDYGFHAPTMSFPVAGTLMIEPTESEDLAELDRFCEAMIAIRAEIEKVGSGAWPADDNPLRGAPHTADALGGEWDHAYTREEAVFPAGVSAADKYWPPVRRIDQAYGDRNLVCSCPPLDAYED

SEQ ID NO: 3068 - DNA, 2865 bp, Synechococcus elongatus
  CDS (1)..(2865): transl_table=11
gtgatggtcagttcaccgccccaactagagatcaacttagagaccgatgccgaatttgtagcgcggcacattggtattacgcccagcgatctaccgaagatgttgagcctgttgggatatggcagcctcaaggaactcatcaatgccgtcattccgccggagattcgtttgcaacgccctcttgcccttagcgagggtctgagtgaaacggcagccctgcaaaaattacgcacccttgcccagcaaaaccaagtttggcgcagctatatcggcatgggctactacaactgcattacaccctccgtcattcagcgcaacattcttgaaaaccccggctggtacacccagtacaccccctaccaagcggaaattgcccaaggacgcctggaagccctccttaactttcaaaccctggtgagcgatctgacgggcctggccattgccaatgcctccctcctcgatgaagccacggctgccgccgaagccatgaccctgagcttcaatgcctgccgtcaaaggggcgccaaccgcttcctggtggcccaggattgccatccccaaacccttgccgttctgcgtacccgtgccctaccccttggcatccagattgtgcccattgacccgatcgctggggaattgccctgggagaatgcctttggcctcctcctgcaatatcccgctagcgatggcgcggtgcgatcgccccaagccctgattgccgctgcccatgaacggggacttctggtgaccgtagccacggatttgctggccttgaccctgttgaggccgccgggggaattgggggcagatattgccgtgggtagttcgcagcgctttggggtgcccttgggctatgggggtccccatgccgccttctttgccacccgtgaagactttaagcggcagttgccagggcgcctagtgggggtttcccacgatgccttggggcaaagggcattgcgccttgccctgcaaacccgtgagcagcacatccgtcgtgaaaaggctaccagtaacatttgcactgcccaagtcctgctggcagtggtagccagtatgtatgccgtctatcatgggcccgatgggctgcggcaaattgctgagcgcattcatcaacggacggtgagactggcagcaggtttagaagcggcaggctatcaactctactattctgaattttttgacaccctacgcattggcttggggaacttgcccgtgcctgtgctcaaggagcgggcagcggcagcccgcatcaacctgcgctactttgacgatggcagtgcgggtatcagcctcgatgagaccaccactgagaaagatgtagcggatttactggccctctttggcgcccgtcctgctgaagttgaggggggcgatcgcctgcccgccgccctgaaacgtcaatccccttatctccagcacccggtctttcaggactaccacagcgaacacgcgctgctgcgctacattcatcgccttcaggccaaggatctctccctcaccacctcaatgattccccttggctcctgcacgatgaagctgaatgccacagctgaaatgctgcccatcagttggccagaattcaatcagctccatccctttgctccccaagaacaggctcagggataccaggcgctctttcgggaactggcggccatgctggcggaaattacgggctttgatgccatttccctgcaacccaatgctggctcccaaggggagtatgcgggactcttggtgattcgtcagtaccaccacagccgcggcgaaagtcagcgcaatgtctgtctcattcccacctctgcccatggcaccaaccccgccagtgccgtgatggctggcatgcaagtcgtggctgtgaattgcgatgcccaaggcaacattgatgtggcggatctggcggccaaggctgagacctatggcgatcgcctggcggccttgatgatcacctatccctccacccatggcgtctttgaaacgggaatttgccaaatctgcgacatcatccatcgctacggtgggcaagtttatatggatggtgcgaatatgaatgcccaagtggggctgtgccgtccgggggactttggtgctgatgtttgccatctcaacctccacaaaaccttttgtattccccacggtgggggtgggccgggggtggggcccatcggagtcaaggcccatttagctccctttttgccaacgacgcaggtgattccccaggggtcagaaactggccctgtgaccgccgcaccttggggcagtgccagtattttgccgatttcatggatgtatatcaccctgatggggggggtggggctgacccgggccacggcgatcgccatcctcaacgccaactacattgccaaacgccttgaaccctactatcccgttctctacaagggtgcccacggcttggtggcccacgagtgcattctcgatctgcgtcccctgaaaaaatcagcggggattgaggtggaggatattgccaagcggttgatggactacggcttccatgctcccactgtctcttggccagtgcccggcacgctgatgattgaacccacagagagtgaaaccaaggcggaattggatcgcttctgtgaggcgatgattgccattcgttcagaaattgctgaaattgaggccggggtcagcgatcgccagcaaaaccccctgaaaaatgccccccatccagcactgatgctggccacagagccatggccctacccctattcgcgggaggtggccgcctaccctgccccctggctgcgggagtacaaattctggccagcggtagcccgtattgacaatgcctatggcgatcgccacctcgtttgtacctgctcaatgcccctgaccaactag

SEQ ID NO: 3069 - protein, 954 aa, Synechococcus elongatus
MMVSSPPQLEINLETDAEFVARHIGITPSDLPKMLSLLGYGSLKELINAVIPPEIRLQRPLALSEGLSETAALQKLRTLAQQNQVWRSYIGMGYYNCITPSVIQRNILENPGWYTQYTPYQAEIAQGRLEALLNFQTLVSDLTGLAIANASLLDEATAAAEAMTLSFNACRQRGANRFLVAQDCHPQTLAVLRTRALPLGIQIVPIDPIAGELPWENAFGLLLQYPASDGAVRSPQALIAAAHERGLLVTVATDLLALTLLRPPGELGADIAVGSSQRFGVPLGYGGPHAAFFATREDFKRQLPGRLVGVSHDALGQRALRLALQTREQHIRREKATSNICTAQVLLAVVASMYAVYHGPDGLRQIAERIHQRTVRLAAGLEAAGYQLYYSEFFDTLRIGLGNLPVPVLKERAAAARINLRYFDDGSAGISLDETTTEKDVADLLALFGARPAEVEGGDRLPAALKRQSPYLQHPVFQDYHSEHALLRYIHRLQAKDLSLTTSMIPLGSCTMKLNATAEMLPISWPEFNQLHPFAPQEQAQGYQALFRELAAMLAEITGFDAISLQPNAGSQGEYAGLLVIRQYHHSRGESQRNVCLIPTSAHGTNPASAVMAGMQVVAVNCDAQGNIDVADLAAKAETYGDRLAALMITYPSTHGVFETGICQICDIIHRYGGQVYMDGANMNAQVGLCRPGDFGADVCHLNLHKTFCIPHGGGGPGVGPIGVKAHLAPFLPTTQVIPQGSETGPVTAAPWGSASILPISWMYITLMGGVGLTRATAIAILNANYIAKRLEPYYPVLYKGAHGLVAHECILDLRPLKKSAGIEVEDIAKRLMDYGFHAPTVSWPVPGTLMIEPTESETKAELDRFCEAMIAIRSEIAEIEAGVSDRQQNPLKNAPHPALMLATEPWPYPYSREVAAYPAPWLREYKFWPAVARIDNAYGDRHLVCTCSMPLTN

SEQ ID NO: 3070 - DNA, 2880 bp, Synechococcus sp
  CDS (1)..(2880): transl_table=11
gtgacctcccccttcctgcagcgtcacgtcggtcccagcgactccgaacagcaacagatgctctccgcgctgggctacgcggacatggctgcctttctggctgacgttgtgccggaggacatccttgatgaatttccaccgcaggggttgcttccaccaggttgtggcgaagccgaagccctagtccatctgcgcgagatcgcagccgccaataattcacgccgctcgttgatcggcctgggttactacggaacttccacgccggctttgatccagcgccacgtcttcgaaaatcctgcttggtacacggcctacaccccgtatcaagcggagattgcccagggacgcctcgaggccctgttgaatttccagaccctgatcagcgagctgaccggtctgcccatcgctaatgcgtctttgttggatgaggccacggcggcagcggaagcgatgagcctgagttacggcatttgtcgacggacggaggccaaccgcttcctggtggatgccaacgttcttccccagacctgggccgtgctgcagacccgcgcggaacccttggggatcgatctggagcgtgtcaccccagagcaggccagctttgacgcctcagtgtttggcgtgctgctgcagttgccgggcgctgatggtcagatctgggatcccacggccgtgattgcccgtgcccacgaggctggggccctggtgacggtcgccatcgatcctctggctcaggccttgatcgctcctgtggcgtccttcggcgctgacattgctgttggcagcgcccagcgtttcggtgtgccgatgggtttcggggggccccatgccgccttctttgccaccaaggacacctacaagcgccagatccccggccgtcttgtgggtcagtccagggattcggcagggaatccagccctgcgtctggcattgcagacccgtgagcagcacatccgccgcgacaaggccaccagcaacatctgcacggcccaggttctgctggcggtgatggcgtccttctacgccgttcatcacggccccgaaggtctgatgtcgatcgcccgtcgaatcgtcggtcagcgccggcagcttgagcgtgctttgcaaagccttggttttgttgtgccggacggagagcgcttcgacacggtcaccgtgacctcagctctggcgccagccgtgcatcaagcggttggggaagcaggcttcaacctgcgggtgctcccggatggcgcgaatcccgccgagtcaacgggttttggcatcgccttggatgaatgcaccacggccgatgaactctccaggttggtcgcggccttggccacggccgctggccagacttctccctccttaccgctggcgcccgttgaggagctgtgcggtgtgcccgagcgggttgacccctggcttagccaatcggtgtttcacgaccatctcagtgagaccgaactgatgcgctatatccagcgcctggtgagtcgagatctttccttggtgcacgggatgatccccctcgggagttgcaccatgaagctcaatgcagccgctgagctgctgcccgtgagctggcccgccttcgctggcctgcaccccttcgctccgatggctcaggccgccggctaccagcggttggctgagcagctggaggcttggctcgcagctctcacggggtttgcggcggtgtccctgcagcccaatgctgggtcccagggggagtacgccgggctgctggtgattcgtgcctggcatcgctccaggggcgacgaccatcgtgatgtctgcctgatccccaccagtgcccacggcacgaatcccgccagtgccgtgatggcgggtctcaaggtggtggctgtggcttgcgacgctgacggcaacatcgatcagcaggatctggctgcccgtgcagcggagcacgccgaccgcctggcggccctgatggtcacctacccctccacccatggcgtcttcgaaaccggcattcgcgggatttgtgagctggtgcatcgccacggtggtcaggtgtatctcgatggcgccaacctcaatgcccaagtcggtttgtgccgtccgggcgccttcggtgccgatgtctgccatctgaaccttcacaagaccttctgcattccccacggcggtggcggacccggtgttggtccgatcggtgtggcggaccatctcgctccctttctccccggtcatcccatgcaggcttcgccagatcaagccattgggccagtgtctgcagcagctttgggcagcgcgagcatcctgccgatcagctggatgtacctgcggatgatgggggcggaggccctgcgccaggccacagcggtggcgttgctgtctgccaactatctggcccttcgcctggacccgcactaccccgtgctgttccgcggtgccaccggacgtgttgcccatgaatgcatccttgatttgcgtccgttgaaacgggatgccgggatcgatgtggatgacatcgccaaacgattaatggattacggcttccacgcgccgacggtgagttggcctgtggccggcaccgtgatggtggagcccaccgaaagcgaaagcctggcggaattggatcgtttcgctgacgccatgattgccatccgcaatgaaattcgggatatcgaatcaggggctatggatgccagcaataaccccttgaaacaggctcctcacacgatggctgctgtcatcgccgaggactgggatcgtccttacagccgacaacaggctgcattcccgttgcctgatcagcagcagaacaaggtgtggcccgcggtggctcgtattgacaatgcctatggcgatcgcaacttgatttgcacctgcccaagtgttgaagagattgccgtggcggttgctgcttaa

SEQ ID NO: 3071 - protein, 959 aa, Synechococcus sp
MTSPFLQRHVGPSDSEQQQMLSALGYADMAAFLADVVPEDILDEFPPQGLLPPGCGEAEALVHLREIAAANNSRRSLIGLGYYGTSTPALIQRHVFENPAWYTAYTPYQAEIAQGRLEALLNFQTLISELTGLPIANASLLDEATAAAEAMSLSYGICRRTEANRFLVDANVLPQTWAVLQTRAEPLGIDLERVTPEQASFDASVFGVLLQLPGADGQIWDPTAVIARAHEAGALVTVAIDPLAQALIAPVASFGADIAVGSAQRFGVPMGFGGPHAAFFATKDTYKRQIPGRLVGQSRDSAGNPALRLALQTREQHIRRDKATSNICTAQVLLAVMASFYAVHHGPEGLMSIARRIVGQRRQLERALQSLGFVVPDGERFDTVTVTSALAPAVHQAVGEAGFNLRVLPDGANPAESTGFGIALDECTTADELSRLVAALATAAGQTSPSLPLAPVEELCGVPERVDPWLSQSVFHDHLSETELMRYIQRLVSRDLSLVHGMIPLGSCTMKLNAAAELLPVSWPAFAGLHPFAPMAQAAGYQRLAEQLEAWLAALTGFAAVSLQPNAGSQGEYAGLLVIRAWHRSRGDDHRDVCLIPTSAHGTNPASAVMAGLKVVAVACDADGNIDQQDLAARAAEHADRLAALMVTYPSTHGVFETGIRGICELVHRHGGQVYLDGANLNAQVGLCRPGAFGADVCHLNLHKTFCIPHGGGGPGVGPIGVADHLAPFLPGHPMQASPDQAIGPVSAAALGSASILPISWMYLRMMGAEALRQATAVALLSANYLALRLDPHYPVLFRGATGRVAHECILDLRPLKRDAGIDVDDIAKRLMDYGFHAPTVSWPVAGTVMVEPTESESLAELDRFADAMIAIRNEIRDIESGAMDASNNPLKQAPHTMAAVIAEDWDRPYSRQQAAFPLPDQQQNKVWPAVARIDNAYGDRNLICTCPSVEEIAVAVAA

SEQ ID NO: 3072 - DNA, 2952 bp, Synechocystis sp
  CDS (1)..(2952): transl_table=11
atgcccaacctagagcccgccgttgttgtccctacctccgaggcgatcgccgttgacctgactaagctagaggagaagttagctccggcggatagttttttggatcgtcacttgggccccggagaaacggaacagcggcaaatgctccagacactgggttttgatactttgggggatttgattgaccaagccgtgcccccggccattcgctttccccggtctttgcaactaccagcttcccaaagtgagtatggggcgatcgcccaactgaaatccattgcctccaaaaatcaagtttttcgctcctatattggcatggggtactacgacaccatcaccccgccggttatccaacggaacattttagaaaaccccggttggtacacagcctataccccctaccaagcggaaattgcccagggtcggttggaagcgctgttgaattttcaaaccatggtgatggatttaaccgggctggaaattgccaatgcttctttgttggatgaaggtaccgccgccgctgaagccatggccctgagttatggggtcagcaaaagtaaagccaatgcttttttcgttgcccaggactgccatccccaaaccattgaggtgattaaaacccgggccaatcccctcggtattgaagtaattgtcggcgaccatcatactttttccttttctacgtccattttcggcgctttactgcaataccctgccaccgatggggctgtttatgattaccgtagtttcattgacaaagcccatcaacaccaagccttggttaccctggccgccgaccccctcagtctgaccctgctcactccccccggtgaattgggggctgacattgcggtgggcagtacccagaggtttggcattcccttgggttacggtgggccccacgccgcctactttgccaccaaggccgaatatcagcggaaaatgccgggacgcattgtgggggtttccaaggatgcccatggtaaccccgctctccgtttagcgctgcaaaccagggaacaacatatccgtcgggacaaggccactagtaatatctgtactgcccaggttctcttggcagtgatggcttctatgtatggggtgtaccacggttccacggggctaaaaaatattgccctgagaattcaccagttgacggtcctattggcgatcggcttaaagcggttaaattacagtctcaataatgattactttttcgataccctgcgggtgggggtaggggaacagagtgctccagccattttgaaagcggcggaagggcggggaattaatctgcggcccctggtccctggggaagtgggcattagcttggatgaaacggtgacggtgcaggatctgcttgacctgtggcaagtttttgctggtaaggataatttaccctttacaccggaggaactgtggtcggaagttaaaacgagctttcccgccgatttaacccgtcagagtctatacctacaggatgcagtttttaatcagtaccattccgaaaccgagttactgcgttatttgcatcaattagaaagcaaagatttagccctaaacacttccatgattccgttgggttcctgcacgatgaaactcaacgccacagcggaaatgatgccggttacttggcctgaatttggcaaaattcacccctttgcccccgctggtcaaacggaaggttatcagattttatttgcccaattggaagcctggttgggggaaatcaccggttttgatgccatttctttgcaacctaatgccggttcccaaggagaatatgcgggtttgcaggtgatccgtcagtatcacctcagtcggggtgaggaacaacgcaatatttgtttaatccctgaatcggcccacggcaccaatccagccagtgcggtgatgtgtggcatgcaggtggtcccggttaagtgcgacggggaaggcaacatcgatgtggaagatttgaccagtaaagcagaaaagtacggcgatcgcctggcggcgttaatggtgacctatccttctacccatggggtatttgaagccaccatcggaactatttgcgacattgtgcatcgttttggcggcgaggtttacatggatggggccaatatgaatgcccaggtgggactgtgccgtccggctgattttggggcggatgtgtgccatctcaatttacacaagactttttgcattccccacggcggtggcggccccggtatgggccccattggggttaaatcccatttgcaggcatttttaccccggactagtttaaattcgactgctgaactccaagcagaagaccaatccattggcatgatttccgctgccccttacggcagtgccagtatcttggttatttcttggatgtacattgccatgatgggcccccagggtttaaccaaggcaacggaggtggccattctcagtgccaattacatggcaaagcggctggaaaattattaccccattttattcaggggcaataatgagttagtggcccatgaatgcattctcgatctgcgtcccctgaagaaacaagcggcgatcgaggtcgaagatgtggccaaacgcctcatggattttggtttccatgcccccacggtgtcctggccggtgctgggtaccatgatggtggagccgacggagagtgaatccctaggggagttagaccgtttttgtgatgccatgattgccatttaccaagaagctcaggcgatcacccatggagaaattgatcccgctgataacccgttgaaaaatgctccccatacggcccaatccctcatctgtggcgaatggaaccatccctacagccaggaagaagctgcttaccctgctccttggactaagcagtttaaattttggcccgccgttggccgcattaataatacctacggtgatcgccatttagtttgctcctgtgaaggtatggaggcttataaggaaggatag

SEQ ID NO: 3073 - protein, 983 aa, Synechocystis sp
MPNLEPAVVVPTSEAIAVDLTKLEEKLAPADSFLDRHLGPGETEQRQMLQTLGFDTLGDLIDQAVPPAIRFPRSLQLPASQSEYGAIAQLKSIASKNQVFRSYIGMGYYDTITPPVIQRNILENPGWYTAYTPYQAEIAQGRLEALLNFQTMVMDLTGLEIANASLLDEGTAAAEAMALSYGVSKSKANAFFVAQDCHPQTIEVIKTRANPLGIEVIVGDHHTFSFSTSIFGALLQYPATDGAVYDYRSFIDKAHQHQALVTLAADPLSLTLLTPPGELGADIAVGSTQRFGIPLGYGGPHAAYFATKAEYQRKMPGRIVGVSKDAHGNPALRLALQTREQHIRRDKATSNICTAQVLLAVMASMYGVYHGSTGLKNIALRIHQLTVLLAIGLKRLNYSLNNDYFFDTLRVGVGEQSAPAILKAAEGRGINLRPLVPGEVGISLDETVTVQDLLDLWQVFAGKDNLPFTPEELWSEVKTSFPADLTRQSLYLQDAVFNQYHSETELLRYLHQLESKDLALNTSMIPLGSCTMKLNATAEMMPVTWPEFGKIHPFAPAGQTEGYQILFAQLEAWLGEITGFDAISLQPNAGSQGEYAGLQVIRQYHLSRGEEQRNICLIPESAHGTNPASAVMCGMQVVPVKCDGEGNIDVEDLTSKAEKYGDRLAALMVTYPSTHGVFEATIGTICDIVHRFGGEVYMDGANMNAQVGLCRPADFGADVCHLNLHKTFCIPHGGGGPGMGPIGVKSHLQAFLPRTSLNSTAELQAEDQSIGMISAAPYGSASILVISWMYIAMMGPQGLTKATEVAILSANYMAKRLENYYPILFRGNNELVAHECILDLRPLKKQAAIEVEDVAKRLMDFGFHAPTVSWPVLGTMMVEPTESESLGELDRFCDAMIAIYQEAQAITHGEIDPADNPLKNAPHTAQSLICGEWNHPYSQEEAAYPAPWTKQFKFWPAVGRINNTYGDRHLVCSCEGMEAYKEG

SEQ ID NO: 3074 - DNA, 2865 bp, Vibrio parahaemolyticus
  CDS (1)..(2865): transl_table=11
atgactgaattacttcaaagcctcagcacacaaaacgagttcgttggacgccacaacggaccaaaactttctgaccaacaaaaaatgttggaagcgatcaacgcagttagcctagacgcactgatcagcgaaaccgtaccagcaaacatccgccttgagcagccaatgacgttggcagaagcgaaaagcgaagcggacatgttggctacgatgaaacaattcgcaaaacaaaaccaagtcaaacgtacattcatcggtcagggttactacaacacgttcacgccaaatgtcattctgcgtaacgtactagaaaacccaggctggtacaccgcgtacacaccataccaaccagaaatttctcaaggccgtctggaatcactactgaacttccaacaaatggttatcgacctaaccggtatggaaatcgcaaacgcgtctttgcttgatgaagcaacggcagcggcagaagcgatgacactttgtaagcgcgcaggtaagagcaagagcaacgtattctttgtggctgacgatgtgcacccacaaaccatcgaagtggtaaaaacgcgtgcaaaattcatcggttttgaagtgctagttggttctttagaatctctaccagagcaagacgtattcggcgcgctggttcaatacccaagcacaacgggtgaagttcgtgacctaacggacatcatcgcgaaggcacaagcaaacaaaacccttgtcactgttgcgactgacctacttgcttgtaccctattgaagcctgctggagaaatgggcgcagacgtcgcaattggttcagctcagcgtttcggcgtaccaatgggttacggcggtccacacgcggcattcatggcaactcgtgacaaacacaaacgtacaatgccaggccgtgttatcggtgtttcaatcgatgcaaaaggcaaccaagcacttcgtatggcaatgcaaactcgcgagcagcacatccgccgcgaaaaagcgacatcaaacatctgtaccgctcaagcgttactagcaaacatggcctctttctacgcggtttaccacggtgctgaaggtctacgcaccattgctcgtcgcacgcaccacatgactgccatccttgctgctggcctaacaaaaggcggctttgaactggctcataacagcttcttcgacaccatcaccatcaacactggtgagaaaacgcaagatctgtacacaaaagcactcgcagcagacatcaacctacgcgtcctacctggcaaactaggcattagcttagatgaaacaacaaccgttgcagatgtcgaagctttgtttgctatctttggcgtaaaagaagacgttaccgcactatctacggaagtcgctggtaacgagtttgccgccattccagaagcgctacgtcgtacttcagaatacctaacgcacccagtgttcaacacttaccacagtgaaacacaaatgatgcgttacctaaaacagcttgaaaacaaagacttctcgctaacgcacggcatgatcccactaggcagctgtacgatgaagctaaacgcagctgcagagatgatcccaatcacttggcctgagtttggttctatccacccatttgcaccagcagaacaagcggcgggctatgcagcgctagcgaaagatctaaaagagaagctttgtgaaattacaggctacgacgcattctcactacagccaaactctggcgcatcgggcgagtatgcaggtcttatcgcgattcaacgctaccacgaaagccgtggcgaaggtcaccgcaacgtatgtttgatcccaagctctgcgcacggtactaaccctgcaaccgcatctatggtgtcaatgaaagttgtggttgttaagtgtgatgacgaaggcaacatcgacatcgacgacctagcagcgaaaatcgagaagcacaaagacaacctatccagcatcatgatcacttacccttctacgcacggcgtttacgaagagaaagtgaaagaagtgtgtgaaatggttcatgcagcaggcggtcaagtatacctagacggcgcgaacatgaacgcacaggttggtctaacgtcccctggctttatcggctcagacgtttctcacctaaacctacacaaaaccttctgtatccctcacggtggcggcggtccaggtatgggtcctatcggcgttaaatcgcacctagcacctttcctaccaggtcacatcgagaacggtgtagaaggcgaagacttcgcagtatcagctgcagattttggtagtgcatctatcctacctatctcttgggcttacatcgcaatgatgggtgaagcaggcttatccaacgcaaccaaggtcgcgattctaaacgctaactatgtgatggaacgtctacgccctcactaccctgttctttaccgtggtaaaaacggccgcgtagcgcacgaatgtattatcgacatccgtccgctgaaagaagaaacaggcattagcgaagaagatatcgccaagcgtctaatggactacggtttccacgcgccaaccatgtcgttcccagttgctggcacgctaatggttgaaccaacggaatctgaagacctagcagagctaaaccgcttctgtgatgcgatgatttctattcgtgaagaaatgacgaaagtgaaaaatggtgaatggccactagagaacaaccctctcgttaatgcgccacacacgcaagttgacctttctgctgaagaatgggatcgcccatactcacgcgaacttggctgcttcccatcaaaagcaaccaaatcttggaaatactggcctacagtaaaccgcgtagataacgtatacggcgaccgtaacctaatctgctcgtgcccaagcatcgataactacgaagactaa

SEQ ID NO: 3075 - protein, 954 aa, Vibrio parahaemolyticus
MTELLQSLSTQNEFVGRHNGPKLSDQQKMLEAINAVSLDALISETVPANIRLEQPMTLAEAKSEADMLATMKQFAKQNQVKRTFIGQGYYNTFTPNVILRNVLENPGWYTAYTPYQPEISQGRLESLLNFQQMVIDLTGMEIANASLLDEATAAAEAMTLCKRAGKSKSNVFFVADDVHPQTIEVVKTRAKFIGFEVLVGSLESLPEQDVFGALVQYPSTTGEVRDLTDIIAKAQANKTLVTVATDLLACTLLKPAGEMGADVAIGSAQRFGVPMGYGGPHAAFMATRDKHKRTMPGRVIGVSIDAKGNQALRMAMQTREQHIRREKATSNICTAQALLANMASFYAVYHGAEGLRTIARRTHHMTAILAAGLTKGGFELAHNSFFDTITINTGEKTQDLYTKALAADINLRVLPGKLGISLDETTTVADVEALFAIFGVKEDVTALSTEVAGNEFAAIPEALRRTSEYLTHPVFNTYHSETQMMRYLKQLENKDFSLTHGMIPLGSCTMKLNAAAEMIPITWPEFGSIHPFAPAEQAAGYAALAKDLKEKLCEITGYDAFSLQPNSGASGEYAGLIAIQRYHESRGEGHRNVCLIPSSAHGTNPATASMVSMKVVVVKCDDEGNIDIDDLAAKIEKHKDNLSSIMITYPSTHGVYEEKVKEVCEMVHAAGGQVYLDGANMNAQVGLTSPGFIGSDVSHLNLHKTFCIPHGGGGPGMGPIGVKSHLAPFLPGHIENGVEGEDFAVSAADFGSASILPISWAYIAMMGEAGLSNATKVAILNANYVMERLRPHYPVLYRGKNGRVAHECIIDIRPLKEETGISEEDIAKRLMDYGFHAPTMSFPVAGTLMVEPTESEDLAELNRFCDAMISIREEMTKVKNGEWPLENNPLVNAPHTQVDLSAEEWDRPYSRELGCFPSKATKSWKYWPTVNRVDNVYGDRNLICSCPSIDNYED

SEQ ID NO: 3076 - DNA, 2865 bp, Vibrio vulnificus
  CDS (1)..(2865): transl_table=11
atgactgaattacttcaaagcctcaacacacaacacgagttcgttggtcgccacaacggaccaaaccacgccgatcaacaaaaaatgctttctaccattaacgcagaaagcctagatgccttgatcgcacaaaccgttccagcacaaattcgccttgaaaagccaatgcaactggcagaagcacagagcgaagcagacatgctggcatcgatcaaaaagttcgctgatttaaaccaagttaagcgcactttcattggccaaggttactacaacaccttcacgccaaacgttattttgcgtaacgtactggaaaacccaggctggtacacggcttacacgccataccaaccagaaatttctcaaggtcgattggaatcattgttgaactatcaacaaatggtgatggacctaacgggcatggacatcgcaaacgcctctctactcgatgaagccaccgcagcagcagaagcgatgacgctttgccagcgcgctggtaagagcaagagcaaagtcttcttcgtggcagacgatgttcacccacaaaccattgaagtgatcaaaactcgcgcaaaatacttcggctttgacgtagtgatcggcaatgttgattcactcccacaaacagaagcgttcggtgccctacttcaatacccaagcacaacgggcgaagtacgcgatctcaccgatgtcatcacgcaagcacaagccaacaagacactggtttcagttgctaccgatctccttgcttctgcacttgtgaagccagccggcgaaatgggtgcagatgttgtcattggctcagcacaacgctttggcgtacctatgggttacggtggcccacacgcagcattcatggcaacgcgcgaacagcacaaacgcaccatgccaggccgtgtgatcggtgtttctatcgacgccaaaggcaaccaagcactgcgcatggcaatgcaaacacgtgagcagcatatccgccgcgagaaagcgacctcgaacatctgtacggcacaggcactgcttgccaacatggcatcgttctttgccgtgtaccacggtgaagtaggtatccgcaccatcgcgcgccgcactcaccacatgacggctattcttgctgctggcctaaccaaatccggttacgagcttgcgcataacgcgttcttcgacaccatcaccatcaacactggtgacaacactcaagcgctttacgccaaagcacaagcggcagacatcaacctgcgtctgcttgacggccaaatcggcatcagctttgacgaaaccactaccgtggcagacatcgacgccctattcgcaattttcgatgtgaaagagagcgtaaacgcactttcaaccgacatcgcaggcaacgagtttgccgcaattccagaagcgtgtcgtcgtactagccgtttcctcactcaccctgtgttcaacactcaccacagtgaaacacagatgatgcgttacctaaaacagctagaaaacaaagacttctcgcttactcacggcatgatcccactgggcagctgtaccatgaagctcaacgccgccgcagagatgatccctgtaacttggcctgagtttggtgcgcttcacccattcgcgcctatcgagcaagctgcgggttacactgcactggctgaagatctcaaagcgaagctgtgtgaaatcactggctacgatgcgttctcactacaaccaaactcgggtgcttctggcgaatacgctggccttatcgcgattcagcgttaccacgaaagccgtggcgaaggtcaccgcaacgtgtgtttgatcccaagctccgcgcacggcaccaacccagcaacggctgcgatggtttcaatgaaagtggtggtggtgaaatgtgatgaaaacggcaacatcgaccttgtcgaccttgctgcgaaaatcgaaaaacaccaagaaaacctatcaagtatcatgatcacgtatccttcaacgcacggcgtttacgaagagcaagtgaaagaagtgtgcgaaatggttcacgcggctggcggtcaggtttatcttgatggcgcaaacatgaacgcgcaggttggcctaacgtctccgggctttatcggttcagacgtttcgcaccttaacctacacaaaaccttctgtatcccacacggtggtggcggtccgggtatgggtcctatcggtgtgaaatcgcacctagcacctttcctacctggtcacatcgaaaacggtgtagaaggtaaagagtttgcagtttcggcagcggatctcggcagtgcatcaattctgccaatctcttgggcttacattgccatgatgggcgcagatggcctaacagaagcaaccaaagtggcgattttgaacgcgaactacgtgatggagcgtctacgcccgcactaccctgttctttaccgtggcaccaatggccgcgtggcgcacgaatgtattatcgatattcgtccgctgaaagaagaaacaggcatcagcgaagaagacattgcaaaacgtttgatggactacggtttccacgcgccaaccatgtcgttccctgtggcaggcacactgatggtagagccaacggaatcggaagatctggaagagctagatcgtttctgtgacgcgatgatcgccatccgcgaagagatgaccaaagtgaagaacggtgaatggccactagagaacaaccctctggttaacgcgccacacacgcaagtagacctaatggaagagcaatgggatcgcccatacccacgtgaaatcgcgtgcttcccatctgctgcgactaagcgttctaaatactggccaaccgtgaaccgtgtagacaacgtctacggtgaccgtaacctagtttgctcatgcccaggcattgagaactacgaagagtaa

SEQ ID NO: 3077 - protein, 954 aa, Vibrio vulnificus
MTELLQSLNTQHEFVGRHNGPNHADQQKMLSTINAESLDALIAQTVPAQIRLEKPMQLAEAQSEADMLASIKKFADLNQVKRTFIGQGYYNTFTPNVILRNVLENPGWYTAYTPYQPEISQGRLESLLNYQQMVMDLTGMDIANASLLDEATAAAEAMTLCQRAGKSKSKVFFVADDVHPQTIEVIKTRAKYFGFDVVIGNVDSLPQTEAFGALLQYPSTTGEVRDLTDVITQAQANKTLVSVATDLLASALVKPAGEMGADVVIGSAQRFGVPMGYGGPHAAFMATREQHKRTMPGRVIGVSIDAKGNQALRMAMQTREQHIRREKATSNICTAQALLANMASFFAVYHGEVGIRTIARRTHHMTAILAAGLTKSGYELAHNAFFDTITINTGDNTQALYAKAQAADINLRLLDGQIGISFDETTTVADIDALFAIFDVKESVNALSTDIAGNEFAAIPEACRRTSRFLTHPVFNTHHSETQMMRYLKQLENKDFSLTHGMIPLGSCTMKLNAAAEMIPVTWPEFGALHPFAPIEQAAGYTALAEDLKAKLCEITGYDAFSLQPNSGASGEYAGLIAIQRYHESRGEGHRNVCLIPSSAHGTNPATAAMVSMKVVVVKCDENGNIDLVDLAAKIEKHQENLSSIMITYPSTHGVYEEQVKEVCEMVHAAGGQVYLDGANMNAQVGLTSPGFIGSDVSHLNLHKTFCIPHGGGGPGMGPIGVKSHLAPFLPGHIENGVEGKEFAVSAADLGSASILPISWAYIAMMGADGLTEATKVAILNANYVMERLRPHYPVLYRGTNGRVAHECIIDIRPLKEETGISEEDIAKRLMDYGFHAPTMSFPVAGTLMVEPTESEDLEELDRFCDAMIAIREEMTKVKNGEWPLENNPLVNAPHTQVDLMEEQWDRPYPREIACFPSAATKRSKYWPTVNRVDNVYGDRNLVCSCPGIENYEE

SEQ ID NO: 3078 - DNA, 2865 bp, Vibrio vulnificus
  CDS (1)..(2865): transl_table=11
atgactgaattacttcaaagcctcaacacacaacacgagttcgttggtcgccacaacggaccaaaccacgccgatcaacaaaaaatgctttctaccattaacgcagaaagcctagatgcgttgatcgcacaaaccgttcccgcacaaattcgccttgaaaagccaatgcaactggcagaagcacagagcgaagcagacatgctggcatcgatcaaaaagttcgctgatttaaaccaagttaagcgcactttcattggccaaggttactacaacaccttcacgccaaacgttattttgcgtaacgtactggaaaacccaggctggtacacggcttacacgccataccaaccagaaatttctcaaggtcgattagaatcattgttgaactatcaacaaatggtgatggacctaacgggcatggacatcgcaaacgcctctctactcgatgaagccaccgcagccgcagaagcgatgacgctttgccagcgcgctggtaagagcaagagcaaagtcttcttcgtggcagacgatgttcacccacaaaccattgaagtgatcaaaactcgcgcgaaatacttcggctttgacgtagtgatcggcaatgttgatgcacttccacaaacagaagcgttcggtgccctacttcaatacccaagcacaacgggcgaagttcgcgatctcaccgatgtcatcgcacaagcacaagccaacaaaacactggtttctgttgctaccgatctcctcgcttctgcacttgtgaagccagctggtgaaatgggcgcagatgttgtcattggctcagcacagcgctttggcgtacctatgggttacggtggcccacacgcagccttcatggcaacacgcgaacagcacaaacgcaccatgccaggccgtgtgatcggtgtttctatcgacgccaaaggcaaccaagcactgcgcatggcaatgcaaacacgtgagcagcatatccgccgcgagaaagcgacctctaacatctgtacggcacaagcactgcttgccaacatggcatcgttctttgccgtgtaccacggtgaagaaggcatccgcaccatcgcgcgccgcactcaccacatgacggctattcttgctgctggcctaaccaaatccggttacgagcttgcgcacaacgcgttcttcgacaccatcaccattaacactggtgacaaaactcaagcgctttacgccaaagcacaagcggcagacatcaacctgcgcctgcttgacggccaaatcggcatcagctttgacgaaaccactaccgtggcagacatcgacgccctgttcgcgattttcgatgtgaaagagagcgtaaacgcactttcaaccgacatcgcaggcaacgaatttgctgcgattccagaagcgtgtcgccgtactagccgtttcctaagtcaccctgtgttcaacactcaccacagtgaaacacagatgatgcgttacctaaaacagctagaaaacaaagacttctcgcttactcacggcatgatcccactgggcagctgtaccatgaagctcaacgccgccgcagagatgatccctgtaacttggcctgagtttggtgcgcttcacccattcgcgcctatcgagcaagctgcgggttacactgcactggctgaagatctcaaagcgaagctgtgtgaaatcactggctacgatgcgttctcactacaaccaaactcgggtgcttctggcgaatacgctggccttatcgcgattcagcgttaccacgaaagccgtggcgaaggtcaccgcaacgtgtgtttgatcccaagctccgcgcacggcaccaacccagcaacggctgcgatggtttcgatgaaagtggtggtggtgaaatgtgatgaaaacggcaacatcgaccttgtcgaccttgctgcgaaaatcgaaaaacaccaagaaaacctatcaagcatcatgatcacgtacccttcaacgcacggcgtttacgaagagcaagtgaaagaagtgtgcgaaatggttcacgcggctggcggtcaggtttatcttgatggcgcaaacatgaacgcgcaggttggcctaacgtctccgggctttatcggttcagacgtttcgcaccttaacctacacaaaaccttctgtatcccacacggtggtggcggtccgggtatgggtcctatcggtgtgaaatcgcacctagcacctttcctacctggtcacatcgaaaacggtgtagaaggtaaagagttcgcagtttcggcagcggatctcggcagtgcatcaattctgccaatctcttgggcttacattgccatgatgggcgcagatggcctaacagaagccaccaaagtggcgattttgaacgcgaactacgtgatggagcgtctacgcccgcactaccctgttctttaccgtggcaccaatggccgcgtggcgcacgaatgtattatcgatattcgtccgctgaaagaagaaacaggcatcagcgaagaagacattgcaaaacgtttgatggactacggtttccacgcgccaaccatgtcgttcccagtagcaggcacactgatggtagagccaacggaatcggaagatctggaagagctagaccgtttctgtgacgcgatgatcgccatccgcgaagagatgaccaaagtgaagaacggtgaatggccactagagaacaaccctctggttaacgcgccacacacgcaagtagacctgatggaagagcaatgggatcgcccatacccacgtgaaatcgcgtgcttcccatctgctgcgactaagcgttctaaatactggccaaccgtgaaccgtgtagacaacgtctacggtgaccgtaacctagtatgctcatgcccaggcattgagaactacgaagagtaa

SEQ ID NO: 3079 - protein, 954 aa, Vibrio vulnificus
MTELLQSLNTQHEFVGRHNGPNHADQQKMLSTINAESLDALIAQTVPAQIRLEKPMQLAEAQSEADMLASIKKFADLNQVKRTFIGQGYYNTFTPNVILRNVLENPGWYTAYTPYQPEISQGRLESLLNYQQMVMDLTGMDIANASLLDEATAAAEAMTLCQRAGKSKSKVFFVADDVHPQTIEVIKTRAKYFGFDVVIGNVDALPQTEAFGALLQYPSTTGEVRDLTDVIAQAQANKTLVSVATDLLASALVKPAGEMGADVVIGSAQRFGVPMGYGGPHAAFMATREQHKRTMPGRVIGVSIDAKGNQALRMAMQTREQHIRREKATSNICTAQALLANMASFFAVYHGEEGIRTIARRTHHMTAILAAGLTKSGYELAHNAFFDTITINTGDKTQALYAKAQAADINLRLLDGQIGISFDETTTVADIDALFAIFDVKESVNALSTDIAGNEFAAIPEACRRTSRFLSHPVFNTHHSETQMMRYLKQLENKDFSLTHGMIPLGSCTMKLNAAAEMIPVTWPEFGALHPFAPIEQAAGYTALAEDLKAKLCEITGYDAFSLQPNSGASGEYAGLIAIQRYHESRGEGHRNVCLIPSSAHGTNPATAAMVSMKVVVVKCDENGNIDLVDLAAKIEKHQENLSSIMITYPSTHGVYEEQVKEVCEMVHAAGGQVYLDGANMNAQVGLTSPGFIGSDVSHLNLHKTFCIPHGGGGPGMGPIGVKSHLAPFLPGHIENGVEGKEFAVSAADLGSASILPISWAYIAMMGADGLTEATKVAILNANYVMERLRPHYPVLYRGTNGRVAHECIIDIRPLKEETGISEEDIAKRLMDYGFHAPTMSFPVAGTLMVEPTESEDLEELDRFCDAMIAIREEMTKVKNGEWPLENNPLVNAPHTQVDLMEEQWDRPYPREIACFPSAATKRSKYWPTVNRVDNVYGDRNLVCSCPGIENYEE

SEQ ID NO: 3080 - DNA, 2934 bp, Xanthomonas axonopodis pv
  CDS (1)..(2934): transl_table=11
atgtcccagaccccgtcttccctgcgcgacctcgaacaccacagcgcgttcgtcgagcgccatatcggccccaacgacgcggaaatcgcccagatgctggacgtggtcggccatgcttcgctggatgcgctgaccgatgccatcgtgccgggcaacatcaagtcgccggcgccgctggcgctgcccgaggcgatcaccgaagaagaagcgctggccaagatccgcgccatcgccagcaagaatcaggtgcagcgtaattttatcggccagggctattacggcacccacacgccgaaggtcatcctgcgcaacatcctggaaaaccccgcctggtacaccgcctacacgccataccaggctgagatttcgcaaggccgcatggaagcgctgatcaacttccagaccctgtgcgccgacctcaccggcatgcagatcgccaacgcctcgctgctggacgaagccaccgccgcggccgaggcgatgaccctggccaagcgctcggccaagtccaagtccaacacgttcttcgtgcacgacgcagtgcatccccagacgctggaactgctgcgcacgcgcgccgagccgctggacatcgtgctgcgtgtcggcacgccggaagaagcgctgcaggccgagtgcttcggggtgctgctgcagtacccggacagcttcggtcatatcggcgatcacgctgcactggccgatgccgtgcacgcgcaaggcggcctggtcgcggtggccaccgatctgctggcgctgaccctgatcgccgctccgggcgaatggggcgcggacatcgtggtcggcaactcgcagcgcttcggcgtgccgttcggctttggcggcccgcatgcagcgttcatggcgtgccgcgatgcctacaagcgctcgatgcccggccgtttgatcggcgtgtcgatcgatgccgccggcaacccggcgtatcgcttgaccctgcagacccgcgagcaacatatccgccgcgaaaaggccacctccaacatctgcaccgcgcaggtgctgctggcggtgatggcgtcgatgtatgcggtctaccacggccccgacggcctggtgcgcatcgcgcgccgcacccatcgtctggcggcgatcctggcggccgcactgcgcagcgctggcgtttccgtcggcgatcgcttcttcgacaccttgcacgtcaaggcgatcgatgccgatgccatccacgcccgtgcgcgcgcggctggcatcaacctgcgcgccatcgacagcgaggcggtgggcatcagcctggacgaaaccaccacgcgcgccgatgtggttgcgctggcgcagctgttcggtgccacggccgatgtggacgcgctggatgcggccacggccgatgcgctgccgcaaggcctgctgcgcaccaccccgttcctgacccacccggtcttcaacacccaccacagcgagcacgaactgctgcgctacatgcgctcgctggccgacaaggacctggcgatggatcgcaccatgatcccgctgggcagctgcaccatgaagctcaacgccaccgccgagatgatcccggtgacctggccggaattcggcgccatccatccgctcgctccggccgagcagtccgccggctacgcgcagttgatcgacgaactcgaagcgatgctggtcgaatgcaccggctacgatgcggtgagcctgcaacccaattctggcgcgcaaggcgaatacgccggcctgctggcgatccgcgcctatcaccgttcgcgcgggcaagcgcatcgcgatatctgcctgattcccgaatcggcgcacggcaccaacccggcttcggcgcagatgtgcggcatgaccgtggtggtgaccaagtgcgatgccaacggcaatgtggacgtggatgacatccgcgccaaggcggaaaaatattccgaccgcctggcggcgctgatgatcacctacccgtccacccacggcgtgttcgaagaagacgtggtggcgatctgcgaagcggtgcatgcgcatggcggccaggtctataccgacggcgccaacatgaatgccctggtcggcgtcgccaagcccggcaagtggggctcggacgtgtcgcacctcaacctgcacaagaccttctgcattccgcacggcggtggcggcccgggcgtgggcccgtgcgcggtgaagtcgcacctggcgccgtacctgcctcgtgccggcatccatgccggcgaaggtcaaactgccgccatccatggcggcggattcaactccgaaagcgggaatggacactcctcgcgcatcggcggcatggtcagcgccgcggcctacggttctgcctcgatcctgccgatcagctggatgtacgtgaccatgatgggcagcgccggcctgcgcaaggccacgcaagtggccttgctcaacgccaactacatcgccaagcgcctggcgccgcactacaagacgctgtacaccggccgcaatggcctggtcgcgcacgagtgcatcctcgacgtgcgcccgctggagaagaccagcggcatcggcgccgaagacatcgccaagcggctgatcgacttcggcttccatgcaccgacgttgagcttcccggtcgccggcacgctgatggtggaaccgaccgaaagcgaatcgcagcacgaactggaccgcttcatcgacgcgatgatccagatccgcgaggagatccgcgccatcgaagacggccgcctggaccgcgaagacaacccgctcaagcacgcgccgcataccgcaacgcaggtgtcggccagcgagtggacgcatgcctacccgcgcgagctggccgcgttcccgctgcccagcctcaagcagcagaagtactggccgccggtggcacgcgtggacaacgtctacggcgacaagaacgtgatgtgcgcctgcatcccggtggatgcgtacaaggaagacgccgaggcctga

SEQ ID NO: 3081 - protein, 977 aa, Xanthomonas axonopodis pv
MSQTPSSLRDLEHHSAFVERHIGPNDAEIAQMLDVVGHASLDALTDAIVPGNIKSPAPLALPEAITEEEALAKIRAIASKNQVQRNFIGQGYYGTHTPKVILRNILENPAWYTAYTPYQAEISQGRMEALINFQTLCADLTGMQIANASLLDEATAAAEAMTLAKRSAKSKSNTFFVHDAVHPQTLELLRTRAEPLDIVLRVGTPEEALQAECFGVLLQYPDSFGHIGDHAALADAVHAQGGLVAVATDLLALTLIAAPGEWGADIVVGNSQRFGVPFGFGGPHAAFMACRDAYKRSMPGRLIGVSIDAAGNPAYRLTLQTREQHIRREKATSNICTAQVLLAVMASMYAVYHGPDGLVRIARRTHRLAAILAAALRSAGVSVGDRFFDTLHVKAIDADAIHARARAAGINLRAIDSEAVGISLDETTTRADVVALAQLFGATADVDALDAATADALPQGLLRTTPFLTHPVFNTHHSEHELLRYMRSLADKDLAMDRTMIPLGSCTMKLNATAEMIPVTWPEFGAIHPLAPAEQSAGYAQLIDELEAMLVECTGYDAVSLQPNSGAQGEYAGLLAIRAYHRSRGQAHRDICLIPESAHGTNPASAQMCGMTVVVTKCDANGNVDVDDIRAKAEKYSDRLAALMITYPSTHGVFEEDVVAICEAVHAHGGQVYTDGANMNALVGVAKPGKWGSDVSHLNLHKTFCIPHGGGGPGVGPCAVKSHLAPYLPRAGIHAGEGQTAAIHGGGFNSESGNGHSSRIGGMVSAAAYGSASILPISWMYVTMMGSAGLRKATQVALLNANYIAKRLAPHYKTLYTGRNGLVAHECILDVRPLEKTSGIGAEDIAKRLIDFGFHAPTLSFPVAGTLMVEPTESESQHELDRFIDAMIQIREEIRAIEDGRLDREDNPLKHAPHTATQVSASEWTHAYPRELAAFPLPSLKQQKYWPPVARVDNVYGDKNVMCACIPVDAYKEDAEA

SEQ ID NO: 3082 - DNA, 2928 bp, Xanthomonas campestris pv
  CDS (1)..(2928): transl_table=11
atgtcccagactccgtcttccctgcgcgacctcgaacaccacagcgcgttcgtcgaacgccacatcggccccaacgacgcggaaatcgcgcagatgctgggcgttgtcggccacgactcgctggatgcgatgaccgacgccatcgtgccgtccaacatcaagtcgccggccgcgctggcgctgcccgatgcgatcaccgaagaagaagcgctggccaggatccgcgccattgccagcaagaaccaggtgcagcgcacgttcatcggccaggggtactacggcacgcatacgccgaaggtgatcctgcgcaacatcctggaaaacccggcctggtacaccgcctacacgccctaccaggccgagatttcgcagggccgcatggaagcgctgatcaacttccagaccatgtgcgccgacctcaccggcatgcagatcgccaatgcctcgctgctggacgaagccaccgccgcagccgaagcgatgacgctggccaagcgctcggccaagtccaagtccgatacgttcttcgtgcacgacgcagtgcacccgcagacgcaggagctgctgcgcacgcgcgccgagccgctgggcatcgtgctgcgtgtgggcacgccggacgaagccatgcaggccgagtgcttcggcgtgctgctgcagtacccggacagcttcggccacatcggcgatcacgccgcgttggccgatgccgtgcacgcgcagggcggcctggtcgccgtggccaccgatctgctggcgctcacgctgatcgccgcgccgggcgaatggggcgcggacatcgtggtgggcaactcgcagcgcttcggcgtgccgttcggcttcggtggcccgcatgcggccttcatggcctgccgcgatgcctacaagcgctcgatgccgggccgcttgatcggggtgtcgatcgatgctgccggcaacccggcctatcgcctcacgctgcagacgcgtgagcaacacattcgtcgcgaaaaggccacctccaacatctgcaccgcgcaggtgctgctggcggtgatggcctcgatgtacgcggtctaccacggccccgagggcctcacacgcattgcccgccgcacccatcgcctggcggcgatcctggcggccgcattgcgcagcgccggcgtcaccgtgggcgagcatttcttcgacacgctgcacgtcaaggcgatcgatgccgatgccatccacgccaaggcgcatgcggccggcatcaacctgcgcgcgatcgatagcgaagcggtcggcatcagcctggacgaaaccagcacgcgcgccgatgtggtggcactggcgcagctgttcggtgcccaggcggatatcgatgcgctggatgcggccaccgccgacgcgctgccgcagggcatgcgccgcaccagcgcattcctgcagcacccggtgttcaacacccatcacagcgaacacgaactgctgcgctacatgcgctcgctggccgacaaggacctggccatggatcgcaccatgatcccgctgggcagctgcacgatgaagctcaacgccaccgccgagatgattccggtgacctggccggaattcggcgcgatccatccgctggcaccgcccgagcagtcggccggttatgcgcagctgatcgaagaactggaagcgatgctggtcgaatgcaccggctacgacgcggtgagcctgcagcccaattccggcgcgcagggcgaatacgccggcctgctggcaatccgcgcctatcaccgctcgcgcaacgaagcccaccgcgacatctgcctgattcccgaatccgcccacggcaccaacccggcctccgcgcagatgtgcggcatgaccgtggtggtgaccaagtgcgatgccaacggcaatgtcgatgtcgatgacattcgcgccaaggccgagaaatattccgaccgcctggccgcgctgatgatcacctacccgtccacgcacggcgtgttcgaagaagacgtggtggcgatttgcgaagcggtgcacgcgcacggcggccaggtgtataccgacggcgccaacatgaacgccctggtcggcgtggccaagcccggcaagtggggctcggacgtgtcgcatctcaacctgcacaagaccttctgcattccacatggcggcggcggccctggcgtgggcccgtgtgcagtcaaatcgcatctggccccgttcctgcccaagacgcttcctaatgccggcatccgtgccggcgaaaatcaaaaagctgccatccatggcagcggatccaacttcggcgaaggcgaggtcggcatggtcagcgcggccagctacggctccgcctcgatcctgccgatcagctggatgtacgtgaccatgatgggcagtgccggcctgcgcaaggccacgcaggtggcattgctcaacgccaactacatcgccaagcgtttgagcgcgcactacaagacgctgtacaccggccgcaacgggctggtggcgcacgagtgcatcctcgacgtgcgcccgctggaaaagaccagcggcatcggtgccgaggacatcgccaagcggctgatcgacttcggcttccatgcgccgacgctgagcttcccggtggccggcaccttgatggtggagccgaccgaaagcgaatcgcagcatgaactggaccgcttcatcgacgcgatgatccagatccgcgaagaaatccgcgcgatcgaagacggccgcctggaccgcgaggacaacccgctcaagcacgccccgcacaccgccacgcaggtctcggccagtgagtggacgcatgcctatccgcgcgagctggccgccttcccgctgccctcgctcaagcagcagaagtactggccgccggtgggccgcgtggacaatgtctacggcgacaagaacgtgatgtgtgcctgtatcccggtggatgcgtacaaggacgatgtggtggcataa

SEQ ID NO: 3083 - protein, 975 aa, Xanthomonas campestris pv
MSQTPSSLRDLEHHSAFVERHIGPNDAEIAQMLGVVGHDSLDAMTDAIVPSNIKSPAALALPDAITEEEALARIRAIASKNQVQRTFIGQGYYGTHTPKVILRNILENPAWYTAYTPYQAEISQGRMEALINFQTMCADLTGMQIANASLLDEATAAAEAMTLAKRSAKSKSDTFFVHDAVHPQTQELLRTRAEPLGIVLRVGTPDEAMQAECFGVLLQYPDSFGHIGDHAALADAVHAQGGLVAVATDLLALTLIAAPGEWGADIVVGNSQRFGVPFGFGGPHAAFMACRDAYKRSMPGRLIGVSIDAAGNPAYRLTLQTREQHIRREKATSNICTAQVLLAVMASMYAVYHGPEGLTRIARRTHRLAAILAAALRSAGVTVGEHFFDTLHVKAIDADAIHAKAHAAGINLRAIDSEAVGISLDETSTRADVVALAQLFGAQADIDALDAATADALPQGMRRTSAFLQHPVFNTHHSEHELLRYMRSLADKDLAMDRTMIPLGSCTMKLNATAEMIPVTWPEFGAIHPLAPPEQSAGYAQLIEELEAMLVECTGYDAVSLQPNSGAQGEYAGLLAIRAYHRSRNEAHRDICLIPESAHGTNPASAQMCGMTVVVTKCDANGNVDVDDIRAKAEKYSDRLAALMITYPSTHGVFEEDVVAICEAVHAHGGQVYTDGANMNALVGVAKPGKWGSDVSHLNLHKTFCIPHGGGGPGVGPCAVKSHLAPFLPKTLPNAGIRAGENQKAAIHGSGSNFGEGEVGMVSAASYGSASILPISWMYVTMMGSAGLRKATQVALLNANYIAKRLSAHYKTLYTGRNGLVAHECILDVRPLEKTSGIGAEDIAKRLIDFGFHAPTLSFPVAGTLMVEPTESESQHELDRFIDAMIQIREEIRAIEDGRLDREDNPLKHAPHTATQVSASEWTHAYPRELAAFPLPSLKQQKYWPPVGRVDNVYGDKNVMCACIPVDAYKDDVVA

SEQ ID NO: 3084 - DNA, 2982 bp, Xylella fastidiosa
  CDS (1)..(2982): transl_table=11
gtgttttcagtctcccacttttgttcaggaagcctcatgatgtctcacaccctatcttctttgcgtgatcttgaatatcagggtgcgtttgttgagcgccatatcggccctaatgatgttgagatcgcgcagatgttgcgtgtcgttggctacgattcgttggagtcgctgacggatgccattgtgccggagaagatcaggtcaaccgttgcgttggatttgcctaaggggatcacggaagaggaagcgctcgccaagattcgggtgattgccaataaaaatcgagtgtttcgcagcttcattggtcagggctactacggcacgcatacgccgaaggtgattttgcgaaatgtccttgagaatccggcgtggtacacggcgtataccccgtaccaggcggagatttcgcagggacgaatggaagcgctgatcaactttcagaccatgtgcgctgatctaacagggatggagatcgccaatgcgtctttgttggatgaggcgactgctgcggccgaagcgatgagcttggccaagcgttcggcgaaatcgcgctcggatctgttttttgtgcacgatgcggtgcatccgcagacgttggagttactgcgtacccgtgccgagccgttgggcattgtgttgcgtgtgggcacgccggaggaggcgttgcaggccgatgtgttcggaatattgttgcaatatccagataccttcggtcgcatcggtgatcacagggtcttggcggatgccgtgcatgcacggggtggattggttgcggtggccagcgatctgttggcgctgacgttgattacgccaccaggcgaatggggggcggatattgtcgtaggcaatagtcagcgctttggcgtgccgtttggctttggtgggccgcatgctgggttcatggcatgtcgcgatatatataagcgctcgataccagggcgtttgattggtgtctcggtcgatgctgccggtcatccggcgtaccgtttggctttgcagacgcgtgagcagcatattcgccgtgagaaggcaacttccaacatctgtactgcgcaagtgttgctggcggtgatggcctctatgtatgcggtctatcacggccctcaagggttgctccgtattgcgtggcgtactcaccgcatggcggcgattctggcggcggcgttgcgtggtgccggtctgactgtcggtgagtatttcttcgatacgctccatattgtcggtattgatgccgtggcgatccattgtgcggcggcggcggctgggatgaatctgcgcatgattgataatgcgcagcttgggatcagtctggatgagacggtcacccgttctgacgtggtggctttagggcaggtatttggtgtgcaggtcgatgtggaggcgcttgatgcgatcactgccgatgcgttgccagcggggttgttgcgcagcagcgcatttttgacgcatcccgtgttcaatacgcatcacagtgagcatgagttgctacgttatttgcgcatgttggccgataaggatttggcaatggatcggaccatgatcccgttggggtcgtgcacgatgaagctcaatgccactgctgagatgattccagtgacgtggcaggaatttgcttgcattcatccattggctccggcggtgcaatggagcggctatcgccagttgattgatgagttggaggcgatgttggcggaatgcactggttacgatgcgatcagtttgcagccgaattctggtgcacagggtgaatatgcgggtctgttggcgatccgtgcgtatcaccgttcacgtggtgaggaacggcgcaatgtgtgcctgattcctgagtcggcgcatgggactaatccggcgtcggcgcagctatgtgggatgcaggtggtcattatcaaatgcgacagaagcggtaatgtcgatgtcgatgatttgcggatgaaggcggagaaatattcagacagtctcgccgcgctcatggtgacctatccgtccacgcatggggtgttcgaggaggcgattactgagatttgtgagattgtccatgcgcatgggggccaggtgtatacggacggcgccaatatgaatgcgttggttggtgtggcgaaaccggggcgatggggttcggacgtgtcccacctgaatcttcataagacgttttgtatcccgcatggcggcggtggtccgggtgtaggtccctgtgctgtgaaagcgcatttggctccttttttgcctaaaacgttgccattgccaggagacgcagcgggattgccggttcagggcacgcaagaagccaaggtcggcatggtgagtgcggccaattttggttcagcgtcgatcctgccggtgagttggatgtacatcaccatgatgggggcggcggggttgcgtaaggcgacccaggttgcgttactcaacgcaaattacattgctaagcgcttagcacctcactataagacgttatataccggccgccatggtctggttgcacatgagtgcattcttgatgtgcgtccgttggagaaggtgagtggtgtcagtgccgaagatattgctaaacggttgatcgattttggtttccatgcgccgacattgagtttccccgtggcgggtacgctgatggtggagccgaccgagagtgaatcgcagcaagagttggatcgttttgtcgatgcaatgattcagatccgtggggagattgctgcgattgagaaggggcatcttgatcctgaggataatccgctcaagcaggcgccacacacggcggtacaggtcatggcttcgcaatgggggcatgcgtattcgcgtgagttggctgccttcccattgggcgtgttgcaccatgccaaatactggcctccggtagcgcgtgtggataacgtttacggtgataagcacgtgatgtgtgcctgtattccggtagaggcctacaaggagaaagaggattctgaaatccagcatctgattgaggaggatgcatcccgttgctga

SEQ ID NO: 3085 - protein, 993 aa, Xylella fastidiosa
MFSVSHFCSGSLMMSHTLSSLRDLEYQGAFVERHIGPNDVEIAQMLRVVGYDSLESLTDAIVPEKIRSTVALDLPKGITEEEALAKIRVIANKNRVFRSFIGQGYYGTHTPKVILRNVLENPAWYTAYTPYQAEISQGRMEALINFQTMCADLTGMEIANASLLDEATAAAEAMSLAKRSAKSRSDLFFVHDAVHPQTLELLRTRAEPLGIVLRVGTPEEALQADVFGILLQYPDTFGRIGDHRVLADAVHARGGLVAVASDLLALTLITPPGEWGADIVVGNSQRFGVPFGFGGPHAGFMACRDIYKRSIPGRLIGVSVDAAGHPAYRLALQTREQHIRREKATSNICTAQVLLAVMASMYAVYHGPQGLLRIAWRTHRMAAILAAALRGAGLTVGEYFFDTLHIVGIDAVAIHCAAAAAGMNLRMIDNAQLGISLDETVTRSDVVALGQVFGVQVDVEALDAITADALPAGLLRSSAFLTHPVFNTHHSEHELLRYLRMLADKDLAMDRTMIPLGSCTMKLNATAEMIPVTWQEFACIHPLAPAVQWSGYRQLIDELEAMLAECTGYDAISLQPNSGAQGEYAGLLAIRAYHRSRGEERRNVCLIPESAHGTNPASAQLCGMQVVIIKCDRSGNVDVDDLRMKAEKYSDSLAALMVTYPSTHGVFEEAITEICEIVHAHGGQVYTDGANMNALVGVAKPGRWGSDVSHLNLHKTFCIPHGGGGPGVGPCAVKAHLAPFLPKTLPLPGDAAGLPVQGTQEAKVGMVSAANFGSASILPVSWMYITMMGAAGLRKATQVALLNANYIAKRLAPHYKTLYTGRHGLVAHECILDVRPLEKVSGVSAEDIAKRLIDFGFHAPTLSFPVAGTLMVEPTESESQQELDRFVDAMIQIRGEIAAIEKGHLDPEDNPLKQAPHTAVQVMASQWGHAYSRELAAFPLGVLHHAKYWPPVARVDNVYGDKHVMCACIPVEAYKEKEDSEIQHLIEEDASRC

SEQ ID NO: 3086 - DNA, 2982 bp, Xylella fastidiosa
  CDS (1)..(2982): transl_table=11
gtgttttcagcctcccacttttgttcaggaagtctcatgatgtctcaccccctgtcttctctgcgtgatcttgaatatcacggtgcgtttgttgagcgccatatcggccctaatgatgttgagatcgcgcagatgttgcgtgtcgttggctacgattcgttggagtcgctgacggatgccattgtgccggagaagatcaggtcaaccgttgcgttggatttgcctaaggggatcacggaagaggaagcgcttgccaagattcgggtgattgccaataaaaatcgagtgtttcgcagcttcattggtcagggctactacggcacgcatacgccgaaggtgattttgcgaaatatccttgagaatccggcgtggtacacggcttataccccgtaccaggcggagatttcgcagggacgaatggaagcgctgatcaactttcagaccatgtgcgccgatctaacagggatggagatcgccaatgcgtctttgttggatgaggcgacagctgcggccgaagcgatgagcttggccaagcgttcggcgaaatcgcgctcggatctgttttttgtgcacgatgcggtgcatccgcagacgttggagttactgcgtacccgtgccgagccgttgggcattgtgttgcgtgtgggcacgccggaggaggcgttgcaggtcgatgtgttcggaatattgttgcaatatccagataccttcggtcgcatcggtgatcacagggtcttggcggatgctgtgcatgcacggggtgggttggttgcggtggccagcgatctgttggcgctgacgttgattacgccaccaggcgaatggggggcggatattgttgtaggcaatagtcagcgctttggcgtgccgtttggctttggtgggccgcatgctgggttcatggcatgtcgcgatatatataagcgctctataccagggcgtttgattggtgtctcggtcgatgctgccggtcatccggcgtaccgtttggctttgcagacgcgtgagcagcatattcgccgtgagaaggcaacgtccaacatctgtactgcgcaagtgttgctggcggtgatggcctctatgtatgcggtctatcacggccctcaaggattgctccgtattgcgtggcgtactcaccgcatggcggcgattctggcggcggcgttgcgtggtgccggtctgactgtcggtgagtatttcttcgatacgctccatattgtcggtattgatgccttggcgatccattgtgcggcggcggcggctgggatgaatctgcgcatgattgataatgcgcagattgggatcagtctggatgagacggtcacccgttctgacgtggtggctttagggcaggtatttggtgtgcaggtcgatgtggaggcgcttgatgcgatcactgccgatgcgttgccagcggggttgttgcgcagcagcgcatttttgacgcatcccgtgttcaatacgcatcacagtgagcatgagttgctacgttatttgcgcatgttggccgataaggatttggcaatggatcggaccatgatcccgttggggtcgtgcacgatgaagctcaatgccactgctgagatgattccagtgacgtggcaggaatttgcttgcattcatccattggctccggtggtgcaatggagcggctatcgccagttgattgatgagttggaggcgatgttggtcgaatgcactggttacgatgcgatcagtttgcagccgaattctggtgcacagggtgagtatgcgggtttgttggcgatccgtgcgtatcaccgttcacgtggtgaggaacggcgcaatgtgtgcctgattcctgagtcggcgcatgggactaatccggcgtcggcgcagctgtgtgggatgcaggtggtcattatcaaatgcgacagaagcggtaatgtcgatgtcgatgatttgcggatgaaggcggagaaatattcagacactctcgccgcgctcatggtgacctatccgtccacgcatggggtgttcgaggaggcgattactgagatttgtgagattgtccatgcgcatgggggccaggtgtatacggacggcgccaatatgaatgcgttggttggtgtggcgaaaccggggcgatggggttcggacgtgtcccacctgaatcttcataagacgttttgtatcccgcatggcggcggtggtccgggtgtaggcccatgtgctgtgaaagcgcatttggctccttttttacctaaaacgttgccattgccgggagacgcagcgggattgccggttcagggcacgcaagaagccaaggtcggtatggtgagtgcggccaattttggttcagcgtcgatcctgccggtgagttggatgtatatcaccatgatgggggcggcggggttgcgtaaggcgacccaggttgcgttactcaacgcaaattacattgctaagcgcttggcacctcactataagacgttgtataccggccgccatggtctggttgcacatgaatgcattcttgatgtgcgttcgttggagaaggtgagtggtgtcagtgccgaagatattgctaaacggttgatcgattttggtttccatgcgccgacattgagttttcccgtggcgggtacgctgatggtggagccgaccgagagtgagtcgcagcaagagttggatcgttttgtcgatgcaatgattcagatccgtggggagattgcggcgattgagaaggggcatcttgatcctgaggataatccgctcaagcaggcgccacatacggcggtacaggtcatggcttcgcaatgggggcatgcgtattcgcgtgagttggctgccttcccattgggcgtgttgcaccatgccaaatactggcctccggtagcgcgtgtggataacgtttacggtgataagcacgtgatgtgtgcctgtattccggtagaggcctacaaagagaaaggggattctgaaatccaggatctgattgaggaggatgcatcccgttgctga

SEQ ID NO: 3087 - protein, 993 aa, Xylella fastidiosa
MFSASHFCSGSLMMSHPLSSLRDLEYHGAFVERHIGPNDVEIAQMLRVVGYDSLESLTDAIVPEKIRSTVALDLPKGITEEEALAKIRVIANKNRVFRSFIGQGYYGTHTPKVILRNILENPAWYTAYTPYQAEISQGRMEALINFQTMCADLTGMEIANASLLDEATAAAEAMSLAKRSAKSRSDLFFVHDAVHPQTLELLRTRAEPLGIVLRVGTPEEALQVDVFGILLQYPDTFGRIGDHRVLADAVHARGGLVAVASDLLALTLITPPGEWGADIVVGNSQRFGVPFGFGGPHAGFMACRDIYKRSIPGRLIGVSVDAAGHPAYRLALQTREQHIRREKATSNICTAQVLLAVMASMYAVYHGPQGLLRIAWRTHRMAAILAAALRGAGLTVGEYFFDTLHIVGIDALAIHCAAAAAGMNLRMIDNAQIGISLDETVTRSDVVALGQVFGVQVDVEALDAITADALPAGLLRSSAFLTHPVFNTHHSEHELLRYLRMLADKDLAMDRTMIPLGSCTMKLNATAEMIPVTWQEFACIHPLAPVVQWSGYRQLIDELEAMLVECTGYDAISLQPNSGAQGEYAGLLAIRAYHRSRGEERRNVCLIPESAHGTNPASAQLCGMQVVIIKCDRSGNVDVDDLRMKAEKYSDTLAALMVTYPSTHGVFEEAITEICEIVHAHGGQVYTDGANMNALVGVAKPGRWGSDVSHLNLHKTFCIPHGGGGPGVGPCAVKAHLAPFLPKTLPLPGDAAGLPVQGTQEAKVGMVSAANFGSASILPVSWMYITMMGAAGLRKATQVALLNANYIAKRLAPHYKTLYTGRHGLVAHECILDVRSLEKVSGVSAEDIAKRLIDFGFHAPTLSFPVAGTLMVEPTESESQQELDRFVDAMIQIRGEIAAIEKGHLDPEDNPLKQAPHTAVQVMASQWGHAYSRELAAFPLGVLHHAKYWPPVARVDNVYGDKHVMCACIPVEAYKEKGDSEIQDLIEEDASRC

SEQ ID NO: 3088 - DNA, 3105 bp, Saccharomyces cerevisiae
  CDS (1)..(3105)
atgcttaggacaagagtgactgctctcctttgtagggctactgtcaggtcaagcaccaattatgtttcattagcgaggactagatcattccattctcaatctattttgctcaaaacagccgctacagacataacgtctacacagtacagcaggattttcaatcctgacttgaaaaacattgatagaccgctagatacttttgctagacgtcatttaggtccttctcctagcgacgttaagaaaatgttaaaaacaatgggttatagcgatttaaacgcatttatagaagagctcgttcctcccaatattttgaagagaagacccttgaaactagaagctcctagtaagggattctgtgaacaagaaatgcttcaacatctagaaaagattgccaataagaaccactataaagttaaaaatttcataggtaagggttactacggtacgattttaccaccggttatacaaagaaacctgctagaaagtccagaatggtatacttcttatacgccctatcaacccgaaatttctcaaggtaggctagaagcgctattaaactttcaaacggttgtttcagatttgactggtttgcctgtggcgaacgcctcattgttggatgagggtacagcggctggagaagctatgctcttgtcattcaatatttccagaaaaaagaaactaaaatacgtaatagataaaaaattacaccagcaaacaaagagtgtccttcacaccagagccaagccgttcaatattgaaattattgaagttgactgttcggatatcaagaaagctgtggatgttttaaagaaccccgacgtatctggttgtttggttcaatatccagcgacagatggttcaatcttaccgcctgactcgatgaaacagttatctgatgcgttacactctcacaagtctttgctctctgtggcctcagatttaatggctttgacacttctaaaaccacctgctcattacggtgctgatatcgtcctgggttcctctcaacgatttggtgtcccaatgggttatggtggtcctcatgctgcttttttcgctgttattgataaattaaacagaaaaattccaggtagaattgtcggtatctctaaagaccgcttaggcaagacggccttgcggttggccctccaaacaagagaacaacatatcaagcgtgataaggcaacttcaaatatatgtaccgctcaagctttactggctaatgttgcttcgagctactgtgtttatcacggtcctaagggcctacagaatatttccaggaggatatttagcttaacatcaatattggcaaatgccatcgaaaatgacagttgccctcacgaactaattaataaaacatggtttgatactttgactataaagttaggtaatggcatatcctccgagcagttattggacaaggccttgaaagaatttaatatcaatttgtttgccgtggacaccaccactatttccttggctcttgatgaaacaactacaaaagctgatgttgaaaatctactaaaagtgtttgacattgaaaattcttcgcagtttctttctgaggactattctaacagtttcccaagggaatttcagcgtactgatgaaatattgaggaacgaagtctttcacatgcaccatagcgaaacagcaatgttgagatatttacataggttgcaatctcgtgatttatctcttgctaattctatgattcctttaggttcctgtactatgaaattgaacagtactgttgaaatgatgccaatcacttggccccaattttcgaatatccatccgttccagccatcaaaccaagtccaaggatacaaggaactaattacttcgttggagaaagatttatgcagcattacaggtttcgatggtatttctttacaaccaaattcaggtgctcaaggtgaatatactggtctgagagtaatcagatcctacctggaaagcaaaggtgaaaatcatcgtaacgtgtgtttaatccctgtatccgctcatggtacaaatccggcttctgccgctatggcgggtttaaaagttgttcctgtcaactgtttgcaggatggctcattagatctggttgacttaaagaataaggctgaacaacattctaaagaactagccgccgtaatgatcacctatccttccacttacggtttatttgaaccaggcatccaacatgctattgatatcgtacattcttttggtggacaagtctatttggatggtgctaatatgaatgcgcaggttgggctaacttcacccggagatcttggtgcagatgtttgccacttgaatttacataagacattttccattcctcatggtggtggtggtccagctggagctcccatttgcgtcaaatctcatttaataccccatttacctaaacatgacgttgttgatatgatcactggaatcggcggtagcaaatccatcgattcggtctcctctgctccatatggtaatgctttagtgttaccaatttcttatgcctatatcaaaatgatgggtaatgagggattaccattttctagtgtgatagcaatgctaaattcaaattatatgatgacaagattaaaagatcattataaaattcttttcgtcaatgaaatgagcacactaaaacactgcgctcatgaatttatagttgatctaagagaatacaaagctaaaggtgttgaagctatcgatgttgccaagagattgcaagactacggattccatgccccaacgttggccttccctgttcccggaactttgatgatagaaccaacagaatcggaaaacttggaagaattggatagattctgtgatgccatgatatccatcaaagaagaaataaatgccttagtagcaggtcaaccaaaaggacagattttgaaaaatgcccctcattcattggaagatcttattacttcctccaattgggatacgagaggttatacccgtgaagaagccgcttacccattaccctttttgagatacaataaattctggcctactgtcgctagactggatgacacttatggtgacatgaatttaatatgtacatgcccttctgtagaagaaattgcgaacgaaactgaatga

SEQ ID NO: 3089 - protein, 1034 aa, Saccharomyces cerevisiae
MLRTRVTALLCRATVRSSTNYVSLARTRSFHSQSILLKTAATDITSTQYSRIFNPDLKNIDRPLDTFARRHLGPSPSDVKKMLKTMGYSDLNAFIEELVPPNILKRRPLKLEAPSKGFCEQEMLQHLEKIANKNHYKVKNFIGKGYYGTILPPVIQRNLLESPEWYTSYTPYQPEISQGRLEALLNFQTVVSDLTGLPVANASLLDEGTAAGEAMLLSFNISRKKKLKYVIDKKLHQQTKSVLHTRAKPFNIEIIEVDCSDIKKAVDVLKNPDVSGCLVQYPATDGSILPPDSMKQLSDALHSHKSLLSVASDLMALTLLKPPAHYGADIVLGSSQRFGVPMGYGGPHAAFFAVIDKLNRKIPGRIVGISKDRLGKTALRLALQTREQHIKRDKATSNICTAQALLANVASSYCVYHGPKGLQNISRRIFSLTSILANAIENDSCPHELINKTWFDTLTIKLGNGISSEQLLDKALKEFNINLFAVDTTTISLALDETTTKADVENLLKVFDIENSSQFLSEDYSNSFPREFQRTDEILRNEVFHMHHSETAMLRYLHRLQSRDLSLANSMIPLGSCTMKLNSTVEMMPITWPQFSNIHPFQPSNQVQGYKELITSLEKDLCSITGFDGISLQPNSGAQGEYTGLRVIRSYLESKGENHRNVCLIPVSAHGTNPASAAMAGLKVVPVNCLQDGSLDLVDLKNKAEQHSKELAAVMITYPSTYGLFEPGIQHAIDIVHSFGGQVYLDGANMNAQVGLTSPGDLGADVCHLNLHKTFSIPHGGGGPAGAPICVKSHLIPHLPKHDVVDMITGIGGSKSIDSVSSAPYGNALVLPISYAYIKMMGNEGLPFSSVIAMLNSNYMMTRLKDHYKILFVNEMSTLKHCAHEFIVDLREYKAKGVEAIDVAKRLQDYGFHAPTLAFPVPGTLMIEPTESENLEELDRFCDAMISIKEEINALVAGQPKGQILKNAPHSLEDLITSSNWDTRGYTREEAAYPLPFLRYNKFWPTVARLDDTYGDMNLICTCPSVEEIANETE

SEQ ID NO: 3090 - DNA, 2880 bp, Yersinia pestis
  CDS (1)..(2880): transl_table=11
atgactcagaatctcagccagcttgaacataacgatgcttttattcagcgccatattggctcctcagttgaacagcagcagcagatgttggccgccgttggtgccagttcgttaagtacgttgatccagcaaattgttccggcagatatccaattgcctggcccaccaccagtgggtgaggccgccaccgaacaccaggcgctggcggaactcaaagggatcgccagccagaatcaatgctataaatcctatatcggcatgggctacagcccggtactgaccccgcccgtcatcctgcgtaatatgctggaaaaccccggctggtacaccgcgtataccccttatcaaccagaagtttctcaaggccgccttgaggcactgttgaatttccagcaattgacacaagacttgacgggcttggatctggcatcggcctctttgctggatgaagccacggcagcggcagaatccatggcactggcgaaacgtgccagtaagctgaaagacgctaatcgtttctttgttgctgacgatgtccacccgcaaacgctggatgtggtattgacccgcgctgagacctttggttttgacgtgattgttgatcgcgcagaaaaagtactggaactagacggtatctttggtgtgctgttgcaacaagtcgggaccaccggcgagttacatgattacagcgccctgttggccgaactgaaaaaacgtaaaattattaccagtgttgccgctgatattatggcgttggtactgttgaccgctccgggtgcacagggtgcagatgtggtatttggttccgcacaacgttttggtgtgcctatgggctacggcggtccacacgcggcattctttgcttgccgtgatgaatttaaacgttcaatgccaggccggattattggggtgtcccgtgatgccgcaggcaatacggcgttgcgaatggcgatgcaaactcgcgaacaacatatccgccgtgaaaaagccaattccaatatctgtacctcgcaggtgttactggccaatattgccagtctgtatgcggtttatcatggcccacagggcttacagcgtattgctggccgtattcaccggatgactgacattctggctgctggcttgcagcacgcggggttgaccctacgtttcaaacactggttcgataccctaaccgttgaagttaaagataaagcggcggtactggcccgtgcattaagttttggcattaacctgcgtactgacattcatggcgcggtagggatcacactgaatgaaaccacctcacgcgaagatattcagacgctgtttgccttgttcgttggcgataaccacggtttggatatcgatcaacttgatgccgccgttagtcagcatagccaatcaattcaagacagtatgctgcgccgggacccgatcctgacccatccggtgtttaatcgttaccacagcgaaacggaaatgatgcgctatatgcatcgtttagagcgtaaagatttggcattgaatcaggcgatgatcccgctgggatcctgcaccatgaaattgaatgccgcggctgaaatgatcccaatcacttggccagagttcgctgaattgcacccattctgtccaccagaacaggctgcgggttaccagcagatgattggtcagctatcgcaatggttagtacaactgacggggtatgatgctgtctgtatgcagccaaactcaggggcgcaaggtgaatatgccggtctactggctatccgccgttaccatgagagccgcaatcaggcgaaccgccatatctgtctgatcccaagttcagcccatggaacgaacccagcttcagcacaaatggcgggtatgtcggtggtggtggtcgcctgtgataaacaaggcaatattgatctgcacgatttacgtcagaaagcggaacacgcgggtgatgagctgtcatgcattatggtgacttacccatcaactcacggggtttatgaagaaactatccgtgaagtttgccagatcgttcatcagtttggtgggcaggtgtatctggatggcgcgaacatgaacgcccaagttgggatcaccacaccgggttatattggcgcggatgtttcgcatctcaatctgcataaaactttctgtatcccacatggcggcggtggcccaggtatggggcctattggcgtgaaagcccatctagccccgtttgtccctggtcatagcgtggtgcaaattgatggcatgacgacgcaacaaggggcggtttctgctgcaccgtttggcagtgcttctattttaccgatcagttggatgtatatccgcatgatgggggctgatggtctgaagcaagccagtcaggtcgcgatcttaaatgccaactatattgctactcgcttgaaaaatgcttatccggtgctctataccggccatgatggccgtgtggcgcacgaatgtattttggatatccgtccattgaaagaagcgaccggcatcagtgaaatggatatcgccaagcgcttgatcgacttcggtttccatgcaccgaccatgtccttcccggttgcgggtacgttgatggttgaacccactgagtctgaaagtaaagttgagttagatcgctttattgatgcgatgttggctattcgcgccgagatcgagaaagtggctcaaggcgaatggccattggaagacaacccgctggtgaatgccccgcatactcaggctgaattggttggtgagtggacacatccatacagccgcgaactggcggtattcccggtggcgggtgtactggagaataaatactggccaaccgtaaagcgtctggatgatgtttacggtgatcggaatttgttctgttcatgtgtgccaatcagtgactatgagtaa

SEQ ID NO: 3091 - protein, 959 aa, Yersinia pestis
MTQNLSQLEHNDAFIQRHIGSSVEQQQQMLAAVGASSLSTLIQQIVPADIQLPGPPPVGEAATEHQALAELKGIASQNQCYKSYIGMGYSPVLTPPVILRNMLENPGWYTAYTPYQPEVSQGRLEALLNFQQLTQDLTGLDLASASLLDEATAAAESMALAKRASKLKDANRFFVADDVHPQTLDVVLTRAETFGFDVIVDRAEKVLELDGIFGVLLQQVGTTGELHDYSALLAELKKRKIITSVAADIMALVLLTAPGAQGADVVFGSAQRFGVPMGYGGPHAAFFACRDEFKRSMPGRIIGVSRDAAGNTALRMAMQTREQHIRREKANSNICTSQVLLANIASLYAVYHGPQGLQRIAGRIHRMTDILAAGLQHAGLTLRFKHWFDTLTVEVKDKAAVLARALSFGINLRTDIHGAVGITLNETTSREDIQTLFALFVGDNHGLDIDQLDAAVSQHSQSIQDSMLRRDPILTHPVFNRYHSETEMMRYMHRLERKDLALNQAMIPLGSCTMKLNAAAEMIPITWPEFAELHPFCPPEQAAGYQQMIGQLSQWLVQLTGYDAVCMQPNSGAQGEYAGLLAIRRYHESRNQANRHICLIPSSAHGTNPASAQMAGMSVVVVACDKQGNIDLHDLRQKAEHAGDELSCIMVTYPSTHGVYEETIREVCQIVHQFGGQVYLDGANMNAQVGITTPGYIGADVSHLNLHKTFCIPHGGGGPGMGPIGVKAHLAPFVPGHSVVQIDGMTTQQGAVSAAPFGSASILPISWMYIRMMGADGLKQASQVAILNANYIATRLKNAYPVLYTGHDGRVAHECILDIRPLKEATGISEMDIAKRLIDFGFHAPTMSFPVAGTLMVEPTESESKVELDRFIDAMLAIRAEIEKVAQGEWPLEDNPLVNAPHTQAELVGEWTHPYSRELAVFPVAGVLENKYWPTVKRLDDVYGDRNLFCSCVPISDYE

SEQ ID NO: 3092 - DNA, 2976 bp, Oryza sativa
  CDS (1)..(2976)
atggagcgcgcacgccgcctcgccaaccgcgccctgctgcgccgcctcctcgcggcggcggcgtccaccacgtccccggccccgtcccgcggcatctcgaccctggccaaggcgcccggggcggggtcgcgcccgcgcgccccgcgcccggcgccccaccagtacaccacggggcggcccgtgtcggcgtcggcgctgcagccgagcgacacgttcccgcggaggcacaactcggccacgccggcggagcaggcggcgatggcgtcggagtgcgggttcaacaccctcgacgcgctcatcgacgccaccgtcccggccgccatccgcgcgccgacgatgcacttctccgggaagttcgacgccgggtttaccgagtcccagatgattgaccacatgcagcgcctggcggccatgaacaaggcctacaagtccttcatcgggatggggtactacaacacccacgtccccgcggtgatactgcgcaacctcatggagaaccccgcgtggtacacgcagtacacgccgtaccaggcggagatcgcgcagggccgtctcgagtcgctgctcaactaccagaccatggtcgccgacctcaccggcctgcccatgtccaacgcctcgctgcttgacgaggccaccgccgccgccgaggccatggccatgtgcaacggcatcctgaaatccaagaagaagaccttcctcatcgcctccaactgccacccgcagaccatcgacgtctgccagacgcgcgccgctgggttcgacctcaacgtcatcgtcgcggacgccaaggacttcgactacagcagcggtgatgtgtgcggagtgctcgtgcagtaccccggcacggagggggaggtgctggactacgcggagttcgtcaaggacgcgcacgcgcacggcgtcaaggtggtcatggccaccgacctgctcgcgctcacctcgctgcgcccgcccggtgagatcggcgccgacatcgccgtcggctccgcgcagcggttcggcgtgcccatggggtacggaggcccgcacgccgcgttcctcgccacttcccaggagtacaagcgcctcatgcccggccgtatcatcggcgtgagcgtcgattccagcggcaagcccgcgctccggatggcgatgcagacccgggagcagcacatccgccgcgacaaggccaccagcaacatctgcactgcccaggccttgctcgccaacatggcagcgatgtatgctgtctaccatggtcccgaggggctaaaggcaattgccgaccgtgtacacggcctggctggtacctttgcccatggactgaagaagctcggaacagtgactgtgcaggaactgccgttctttgacactgtcaaggtcaaggtcgctgatgcgaatgcgattgcccaggaggcctgcaagaacgagatgaaccttcgtgttgttgatgcaaccacgataaccgtggcctttgatgagaccacaaccttagaggatgtcgacaagctgttcaaggtgttcaatggtggcaagccagtgaacttcactgctgaatccctcgcatcagaggtgtcaagctcaattccgagtagccttgtgcgcaagagcccctacttaacacacccgatctttaacatgtaccatacagagcacgagcttctccgatacctgcacaagttgcaatccaaggatctttcactgtgccacagtatgatccctcttggttcttgcactatgaaactaaatgctacagtggagatgatgcccgtcacctaccccagctttgcaaacatgcacccatttgcacctactgaacaagccgcaggatatcatgcaagaggagactaccaccgggacgtctgtatcattcctgtgtcagcccatggtacaaatcctgcaagtgctgctatgtgtggaatgaagatcgttgctgttggaactgattccaaaggtaacattaacatcgaggagttgaggaaagctgctgaagcaaacaaggacaacttggctgctcttatggttacctatccttcgacccatggagtctatgaagaaggcattgatgagatatgcaggataattcatgagaacggtgggcaggtatacatggatggggctaacatgaatgctcaggtcggattgacaagccctggctttattggagcagatgtttgccaccttaaccttcacaagacattctgcattccacatggtgggggtggtcctggaatgggtcctattggtgttaagaagcacttagcaccatttttaccatctcatccagtgatcaccactggtggcttccctctccctgagaaaaccgaccctcttggtaccatttctgctgccccatggggatcagcgttgattctgccaatttcctacacatacatagccatgatgggttctaagggtctcactgatgcttcaaagattgcaatcttgaatgcaaactacatggcaaagcgtctggagaaacactacccagttcttttccgtggagtcaatggaactgttgcccatgaattcatcattgatttaagaggatttaagacgactgctggtatagagccagaggatgttgcaaagcgtttgatggactatggattccatgcacctactatgtcatggcctgttccaggcacacttatgattgaacccactgaaagtgaaagcaaggccgaactagacaggttctgtgatgctctaatctcaatcagggaagaaattgcagaaatcgaaagtggcaaagcagatgtgaacaacaatgtcctcaagagtgctcctcacccgccccaacttctgatgagcgactcatggactaagccgtactccagggagtacgctgcgttccctgcagcgtggcttcggggcgccaagttctggccaacaacatgtcgcgtggacaatgtgtatggggatcgcaacctcatctgcactctgcaacagggatcccaagtcgcagaagaagctgcagctgctaccgcatga

SEQ ID NO: 3093 - protein, 991 aa, Oryza sativa
MERARRLANRALLRRLLAAAASTTSPAPSRGISTLAKAPGAGSRPRAPRPAPHQYTTGRPVSASALQPSDTFPRRHNSATPAEQAAMASECGFNTLDALIDATVPAAIRAPTMHFSGKFDAGFTESQMIDHMQRLAAMNKAYKSFIGMGYYNTHVPAVILRNLMENPAWYTQYTPYQAEIAQGRLESLLNYQTMVADLTGLPMSNASLLDEATAAAEAMAMCNGILKSKKKTFLIASNCHPQTIDVCQTRAAGFDLNVIVADAKDFDYSSGDVCGVLVQYPGTEGEVLDYAEFVKDAHAHGVKVVMATDLLALTSLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPEGLKAIADRVHGLAGTFAHGLKKLGTVTVQELPFFDTVKVKVADANAIAQEACKNEMNLRVVDATTITVAFDETTTLEDVDKLFKVFNGGKPVNFTAESLASEVSSSIPSSLVRKSPYLTHPIFNMYHTEHELLRYLHKLQSKDLSLCHSMIPLGSCTMKLNATVEMMPVTYPSFANMHPFAPTEQAAGYHARGDYHRDVCIIPVSAHGTNPASAAMCGMKIVAVGTDSKGNINIEELRKAAEANKDNLAALMVTYPSTHGVYEEGIDEICRIIHENGGQVYMDGANMNAQVGLTSPGFIGADVCHLNLHKTFCIPHGGGGPGMGPIGVKKHLAPFLPSHPVITTGGFPLPEKTDPLGTISAAPWGSALILPISYTYIAMMGSKGLTDASKIAILNANYMAKRLEKHYPVLFRGVNGTVAHEFIIDLRGFKTTAGIEPEDVAKRLMDYGFHAPTMSWPVPGTLMIEPTESESKAELDRFCDALISIREEIAEIESGKADVNNNVLKSAPHPPQLLMSDSWTKPYSREYAAFPAAWLRGAKFWPTTCRVDNVYGDRNLICTLQQGSQVAEEAAAATA

SEQ ID NO: 3094 - DNA, 2679 bp, Oryza sativa
  CDS (1)..(2679)
atggagcgcgcacgccgcctcgccaaccgcgcgctgctgcgccgcctcctcgcggcggcgacggcggagtccccggcggccccgtcccgcggcatctcgaccctggccaaggggtcgcgcccgcgcgcccccccacgcccggcgccccaccagtacaccacggggcggcggcccgtgtcggcgtcggcgctgcagccgagcgacacgttcccgcggcggcacaactcggcgacgccggcggagcaggcggcgatggcgtcggagtgcgggttcggcaccgtcgacgcgctcatcgacgccaccgtcccggccgccatccgcgcgccggagatgcgcttctccgggaggttcgacgccgggttcaccgagtccgagatgatcgagcacatgcagcgcctcgccgccatgaacagggcctacaagtccttcatcgggatggggtactacaacacccacgtccccgcggtgatcctgcgcaacctcatggagaacccggcgtggtacacgcagtacacgccgtaccaggcggagatcgcgcagggtcgcctcgagtcgctgctcaactaccagaccatggtcgccgacctcaccggcctccccatgtccaacgcctcgctgctcgacgaggccaccgccgccgccgaggccatggccatgtgcaacggcatcctcaagtccaagaagaagaccttcctcatcgcctccaactgccacccgcagaccatcgacgtgtgccagacgcgcgccgccgggttcgacctcaacgtcgtcgtcgcggacgccaaggacttcgactacggcagcggcgacgtgtgcggggtgctcgtgcagtaccccggcacggagggggaggtgctggactacgcggagttcgtcagggacgcgcacgcgcacggcgtcaaggtggtcatggccaccgacctgctcgcgctcacctcgctgcgcccgcccggcgagatcggtgccgacatcgccgtcggctccgcgcagcggttcggcgtgcccatggggtacggcggcccgcacgccgcgttcctcgccacgtcccaggagtacaagcgcctcatgcccggccgcatcatcggcgtcagcgtcgattccagcggcaagcccgcgctccggatggcgatgcagacccgggagcagcacatccgccgcgacaaggccaccagcaacatctgcactgcccaggccttgctcgccaacatggcagcgatgtatgctgtctaccatggtcccgaggggctaaaggcaattgccgaccgtgtacatggactggctggtacatttgcccaaggattgaagaagctcggaacagtgacggtgcaggagctgcccttcttcgacactgtcaaggtcaaggtcgctgacgcgaatgcgattgcccaggaggcctgcaagaacgagatgaaccttcgtgtcgttgatgcaaccacgataaccgttgcctttgatgagaccacaaccttggaggatgtcgacaagctgttcaaggtgttcaatggtggcaagccagtgaacttcactgctgaatccctcgcaccagaggtctcaagctcaattccgagtagccttgtgcgcaagagcccctacttaacccacccgatctttaacatgtaccatacagagcatgagcttctccgctacctgtacaagttgcaatccaaggacctttcactgtgccacagtatgatccctcttggttcttgcactatgaaactaaatgctacagtggagatgatgcctgtcacctaccccaactttgcaaacatgcacccatttgcacctactgaccaagccgcaggatatcatgaaatgtttgatgacttgggcgatctgctgtgcaagatcactggctttgattctttctctttgcaaccaaatgctggtgcttcaggggagtatgccggattgatggttatccgtgcttaccacagggcaagaggagactaccaccgggatgtctgtatcattcctgtgtcagcccatggtacaaatcctgcaagtgctgctatgtgtggaatgaagattgttgctgttggaactgattccaaaggtaacattaacatcgaggagttgaggaaagctgctgaagcaaacaaggacaacttggctgctcttatggttacctatccttcgacccatggagtctatgaagaaggcattgatgagatatgcatgataattcatgagaacggtgggcaggtctacatggatggagctaacatgaatgctcagaaacactacccagttcttttccgtggagtcaatggaactgttgcccatgagttcattattgatttaagaggatttaagacgactgctggtatagagccagaggatgttgcaaagcgtttgatggactatggattccatgcacctactatgtcatggcctgttccaggcacacttatgattgaaccaactgaaagtgaaagcaaggccgaactagataggttctgtgatgctctaatctcaatcagggaagaaattgcagagatagaaagtggcaaagcagatgtgaacaacaacgtcctcaaggtaaaatactactataccgctatctgttttcatatattagattgtcgcgtggacaatgtgtacggggatcgcaacctcatctgcactctgcaacagggatcccaagtcgcagaagaagctgcagctgctaccgcatga

SEQ ID NO: 3095 - protein, 892 aa, Oryza sativa
MERARRLANRALLRRLLAAATAESPAAPSRGISTLAKGSRPRAPPRPAPHQYTTGRRPVSASALQPSDTFPRRHNSATPAEQAAMASECGFGTVDALIDATVPAAIRAPEMRFSGRFDAGFTESEMIEHMQRLAAMNRAYKSFIGMGYYNTHVPAVILRNLMENPAWYTQYTPYQAEIAQGRLESLLNYQTMVADLTGLPMSNASLLDEATAAAEAMAMCNGILKSKKKTFLIASNCHPQTIDVCQTRAAGFDLNVVVADAKDFDYGSGDVCGVLVQYPGTEGEVLDYAEFVRDAHAHGVKVVMATDLLALTSLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPEGLKAIADRVHGLAGTFAQGLKKLGTVTVQELPFFDTVKVKVADANAIAQEACKNEMNLRVVDATTITVAFDETTTLEDVDKLFKVFNGGKPVNFTAESLAPEVSSSIPSSLVRKSPYLTHPIFNMYHTEHELLRYLYKLQSKDLSLCHSMIPLGSCTMKLNATVEMMPVTYPNFANMHPFAPTDQAAGYHEMFDDLGDLLCKITGFDSFSLQPNAGASGEYAGLMVIRAYHRARGDYHRDVCIIPVSAHGTNPASAAMCGMKIVAVGTDSKGNINIEELRKAAEANKDNLAALMVTYPSTHGVYEEGIDEICMIIHENGGQVYMDGANMNAQKHYPVLFRGVNGTVAHEFIIDLRGFKTTAGIEPEDVAKRLMDYGFHAPTMSWPVPGTLMIEPTESESKAELDRFCDALISIREEIAEIESGKADVNNNVLKVKYYYTAICFHILDCRVDNVYGDRNLICTLQQGSQVAEEAAAATA

SEQ ID NO: 3096 - DNA, 3595 bp, Brassica napus
  CDS (137)..(3274)
gacagtcagtagtgatatacaaccatttgcaccacctctccaccaaccaatccaatggcacaaaactagaaagacaatcaatctttctgcgttttcctgattccatcccaccttctctaatcaatcaccaatcaccatggagcgcgcacgtaggctcgcttacagaggcatcgtgagacgcctcgttaacgaatcgaaacgacaccgtaacggcgagatcacccctcaccacgtcccttccgttgtcccccacgctcccgctcggtacatctcttccctctcccctttcctctccaacaaccaccacagatccgtcaatctccccaaacaccaccaccaccaccataaccagacgcgttcgatctccgtcgatgcggttaaggcgggagacaccttcccgcgccgccacaactccgcgacgccggacgagcaagcgcacatggcgaaatactgcggatacgaccacatcgactccttggtcgacgacaccgtcccgaaacagatccgaatcgactcgatgaagttctccaaattcgacggaggcctcaccgagagcgagatgatggctcacatgaccgagctcgcctccaagaacaaggtcttcaagtccttcatcgggatggggtactacaacacacacgtccccaccgtgatcatccgcaacatcctggagaaccccgcctggtacactcagtacactccttaccaggcggagatctcccaggggaggctcgagtctctcctcaacttccagacgatgatcaccgatctcacgggactccccatgtccaacgcctcgttgctagacgaagggacagccgccgccgaggccatggcgatgtgtaacaacattcaaaaggggaagaagaagacgttcgtgatcgcgagtaactgccaccctcagacgatcgagatttgtaaaactagagctgatggatttgatttaaaggttgttacgaaggatcttaaagagattgattatagctgtggtgacgtgtgtggtgtgctcgttcagtaccccgggactgagggggaagtgttagattacggcgagtttgttaagaacgctcacgctaacggcgttaaggttgttatggcgacggatctgttggcgttgacggtgttaaagcctcctggggagtttggggctgatattgtcgttggttcggctcagaggtttggcgttccgatgggttacggtggtccccacgctgcttttttggctacttcctcggagtataagaggatgatgccggggaggattattggtgttagtgttgattctactgggaagccagctctgcgtatggctatgcagactagggagcagcatattaggagggataaagccactagcaacatctgtactgctcaagcgttgcttgcgaacatggctgctatgtatgctgtttaccacggacctgcgggtttaaaatctattgccgagcgcgttcatggtcttgctggtatattttctctaggattgaagaagcttggggttgctgaagttcaagatcttccttactttgacactgtgaagattaagtgttcggatgcacatgcgattgctgatgcagctgtcaagagcgaaatgaatctgcgtgttgtggactccaacactattactgcttcttttgatgaaacaaccaccttggatgatgtcgataaacttttcaaagtctttgcttctggcaagcctgttccgttcacggctgaatctcttgcacctgaggttcagaattccattccctctaacttaacaagagagagcacttatctcacccacccaatcttcaacatgtaccacacagagcatgagttactcaggtacatccacaagttagcgaataaggatctctcactgtgccacagcatgattccattgggatcttgtacaatgaagttaaatgcaacaactgaaatgatgccagtctcatggccaagtttcactgacatccacccatttgctccagttgatcaagcacaaggttatcaggaaatgttcagcaccttgggtgatctcttgtgtacaatcactgggtttgactctctctcattgcaacctaatgctggtgcttctggtgagtataccgggctcatggttatccgcgaatatcacaggtcaagaggagatcatcacagaaacgtgtgtatcatacccgtctctgcacatgggacaaaccctgcaagcgctgctatgtgcggaatgaaaattattacggttggaactgatgctaagggaaacatcaacatggacgaggtgagaaaagctgctgaagacaacaaagacagcttagctgccctcatggttacatacccttcaactcatggagtctatgaagagactattgatgagatttgcaaaataatacacgacaacggaggtcaagtgtacatggatggtgccaacatgaatgcacaggttggtttgaccagccctggtttcattggagcggatgtgtgccatctcaatctccacaagaccttctgtattcctcatggaggtggcgggcctggaatgggtcccattggtgtgaagaagcatttagcaccatttcttccttctcaccctgtgatacccactggtggtttcccgcaacccgagaagacagaaccgctgggtcccattgccgctgcaccgtggggatctgcgcttatcttgccaatatcttactcttacattgccatgatgggatctggtggactcactgaggcctcaaagattgcaatcttgaatgccaattacatggcaaagcgcctagagaagcacttcccagttctgttccgtggtgccaacggaacagtagcacacgaattcatcatagatctgagaggcttcaagaacactgctggaatagaagcagaggatgtggcgaaacggctgatggactatggtttccatgcacccacaatgtctttccctgtctctggaacgctcatgattgagccgacggagagtgaaagcaaggcggagttagacaggttctgtgatactctcatttcgatcagggaagaaattgcacagattgaaaaaggaaatgcagatgtccagaacaacgttctcaagggagctccacattctccagctatgctaatgtcagacacatggaagaaaccgtattcccgagagtacgctgctttccctaccccatggctccgctctgccaagttctggccaaccacagggcgtgtggacaatgtgtatggagacaggaagctggtgtgcactctcctaccagaagaagaacaagtcgcagctgcagtatcagcttgatttacattcatgtcttatgttatgtgtcccactttctctcatttctcttctctctctgctcttccatgtttatttccacagtgttcttattatcatacactttctatctagctgtgtaatgtttccattggaatgttgctaatcacatcatccttcgtttcaaaaaaaaaaaaaaaaaaaaaaaaaaaaaaaaaaaaaaaaaaaaaaaagggagggccaaaaaaaaaaaaaaaaaaaaaaaaaaccccccccccttaaaaaaaaacaatttttacccccgggggggggaaaaaattttttttttttttggggccccaaaaa

SEQ ID NO: 3097 - protein, 1045 aa, Brassica napus
MERARRLAYRGIVRRLVNESKRHRNGEITPHHVPSVVPHAPARYISSLSPFLSNNHHRSVNLPKHHHHHHNQTRSISVDAVKAGDTFPRRHNSATPDEQAHMAKYCGYDHIDSLVDDTVPKQIRIDSMKFSKFDGGLTESEMMAHMTELASKNKVFKSFIGMGYYNTHVPTVIIRNILENPAWYTQYTPYQAEISQGRLESLLNFQTMITDLTGLPMSNASLLDEGTAAAEAMAMCNNIQKGKKKTFVIASNCHPQTIEICKTRADGFDLKVVTKDLKEIDYSCGDVCGVLVQYPGTEGEVLDYGEFVKNAHANGVKVVMATDLLALTVLKPPGEFGADIVVGSAQRFGVPMGYGGPHAAFLATSSEYKRMMPGRIIGVSVDSTGKPALRMAMQTREQHIRRDKATSNICTAQALLANMAAMYAVYHGPAGLKSIAERVHGLAGIFSLGLKKLGVAEVQDLPYFDTVKIKCSDAHAIADAAVKSEMNLRVVDSNTITASFDETTTLDDVDKLFKVFASGKPVPFTAESLAPEVQNSIPSNLTRESTYLTHPIFNMYHTEHELLRYIHKLANKDLSLCHSMIPLGSCTMKLNATTEMMPVSWPSFTDIHPFAPVDQAQGYQEMFSTLGDLLCTITGFDSLSLQPNAGASGEYTGLMVIREYHRSRGDHHRNVCIIPVSAHGTNPASAAMCGMKIITVGTDAKGNINMDEVRKAAEDNKDSLAALMVTYPSTHGVYEETIDEICKIIHDNGGQVYMDGANMNAQVGLTSPGFIGADVCHLNLHKTFCIPHGGGGPGMGPIGVKKHLAPFLPSHPVIPTGGFPQPEKTEPLGPIAAAPWGSALILPISYSYIAMMGSGGLTEASKIAILNANYMAKRLEKHFPVLFRGANGTVAHEFIIDLRGFKNTAGIEAEDVAKRLMDYGFHAPTMSFPVSGTLMIEPTESESKAELDRFCDTLISIREEIAQIEKGNADVQNNVLKGAPHSPAMLMSDTWKKPYSREYAAFPTPWLRSAKFWPTTGRVDNVYGDRKLVCTLLPEEEQVAAAVSA

SEQ ID NO: 3098 - DNA, 3920 bp, Glycine max
  CDS (128)..(3307)
cacacacaccaatggaatcataacaagaaaaagataaacactccccagagttcaaagagcaagcactatttcctctgttgtgtcttttttcaatttgttttccctctctgtagcagcagcagcagtgatggaacgtgctcgcaggctagcaaaccgcgccattctgaggcgtctggtttcagaggcaaagcagcatcagaagaatgaatccgtgctgcactcttccaccacccccatgctgctctattcttcctccaggtgcatgtcctctgttctgcgaagcaagggatccaaaacagagacccttctgggaaggaacatcaacatgtcacgcggcgttgttgttgctgctgctggtggttttctcggcgttggctcggcccggtccatctcggtcgaagcgcttcgaccgagcgacaccttcccccggcggcacaactctgccaccccggaggagcagagcaagatggcagagtcgtgtggcttcggtagcctcgactccctcgtggacgccaccgtgcctaagtcgatacgccttaaggatatgaagttcgggaaattcgatgcagggcttacagagaaccagatgatagagcacatgaaggacttggcctcaaagaacaaggttttcaagtcctacattggaatggggtactacaacactcatgttccaccagtgatcctgaggaacattatggagaaccctgcttggtacactcagtacacaccttaccaggctgagatatctcaggggaggcttgagtcactgctgaattaccaaaccatgatcactgacctcaccggcttgcctatgtccaatgcttcattgcttgatgagggaactgctgctgctgaagcaatgtccatgtgcaacaacattcagaaagggaagaagaagaccttcatcattgcaagtaactgccaccctcaaaccattgatatttgcaagacaagggctgatggttttgatctgaaggttgttactgcagatcttaaggacattgattacaagtctggggatgtttgtggtgtgcttgtgcagtaccctggcactgagggagaggttttggactatggggagtttgtgaagaaggctcatgctcatgaggtgaaggttgttatggcaagtgatttgttggcactgactgtgttgaagcctcctggtgagttcggggcagatattgttgttggatcagctcagaggtttggggtgccaatggggtatggagggcctcatgcagctttcttggccacttcacaagagtacaagaggatgatgcctgggagaatcattggggtcagtgtcgattcttccggaaagactgctttgaggatggcgatgcaaactagggagcagcatatcaggagggacaaggccaccagcaacatttgcactgctcaggcactgcttgcaaacatggctgccatgtatgctgtgtatcatggacctgaaggcctcaagaacattgcacaccgtgttcatggtcttgctggggcatttgctcttggaataaagaaacttggaactgtggaaattcaggaccttcccttctttgacactgtgaaggttaagacttccaatgcacacgcaattgctgatgctgctctcaaaagtggaataaatttgcgagttgttgatggaaacactatcactgttgcttttgatgaaacaaccacattagaggatgttgataatcttttcaaagtttttgctggtggaaagcccgtctccttcacagctgcatctcttgcaccagaagttcagagtgcgattccttctggattagttaggaagagcccttatctgacgcaccctatctttaacacgtaccaaactgagcatgagttgcttaggtacttgtataggctacaatcaaaagatctctcactatgccacagtatgatcccacttggatcttgtacaatgaagctgaatgcaacaactgaaatgatgcctgtgacatggcccagctttagtgatattcacccttttgcaccagttgaccaggctcaaggttatcaggaaatgttcaacaatttgggtgaactgttgtgcaccatcactgggttcgactccttctctttgcaaccaaatgctggtgctgctggagaatatgctggacttatggttattcgtgcatatcatttggcaaggggagaccaccaccgcaatgtttgcattatacctgtctcagcacacggaacaaatcctgctagtgcagctatgtgtggaatgaaaattgtctctgttggaactgatgccaagggaaacattaatatagaagagctgaggaaggctgctgaaacacacaaggataacttatctgcacttatggtaacatatccttcaacccacggtgtttatgaggaaggtattgacgaaatttgcaatattattcatgataatggaggccaagtatatatggatggtgccaacatgaatgctcaggtgggactcacaagcccgggttggataggagcagatgtttgccatctcaatctccacaagacattttgcatccctcatggaggaggtggccctggcatgggacctattggtgtaaagaaacacttggcaccatttttaccttcacaccctgtgatagaaactggtggaattcctgcccctgacaaacctcaaccacttggtaccatcgctgctgcaccatggggctcagcactcatattgccaatctcttacacttacatagccatgatgggttctaaaggactcaccgatgcatcaaagatagccattttgaatgcaaactacatggcaaaacgattggagaattattacccggttcttttccgtggagtcaatggaacagttgctcatgaattcatcattgacttgagaggctttaagaatactgctggaattgagcctgaagatgttgcaaagcgcctcatggactacggttttcatgcaccaacaatgtcatggcctgtgcctggcacactcatgattgagcctactgagagtgaaagcaaggccgagttagacaggttctgtgatgctcttatttccattagacaagaaattgctgagattgagaaaggaaaggttgacattaacaacaatgtacttaagggcgcccctcatccaccatcactgctcatggctgatgcatggacaaaaccatactccagggaatatgcagccttcccagctccttggctccgtactgcaaagttctggcctaccacaggacgtgttgataatgtgtacggtgaccgcaacctcatttgcacccttctcccagcatcacaggctgttgaagaacaagcagctgccacagcataatgtgttcaaatgacaactattttcatttcccgttgtacataaactcttattcctattcatacagttcttgcacttgttgaatattgcttcatcatatgtgacaatgatgataatccactgctcttaagtttcatccaatcacaggaaaaaaaaaaaaagtaattcgtataattgctgctgctattggattttaggaatgtattttaggcctatctgttacagtaatgtgaaaaaatggatttgattcatgtaaaaaatactcagatttaatgggacctatataaatttcacccaaatagtgtgtgtggtactaacatttattatagtctattgaaggtgtgctatgttgtatgtagtgactgcatagtttagtttgagaaataaatgcatagactaattaatgaatgaaacatgtgtatcaggacgtgttgataatgtgtacggtgaccgcaacctcatttgcacccttctcccagcatcacaggctgttgaagaacaagcagctgccacagcataatgtgttcaaatgacaactattttcatttcccgttgtacataaactcttattcctattcatacagttcttgcacttgttgaatattgcttcatcata

SEQ ID NO: 3099 - protein, 1059 aa, Glycine max
MERARRLANRAILRRLVSEAKQHQKNESVLHSSTTPMLLYSSSRCMSSVLRSKGSKTETLLGRNINMSRGVVVAAAGGFLGVGSARSISVEALRPSDTFPRRHNSATPEEQSKMAESCGFGSLDSLVDATVPKSIRLKDMKFGKFDAGLTENQMIEHMKDLASKNKVFKSYIGMGYYNTHVPPVILRNIMENPAWYTQYTPYQAEISQGRLESLLNYQTMITDLTGLPMSNASLLDEGTAAAEAMSMCNNIQKGKKKTFIIASNCHPQTIDICKTRADGFDLKVVTADLKDIDYKSGDVCGVLVQYPGTEGEVLDYGEFVKKAHAHEVKVVMASDLLALTVLKPPGEFGADIVVGSAQRFGVPMGYGGPHAAFLATSQEYKRMMPGRIIGVSVDSSGKTALRMAMQTREQHIRRDKATSNICTAQALLANMAAMYAVYHGPEGLKNIAHRVHGLAGAFALGIKKLGTVEIQDLPFFDTVKVKTSNAHAIADAALKSGINLRVVDGNTITVAFDETTTLEDVDNLFKVFAGGKPVSFTAASLAPEVQSAIPSGLVRKSPYLTHPIFNTYQTEHELLRYLYRLQSKDLSLCHSMIPLGSCTMKLNATTEMMPVTWPSFSDIHPFAPVDQAQGYQEMFNNLGELLCTITGFDSFSLQPNAGAAGEYAGLMVIRAYHLARGDHHRNVCIIPVSAHGTNPASAAMCGMKIVSVGTDAKGNINIEELRKAAETHKDNLSALMVTYPSTHGVYEEGIDEICNIIHDNGGQVYMDGANMNAQVGLTSPGWIGADVCHLNLHKTFCIPHGGGGPGMGPIGVKKHLAPFLPSHPVIETGGIPAPDKPQPLGTIAAAPWGSALILPISYTYIAMMGSKGLTDASKIAILNANYMAKRLENYYPVLFRGVNGTVAHEFIIDLRGFKNTAGIEPEDVAKRLMDYGFHAPTMSWPVPGTLMIEPTESESKAELDRFCDALISIRQEIAEIEKGKVDINNNVLKGAPHPPSLLMADAWTKPYSREYAAFPAPWLRTAKFWPTTGRVDNVYGDRNLICTLLPASQAVEEQAAATA

SEQ ID NO: 3100 - DNA, 22 bp, Artificial sequence
  primer
atgacacagacgttaagccagc

SEQ ID NO: 3101 - DNA, 24 bp, Artificial sequence
  primer
ttactggtattcgctaatcggtac

SEQ ID NO: 3102 - protein, 1161 aa, Artificial sequence
  consensus sequence
  Variant (2)..(2): Xaa in position 2 is any amino acid
  Variant (3)..(3): Xaa in position 3 is any or no amino acid
  Variant (6)..(6): Xaa in position 6 is any amino acid
  Variant (8)..(13): Xaa in position 8 to 13 is any amino acid
  Variant (14)..(15): Xaa in position 14 to 15 is any or no amino acid
  Variant (18)..(20): Xaa in position 18 to 20 is any amino acid
  Variant (22)..(33): Xaa in position 22 to 33 is any amino acid
  Variant (34)..(35): Xaa in position 34 to 35 is any or no amino acid
  Variant (37)..(38): Xaa in position 37 to 38 is any amino acid
  Variant (40)..(51): Xaa in position 40 to 51 is any amino acid
  Variant (52)..(67): Xaa in position 52 to 67 is any or no amino acid
  Variant (69)..(78): Xaa in position 69 to 78 is any amino acid
  Variant (80)..(81): Xaa in position 80 to 81 is any amino acid
  Variant (83)..(88): Xaa in position 83 to 88 is any amino acid
  Variant (89)..(89): Xaa in position 89 is any or no amino acid
  Variant (92)..(92): Xaa in position 92 is any amino acid
  Variant (95)..(96): Xaa in position 95 to 96 is any amino acid
  Variant (98)..(99): Xaa in position 98 to 99 is any amino acid
  Variant (101)..(101): Xaa in position 101 is any amino acid
  Variant (104)..(104): Xaa in position 104 is any amino acid
  Variant (107)..(108): Xaa in position 107 to 108 is any amino acid
  Variant (112)..(112): Xaa in position 112 is any amino acid
  Variant (116)..(116): Xaa in position 116 is any amino acid
  Variant (122)..(122): Xaa in position 122 is any amino acid
  Variant (125)..(125): Xaa in position 125 is any amino acid
  Variant (131)..(131): Xaa in position 131 is any amino acid
  Variant (135)..(135): Xaa in position 135 is any amino acid
  Variant (137)..(140): Xaa in position 137 to 140 is any amino acid
  Variant (145)..(148): Xaa in position 145 to 148 is any amino acid
  Variant (156)..(156): Xaa in position 156 is any amino acid
  Variant (164)..(175): Xaa in position 164 to 175 is any amino acid
  Variant (176)..(181): Xaa in position 176 to 181 is any or no amino acid
  Variant (183)..(189): Xaa in position 183 to 189 is any amino acid
  Variant (193)..(194): Xaa in position 193 to 194 is any amino acid
  Variant (196)..(197): Xaa in position 196 to 197 is any amino acid
  Variant (201)..(203): Xaa in position 201 to 203 is any amino acid
  Variant (205)..(217): Xaa in position 205 to 217 is any amino acid
  Variant (218)..(237): Xaa in position 218 to 237 is any or no amino acid
  Variant (239)..(241): Xaa in position 239 to 241 is any amino acid
  Variant (243)..(243): Xaa in position 243 is any amino acid
  Variant (245)..(247): Xaa in position 245 to 247 is any amino acid
  Variant (248)..(251): Xaa in position 248 to 251 is any or no amino acid
  Variant (253)..(255): Xaa in position 253 to 255 is any amino acid
  Variant (256)..(258): Xaa in position 256 to 258 is any or no amino acid
  Variant (260)..(276): Xaa in position 260 to 276 is any amino acid
  Variant (277)..(278): Xaa in position 277 to 278 is any or no amino acid
  Variant (280)..(280): Xaa in position 280 is any amino acid
  Variant (282)..(282): Xaa in position 282 is any amino acid
  Variant (284)..(284): Xaa in position 284 is any amino acid
  Variant (286)..(290): Xaa in position 286 to 290 is any amino acid
  Variant (293)..(294): Xaa in position 293 to 294 is any amino acid
  Variant (298)..(300): Xaa in position 298 to 300 is any amino acid
  Variant (302)..(303): Xaa in position 302 to 303 is any amino acid
  Variant (310)..(310): Xaa in position 310 is any amino acid
  Variant (312)..(312): Xaa in position 312 is any amino acid
  Variant (318)..(320): Xaa in position 318 to 320 is any amino acid
  Variant (322)..(327): Xaa in position 322 to 327 is any amino acid
  Variant (329)..(330): Xaa in position 329 to 330 is any amino acid
  Variant (334)..(335): Xaa in position 334 to 335 is any amino acid
  Variant (337)..(337): Xaa in position 337 is any amino acid
  Variant (339)..(339): Xaa in position 339 is any amino acid
  Variant (341)..(342): Xaa in position 341 to 342 is any amino acid
  Variant (344)..(345): Xaa in position 344 to 345 is any amino acid
  Variant (347)..(347): Xaa in position 347 is any amino acid
  Variant (349)..(349): Xaa in position 349 is any amino acid
  Variant (351)..(351): Xaa in position 351 is any amino acid
  Variant (361)..(361): Xaa in position 361 is any amino acid
  Variant (372)..(372): Xaa in position 372 is any amino acid
  Variant (376)..(377): Xaa in position 376 to 377 is any amino acid
  Variant (379)..(380): Xaa in position 379 to 380 is any amino acid
  Variant (384)..(384): Xaa in position 384 is any amino acid
  Variant (388)..(388): Xaa in position 388 is any amino acid
  Variant (391)..(392): Xaa in position 391 to 392 is any amino acid
  Variant (395)..(395): Xaa in position 395 is any amino acid
  Variant (397)..(406): Xaa in position 397 to 406 is any amino acid
  Variant (407)..(407): Xaa in position 407 is any or no amino acid
  Variant (409)..(409): Xaa in position 409 is any amino acid
  Variant (410)..(411): Xaa in position 410 to 411 is any or no amino acid
  Variant (413)..(419): Xaa in position 413 to 419 is any amino acid
  Variant (420)..(428): Xaa in position 420 to 428 is any or no amino acid
  Variant (432)..(443): Xaa in position 432 to 443 is any amino acid
  Variant (444)..(451): Xaa in position 444 to 451 is any or no amino acid
  Variant (453)..(456): Xaa in position 453 to 456 is any amino acid
  Variant (457)..(457): Xaa in position 457 is any or no amino acid
  Variant (461)..(470): Xaa in position 461 to 470 is any amino acid
  Variant (471)..(478): Xaa in position 471 to 478 is any or no amino acid
  Variant (481)..(508): Xaa in position 481 to 508 is any amino acid
  Variant (509)..(559): Xaa in position 509 to 559 is any or no amino acid
  Variant (561)..(564): Xaa in position 561 to 564 is any amino acid
  Variant (566)..(566): Xaa in position 566 is any amino acid
  Variant (568)..(569): Xaa in position 568 to 569 is any amino acid
  Variant (571)..(575): Xaa in position 571 to 575 is any amino acid
  Variant (577)..(580): Xaa in position 577 to 580 is any amino acid
  Variant (583)..(585): Xaa in position 583 to 585 is any amino acid
  Variant (587)..(589): Xaa in position 587 to 589 is any amino acid
  Variant (591)..(592): Xaa in position 591 to 592 is any amino acid
  Variant (594)..(596): Xaa in position 594 to 596 is any amino acid
  Variant (610)..(611): Xaa in position 610 to 611 is any amino acid
  Variant (614)..(614): Xaa in position 614 is any amino acid
  Variant (616)..(617): Xaa in position 616 to 617 is any amino acid
  Variant (619)..(620): Xaa in position 619 to 620 is any amino acid
  Variant (622)..(624): Xaa in position 622 to 624 is any amino acid
  Variant (628)..(628): Xaa in position 628 is any amino acid
  Variant (630)..(630): Xaa in position 630 is any amino acid
  Variant (631)..(631): Xaa in position 631 is any or no amino acid
  Variant (633)..(634): Xaa in position 633 to 634 is any amino acid
  Variant (637)..(637): Xaa in position 637 is any amino acid
  Variant (638)..(642): Xaa in position 638 to 642 is any or no amino acid
  Variant (644)..(646): Xaa in position 644 to 646 is any amino acid
  Variant (648)..(650): Xaa in position 648 to 650 is any amino acid
  Variant (653)..(656): Xaa in position 653 to 656 is any amino acid
  Variant (658)..(658): Xaa in position 658 is any amino acid
  Variant (662)..(662): Xaa in position 662 is any amino acid
  Variant (664)..(664): Xaa in position 664 is any amino acid
  Variant (672)..(673): Xaa in position 672 to 673 is any amino acid
  Variant (675)..(676): Xaa in position 675 to 676 is any amino acid
  Variant (679)..(680): Xaa in position 679 to 680 is any amino acid
  Variant (681)..(684): Xaa in position 681 to 684 is any or no amino acid
  Variant (686)..(687): Xaa in position 686 to 687 is any amino acid
  Variant (688)..(688): Xaa in position 688 is any or no amino acid
  Variant (690)..(691): Xaa in position 690 to 691 is any amino acid
  Variant (696)..(696): Xaa in position 696 is any amino acid
  Variant (707)..(707): Xaa in position 707 is any amino acid
  Variant (709)..(709): Xaa in position 709 is any amino acid
  Variant (711)..(712): Xaa in position 711 to 712 is any amino acid
  Variant (715)..(721): Xaa in position 715 to 721 is any amino acid
  Variant (722)..(722): Xaa in position 722 is any or no amino acid
  Variant (724)..(725): Xaa in position 724 to 725 is any amino acid
  Variant (727)..(728): Xaa in position 727 to 728 is any amino acid
  Variant (731)..(732): Xaa in position 731 to 732 is any amino acid
  Variant (734)..(740): Xaa in position 734 to 740 is any amino acid
  Variant (742)..(744): Xaa in position 742 to 744 is any amino acid
  Variant (746)..(746): Xaa in position 746 is any amino acid
  Variant (755)..(755): Xaa in position 755 is any amino acid
  Variant (757)..(762): Xaa in position 757 to 762 is any amino acid
  Variant (764)..(766): Xaa in position 764 to 766 is any amino acid
  Variant (768)..(769): Xaa in position 768 to 769 is any amino acid
  Variant (775)..(775): Xaa in position 775 is any amino acid
  Variant (780)..(780): Xaa in position 780 is any amino acid
  Variant (783)..(783): Xaa in position 783 is any amino acid
  Variant (786)..(788): Xaa in position 786 to 788 is any amino acid
  Variant (791)..(792): Xaa in position 791 to 792 is any amino acid
  Variant (794)..(794): Xaa in position 794 is any amino acid
  Variant (797)..(797): Xaa in position 797 is any amino acid
  Variant (816)..(816): Xaa in position 816 is any amino acid
  Variant (819)..(820): Xaa in position 819 to 820 is any amino acid
  Variant (822)..(823): Xaa in position 822 to 823 is any amino acid
  Variant (826)..(826): Xaa in position 826 is any amino acid
  Variant (828)..(828): Xaa in position 828 is any amino acid
  Variant (831)..(837): Xaa in position 831 to 837 is any amino acid
  Variant (838)..(877): Xaa in position 838 to 877 is any or no amino acid
  Variant (882)..(882): Xaa in position 882 is any amino acid
  Variant (886)..(886): Xaa in position 886 is any amino acid
  Variant (891)..(893): Xaa in position 891 to 893 is any amino acid
  Variant (895)..(897): Xaa in position 895 to 897 is any amino acid
  Variant (900)..(900): Xaa in position 900 is any amino acid
  Variant (901)..(901): Xaa in position 901 is any or no amino acid
  Variant (904)..(905): Xaa in position 904 to 905 is any amino acid
  Variant (907)..(909): Xaa in position 907 to 909 is any amino acid
  Variant (911)..(911): Xaa in position 911 is any amino acid
  Variant (913)..(913): Xaa in position 913 is any amino acid
  Variant (917)..(919): Xaa in position 917 to 919 is any amino acid
  Variant (922)..(922): Xaa in position 922 is any amino acid
  Variant (923)..(924): Xaa in position 923 to 924 is any or no amino acid
  Variant (926)..(927): Xaa in position 926 to 927 is any amino acid
  Variant (929)..(930): Xaa in position 929 to 930 is any amino acid
  Variant (932)..(933): Xaa in position 932 to 933 is any amino acid
  Variant (934)..(942): Xaa in position 934 to 942 is any or no amino acid
  Variant (944)..(944): Xaa in position 944 is any amino acid
  Variant (949)..(949): Xaa in position 949 is any amino acid
  Variant (951)..(951): Xaa in position 951 is any amino acid
  Variant (953)..(953): Xaa in position 953 is any amino acid
  Variant (955)..(959): Xaa in position 955 to 959 is any amino acid
  Variant (960)..(960): Xaa in position 960 is any or no amino acid
  Variant (962)..(965): Xaa in position 962 to 965 is any amino acid
  Variant (967)..(967): Xaa in position 967 is any amino acid
  Variant (972)..(972): Xaa in position 972 is any amino acid
  Variant (974)..(974): Xaa in position 974 is any amino acid
  Variant (981)..(981): Xaa in position 981 is any amino acid
  Variant (983)..(983): Xaa in position 983 is any amino acid
  Variant (986)..(986): Xaa in position 986 is any amino acid
  Variant (991)..(991): Xaa in position 991 is any amino acid
  Variant (998)..(1000): Xaa in position 998 to 1000 is any amino acid
  Variant (1006)..(1007): Xaa in position 1006 to 1007 is any amino acid
  Variant (1009)..(1011): Xaa in position 1009 to 1011 is any amino acid
  Variant (1014)..(1014): Xaa in position 1014 is any amino acid
  Variant (1016)..(1021): Xaa in position 1016 to 1021 is any amino acid
  Variant (1023)..(1026): Xaa in position 1023 to 1026 is any amino acid
  Variant (1027)..(1028): Xaa in position 1027 to 1028 is any or no amino acid
  Variant (1030)..(1030): Xaa in position 1030 is any amino acid
  Variant (1032)..(1033): Xaa in position 1032 to 1033 is any amino acid
  Variant (1037)..(1044): Xaa in position 1037 to 1044 is any amino acid
  Variant (1045)..(1051): Xaa in position 1045 to 1051 is any or no amino acid
  Variant (1053)..(1054): Xaa in position 1053 to 1054 is any amino acid
  Variant (1055)..(1058): Xaa in position 1055 to 1058 is any or no amino acid
  Variant (1060)..(1060): Xaa in position 1060 is any amino acid
  Variant (1062)..(1063): Xaa in position 1062 to 1063 is any amino acid
  Variant (1065)..(1066): Xaa in position 1065 to 1066 is any amino acid
  Variant (1068)..(1074): Xaa in position 1068 to 1074 is any amino acid
  Variant (1075)..(1093): Xaa in position 1075 to 1093 is any or no amino acid
  Variant (1096)..(1096): Xaa in position 1096 is any amino acid
  Variant (1098)..(1098): Xaa in position 1098 is any amino acid
  Variant (1100)..(1100): Xaa in position 1100 is any amino acid
  Variant (1102)..(1104): Xaa in position 1102 to 1104 is any amino acid
  Variant (1105)..(1129): Xaa in position 1105 to 1129 is any or no amino acid
  Variant (1134)..(1156): Xaa in position 1134 to 1156 is any amino acid
  Variant (1158)..(1158): Xaa in position 1158 is any amino acid
  Variant (1160)..(1160): Xaa in position 1160 is any amino acid
FXXRHXGXXXXXXXXMLXXXGXXXXXXXXXXXXXXPXXIXXXXXXXXXXXXXXXXXXXXXXXXXXXXEXXXXXXXXXXAXXNXXXXXXXIGXGYXXTXXPXVIXRNXXENPXWYTXYTPYQXEIXQGRLEXLLNXQXXXXDLTGXXXXNASLLDEXTAAAEAMXXXXXXXXXXXXXXXXXXFXXXXXXXPQTXXVXXTRAXXXGXXXXXXXXXXXXXXXXXXXXXXXXXXXXXXXXXGXXXQXPXXXXXXXGXXXXXXDXXXXXXXXXXXXXXXXXXXAXDXLXLXXXXXPGXXGADXXXGXXQRFGVPXGXGGPHAXXXAXXXXXXRXXPGRXXGXSXDXXGXXAXRXAXQTREQHIRRXKATSNICTAQXLLAXXAXXYAVXHGPXGLXXIAXRXXXXXXXXXXXLXXXGXXXXXXXXXXXXXXXXFDTXXXXXXXXXXXXXXXXXXXXAXXXXXNLRXXXXXXXXXXXXXXXXXXDEXXXXXXXXXXXXXXXXXXXXXXXXXXXXXXXXXXXXXXXXXXXXXXXXXXXXXXXXXXXXXXXXXXXXXXXXXXXXXXXRXXXXLXHXXFXXXXXEXXXXRYXXXLXXXDXXLXXXMIPLGSCTMKLNAXXEMXPXXWXXFXXXHPFXPXXQXXGYXXXXXXLXXXLXXXTGXXXXSXQPNXGXQGEYAGLXXIXXYHXXXXXXGXXXRXXCLIPXSAHGTNPASAXMXGXXVVXXXXXXXXGXXDXXDLXXKXXXXXXXLXXXMXTYPSTHGVXEXXXXXXCXXXHXXGGQVYXDGANXNAXVGXXXPGXXGXDVXHLNLHKTFCIPHGGGGPGXGPXXVXXHLXPXLPXXXXXXXXXXXXXXXXXXXXXXXXXXXXXXXXXXXXXXXXXXXXXXXSAAPXGSAXILPIXXXYXXXMGXXGLXXAXXXAXLXANYXXXRLXXXYXXLXXGXXXXXXXXXXXGXVAHEXIXDXRXXXXXXGXXXXDXAKRLXDXGFHAPTXSXPVXGTLMXEPTESEXXXELDRFXXAXXXIRXEXXXXXXGXXXXXXNXLXXAPHXXXXXXXXXXXXXXXWXXXXXXYXRXXAXXPXXXXXXXXXXXXXXXXXXXXXXXXXXWPXVXRXDXXXXXXXXXXXXXXXXXXXXXXXXXXXXGDRNXXXXXXXXXXXXXXXXXXXXXXXLXCXC

SEQ ID NO: 3103 - protein, 41 aa, Artificial sequence
  protein pattern
  Variant (2)..(2): Xaa in position 2 is Leu or Met
  Variant (3)..(3): Xaa in position 3 is Ala, Ser or Thr
  Variant (4)..(4): Xaa in position 4 is Leu or Met
  Variant (5)..(5): Xaa in position 5 is Gln or Ser
  Variant (14)..(14): Xaa in position 14 is Asp or Glu
  Variant (17)..(18): Xaa in position 17 to 18 is any or no amino acid
  Variant (20)..(21): Xaa in position 20 to 21 is any or no amino acid
  Variant (25)..(25): Xaa in position 25 is Ala or Ser
  Variant (27)..(27): Xaa in position 27 is Ala, Ile or Val
  Variant (31)..(31): Xaa in position 31 is any amino acid
  Variant (32)..(32): Xaa in position 32 is Ile, Leu, Met or Val
  Variant (33)..(33): Xaa in position 33 is Ala, Ser or Thr
  Variant (34)..(34): Xaa in position 34 is Ala, Gly, Ser, Thr or Val
  Variant (35)..(35): Xaa in position 35 is any amino acid
  Variant (36)..(36): Xaa in position 36 is Phe or Tyr
  Variant (37)..(37): Xaa in position 37 is Ala, Gly or Val
  Variant (38)..(38): Xaa in position 38 is any amino acid
  Variant (39)..(39): Xaa in position 39 is Phe, His, Trp or Tyr
RXXXXTREQHIRRXKAXXNXXICTXQXLLAXXXXXXXXXHG

SEQ ID NO: 3104 - protein, 38 aa, Artificial sequence
  protein pattern
  Variant (5)..(5): Xaa in position 5 is any amino acid
  Variant (7)..(7): Xaa in position 7 is any amino acid
  Variant (11)..(11): Xaa in position 11 is Ala, Gly or Ser
  Variant (14)..(14): Xaa in position 14 is Ile, Leu, Met or Val
  Variant (16)..(16): Xaa in position 16 is Phe or Trp
  Variant (19)..(19): Xaa in position 19 is any amino acid
  Variant (22)..(22): Xaa in position 22 is Phe, Ile, Leu, Met or Val
  Variant (24)..(24): Xaa in position 24 is Ile or Val
  Variant (31)..(31): Xaa in position 31 is Ala, Asp, Gly, Asn, Pro, Ser or Thr
  Variant (32)..(33): Xaa in position 32 to 33 is any amino acid
  Variant (35)..(35): Xaa in position 35 is Ile, Leu or Met
  Variant (38)..(38): Xaa in position 38 is Phe or Leu
AKRLXDXGFHXPTXSXPVXGTXMXEPTESEXXXEXDRX

SEQ ID NO: 3105 - protein, 29 aa, Artificial sequence
  protein pattern
  Variant (2)..(2): Xaa in position 2 is any amino acid
  Variant (5)..(5): Xaa in position 5 is Cys or Ser
  Variant (14)..(14): Xaa in position 14 is Ala, Cys or Ser
  Variant (15)..(15): Xaa in position 15 is any amino acid
  Variant (24)..(24): Xaa in position 24 is any amino acid
  Variant (27)..(28): Xaa in position 27 to 28 is any or no amino acid
GXDVXHLNLHKTFXXPHGGGGPGXGPXXV

SEQ ID NO: 3106 - protein, 62 aa, Artificial sequence
  protein pattern
  Variant (2)..(5): Xaa in position 2 to 5 is any amino acid
  Variant (6)..(6): Xaa in position 6 is Ala, Ser or Thr
  Variant (8)..(8): Xaa in position 8 is any amino acid
  Variant (9)..(9): Xaa in position 9 is Ala, Asp, Glu, Gly, Asn, Gln, Ser or Thr
  Variant (10)..(10): Xaa in position 10 is Leu or Met
  Variant (11)..(11): Xaa in position 11 is any amino acid
  Variant (14)..(14): Xaa in position 14 is Ile, Leu or Met
  Variant (15)..(16): Xaa in position 15 to 16 is any amino acid
  Variant (18)..(20): Xaa in position 18 to 20 is any amino acid
  Variant (22)..(23): Xaa in position 22 to 23 is any or no amino acid
  Variant (25)..(27): Xaa in position 25 to 27 is any amino acid
  Variant (28)..(29): Xaa in position 28 to 29 is any or no amino acid
  Variant (32)..(32): Xaa in position 32 is Ala, Pro or Ser
  Variant (43)..(43): Xaa in position 43 is Ala, Ser, Thr or Val
  Variant (44)..(44): Xaa in position 44 is any amino acid
  Variant (46)..(46): Xaa in position 46 is Leu or Met
  Variant (47)..(47): Xaa in position 47 is any amino acid
  Variant (48)..(48): Xaa in position 48 is Ala, Asn, Pro, Ser or Thr
  Variant (49)..(49): Xaa in position 49 is Ile, Leu, Met or Val
  Variant (50)..(50): Xaa in position 50 is Glu, Ser or Thr
  Variant (51)..(53): Xaa in position 51 to 53 is any amino acid
  Variant (55)..(57): Xaa in position 55 to 57 is any amino acid
  Variant (60)..(61): Xaa in position 60 to 61 is any amino acid
FXXXXXEXXXXRYXXXLXXXDXXLXXXXXMIXLGSCTMKLNAXXEXXXXXXXXFXXXHPXXP

SEQ ID NO: 3107 - protein, 27 aa, Artificial sequence
  protein pattern
  Variant (2)..(3): Xaa in position 2 to 3 is any amino acid
  Variant (7)..(7): Xaa in position 7 is any amino acid
  Variant (8)..(8): Xaa in position 8 is Ala, Cys, Ser, Thr or Val
  Variant (9)..(9): Xaa in position 9 is Phe, Ile, Leu or Val
  Variant (11)..(11): Xaa in position 11 is Asn, Ser or Thr
  Variant (12)..(12): Xaa in position 12 is Ala, Gly, Asn, Ser or Thr
  Variant (17)..(17): Xaa in position 17 is Ile, Leu, Met or Val
  Variant (19)..(21): Xaa in position 19 to 21 is any amino acid
  Variant (25)..(25): Xaa in position 25 is any amino acid
  Variant (27)..(27): Xaa in position 27 is Ala or Gly
GXXGADXXXGXXQRFGXPXXXGGPXAX

SEQ ID NO: 3108 - protein, 24 aa, Artificial sequence
  protein pattern
  Variant (6)..(6): Xaa in position 6 is Phe or Tyr
  Variant (8)..(9): Xaa in position 8 to 9 is any amino acid
  Variant (10)..(10): Xaa in position 10 is Ile or Val
  Variant (11)..(12): Xaa in position 11 to 12 is any amino acid
  Variant (13)..(13): Xaa in position 13 is Ile, Leu, Met or Val
  Variant (15)..(17): Xaa in position 15 to 17 is any amino acid
  Variant (19)..(20): Xaa in position 19 to 20 is any amino acid
STHGVXEXXXXXXCXXXHXXGGQV

SEQ ID NO: 3109 - protein, 26 aa, Artificial sequence
  protein pattern
  Variant (2)..(3): Xaa in position 2 to 3 is any amino acid
  Variant (8)..(8): Xaa in position 8 is any or no amino acid
  Variant (10)..(10): Xaa in position 10 is any or no amino acid
  Variant (16)..(16): Xaa in position 16 is Ala or Pro
  Variant (18)..(18): Xaa in position 18 is Ser or Thr
  Variant (20)..(20): Xaa in position 20 is any amino acid
  Variant (21)..(21): Xaa in position 21 is Leu or Met
  Variant (22)..(22): Xaa in position 22 is any amino acid
  Variant (23)..(23): Xaa in position 23 is Asp, Glu, Gly, Asn or Ser
  Variant (24)..(25): Xaa in position 24 to 25 is any amino acid
RXXCLIPXSXAHGTNXAXAXXXXXXV

SEQ ID NO: 3110 - protein, 28 aa, Artificial sequence
  protein pattern
  Variant (3)..(3): Xaa in position 3 is Phe or Tyr
  Variant (4)..(6): Xaa in position 4 to 6 is any amino acid
  Variant (7)..(7): Xaa in position 7 is Cys or Ser
  Variant (8)..(8): Xaa in position 8 is Phe, Ile, Leu, Met or Val
  Variant (12)..(12): Xaa in position 12 is Ala or Ser
  Variant (14)..(14): Xaa in position 14 is Ala or Ser
  Variant (15)..(15): Xaa in position 15 is Ala, Gln or Ser
  Variant (18)..(18): Xaa in position 18 is any amino acid
  Variant (22)..(23): Xaa in position 22 to 23 is any amino acid
  Variant (25)..(26): Xaa in position 25 to 26 is any amino acid
  Variant (27)..(27): Xaa in position 27 is Phe, Trp or Tyr
TGXXXXXXQPNXGXXGEXAGLXXIXXXH

SEQ ID NO: 3111 - protein, 24 aa, Artificial sequence
  protein pattern
  Variant (2)..(3): Xaa in position 2 to 3 is any or no amino acid
  Variant (5)..(6): Xaa in position 5 to 6 is any amino acid
  Variant (7)..(7): Xaa in position 7 is any or no amino acid
  Variant (11)..(11): Xaa in position 11 is any amino acid
  Variant (14)..(14): Xaa in position 14 is any amino acid
  Variant (15)..(15): Xaa in position 15 is Ile or Val
  Variant (16)..(16): Xaa in position 16 is Pro, Ser or Thr
  Variant (17)..(18): Xaa in position 17 to 18 is any amino acid
  Variant (20)..(21): Xaa in position 20 to 21 is any amino acid
  Variant (22)..(23): Xaa in position 22 to 23 is Leu or Met
AXXAXXXGSAXILXXXXXYXXXXG

SEQ ID NO: 3112 - protein, 21 aa, Artificial sequence
  protein pattern
  Variant (2)..(2): Xaa in position 2 is any or no amino acid
  Variant (4)..(4): Xaa in position 4 is any or no amino acid
  Variant (6)..(6): Xaa in position 6 is any amino acid
  Variant (8)..(8): Xaa in position 8 is Ala, Ile, Leu or Val
  Variant (10)..(10): Xaa in position 10 is any amino acid
  Variant (11)..(11): Xaa in position 11 is Ala, Thr or Val
  Variant (12)..(12): Xaa in position 12 is any amino acid
  Variant (15)..(16): Xaa in position 15 to 16 is any amino acid
  Variant (17)..(17): Xaa in position 17 is Phe, Leu or Val
  Variant (18)..(18): Xaa in position 18 is any amino acid
  Variant (20)..(20): Xaa in position 20 is Ala, Asp, Glu, Ser or Thr
WXPXVXRXDXXXGDXXXXCXC

SEQ ID NO: 3113 - protein, 14 aa, Artificial sequence
  protein pattern
  Variant (2)..(2): Xaa in position 2 is Ile, Leu, Met or Val
  Variant (7)..(7): Xaa in position 7 is Leu or Met
  Variant (10)..(10): Xaa in position 10 is any amino acid
  Variant (13)..(13): Xaa in position 13 is Ile, Leu or Val
  Variant (14)..(14): Xaa in position 14 is Ala, Cys, Ser or Thr
YXDGANXNAXVGXX

SEQ ID NO: 3114 - protein, 15 aa, Artificial sequence
  protein pattern
  Variant (2)..(2): Xaa in position 2 is any amino acid
  Variant (3)..(3): Xaa in position 3 is Ile, Leu, Met or Val
  Variant (7)..(7): Xaa in position 7 is Ile, Leu or Val
  Variant (8)..(8): Xaa in position 8 is Ile or Val
  Variant (10)..(11): Xaa in position 10 to 11 is any or no amino acid
  Variant (13)..(14): Xaa in position 13 to 14 is any or no amino acid
RXXPGRXXGXXVXXD

SEQ ID NO: 3115 - protein, 12 aa, Artificial sequence
  protein pattern
  Variant (5)..(5): Xaa in position 5 is any amino acid
  Variant (7)..(7): Xaa in position 7 is Phe, Ile, Leu or Val
  Variant (9)..(9): Xaa in position 9 is any amino acid
  Variant (11)..(11): Xaa in position 11 is any amino acid
  Variant (12)..(12): Xaa in position 12 is Phe, Ile, Leu, Met or Val
VAHEXIXDXRXX

SEQ ID NO: 3116 - protein, 23 aa, Artificial sequence
  protein pattern
  Variant (2)..(2): Xaa in position 2 is Ser or Thr
  Variant (3)..(4): Xaa in position 3 to 4 is any amino acid
  Variant (5)..(5): Xaa in position 5 is Ala or Ser
  Variant (6)..(6): Xaa in position 6 is Ile, Leu or Val
  Variant (7)..(7): Xaa in position 7 is any amino acid
  Variant (8)..(8): Xaa in position 8 is Ala, Asn, Ser or Thr
  Variant (12)..(12): Xaa in position 12 is Ile, Leu, Met or Val
  Variant (13)..(15): Xaa in position 13 to 15 is any amino acid
  Variant (17)..(19): Xaa in position 17 to 19 is any amino acid
  Variant (20)..(20): Xaa in position 20 is Phe or Tyr
  Variant (21)..(22): Xaa in position 21 to 22 is any amino acid
AXXXXXXXANYXXXXLXXXXXXL

SEQ ID NO: 3117 - DNA, 990 bp, Escherichia coli
  CDS (1)..(990)
atgcatattacatacgatctgccggttgctattgatgacattattgaagcgaaacaacgactggctgggcgaatttataaaacaggcatgcctcgctccaactattttagtgaacgttgcaaaggtgaaatattcctgaagtttgaaaatatgcagcgtacgggttcatttaaaattcgtggcgcatttaataaattaagttcactgaccgatgcggaaaaacgcaaaggcgtggtggcctgttctgcgggcaaccatgcgcaaggggtttccctctcctgcgcgatgctgggtatcgacggtaaagtggtgatgccaaaaggtgcgccaaaatccaaagtagcggcaacgtgcgactactccgcagaagtcgttctgcatggtgataacttcaacgacactatcgctaaagtgagcgaaattgtcgaaatggaaggccgtatttttatcccaccttacgatgatccgaaagtgattgctggccagggaacgattggtctggaaattatggaagatctctatgatgtcgataacgtgattgtgccaattggtggtggcggtttaattgctggtattgcggtggcaattaaatctattaacccgaccattcgtgttattggcgtacagtctgaaaacgttcacggcatggcggcttctttccactccggagaaataaccacgcaccgaactaccggcaccctggcggatggttgtgatgtctcccgcccgggtaatttaacttacgaaatcgttcgtgaattagtcgatgacatcgtgctggtcagcgaagacgaaatcagaaacagtatgattgccttaattcagcgcaataaagtcgtcaccgaaggcgcaggcgctctggcatgtgctgcattattaagcggtaaattagaccaatatattcaaaacagaaaaaccgtcagtattatttccggcggcaatatcgatctttctcgcgtctctcaaatcaccggtttcgttgacgcttaa

SEQ ID NO: 3118 - protein, 329 aa, Escherichia coli
MHITYDLPVAIDDIIEAKQRLAGRIYKTGMPRSNYFSERCKGEIFLKFENMQRTGSFKIRGAFNKLSSLTDAEKRKGVVACSAGNHAQGVSLSCAMLGIDGKVVMPKGAPKSKVAATCDYSAEVVLHGDNFNDTIAKVSEIVEMEGRIFIPPYDDPKVIAGQGTIGLEIMEDLYDVDNVIVPIGGGGLIAGIAVAIKSINPTIRVIGVQSENVHGMAASFHSGEITTHRTTGTLADGCDVSRPGNLTYEIVRELVDDIVLVSEDEIRNSMIALIQRNKVVTEGAGALACAALLSGKLDQYIQNRKTVSIISGGNIDLSRVSQITGFVDA

SEQ ID NO: 3119 - DNA, 1002 bp, Medicago truncatula
  CDS (1)..(1002)
atggaagaggagagtcaaataccaaagggaagatatgctgctgatatttcatccataaatgaagcacatgccagaataaaatcattgattcttaagaccccagttctctcctccacctctctgaatgccatatcaggaaggcagctttactttaagtgtgaaagcttccaaaagggtggagcttttaaatttagaggtgcatgcaatgctgttttctctctcaatgatgaagatgcgtctaaaggggttataacacacagcagtggaaaccatgctgctgcattggctctggcagcaaaactacgggggatccctgcatacattgttattcctaaaaatgcgccaacatgtaaaattgagaatgtgaagcggtatggtggtcaggttatctggtctgaggccaatatgcgatcaagagaggaaactgcgaataaagtgtggcaagaaactggtgctatttttatacatccttataatgatgggcgcatactgagtggccagggtaccatatccttggagcttctggaacaagcccctcaactagatacacttgtggtaccaataagtggaggtggtttgatatcaggagtagcattggctgccaagtctatcaacccggccattcgtattttggctgctgaacctaaaggggccgatgacgcagcacaatctaaagcagctggaaggataataacattgcccgagaccaatactatagctgacgggctacgagcatttcttggagatttcacatggcctgtcgtacgagatcttgttgacgacataataactgtggaagacagtgaaattgttaaagccatgcaactgtgttatgaaattcttaagattgttgtagaaccaagtggagcaattggccttgcagctgttctatccgaatcttttcagaaaaatcctgcttggaaagattgcaagcatataggaatagtagtgtcaggtggaaatgttgatatggccgtgctttgggattctctgaacaaatga

SEQ ID NO: 3120 - protein, 333 aa, Medicago truncatula
MEEESQIPKGRYAADISSINEAHARIKSLILKTPVLSSTSLNAISGRQLYFKCESFQKGGAFKFRGACNAVFSLNDEDASKGVITHSSGNHAAALALAAKLRGIPAYIVIPKNAPTCKIENVKRYGGQVIWSEANMRSREETANKVWQETGAIFIHPYNDGRILSGQGTISLELLEQAPQLDTLVVPISGGGLISGVALAAKSINPAIRILAAEPKGADDAAQSKAAGRIITLPETNTIADGLRAFLGDFTWPVVRDLVDDIITVEDSEIVKAMQLCYEILKIVVEPSGAIGLAAVLSESFQKNPAWKDCKHIGIVVSGGNVDMAVLWDSLNK

SEQ ID NO: 3121 - DNA, 1227 bp, Gluconobacter oxydans 621H
  CDS (1)..(1227)
atgtctgacgtcctgacgtccaccacccctgtcgtgaccatcgcggacatcgagagcgcccatgagcgcatcgcgtccacggtggtccgcacgccgaccatcgcctgcccggccctttcccggctgacaggcgcggagattacgctcaagctcgaaaaccttcaggcgatcggctccttcaaggagcgcggagcggccaacaagatggccctcctgacgccggaagagcgggcgcgcggcgtcattaccgtctcggcaggcaaccacgcacagggtgtggcccgtcaggccagtcttcttggtattgatgcgaccatcgtcatgccgcgcttcacgccggccaccaaggtcgcggcaacgcaggcctggggcgcgaatgtcgtgctcgcaggggacgatttcgcacaggccagcgagaccgctgccgagctccagaagcaggacggccgcgttctcgtccacccgttcaatgatccggccgtcatcgccggtcagggcactgcggcgctggagcttctggaagatgctccggacatcgatacggtcgtcgtgcccgtgggcggcggtggcctgatcggtgggtttgcgaccgtcatggcggcgctgcgtccggatgtcgaggtcattggggtacaggtcgaggcctatgcctcgctgtcaaactacccgcaggaagacggcccgactcagggcggctcaaccatcgcggaaggtatcgccgtcacaaggctcggcgatcactgcctgaacgcctttcgcaacaagatctcgaagatcctcgttgtcagcgagcttcaggtcgaaagctccatcacgacgctggctgaaaaggccaagcaggtctgtgaaggtgcgggcgccacgggccttgctgcagttctggcctatccggagctgttcaagggacgccgcgttgccctgcccctgtctggcggcaacatcaacgcccgtatccttgccaacacaatcctgcgctcccttctccgggacggacggatcctgcggctgatcttccagatccccgaccgtccaggcatgctggcggatatttcggcccgcatcggcaattatggcggaaacatcatcgaagtctcccatcaccgcctgttcgcctccccgtccgttcagacggccgaactgctggtgatggtggaagcccgcgacaccgaacatgcccaccagatcgagaccgatctggcacggcattacatcgtccggcgcgactga

SEQ ID NO: 3122 - protein, 408 aa, Gluconobacter oxydans 621H
MSDVLTSTTPVVTIADIESAHERIASTVVRTPTIACPALSRLTGAEITLKLENLQAIGSFKERGAANKMALLTPEERARGVITVSAGNHAQGVARQASLLGIDATIVMPRFTPATKVAATQAWGANVVLAGDDFAQASETAAELQKQDGRVLVHPFNDPAVIAGQGTAALELLEDAPDIDTVVVPVGGGGLIGGFATVMAALRPDVEVIGVQVEAYASLSNYPQEDGPTQGGSTIAEGIAVTRLGDHCLNAFRNKISKILVVSELQVESSITTLAEKAKQVCEGAGATGLAAVLAYPELFKGRRVALPLSGGNINARILANTILRSLLRDGRILRLIFQIPDRPGMLADISARIGNYGGNIIEVSHHRLFASPSVQTAELLVMVEARDTEHAHQIETDLARHYIVRRD

SEQ ID NO: 3123 - DNA, 984 bp, Mesorhizobium loti MAFF303099
  CDS (1)..(984): transl_table=11
atgaccgccaccacccctcccggcatcgccgacatccgtgccgccgccgcccgcctctccggcctgatcgtcgaaacgccattgatcgaatcggccgagctgaacaagcgcttcggcggccgtatcctgttcaagccggagacgttgcagcgcaccggctcgttcaagttccgcggcgcctacaacaagctgtcgtcgctgagcgaggaagagcgcagccgtggcgtcgtcgccttctcctccggcaatcatgcgcaaggggttgccgcttcggccgccatgttcggcgtcaaggcggtcatcgccatgccggcggacgcgccggcgatgaagatcggcaatgtccgcaagatgggcgcggaggtggtgccgttcgaccgctttcgcgatgaccgcatgaccgtggttcgcccctatatcgacaagggcatggtgctggtgccgcccttcgacgatccggccatcattgccgggcaaggcacgatcggccttgaactgatgcggcagggcagggcgctcggcgtcagcctcgacaccgtcgtcatcccctgcgggggcggcggcctgtcgagcggcatttcggtggcggtcaaggatgcctcgccgggcacggcggtctgggcggtagagcccgagcatttcgacgacacgcgccgctcgctcgccgcaggcgcgcgggtttcgaacgagcccggccacagctcgatctgcgacgcgatcctgaccgccgagccgggcgccatcaccttcgaaatcaaccgcaggaacctcactggggccattgccgtctccgacaaggcgaccgcacaggcgatgcgcgatgccatggcctatctgaagctggtggtcgagccgggcggctgcgtggcgctggcggcgctgtcgtcgggcgagatcgaactgtccggcaaatgcgtcgccgtggtgctgtccggcggcaatgtcgatttcggcacctatgccgggatcatggcggccgcctga

SEQ ID NO: 3124 - protein, 327 aa, Mesorhizobium loti MAFF303099
MTATTPPGIADIRAAAARLSGLIVETPLIESAELNKRFGGRILFKPETLQRTGSFKFRGAYNKLSSLSEEERSRGVVAFSSGNHAQGVAASAAMFGVKAVIAMPADAPAMKIGNVRKMGAEVVPFDRFRDDRMTVVRPYIDKGMVLVPPFDDPAIIAGQGTIGLELMRQGRALGVSLDTVVIPCGGGGLSSGISVAVKDASPGTAVWAVEPEHFDDTRRSLAAGARVSNEPGHSSICDAILTAEPGAITFEINRRNLTGAIAVSDKATAQAMRDAMAYLKLVVEPGGCVALAALSSGEIELSGKCVAVVLSGGNVDFGTYAGIMAAA

SEQ ID NO: 3125 - DNA, 1059 bp, Mesorhizobium loti MAFF303099
  CDS (1)..(1059): transl_table=11
gtgtggcgacgagacgccgcgccccgaatttgggcagctgatgacgcttcctctgccgcgcgattgatgatcatgacgaccgtctcccttaacgatatccgcgccgcgcgtgagcgtattgccagcaaggtcgagtacacgccgactgttttatcctcgagcctttcggaacgtctcggtgtccccgtccatctcaagctcgagcatcgccagactaccggcagcttcaagctccgcggcgccacgaatgccgtctcttcgctgagcgcggaagaaaaggcaggcggtgtggtcgcggcctcgaccggcaaccatggccgggcgctggcacatgctgcgaagctcgaaggcatgcgcgcggtgatctgcatgtcgcggctggtgccccagaacaagctcgacgaaatccgccggctcggcgccgaggtccacatcgtcggcaacagccaggacgatgcccagcaggaggttgagcggctggtggcgcagcaggggctggtgatgctgccgcctttcgacaatcccgccatcatcgccgggcaaggcacgctcgggctggagatgatcgagcaggtcccggatgccgctctggtgcttgtgcaactctccggcggtggcctggcttccggcgtcgccacagccgtcaagggcatcaggcccgggacagaagtcatcggcgtttcgatggcgcggggtgctgcgatgaaggcgagcctcgatgccggccggcctgtcctggtggaggaactgccgacgttggcggactcgctgggtggcggcatcggcctcgacaacaggctgaccttcgccatgtgccgcgacctgctcgacgaaatcatcttgctcagcgaggacgagatcgccgcaggtatctgccatgcctatgcgcaggagcgcgagatcgtcgagggcgccggcgcggtcggcatcgcagcgcttctcgccggcaaggtcaaggcgaaagggccgatggtcgtacttctctccggccgcaacatcgacatgaatgcgcaccgccggatcatctgcggcgaggcaatcggggagcgcgccgcatga

SEQ ID NO: 3126 - protein, 352 aa, Mesorhizobium loti MAFF303099
MWRRDAAPRIWAADDASSAARLMIMTTVSLNDIRAARERIASKVEYTPTVLSSSLSERLGVPVHLKLEHRQTTGSFKLRGATNAVSSLSAEEKAGGVVAASTGNHGRALAHAAKLEGMRAVICMSRLVPQNKLDEIRRLGAEVHIVGNSQDDAQQEVERLVAQQGLVMLPPFDNPAIIAGQGTLGLEMIEQVPDAALVLVQLSGGGLASGVATAVKGIRPGTEVIGVSMARGAAMKASLDAGRPVLVEELPTLADSLGGGIGLDNRLTFAMCRDLLDEIILLSEDEIAAGICHAYAQEREIVEGAGAVGIAALLAGKVKAKGPMVVLLSGRNIDMNAHRRIICGEAIGERAA

SEQ ID NO: 3127 - DNA, 1005 bp, Mesorhizobium loti MAFF303099
  CDS (1)..(1005): transl_table=11
atgatggcagaccttctcgtcccctcgctggcccatctcaaacaggcctatgccgtcacctccagggcgacgcagatcacgccgctgctggaatcgaccgcactcgccagggagaccggtgctgcccgtgtcttcatcaagccggaatcgctgcaatgggccggatcgttcaagatccgcggcgcctattggcggttgaagcggctgtcggccgacgaagcgaggaaaggagtcgtcgcctactcctccggcaatttcgcgcaaggcctggcggcagccggccaagcgctcggcattcccgtcaccatcgtcatgccgatcgacgcacccgccgccaagcgtgacgcgacggcgggctatggcgcgcgtgtcgtgttgaccgaccatggcgagcgcgcgcgagaagaggttgccgctgccaaggcgcgcgagatcgccgagacggaagggctggccctgctgcatcccttcgacgatccggagatcgtcgccggccaggctggcgccgggctcgaagcgctcgaccagcttgaggccaaggacgccagcgccgacctgttgttctgctcggtcggcggcggcgggctgatcggcggcgtttcgctcgccttccactatctgtcgccggcgacggagatcatcggcgtcgagccggaaggcttcaatggcatgggctcgtcgctggcgcatggcagcatcgagaccatgccgatcgggccgaaatcgatttgcgacgggctgatgtcgcggcggccgggcgatgcgccgttcgcggcggtcaagaccgctggcgttcgcggaatcaccgtcgatgatcaatcggtgcggcgtgccatgcggatcgccttcgagcggatgaagctggtgctggagccgtccggggctgcgtcgctggcagcattgctcggtggcaaggtggatgtgactgataaaaccgtccttgttgtggctaccggcggcaatgtctcgctcgccgattttatggcgcatatgaaccatgcttga

SEQ ID NO: 3128 - protein, 334 aa, Mesorhizobium loti MAFF303099
MMADLLVPSLAHLKQAYAVTSRATQITPLLESTALARETGAARVFIKPESLQWAGSFKIRGAYWRLKRLSADEARKGVVAYSSGNFAQGLAAAGQALGIPVTIVMPIDAPAAKRDATAGYGARVVLTDHGERAREEVAAAKAREIAETEGLALLHPFDDPEIVAGQAGAGLEALDQLEAKDASADLLFCSVGGGGLIGGVSLAFHYLSPATEIIGVEPEGFNGMGSSLAHGSIETMPIGPKSICDGLMSRRPGDAPFAAVKTAGVRGITVDDQSVRRAMRIAFERMKLVLEPSGAASLAALLGGKVDVTDKTVLVVATGGNVSLADFMAHMNHA

SEQ ID NO: 3129 - DNA, 1221 bp, Thermoplasma volcanium GSS1
  CDS (1)..(1221): transl_table=11
atggaaaacctcgaaataccttcatttgatgagataatagaggcacagagatacctcgaaggcaaagtcaacaggactcctctcataagatcgactactatcggaaaagaatatggagcagatatttatttcaaacttgaaaattttcagaagacaggttcttttaagtcgaggggtgctatatttaggttttcaaagctatctgaagatgaaaaaaggcatggtgtaataactgccagtgcaggaaaccatgcacaaggggtagcctacgcagctatgataaacggcatagatgccaagatagttatgccagaatacacgataccgcaaaaagtaaacgcagttataagctacggggcccacgtcattttaaaaggatccgattatgatgaagcgcataggtacgcggacgagattgcaaaacaggagggtaggatcttcatagaggcattcaacgaccgttgggttatttcagggcaaggcacaataggcctggagataatggaggatttgccagatgttgatataatactcgttccggtaggtggcggcggcctcatctccggaatagcactggcagcaaagcatgcaagcaacaaggtcaaagtaataggaatagaatcagagctgtccgattctatgaaagcatcactccgggaaggaaagatagtggcacatactagcggagtcagcatatgcgacggcatctccgtcaagtatccaggagtcctcacatttgacatagcaagaaagtacgttgatgacatagtaacagtaactgaagaatatgtttctaaggctatctacaaactcttcgagagaaacaagatcgtagccgagccttcaggggcagtaggtctcgccgccataatggagggcaaggtagatgttaagggaaagaaggtcgctatagttgtttccggaggaaacataaacccgctgctcatgtcaaagataatatataaagaattggaaaaccttggccaacttgtacgcatagagtgtactataccagatcggcctgggaacctttacaggatagctatggctatagcagaaaacggcggtaatatataccatgccgaagtagataaccttaggaaggagacgccgccaggattccagtcagttacatttacggtaaatgtcagaggccaagatcacttggatcgtataataggaagcttgagggagatgggctatttatttaggataacatga

SEQ ID NO: 3130 - protein, 406 aa, Thermoplasma volcanium GSS1
MENLEIPSFDEIIEAQRYLEGKVNRTPLIRSTTIGKEYGADIYFKLENFQKTGSFKSRGAIFRFSKLSEDEKRHGVITASAGNHAQGVAYAAMINGIDAKIVMPEYTIPQKVNAVISYGAHVILKGSDYDEAHRYADEIAKQEGRIFIEAFNDRWVISGQGTIGLEIMEDLPDVDIILVPVGGGGLISGIALAAKHASNKVKVIGIESELSDSMKASLREGKIVAHTSGVSICDGISVKYPGVLTFDIARKYVDDIVTVTEEYVSKAIYKLFERNKIVAEPSGAVGLAAIMEGKVDVKGKKVAIVVSGGNINPLLMSKIIYKELENLGQLVRIECTIPDRPGNLYRIAMAIAENGGNIYHAEVDNLRKETPPGFQSVTFTVNVRGQDHLDRIIGSLREMGYLFRIT

SEQ ID NO: 3131 - DNA, 1206 bp, Thermotoga maritima MSB8
  CDS (1)..(1206): transl_table=11
gtgatcacactcgaggatataaaagaagcccaaagaacattgaagaatgtggtgcacaggacagctcttgcttacagctctgttctgagcgaggtaaccggtggagagatctacctgaagatggaaaatctccagaagaccggttcgttcaaaataaggggagcgtacaacaaaatagctcacctgagcgaagaagaaagaaagagaggagtcgttgccgcgtccgctggaaaccacgcgcagggagtggcacttgctgctcaaatcttcggtattcccgctaccattgtgatgccgaggtacgcccctctttctaaaatcaccaaaacgaggaatcttggagctcaggtgattcttgaggggaacattttcgacgaggcctacgaggcggctctcagaatacaggagaaaacaggtgcggtttttgtgcatcccttcaatgatcctcatgtcatcgccgggcagggaactatagggctggaaataatggaagatcttccggatgtggaagtggtggtggtgcccgttggtggaggtggtttgatttcgggagtatccgttgcgatcaaatcgatgaatcctgaggttaaagtaataggcgttcaaacggagaacatgccttccatgatcgcttcactgagaaggggcagggcagagcgggtcgaaggtaaacccacacttgccgatggaatagccgtgaaaaagcccggtgacctgaccttcgagctggtgaagaagtatgtcgatgagatggtcgcggtgaacgaagaagaaatagcggatgctatccttttccttcttgagcaggcaaaggtggttgctgaaggtgcaggagcggtgggtgtagccgctgttttgaacaaactggatgtgaagggaaagaaggtagcgatcgtgataagcggtggtaacatagatgtgaacatgatagacagaatcataaacaaagggctcgtgaagagcggaaggaaggtgttcatagaaacgttcgtgatggacagacccggtgccctgaaagagcttctcgggatagtggcggaactcggcgcaaacgttctttccgtttttcacaatcgctccgcaaaggaagttcccattggttttgccaaaatagagctcgagcttgaaacggtcgatgaaaaacacgtcgaagagatagagagggtgttgatcgcaaagggatacgaggtgaggatagtcgggtga

SEQ ID NO: 3132 - protein, 401 aa, Thermotoga maritima MSB8
MITLEDIKEAQRTLKNVVHRTALAYSSVLSEVTGGEIYLKMENLQKTGSFKIRGAYNKIAHLSEEERKRGVVAASAGNHAQGVALAAQIFGIPATIVMPRYAPLSKITKTRNLGAQVILEGNIFDEAYEAALRIQEKTGAVFVHPFNDPHVIAGQGTIGLEIMEDLPDVEVVVVPVGGGGLISGVSVAIKSMNPEVKVIGVQTENMPSMIASLRRGRAERVEGKPTLADGIAVKKPGDLTFELVKKYVDEMVAVNEEEIADAILFLLEQAKVVAEGAGAVGVAAVLNKLDVKGKKVAIVISGGNIDVNMIDRIINKGLVKSGRKVFIETFVMDRPGALKELLGIVAELGANVLSVFHNRSAKEVPIGFAKIELELETVDEKHVEEIERVLIAKGYEVRIVG

SEQ ID NO: 3133 - DNA, 1143 bp, Xylella fastidiosa 9a5c
  CDS (1)..(1143): transl_table=11
gtgcaatactgccgctggattttcttagcaggcacgagtcagcatggcatgccatcaggatgtgtgcagatcatcaggacgtatagctctatggatatacctgatgtaggtcacaccgttgtcaagcaacccaatgcaagtaacgtcaacaccgtgagtgtggccgatgtgttggctgcacaagcccgcttacgtcgttatctaatgcctaccccaattcactatgccgagcgtttcggagtgatgctgaagttggaaaatctgcaacgcaccggatcctataaagtgcgtggcgcgctgaacgcaatgttagttgcgctggaacgcggcgataaccgcccagtcatttgcgcatcagccggtaaccacgcccaaggcgtagcttggtcagcttaccggctgggtatacaagcaatcactgtcatgcctcacggtgctccggtcacgaaggttgcaggtgtctcacattggggggcgacggtacgccaacacggccaaagctatgacgaggcctatgcgttcgcatgtgagttggctgagcaaaacgattaccactttctatcagcattcgatgatccggatgtgattgccggtcagggaactgttggcatagagatcaccgcgcatgaaccggatgtagtcatcgtgccgatcggcggcggcggccttgcttcaggcattgctttggtgctgcgctcgcagggagtacgtgtcattggcgctcaggtcgagggcgtggatgcgatggcgcgtgcaatccgtggcgacacacgcgagatcgctccagtttcgaccttagctgacggggtgaaagtcaagattcctggtttcattacccgccgtctgtgtgccaacttgttagacgatgtagtgatcgtgcgtgaggctgaactgcgcgaaacattggtgcgtttagtattggaagaacacctgatcgccgaaggggcaggcgcactggcattggccgctggccgccgcgttgcaggtaagcgcaagtgtgcagtggtctccggaggtaatattgacgctgcagtactggccaaactgttgtccgaagtaagaccacggccaccccgcaaaccacgtaggcgtagtgcagatcgccccaacaattgcggcaatttaccgctcccttttaactga

SEQ ID NO: 3134 - protein, 380 aa, Xylella fastidiosa 9a5c
MQYCRWIFLAGTSQHGMPSGCVQIIRTYSSMDIPDVGHTVVKQPNASNVNTVSVADVLAAQARLRRYLMPTPIHYAERFGVMLKLENLQRTGSYKVRGALNAMLVALERGDNRPVICASAGNHAQGVAWSAYRLGIQAITVMPHGAPVTKVAGVSHWGATVRQHGQSYDEAYAFACELAEQNDYHFLSAFDDPDVIAGQGTVGIEITAHEPDVVIVPIGGGGLASGIALVLRSQGVRVIGAQVEGVDAMARAIRGDTREIAPVSTLADGVKVKIPGFITRRLCANLLDDVVIVREAELRETLVRLVLEEHLIAEGAGALALAAGRRVAGKRKCAVVSGGNIDAAVLAKLLSEVRPRPPRKPRRRSADRPNNCGNLPLPFN

SEQ ID NO: 3135 - DNA, 1218 bp, Sulfolobus solfataricus P2
  CDS (1)..(1218): transl_table=11
atgaattacttagaatattttgatagaattagactagcaaaagagaaaatagaaaaatatgtgcatattactccaatagattattctacaacgttttccagaattataaacgcaaaagtttatcttaagttggaaaatctacagaaaactggatcattcaaagttagaggtgcctttaataagttattatctttaaaggaggaagaaaaaaagaatggcgttattgcagtttcagcaggtaatcatgctcaaggagttgcttatgcagcctccacgttaaatatcaaatcgactatagtgatgccagaaacagctccagcttccaagtatttagctacaaaatcctatggggcagaagtagttctttatggtaagtacttgcatgagagtatgaagaaagcggaagaattgattcaaaatactggtttaatatttgttcatccttatagtgatttagatgtgataacgggtcaaggtaccataggattagaattgtatgatatcgaaccagattacgtaattattccaatagggggtggaggattgatttctggtataagtatagctttaaagtatagattcccaaacgtcaagataataggcgttcagtcttcttcttctccttcaatgaaggtttctaaggatcttgggaggcttgtagaaatagagcctagttattccatagctgatggcatattggttaagtctccttctgaattaacctttagtataattaatgagttagtagatgatatagtattagtggatgatgaagaaatagctgaggcaatagttttactacttgaaagaagtaaaacgctagcagaaggagcaggagctgcagcattagcgtcactaatttcagggaaggttaaagtaaatggaatagacaaaaaagtaatttcattagtaagtgggggaaatattgacttatcattattgtctactctaacagagaagtttttatatagacaaaaaagggtagtcaaagtgagggtaatagttccagataagccaggacagttaaataaagtattaagctatgtagttaagatcagaggtaatataatagatattgttcatgataggcacagtagtgatgtattgcctggatacactaaaatatatataactttcgagcttcagtcttcagaggctattaccttacttctgacaaatctggcaaacgagggaatagacgtgaaaattgtagaatag

SEQ ID NO: 3136 - protein, 405 aa, Sulfolobus solfataricus P2
MNYLEYFDRIRLAKEKIEKYVHITPIDYSTTFSRIINAKVYLKLENLQKTGSFKVRGAFNKLLSLKEEEKKNGVIAVSAGNHAQGVAYAASTLNIKSTIVMPETAPASKYLATKSYGAEVVLYGKYLHESMKKAEELIQNTGLIFVHPYSDLDVITGQGTIGLELYDIEPDYVIIPIGGGGLISGISIALKYRFPNVKIIGVQSSSSPSMKVSKDLGRLVEIEPSYSIADGILVKSPSELTFSIINELVDDIVLVDDEEIAEAIVLLLERSKTLAEGAGAAALASLISGKVKVNGIDKKVISLVSGGNIDLSLLSTLTEKFLYRQKRVVKVRVIVPDKPGQLNKVLSYVVKIRGNIIDIVHDRHSSDVLPGYTKIYITFELQSSEAITLLLTNLANEGIDVKIVE

SEQ ID NO: 3137 - DNA, 915 bp, Agrobacterium tumefaciens str. C58
  CDS (1)..(915): transl_table=11
gtggagcgcacgccgctggttcgctcggagtttctctccgaacgctgcggtcatcctgttcatctcaaacttgaaacccttcagcctatcggcgccttcaaactgcgcggcgcgatgaacgcgatcctctcgcttgacgatgcggtgcgacggcgtggcctagtcaccgcctcgacgggcaaccatggtcgggccgttgcttacgccgccgccaaactcggcattcccgccacgatctgcatgtcggcgctggtgccggcaaacaaggttgaggcgatccgcatgcttggcgcggaaatccggattgtcggcagatcacaggatgatgcgcaggaggaagtggagcgcctgacaaaaaaccgaggcctgaccgcgatcccacctttcgatcatgctgacgtcgtggccggccagggcactatcggcctcgaggtcgttgaagacatgcctgaactggcgacaattctcgttcctctatcgggcggtggccttgcgggcggtatcgccgttgcggtgaaggcgctgaagccaagggcgcgggttatcggcatttccatggaacgaggtgcggccatgcatgcgtcagtgaaagccggccgccccgtctcggtttgcgaggaagaaacgctggcggattcgcttggcggcgggattggactggcaaaccgcgtgacctttgcactttgcaagacacttctcgatgagatcgtgctggtctccgaagatgaaatcgcgaccggcatctgccatgcatcccgcgaggaagacctgagagtggaaggcgcgggcgccgttggcttcgcagcaatcctcgccggcaagatcgcggtgagcggccctgccgccatcatcgtatcgggcgggaatatcgatccggcggtccacaagacgatcatcgacgggggagtcgcatga

SEQ ID NO: 3138 - protein, 304 aa, Agrobacterium tumefaciens str. C58
MERTPLVRSEFLSERCGHPVHLKLETLQPIGAFKLRGAMNAILSLDDAVRRRGLVTASTGNHGRAVAYAAAKLGIPATICMSALVPANKVEAIRMLGAEIRIVGRSQDDAQEEVERLTKNRGLTAIPPFDHADVVAGQGTIGLEVVEDMPELATILVPLSGGGLAGGIAVAVKALKPRARVIGISMERGAAMHASVKAGRPVSVCEEETLADSLGGGIGLANRVTFALCKTLLDEIVLVSEDEIATGICHASREEDLRVEGAGAVGFAAILAGKIAVSGPAAIIVSGGNIDPAVHKTIIDGGVA

SEQ ID NO: 3139 - DNA, 1041 bp, Staphylococcus aureus subsp. aureus Mu50
  CDS (1)..(1041): transl_table=11
atgacaaccaacacagttacattacaaacagcacatattgtaagtttaggagatatcgaagaagctaaagcaagcattaaaccatttattcgtcgaacaccactaattaaatctatgtatttaagtcaaaatatcactaaaggtaacgtatatttaaaacttgaaaatatgcagtttacaggttcatttaaatttagaggtgctagcaataaaattaatcatttgtcagatgaacaaaaagctaaaggtattattggcgcatcagccggaaatcatgcacaaggtgtagctttgacagcaaaactattaggtattgatgcaacgattgtgatgccagaaacagcaccaattgctaaacagaatgctaccaaaggatatggtgcaaaagtcattttaaaaggtaaaaactttaatgaaactagactttatatggaagaattagcgaaagaaaatggtatgacaattgttcatccatatgatgataagtttgtcatggctggtcaaggaacaataggattagaaattttagatgatatatggaatgttaatacggtcattgttccagttggtggaggtggcctaattgcaggtattgccaccgctttaaaatcattcaacccatcaattcatataatcggcgttcaagctgaaaatgtgcatggcatggcagagtcattctataagagagctttaactgaacatcgtgaagatagcacaattgcagatggttgtgatgtaaaagtaccaggtgaaaaaacatacgaagtagtaaaacatttagtagatgaatttattcttgtatcagaagaggaaatagaacatgcaatgcaagatttaatgcaacgtgccaaaatcattacagaaggtgcaggagctttacctacagcagctattttaagtgggaaaattgataaaaaatggctagagggtaaaaatgtcgttgcattagtttcaggaggaaacgttgacttaactagagtttctggtgtcattgaacatggcttaaatatcgcggatacaagtaagggtgtggtaggttaa

SEQ ID NO: 3140 - protein, 346 aa, Staphylococcus aureus subsp. aureus Mu50
MTTNTVTLQTAHIVSLGDIEEAKASIKPFIRRTPLIKSMYLSQNITKGNVYLKLENMQFTGSFKFRGASNKINHLSDEQKAKGIIGASAGNHAQGVALTAKLLGIDATIVMPETAPIAKQNATKGYGAKVILKGKNFNETRLYMEELAKENGMTIVHPYDDKFVMAGQGTIGLEILDDIWNVNTVIVPVGGGGLIAGIATALKSFNPSIHIIGVQAENVHGMAESFYKRALTEHREDSTIADGCDVKVPGEKTYEVVKHLVDEFILVSEEEIEHAMQDLMQRAKIITEGAGALPTAAILSGKIDKKWLEGKNVVALVSGGNVDLTRVSGVIEHGLNIADTSKGVVG

SEQ ID NO: 3141 - DNA, 1215 bp, Sulfolobus tokodaii str. 7
  CDS (1)..(1215): transl_table=11
atgtcttatacaaaatattttgatgaaatagtaaaaattcaagatagaattaaacaatatattcatgagacgcctattgattactcaaaaaccttttctgatatgattggagctcaaatatatttaaagcttgaaaatttgcagaaaacaggttcttttaaggtaagaggagctttttcaaaattgacaagcctagccgaagaagaaaggaaaaaaggtgttatagcggtttccgcgggtaatcatgctcaaggtgttgcatatgctgcaaaagttttaggaattaaagcaactatagtaatgccagaaactgctccaatctcaaaatatcaagctacaaagtcatacggtgctcaagttattttgtatgggaaatttcttcatgagagtatgaaaaaagctgaggagattataagagaagaaggaagtattcttgttcatccttacggagatcttgatgtaattttgggtcaaggtacattaggactagaacttttgccatataatccagatattgttgttgttcctataggagggggaggactaatatcaggaatatctatagcattaaaagcaaaaaatccaaaaaccaaaataataggtgtacaatcttcagcttctccttcattaaaggtctcaaaagatcttcataggctagtagagattgagccctctttttcgatagcagatggaattctagtaaaatctccctctgaaataacgtttagcataatagatgaattagtggatgatattgttcttgttgatgatgaagaaatagcaaatgctatagtatatttattagaaagaaataaaacattagtagaaggagcagctgctgcttcattagcagcacttttatctggaaagattaaagttgcttataatcataaagctattccggttctaagtgggggcaatatagatctttcaatgttatccagaattatagataagatgcttttcaagaataaacgaatagtcaaagtgaaggtaatagtaccagataaacctggatatcttaataaagtattaagtagagtagcacaaataagagggaacgttatcgatgtagttcatgatagaacaagcagtgatgttaaacctggttatactaaaatttatgtaatgtttgaagtacctagtggtgatgctctttcagatttcatgtacaacttagctttagatggtattgaggctaaattagtagaatag

SEQ ID NO: 3142 - protein, 404 aa, Sulfolobus tokodaii str. 7
MSYTKYFDEIVKIQDRIKQYIHETPIDYSKTFSDMIGAQIYLKLENLQKTGSFKVRGAFSKLTSLAEEERKKGVIAVSAGNHAQGVAYAAKVLGIKATIVMPETAPISKYQATKSYGAQVILYGKFLHESMKKAEEIIREEGSILVHPYGDLDVILGQGTLGLELLPYNPDIVVVPIGGGGLISGISIALKAKNPKTKIIGVQSSASPSLKVSKDLHRLVEIEPSFSIADGILVKSPSEITFSIIDELVDDIVLVDDEEIANAIVYLLERNKTLVEGAAAASLAALLSGKIKVAYNHKAIPVLSGGNIDLSMLSRIIDKMLFKNKRIVKVKVIVPDKPGYLNKVLSRVAQIRGNVIDVVHDRTSSDVKPGYTKIYVMFEVPSGDALSDFMYNLALDGIEAKLVE

SEQ ID NO: 3143 - DNA, 1221 bp, Thermoplasma acidophilum DSM 1728
  CDS (1)..(1221): transl_table=11
atggacagcgaagcgataccttcatacgaggatatcctttctgcaaaggcctatttggagggccgcataaacaggacgccgctgataaagtccacgacgttcggaaacgagtacggttccgagatgtacttcaagcttgagaatttccagaagacagggtcatttaagtccagaggcgctcttttcaagttctccaagctgagcgaagatgacagaaggagaggcgttttaacggccagcgcgggaaaccacgcgcagggtgtggcgtatgctgcaaaggtcaacggcataaacgcgaagatcgtaatgccggagtacaccatacctcagaaggtaaacgcggtcgccggctatggcgccgaggtgatacttcatggcttcgactacgatgaggcgcacaggtacgctgacgatctcgcaaggaaggaaaaccgggttttcatagaggcattcaatgacagatgggtgatatccggccagggaacgatagggctggagataatggaggacaggcctgacatcgacaccataattgttcctgttggcggcggtggcctcatctctggcatagcactggcggccaagcaccacaatccgcatgtgcgcataataggcatagagtcagaactgtccgattccatgaaggcctccttaagggaggggaagatcgtagcgcatacaagcggtgttagcatatgcgatggcatatctgtcaaatatcctggcgatctgaccttcaacatagcaaaagattacgtcgatgatatagtgacggtgaccgaagaatctgtttccaaagccatatacaggctcttcgagagaatgaagatagttgcggagccttctggagcagttggcctggctgcgataatggagggcaaagtcgatgtaaagggaaggaaggttgctatcgtcgtatcaggcggcaacataaacccgctgctgatgtcaaagataatatacaaggagctggagaaccttgggcagctggtgcgcatagaatgcataataccggacaggccaggaaatctttacaggattgcggaggccatagcaaagaacggtggaaatatataccatgcggaggtcgacaatctcaggaaggagacacctccaggcttccagagcgtgatattcagcgtcaacgttagggggcaggatcatctggacaggatactatcaacgctcagggagatgggttacatcttcaaagtaacatga

SEQ ID NO: 3144 - protein, 406 aa, Thermoplasma acidophilum DSM 1728
MDSEAIPSYEDILSAKAYLEGRINRTPLIKSTTFGNEYGSEMYFKLENFQKTGSFKSRGALFKFSKLSEDDRRRGVLTASAGNHAQGVAYAAKVNGINAKIVMPEYTIPQKVNAVAGYGAEVILHGFDYDEAHRYADDLARKENRVFIEAFNDRWVISGQGTIGLEIMEDRPDIDTIIVPVGGGGLISGIALAAKHHNPHVRIIGIESELSDSMKASLREGKIVAHTSGVSICDGISVKYPGDLTFNIAKDYVDDIVTVTEESVSKAIYRLFERMKIVAEPSGAVGLAAIMEGKVDVKGRKVAIVVSGGNINPLLMSKIIYKELENLGQLVRIECIIPDRPGNLYRIAEAIAKNGGNIYHAEVDNLRKETPPGFQSVIFSVNVRGQDHLDRILSTLREMGYIFKVT

SEQ ID NO: 3145 - DNA, 978 bp, Caulobacter crescentus CB15
  CDS (1)..(978): transl_table=11
atgaccgtctcgctcgccgacatccaagccgccgccgtacgcctgaagggctcggccgtcgagacgccgctgatcgagagccccgccttgaacgacaggctgggcgggcggatcttcctcaagcccgagaccttgcaacgtgccggcgccttcaagtttcgcggcgcctacaaccgtctttctcagctcagcgatgaggaaaaggcgcgcggcgtcgtggccttctcgtccggcaatcacgcccaaggggtggcgctggcggccaggctgctgggcgtgccggcgctgattgtgatgccctccgattcgcccagcgtgaaggtcgaaggcacgcgcgggtttggcgcggacatccgcttctacgaccgcttcaccgaggaccgcgtcgccatcgccgaccagatcgcggccgagcgcggctgcgtggtcgtgccctcgtatgacgacccgcacatcatcgccggccagggcacggtgggtctggagatcgtcgcccaggccgccgcgcaaggcgcgacgctggaccgcctgatctgctgcgtcggcggcggcggtctgatcgccggaacctcgacggcggtgaaggccctctcgccggccaccgagatctggggcgtggagcccgccggcttcgacgagacgcggcgctcgctggaaagcggccggcgcgagaccatcgacaaggacgcccgctcgatctgcgacgccctgctgaccccgatccccggcgacctgacctggccgatcaaccagaaaaacctctcaggcgtggtcgcggtgaccgacgccgaggtggccgaggcgatgcgctatgcgttctcgaccttgaaactggtggtggagcccggcggctgcgtggccctgacggcggcgctgacaggcaaggtcgacgtcgccggcaagaccgtggcgatcgtgctgtcgggcggcaatgtcgatccggggttgttcgcgcaggtcttgggcggtcaaatctga

SEQ ID NO: 3146 - protein, 325 aa, Caulobacter crescentus CB15
MTVSLADIQAAAVRLKGSAVETPLIESPALNDRLGGRIFLKPETLQRAGAFKFRGAYNRLSQLSDEEKARGVVAFSSGNHAQGVALAARLLGVPALIVMPSDSPSVKVEGTRGFGADIRFYDRFTEDRVAIADQIAAERGCVVVPSYDDPHIIAGQGTVGLEIVAQAAAQGATLDRLICCVGGGGLIAGTSTAVKALSPATEIWGVEPAGFDETRRSLESGRRETIDKDARSICDALLTPIPGDLTWPINQKNLSGVVAVTDAEVAEAMRYAFSTLKLVVEPGGCVALTAALTGKVDVAGKTVAIVLSGGNVDPGLFAQVLGGQI

SEQ ID NO: 3147 - DNA, 1203 bp, Caulobacter crescentus CB15
  CDS (1)..(1203): transl_table=11
atgaccctcgacctcgccgctatccaggccgccgccggccgtctccagggccagatcgagcgcacgccgtgccgccactccaagaccctctcgaagatcaccggcgccgaggtgtgggtgaagttcgagaacctgcagttcaccgccgcctacaaggagcgcggcgcgctcaacaagctgatgctcctctcggagaccgagaagcagcgcggcgtcatcgccgccagcgccggcaaccacgcccagggcttggcctatcacggcgcgcgcctcggcgtgccggtcaccatcgtcatgcccaagaccacgcctttcgtgaaggtgcagcacacccgcgacttcggcgcgaccgtggtcatcgagggcgagacctatgacgacgccaacgcccatgcccgcaagctgcgcgacgagcagggcctgaccttcgtccacccgttcgacgactacgacatcatggccggacagggcaccatcgccctggaaatgctggaagacgcgcccgatctggagatcctgcccgtgccgatcggcggcggcggcctgatcagcggcgtggcgacggcggccaaggcgctgaagccggatatccgcatcatcggctgcgagccggccatgtatccgtccttcaccgccaagatgcgcggtgtcgccgcccactgcggcggccagaccatcgccgaaggggtcgcggtcaagcaggtcggcgagctgacctatggcgtcgttcgcccgttgctggacgacgtgctgctgctggaagagccctatctggagcaggccgtctcgctctattgcaatgtcgagaagaccatcgccgagggcgcgggcgcagcctcgctggccgctttgctggcctatcccgaacgcttccggggcaagaagtgcggcctgatcctgtgcggcggcaatatcgacacccgcctcttggcctcggtgctgacccgcgaactggtgcgcgcccagcgcctggccagcttgcgaatcatcggcgacgaccgtccgggcctgttgtcgaccgtcgcctcggtcatcggcgccatgggcgccaacatcatcgaagtgaatcacaaccgcctggccctggacgtgccggccaagggcgcggagttcgacatcaccatcgaaacccgcgacgcccagcacacccaggaggtcatggaggccctgcgcgagagcggctacccgccgcgggtggtttga

SEQ ID NO: 3148 - protein, 400 aa, Caulobacter crescentus CB15
MTLDLAAIQAAAGRLQGQIERTPCRHSKTLSKITGAEVWVKFENLQFTAAYKERGALNKLMLLSETEKQRGVIAASAGNHAQGLAYHGARLGVPVTIVMPKTTPFVKVQHTRDFGATVVIEGETYDDANAHARKLRDEQGLTFVHPFDDYDIMAGQGTIALEMLEDAPDLEILPVPIGGGGLISGVATAAKALKPDIRIIGCEPAMYPSFTAKMRGVAAHCGGQTIAEGVAVKQVGELTYGVVRPLLDDVLLLEEPYLEQAVSLYCNVEKTIAEGAGAASLAALLAYPERFRGKKCGLILCGGNIDTRLLASVLTRELVRAQRLASLRIIGDDRPGLLSTVASVIGAMGANIIEVNHNRLALDVPAKGAEFDITIETRDAQHTQEVMEALRESGYPPRVV

SEQ ID NO: 3149 - DNA, 972 bp, Sinorhizobium meliloti 1021
  CDS (1)..(972)
atgcgcaattaccccaccattcaggacatccgtgaagcccgggaacggctgaaaccgcacgtcaggcacacgccgctcttgcgtgcggagaaaatcgagaaggccgctggctgtcagctttatctcaaacccgaaaccctgcagatcactggcgccttcaagatccgcggcgccctgaacaaggctctctcgctctcgagagaagagatcgcaaacggcattatcgcgacgtcgtcgggcaaccatgcccaggggctttcttacgcggccaagatgctcggcgtaaaagtgatattggtacttccggtcaccacacccaaaatcaagattgaaaatacaaaagccctgggtgcggaagtcattctttttgatggtgataatgctgctagatggaaaaaggtctacgaaatcgctgaaggaaacaagtatgcggttattcacggcttcgaggaccccgttgtaatggctggccagggaacgatcgggtgcgagatactcgaagacctggacgatgtagatacggtcatcgttcccttaggcggcggaggcctgatctcgggaatcgctaccgccataaaagaaacgaaaccatcggtgcgcgttatcggggcagagcctgccttgacaccgaagtattttcacagccgggtaaacaaggagcgcacatcgcttcccttgaagaacaccattgcggatggcttgaggataagcgttccgggtcaaaacccgtatccgattatcgaaaagtatgtggacgagattgttcttgttgaagacgagcacatcatcgccgggatgcgtgctcttgccaaggatgcgaaattgatcgctgaaccagccgcctcgattggcgtcggagcactgttggcgggcatcatagacgtcaagctggatgaaaaagtctgtgcggtgttgtctggcgggaactgggatctacgcgaccttgccgcgatatacaatgtagcggggtaa

SEQ ID NO: 3150 - protein, 323 aa, Sinorhizobium meliloti 1021
MRNYPTIQDIREARERLKPHVRHTPLLRAEKIEKAAGCQLYLKPETLQITGAFKIRGALNKALSLSREEIANGIIATSSGNHAQGLSYAAKMLGVKVILVLPVTTPKIKIENTKALGAEVILFDGDNAARWKKVYEIAEGNKYAVIHGFEDPVVMAGQGTIGCEILEDLDDVDTVIVPLGGGGLISGIATAIKETKPSVRVIGAEPALTPKYFHSRVNKERTSLPLKNTIADGLRISVPGQNPYPIIEKYVDEIVLVEDEHIIAGMRALAKDAKLIAEPAASIGVGALLAGIIDVKLDEKVCAVLSGGNWDLRDLAAIYNVAG

SEQ ID NO: 3151 - DNA, 1005 bp, Sinorhizobium meliloti 1021
  CDS (1)..(1005): transl_table=11
gtgagcgtttctctccccgtgacgatcgacgacatcgaggtggcggcacggcgcatttccggccgtgtacttacgacgccgctggcaatgtcgggctcgttgagcgagctctgcggcgtgccggtcggcttaaagctcgagcaccaccagacgaccggtagcttcaagctgcgcggcgcgaccaatgcagtgctttcgctttctgccggcgaccgggcgctcggcgtaatcgcggcctcgaccggcaatcatggccgggcacttgcccatgcggcaaaggcggaaggctcggtcgctacgatctgcatgtcgcacctggtgcccgtgaacaaggtctccgaaatcagacgcctcggcgccaatgtgcggattgtcggcaattcccaggacgaggcgcaggaagaagtcgaaaggctcgttgcggaaaatggtctcgtgatggtgccgcccttcgaccatcgggcgatcgtcgccgggcaggggacgctcggactcgaggtcgtggcgcagatgccggacgttgccatggtgcttgtaccggtgtcgggtggtggactggcagccggagtggcggcagcggtcaaggcgcgcagaccggcgacgcgtgtcataggcctgacgatggagcgcggtgcggcgatgaaggcgagcttcgccgccggcggacccgcgctcgtcgatgaacaaccgagccttgcggactcgctcggcggcggcatcggcctcgacaatcgcgtcacattccgcatgtgccgggagctcctcgacgacataatcctcctgacggaagccgagatcgccgccggcatgcgccacgcctatgccgaggagcgcgagatcgtcgaaggggcgggggccgtcggcatttcggcgcttctcgccggcaagatcaaggacatcgacggccccatcgcggttattatctcggggcgcaacgtcgacatggacctgcacctgcgcgtgatgaacggcgaaacggacccattccgcgaggaggcggcatga

SEQ ID NO: 3152 - protein, 334 aa, Sinorhizobium meliloti 1021
MSVSLPVTIDDIEVAARRISGRVLTTPLAMSGSLSELCGVPVGLKLEHHQTTGSFKLRGATNAVLSLSAGDRALGVIAASTGNHGRALAHAAKAEGSVATICMSHLVPVNKVSEIRRLGANVRIVGNSQDEAQEEVERLVAENGLVMVPPFDHRAIVAGQGTLGLEVVAQMPDVAMVLVPVSGGGLAAGVAAAVKARRPATRVIGLTMERGAAMKASFAAGGPALVDEQPSLADSLGGGIGLDNRVTFRMCRELLDDIILLTEAEIAAGMRHAYAEEREIVEGAGAVGISALLAGKIKDIDGPIAVIISGRNVDMDLHLRVMNGETDPFREEAA

SEQ ID NO: 3153 - DNA, 972 bp, Ralstonia solanacearum GMI1000
  CDS (1)..(972): transl_table=11
atgaccacgctgcccatcacctacgacgatgtcgtcgccgcccacgcccgcctgcagggccaggtccaccggacgcccgtcctcacgtcgaccacggcgaatgcgctgaccggcgccgagctgttcttcaagtgcgagaacttccagcgcatgggcgccttcaagttccgcggcgcgtacaacgcgctgtcgcagttcacacccgagcagcgcaaggccggcgtcatcaccttctcgtcgggcaatcatgcgcaggcgatcgcgctgtcggcgcggctgctgggcatgcgcgcggtgatcgtgatgcccaaggacgcgccgacgatcaaggtcgaggccacgcgcggctacggcggcgaggtggtcttctacgaccgctataccgaagaccgcgaagccatcggccgccggctggccgagcagcacggcctgacactgatcccgccctacgatcatccgcacgtgatggccgggcagggcacggccgccaaggaactgatcgaagagaccggaccgctcgacctgctgctcgtctgcctgggcggcggcggtctgctgtcgggctgcgccacggcggcgcgcgcgctgagcccggcctgccggatcatcggcgtggagcccgaggccggcaacgacggccagcagagcctgcgcaagggcgagatcgtccacatcgacacgcccgccaccatcgccgacggggcgcagacgcagcacctgggccactacacttttgcggtgatccgtgcgctggtcgacgacatcgcgacggtgagcgatgccgatctggtcgacaccatgcgcttcttcgccggccgcatgaagatcgtggtggagccgaccggctgcctggccgcggcggccgccctgcggcagcgggtggaggtgcgcggcaagcgcgtcggcgtgatcatttcgggcggcaatgtggacctgcagcactttgcccggctcgtgcaggcggacgcatga

SEQ ID NO: 3154 - protein, 323 aa, Ralstonia solanacearum GMI1000
MTTLPITYDDVVAAHARLQGQVHRTPVLTSTTANALTGAELFFKCENFQRMGAFKFRGAYNALSQFTPEQRKAGVITFSSGNHAQAIALSARLLGMRAVIVMPKDAPTIKVEATRGYGGEVVFYDRYTEDREAIGRRLAEQHGLTLIPPYDHPHVMAGQGTAAKELIEETGPLDLLLVCLGGGGLLSGCATAARALSPACRIIGVEPEAGNDGQQSLRKGEIVHIDTPATIADGAQTQHLGHYTFAVIRALVDDIATVSDADLVDTMRFFAGRMKIVVEPTGCLAAAAALRQRVEVRGKRVGVIISGGNVDLQHFARLVQADA

SEQ ID NO: 3155 - DNA, 975 bp, Agrobacterium tumefaciens str. C58
  CDS (1)..(975): transl_table=11
atgacagatatttcgatgatcgaggcggcgcgtgagcgcatcggcaaccatgcggtgcgaacaccgctgctcacctcgccttttctggacgagatcgccgggcgaaagctgttcgttaaggcggaatgcctgcaaaggacgggatccttcaagtttcgcggcggctggtcggcggtatccggcctgccggcggatgtgcgcgccaagggtgtgatcgctttttcctccggcaaccatgcgcagggcgtggcgctcgcggcccgcctgcatggcattcccgccgtcatcatcatgccttcggatgcgccgaagatcaaaatcgacaatacccgcgcctatggcgccgaggtggtgctttacgaccgggcgaatgaagaccgtgacgccattggcaaccggttgtcgagcgagcgcggtttgaccctgatcaggccttacgatgaaccgctggtgattgcggggcaggggaccgctgggctggaaatcgctgagcaaggcgccgaactcggtatcggtgctgccgaggttctggtgccttgcggtggcggcggcctcacctccggcatctctcttgcactcgatgcgaaagcgcgaaattataaggtcaggacggcagaaccggagcgtttcgatgacgtggcgcgctcccttgcggcgggcaagatcgagcggaatgcgacgacatcgggttcgatctgtgatgcaatcgtcacgccgcagcctggcaatatcacctttcccatcatggcagggctttgcgggaaaggtatcgccgtcagcgaggaggaagcgctgcgggccatggttctcgccttcaaccggctgaaggtcgttatcgagccgggtggtgctgttgcgcttgccgcagcgctttttcatggcaaggaactggaaagcgaaaccgtgattgcggttgcctccggcggcaatgtcgatcccgggatcatggccgacgctctgtcacgcttcggttga

SEQ ID NO: 3156 - protein, 324 aa, Agrobacterium tumefaciens str. C58
MTDISMIEAARERIGNHAVRTPLLTSPFLDEIAGRKLFVKAECLQRTGSFKFRGGWSAVSGLPADVRAKGVIAFSSGNHAQGVALAARLHGIPAVIIMPSDAPKIKIDNTRAYGAEVVLYDRANEDRDAIGNRLSSERGLTLIRPYDEPLVIAGQGTAGLEIAEQGAELGIGAAEVLVPCGGGGLTSGISLALDAKARNYKVRTAEPERFDDVARSLAAGKIERNATTSGSICDAIVTPQPGNITFPIMAGLCGKGIAVSEEEALRAMVLAFNRLKVVIEPGGAVALAAALFHGKELESETVIAVASGGNVDPGIMADALSRFG

SEQ ID NO: 3157 - DNA, 1011 bp, Agrobacterium tumefaciens str. C58
  CDS (1)..(1011): transl_table=11
atgaagagcgaaaacctgtccatatccgccgataaaaaccagcttccggtctcgctggccgcgatagagcgggcggcaacgcggctttcgggacaggtggagcgcacgccgctggttcgctcggagtttctctccgaacgctgcggtcatcctgttcatctcaaacttgaaacccttcagcctatcggcgccttcaaactgcgcggcgcgatgaacgcgatcctctcgcttgacgatgcggtgcgacggcgtggcctagtcaccgcctcgacgggcaaccatggtcgggccgttgcttacgccgccgccaaactcggcattcccgccacgatctgcatgtcggcgctggtgccggcaaacaaggttgaggcgatccgcatgcttggcgcggaaatccggattgtcggcagatcacaggatgatgcgcaggaggaagtggagcgcctgacaaaaaaccgaggcctgaccgcgatcccacctttcgatcatgctgacgtcgtggccggccagggcactatcggcctcgaggtcgttgaagacatgcctgaactggcgacaattctcgttcctctatcgggcggtggccttgcgggcggtatcgccgttgcggtgaaggcgctgaagccaagggcgcgggttatcggcatttccatggaacgaggtgcggccatgcatgcgtcagtgaaagccggccgccccgtctcggtttgcgaggaagaaacgctggcggattcgcttggcggcgggattggactggcaaaccgcgtgacctttgcactttgcaagacacttctcgatgagatcgtgctggtctccgaagatgaaatcgcgaccggcatctgccatgcatcccgcgaggaagacctgagagtggaaggcgcgggcgccgttggcttcgcagcaatcctcgccggcaagatcgcggtgagcggccctgccgccatcatcgtatcgggcgggaatatcgatccggcggtccacaagacgatcatcgacgggggagtcgcatga

SEQ ID NO: 3158 - protein, 336 aa, Agrobacterium tumefaciens str. C58
MKSENLSISADKNQLPVSLAAIERAATRLSGQVERTPLVRSEFLSERCGHPVHLKLETLQPIGAFKLRGAMNAILSLDDAVRRRGLVTASTGNHGRAVAYAAAKLGIPATICMSALVPANKVEAIRMLGAEIRIVGRSQDDAQEEVERLTKNRGLTAIPPFDHADVVAGQGTIGLEVVEDMPELATILVPLSGGGLAGGIAVAVKALKPRARVIGISMERGAAMHASVKAGRPVSVCEEETLADSLGGGIGLANRVTFALCKTLLDEIVLVSEDEIATGICHASREEDLRVEGAGAVGFAAILAGKIAVSGPAAIIVSGGNIDPAVHKTIIDGGVA

SEQ ID NO: 3159 - DNA, 1212 bp, Pyrobaculum aerophilum str. IM2
  CDS (1)..(1212): transl_table=11
atgatcctcctggaggaggctgcgtcggtaataagagaaaaacagcgggaatcaaaaatccataggacgccgactttgaggtcagagtctctgactagaataacaggcggggaggtgttcctcaagttggaatcgcttcaaaagacaggcagtttcaagatcaggggggcatattttgccatgtataaatacataaaggagggttatagggagtttataaccgcctcgtcgggtaatcacgcgcagggagttgcctatgcggcacaattacacggagtaaaggccactgttgtaatgcctgaaactacgccttggctcaaggttaaaaagacccaggattacggcgccaacgttatattatacggcgagagttattacgaggcggagaaaaaagccatggaattagtacgcggaggagttaagttcctccacgcgtataacgactggtacgtcatctcgggacaagccactttaggccttgagattgtagaggatgtcggtgacgtagacgtagtagttgtgccaataggcggcggggggcttatctccggcgttgcatatgccgtgaagaagagaaggcctggggcaaaggtaataggggttcaagccagcggagcgccggcggtgtacttgtctttaaaagaggggcggcccattgtgattgagaaagtagacactattgccgacggtatcgctattaaaagccccggcgacattacgttgaaattaatacaagagtacgtagacgacgtggtgttagtagacgacaatgaaattgtagatgccatttacctcctccttgaaaggacaagagtagtggctgagggcgctggggctgttgcagtggccgcgttaatgtcggggaaaattaacgtaagtggtaaaaaagtagtggcggttgtctccggcggtaatatagacgcgcctatttttatgcgcgttctcatgaaggcaatggcgagacagaggcgggtgattaaattagtcggcgaagtgcctgacaagcctggaactcttgcgaaggcctcttctttcctggcctcacacaatgtgaatatcctagaggttttccacgagcgctacgacccggaacaacggcctaattatgtaagactcatatttgtagtggaaattccaggcacgttagacgtatcaaagctcttagacgaactggaaaaaaacggcttctttttcagagtcgcctcgcagtaa

SEQ ID NO: 3160 - protein, 403 aa, Pyrobaculum aerophilum str. IM2
MILLEEAASVIREKQRESKIHRTPTLRSESLTRITGGEVFLKLESLQKTGSFKIRGAYFAMYKYIKEGYREFITASSGNHAQGVAYAAQLHGVKATVVMPETTPWLKVKKTQDYGANVILYGESYYEAEKKAMELVRGGVKFLHAYNDWYVISGQATLGLEIVEDVGDVDVVVVPIGGGGLISGVAYAVKKRRPGAKVIGVQASGAPAVYLSLKEGRPIVIEKVDTIADGIAIKSPGDITLKLIQEYVDDVVLVDDNEIVDAIYLLLERTRVVAEGAGAVAVAALMSGKINVSGKKVVAVVSGGNIDAPIFMRVLMKAMARQRRVIKLVGEVPDKPGTLAKASSFLASHNVNILEVFHERYDPEQRPNYVRLIFVVEIPGTLDVSKLLDELEKNGFFFRVASQ

SEQ ID NO: 3161 - DNA, 1209 bp, Clostridium perfringens str. 13
  CDS (1)..(1209): transl_table=11
gtgattattttgtatttagaaaaaattattaaagcaaaaaaaaatatagaagatgtagttataaaaacacctttaatatatagcgaggtcttttcaaggaaatctggaaaccaagtgtatatgaaatgtgaaaatttacaattaacaggtgcttacaaaataagaggtgctttaaataaaataagatctttatcagatgaagaaaaatcaaaaggtgttgtttgttcttctgccggaaatcatgctcaaggcgtagcttttgcagcatcacaagctaatgttaaatcaactatagtaatgccaaagactactcctctactaaaaatccaatcaacaaaggatttaggagggaatgttgttttatcaggttatgtttatgatgatgcttttaatgaggctaaaagaattgaacaagaacaaggagccttatttatacatccatttaatgatattgatgtaatttgtggacaaggtacagtagccttagaaatatttgaagatttaaatgatgtagatattattctctgccctataggtggcggtggcttaataagtggagttaccctagctgctaaggctttaaaccctaatgttaaagtaattggagtacaggctgaaggtgcaaatgcaatggttaaaagttttaaggcaggagaaataattgctttagacgctgttgatactattgctgatggaattgcagtaaaaagacctggtgatttaacatttaaatttataaaagaatatgttgatgatataataactgtatcagatcatgaaattgttgaagcattctttacattaagtgaaaaacataaacttttagcagaagcttcaggagcagtctcattagcagcttctgctaaattaaattgtaaagataaaaatatagtatcagtaataagtggtggtaatatagatatggttactataacttcattaataaacagcgcattagtagctaaaggaagactttttggatttagtttagaagttcctcataaaccaggacaaatattgaagattgctaaagttcttgctgatactaatgctaatatagtaaaacttgaacatgatcattttaaagcaagggatgctcttaaaaatatggttatagaagtaactttagagacaaatggacactctcacatagaggaaataaaaaaagctttaacagatcaaaattatgtaataaaacaaatttattaa

SEQ ID NO: 3162 - protein, 402 aa, Clostridium perfringens str. 13
MIILYLEKIIKAKKNIEDVVIKTPLIYSEVFSRKSGNQVYMKCENLQLTGAYKIRGALNKIRSLSDEEKSKGVVCSSAGNHAQGVAFAASQANVKSTIVMPKTTPLLKIQSTKDLGGNVVLSGYVYDDAFNEAKRIEQEQGALFIHPFNDIDVICGQGTVALEIFEDLNDVDIILCPIGGGGLISGVTLAAKALNPNVKVIGVQAEGANAMVKSFKAGEIIALDAVDTIADGIAVKRPGDLTFKFIKEYVDDIITVSDHEIVEAFFTLSEKHKLLAEASGAVSLAASAKLNCKDKNIVSVISGGNIDMVTITSLINSALVAKGRLFGFSLEVPHKPGQILKIAKVLADTNANIVKLEHDHFKARDALKNMVIEVTLETNGHSHIEEIKKALTDQNYVIKQIY

SEQ ID NO: 3163 - DNA, 1215 bp, Fusobacterium nucleatum subsp. nucleatum ATCC 25586
  CDS (1)..(1215): transl_table=11
atggctaagttagaagcttttataaaagcaaaagaaaaattatcaaaagtacttttagaaacacagttaatttacagtcctatattctcaaaagaatctggaaacaaagtattcatcaagcctgagaacttacaaaaaacaggttcatttaagataagaggagcatacaataaaatttctaatctaacagatgctgaaaagaaaagaggtgtaattgcctcatctgctggaaatcacgctcaaggtgttgcttatggtgctaaggaatctggtataaaggcagttattgtaatgcctaaatctactcctcttataaaagttgaatctacaaaacaatatggagcagaagttattttacatggtgatgtttatgatgatgcctttaaaaaagcaaaagaattagaagaaaaagaaggttatgtgtttgtccatccttttaatgatgaagatgttttagatgggcaaggaacaatagccctagaaattttagaagaacttcctgaaactgatattatacttgttcctattggtggtggtggtttaatttcaggtatagcttgtgctgcaaaaatattaaaacctgaaataaaaattattggtgttgaaccagaaggagctgcttctgcttatgaagctataaaggaaaataaagttgttgaacttaaagaagctaatacaatagctgatggaaccgctgtaaagaaaattggagacctaaactttgaatatattaaaaaatatgttgatgaaattataacagtatctgattatgaattgatggaagcatttttattattagtagaaaaacataaaattattgcagaaaattctggtatattatcaatagctgctacaaaaaaacttaaggaaaaaaataaaaaagttgtatctgtcataagtggtggtaatatagatgtcttaatgatttcatctatgattaataaaggacttatcagaagagatagaatctttaattttacagttagcattcctgataaaccaggtgaattagcaaaagttgtagatttaatcgctgaacagggggctaatgtgataaaacttgaacataatcaatttaaaaatctatcaagatttaaggacattgaattacaaattactgttgaaactaatggaagtgaacatgtccaaaatttaactcaagcttttgaagaaaaaggttatgaaatagtaagaatcaaatctaaaataaattaa

SEQ ID NO: 3164 - protein, 404 aa, Fusobacterium nucleatum subsp. nucleatum ATCC 25586
MAKLEAFIKAKEKLSKVLLETQLIYSPIFSKESGNKVFIKPENLQKTGSFKIRGAYNKISNLTDAEKKRGVIASSAGNHAQGVAYGAKESGIKAVIVMPKSTPLIKVESTKQYGAEVILHGDVYDDAFKKAKELEEKEGYVFVHPFNDEDVLDGQGTIALEILEELPETDIILVPIGGGGLISGIACAAKILKPEIKIIGVEPEGAASAYEAIKENKVVELKEANTIADGTAVKKIGDLNFEYIKKYVDEIITVSDYELMEAFLLLVEKHKIIAENSGILSIAATKKLKEKNKKVVSVISGGNIDVLMISSMINKGLIRRDRIFNFTVSIPDKPGELAKVVDLIAEQGANVIKLEHNQFKNLSRFKDIELQITVETNGSEHVQNLTQAFEEKGYEIVRIKSKIN

SEQ ID NO: 3165 - DNA, 978 bp, Streptomyces coelicolor A3(2)
  CDS (1)..(978): transl_table=11
gtgacgaccaccaccccgccggtcaccctcgacgacgtccgctccgccgcggcccgcatcaagggcgtcgcgcaccgcaccccggtgctgcgctcgcgcaccctcgacgccctcgtcggcgccgaggtccacctcaagtgcgagaaccagcagcgggtcggcgccttcaagttccgcggcgcctacaacgcggcctcccgcctcaccccggagcagctggccaggggcatcgccgcctactcctcgggcaaccacgcccaggcggtcgccctggccgcccgtgaactgggcacgaccgcggtgatcgtcatgcccgaggacgcgccgccctccaagcgggacgccaccgcgggctacggcgccgagatcgtcacctacgaccgctacaccggcgaccgtgtggccgtcgccgaagcgctggccgccgaccggggactgaccctgatcccgccctacgaacacccgcacgtcatcgcgggccagggcaccgccgccctcgaactggtcgaggagacgggggagctggacgcgctggtcgcccccgtcggcggcggcggcctgatcgccggaagcgccaccgcggtcaaggcactgcaccccggcatgcgggtgatcggcgtcgagccggaggccggggacgacaccaggcgctccctggccgcgggccggcgggtcagcgtgccggtcccgcgcaccatcgccgacggccaggcgctgcccacccccggcgagctgacgttctccctcaaccggcgcctgctcgacgggatcgtgctggtgtccgacgacgagatccgggacgcgatgcggttcgccttcgaacggctgaagaccgtcctcgaacccagcggcgccaccccgctggccgccctcctgaacggccggatcgacgccctgccgcgccgcgtcggcgtgatcctctccggcggcaacgtggacgccgcccggttcgccgaactctgcggcgcgccccgctga

SEQ ID NO: 3166 - protein, 325 aa, Streptomyces coelicolor A3(2)
MTTTTPPVTLDDVRSAAARIKGVAHRTPVLRSRTLDALVGAEVHLKCENQQRVGAFKFRGAYNAASRLTPEQLARGIAAYSSGNHAQAVALAARELGTTAVIVMPEDAPPSKRDATAGYGAEIVTYDRYTGDRVAVAEALAADRGLTLIPPYEHPHVIAGQGTAALELVEETGELDALVAPVGGGGLIAGSATAVKALHPGMRVIGVEPEAGDDTRRSLAAGRRVSVPVPRTIADGQALPTPGELTFSLNRRLLDGIVLVSDDEIRDAMRFAFERLKTVLEPSGATPLAALLNGRIDALPRRVGVILSGGNVDAARFAELCGAPR

SEQ ID NO: 3167 - DNA, 1230 bp, Streptomyces coelicolor A3(2)
  CDS (1)..(1230)
atgagctacagcacagcgtcctgcgtcgctcccgtcaccctcgacgacgtgcgcggagcccagaagatgctctcgggcgtggcgcgggtgacggccatggagggcagcaggcacctctcccagctggtcggctcgccggtgcacctcaagtgcgagaacctccagcggacgggctcgttcaagctgcgcggcgcctacgtgcggatcgccgggctgctccccgagcagcgggccgcgggcgtggtcgcggcgagcgcgggcaaccacgcgcagggcgtcgcgctggcctcgtcgctgctcggtgtgcgctcgacggtgttcatgccgcagggggcgccgctgcccaagatcagcgcgacccgggactacggcgccgaggtgcggctgcacggccaggtggtggacgagacgctggccgccgcgcaggagtacgcggagcggaccggcgcggtcttcatccaccccttcgaccaccccgacgtcatcgcgggccagggcacggtcgggctggagatcctggagcagtgccccgaggtgcggaccgtcgtcgtcggcatcggcgggggcggactggcggccgggatcgcggtcgcggtgaaggcgctgcggccggacgtgcggatcgtcggcgtgcaggcggagggcgcggccgcctacccgccctcgctggccgccggacgcccggtcgccgtgcagaacccggcgacgatggccgacgggatcaaggtggggcggcccggcgacgtgccgttcgggatcgtcggcgaactggtggacgaggtccgcacggtctccgaggacgcgctgtcgaccgcgctgctgctgtgtctggagcgggccaagctggtcgtggagccggccggagcgagcccggtggcggcgctgctgagcgagccggacgccttcgagggaccggtcgtcgcggtcctgtccggcggcaacgtggacccggtgctgatgcagggtgtgctgcggcacggcatggccgcgcagggccgctacctggcggtccggctgcggctgacggaccggcccggcgccctggccacgctgctcggggtgttgtcagtggtcgacgctaacgtcctcgatgtgagccacgtccgaacccatccgcggctcgggctcacggaggcggaggtcgagctgcacctggagacgaagggcccggagcactgcaccgaggtcggccgcgtgctgcgggaagcgggatacacggtcatcgcctga

SEQ ID NO: 3168 - protein, 409 aa, Streptomyces coelicolor A3(2)
MSYSTASCVAPVTLDDVRGAQKMLSGVARVTAMEGSRHLSQLVGSPVHLKCENLQRTGSFKLRGAYVRIAGLLPEQRAAGVVAASAGNHAQGVALASSLLGVRSTVFMPQGAPLPKISATRDYGAEVRLHGQVVDETLAAAQEYAERTGAVFIHPFDHPDVIAGQGTVGLEILEQCPEVRTVVVGIGGGGLAAGIAVAVKALRPDVRIVGVQAEGAAAYPPSLAAGRPVAVQNPATMADGIKVGRPGDVPFGIVGELVDEVRTVSEDALSTALLLCLERAKLVVEPAGASPVAALLSEPDAFEGPVVAVLSGGNVDPVLMQGVLRHGMAAQGRYLAVRLRLTDRPGALATLLGVLSVVDANVLDVSHVRTHPRLGLTEAEVELHLETKGPEHCTEVGRVLREAGYTVIA

SEQ ID NO: 3169 - DNA, 1119 bp, Xanthomonas axonopodis pv. citri str. 306
  CDS (1)..(1119): transl_table=11
atgcctgattccggccgcccttccgcacaggagccagaggtaggcgacgtggccgtgagcgtggccgacgtgctggccgcacaggcacgcctgcgcaagtacctgtcgcccacgccgctgcactacgccgaacgcttcggtgtgtggttgaagctggagaatttgcagcgcaccggctcctacaaggtgcgcggcgcattgaatgcgttgctggccgggctggaacgcggcgatgagcgcccggtgatctgcgcctcggccggcaaccacgcgcaaggtgtggcgtggtcggcgtaccggctgggtgtgcaggccatcacggtaatgccctatggcgcgccgcagaccaagattgccggtgtcgcgcattggggtgccacggtgcgccaacatggcaacagctacgacgaagcgttcgcgtttgcgcgcgagctggccgaccagaacggctatcgcttcctgtccgccttcgacgacccggacgtgatcgccggccagggcacggtgggcatcgagctggcggcgcatgcgccggacgtggtgatcgtgccgatcggcggcggtggcctggcctccggcgtggcgctggcattgaagtcgcaaggcgtgcgcgtggtcggggcgcaggtggaaggcgtggattcgatggcgcgcgccgtccgcggcgatctgcgcgaaatcgctccggtcccaacgctggccgatggcgtgaaggtcaagattccaggcctgctcacgcgccgcctgtgctcgagcctgctcgatgatgtcgtgatcgtgcgcgaggccgaattgcgcgaaacattggtgcgcctggcactggacgaacacgtcattgccgagggcgctggcgccctcgccctggccgccggtcgccgcgtttccggcaaacgcaaatgtgcggtggtctctggcggtaatatcgacgcaaccgtgctggccacactcttgtccgaggtgcggccgcgtccgccacgcaagccgcgccgccgcaataccgagcgactccgcaacgaacgcagcgccaatccgccacccgccacacacgttctttcccgcccatccgcagtcgcttcaacgcctgtcaccgccatcgccgtagaggagtcttcctggtga

SEQ ID NO: 3170 - protein, 372 aa, Xanthomonas axonopodis pv. citri str. 306
MPDSGRPSAQEPEVGDVAVSVADVLAAQARLRKYLSPTPLHYAERFGVWLKLENLQRTGSYKVRGALNALLAGLERGDERPVICASAGNHAQGVAWSAYRLGVQAITVMPYGAPQTKIAGVAHWGATVRQHGNSYDEAFAFARELADQNGYRFLSAFDDPDVIAGQGTVGIELAAHAPDVVIVPIGGGGLASGVALALKSQGVRVVGAQVEGVDSMARAVRGDLREIAPVPTLADGVKVKIPGLLTRRLCSSLLDDVVIVREAELRETLVRLALDEHVIAEGAGALALAAGRRVSGKRKCAVVSGGNIDATVLATLLSEVRPRPPRKPRRRNTERLRNERSANPPPATHVLSRPSAVASTPVTAIAVEESSW

SEQ ID NO: 3171 - DNA, 1041 bp, Staphylococcus aureus subsp. aureus MW2
  CDS (1)..(1041): transl_table=11
atgacaaccaacacagttacattacaaacagcacatattgtaagtttaggagatatcgaagaagctaaagcaagcattaaaccatttattcgtcgaacacctctaattaaatcaatgtatttaagccaaagtataactaaagggaatgtatttctaaaattagaaaatatgcaattcacaggatcttttaaatttagaggcgctagcaataaaattaatcacttaacagatgaacaaaaagaaaaaggcattatcgcagcatctgctgggaaccatgcacaaggtgttgctttaacagctaaattattaggcattgatgcaactatcgtaatgcctgaaacagcaccacaagcgaaacaacaagcaacaaaaggctatggggcaaaggttattttaaaaggtaaaaactttaacgaaactagactttatatggaagaattagcgaaagaaaatggcatgacaatcgttcatccatatgacgataagtttgtaatggcaggccaaggaacaattggtttagaaattttagatgatatttggaatgtgaatacagtcatcgtaccagttggcggtggaggattaattgcaggtattgccaccgcattaaaatcatttaacccttcaattcatattatcggtgttcaatctgagaatgttcatggtatggctgagtctttctataagagagatttaactgaacatcgagtggatagcacgatagcagatggttgtgatgtaaaagttcctggtgaacaaacatatgaagtagttaaacatttagtagatgaatttattcttgttactgaagaagaaattgaacatgctatgaaagatttaatgcagcgtgccaaaattattactgaaggtgcaggcgcattaccaacagctgcaattttaagtggaaaaataaacaataaatggcttgaagataaaaatgttgttgctttagtttcaggcgggaatgttgacttaactagagtttcaggtgtcattgaacatggactgaatattgcagatacaagcaagggtgtggtaggttaa

SEQ ID NO: 3172 - protein, 346 aa, Staphylococcus aureus subsp. aureus MW2
MTTNTVTLQTAHIVSLGDIEEAKASIKPFIRRTPLIKSMYLSQSITKGNVFLKLENMQFTGSFKFRGASNKINHLTDEQKEKGIIAASAGNHAQGVALTAKLLGIDATIVMPETAPQAKQQATKGYGAKVILKGKNFNETRLYMEELAKENGMTIVHPYDDKFVMAGQGTIGLEILDDIWNVNTVIVPVGGGGLIAGIATALKSFNPSIHIIGVQSENVHGMAESFYKRDLTEHRVDSTIADGCDVKVPGEQTYEVVKHLVDEFILVTEEEIEHAMKDLMQRAKIITEGAGALPTAAILSGKINNKWLEDKNVVALVSGGNVDLTRVSGVIEHGLNIADTSKGVVG

SEQ ID NO: 3173 - DNA, 1017 bp, Oceanobacillus iheyensis HTE831
  CDS (1)..(1017): transl_table=11
gtgagttgtcttggggatcgcttaactggtgaaaaagtataccaagctatgaagaaattaacaccgattgttcatcgtacaccattagtaacatcacatacaacggatgatattgttggaaaacatgtttactgtaaaatggaaaatcaacaaaaaactggggcatttaaatttcgaggagcaagttataaattaatgcaactgtcaaaagaagaattacaacacggcgtaattacagcttcagctggtaatcatgcacaaggtgtagctcatgccgctgcaaaattaggagttaaggcaacgatttttatgtctgaaggaacgcctctagcgaaaattaatgcgacaagaaattatggggcaaccgtaaatcttgttggagaaagttttcaagaagcttatgaggcttcacttcaacatcaaaaagtaactggtgctacgtatatccacccatttgatgattatgatattatggctggtcaagggacaattgcaatggaattactccgccaagaagaccgtattgataccattattgtcccaattggtggaggtggattaattagtggcattgcagttgctgctaaacatgtaaatagaaacattaaaataatcggcgtacaggctgaaggtgctgcagcaatgcatcaaagttatcattcgagcaaagtacattctttatcaaatgtttcaacaattgcagaaggaatagcggtaaaacaaccaggagatttgaccttgccacttattcgatcctatgttgatgatattgttacggttaatgatgaacaaattgcttcagcaatcatttacatgttggaaagaaataagacgttaatggaaggtgctggtgccgctgcattagctgcactatttgcacataatgacacgatctcatccaggcattgtggtgttatagttagtggaggtaacttggacatcagtaatatgcaaaaaatacaacatctatccagtaatattaataaaaatccagaaagagcatatgtggcgctataa

SEQ ID NO: 3174 - protein, 338 aa, Oceanobacillus iheyensis HTE831
MSCLGDRLTGEKVYQAMKKLTPIVHRTPLVTSHTTDDIVGKHVYCKMENQQKTGAFKFRGASYKLMQLSKEELQHGVITASAGNHAQGVAHAAAKLGVKATIFMSEGTPLAKINATRNYGATVNLVGESFQEAYEASLQHQKVTGATYIHPFDDYDIMAGQGTIAMELLRQEDRIDTIIVPIGGGGLISGIAVAAKHVNRNIKIIGVQAEGAAAMHQSYHSSKVHSLSNVSTIAEGIAVKQPGDLTLPLIRSYVDDIVTVNDEQIASAIIYMLERNKTLMEGAGAAALAALFAHNDTISSRHCGVIVSGGNLDISNMQKIQHLSSNINKNPERAYVAL

SEQ ID NO: 3175 - DNA, 1248 bp, Bifidobacterium longum NCC2705
  CDS (1)..(1248): transl_table=11
ttgaaggcgctgcaacgtgatcatgcagccgaactgaagctggccgccgaacgactcaaaggcactgcccgccacacggagatcattccttctccggtgctgagcgagatgaccggccatgagattctcctgaagccggaaaacctgcaggtcaccggatccttcaagatccgcggtgcctataacaagattgcttcgctcaccgaagagcagatcgctcacggcatcgtcaccgcgtctgccggcaaccatgcccagggtgtggcctatgcggcccgcgagcgtggagccaaggccaccatctgcatgccgcagatcaccccgccgctgaaggtcgatgccaccaaggcctacggtgccgacgtggtgctgtacggcgatgtgttcgatgaatccgccgcccacgctgctgagctcgccgacaaggaaggcatgatttacgtgccgccattcgacgattacgaagtcatctgcggccaaggcaccatcggtctggagatccttgaagacgtgccgaacgtcactgacgtggtcgtgccgctcggtggtggtggcctgggtgccggcgtggcgctcgccatcaagacattcaagcctgaagtgcgcgtaatcggtgcgattccggagggctcaccggcctggaaggactcgctggccgcgggtcgtgtgtctccggctgaccatgtggttacctccgccgaaggtgttgcggtcaagcaccccggcgacctgcccttcgctctgattaacgagttcctggacgatctggtcaccgtcaccgagcgcgacatcaacgaaatgattctgctcatgctcgagaagcataagctggtggtcgaggcggccggcgccgtttcgctggctgcgctggaacacctgaacctgcgttcgcgcaagttcgccgccgccaccggcccgcacgtggtggttccgattatgtccggcggcaatatcgacaccgtgaccatgggtgcggtgattcagaaaggtatgatcgcccgcggccgcatcatgaacttcgaggtcgagctgccggatactccgggccagctcgtcaaggtggccaccctgcttgccgagcagcgcgccaacgtcattcagcttgatcacgaccagttcaaggcatccggccactacaccaacgcggtgtctctcggcgtcacggtcgagaccaacggccccgagcacatcgaccgcatcctcgcggcactcagggaagccggattccagcccaagcgcatctactga

SEQ ID NO: 3176 - protein, 415 aa, Bifidobacterium longum NCC2705
MKALQRDHAAELKLAAERLKGTARHTEIIPSPVLSEMTGHEILLKPENLQVTGSFKIRGAYNKIASLTEEQIAHGIVTASAGNHAQGVAYAARERGAKATICMPQITPPLKVDATKAYGADVVLYGDVFDESAAHAAELADKEGMIYVPPFDDYEVICGQGTIGLEILEDVPNVTDVVVPLGGGGLGAGVALAIKTFKPEVRVIGAIPEGSPAWKDSLAAGRVSPADHVVTSAEGVAVKHPGDLPFALINEFLDDLVTVTERDINEMILLMLEKHKLVVEAAGAVSLAALEHLNLRSRKFAAATGPHVVVPIMSGGNIDTVTMGAVIQKGMIARGRIMNFEVELPDTPGQLVKVATLLAEQRANVIQLDHDQFKASGHYTNAVSLGVTVETNGPEHIDRILAALREAGFQPKRIY

SEQ ID NO: 3177 - DNA, 1053 bp, Pseudomonas putida KT2440
  CDS (1)..(1053): transl_table=11
ttgctgtttgtggaatattattctatggtggacaaattatccacgcgcctgcaaggacccgtcatgccagccaccccgtccgttgatgcccagttccttgatacattgcaccaaaacattcaggacgcccacgcggcgctccgcccggccgtcagcattaccccgctcttgcacagccctcgtttgtcggcactgaccggctgtgaagtgctgctcaaatgcgaacacctgcagcacaccggttcgttcaagtttcgcggtgccagcaacaagatgcgcctgttgccggccgaggcacgcaagcagggggtgatagccgcctcatccggtaaccatgggcaggccctggccctggccggcaagatggctggcgtgccagtgaaggtctacaccaccacgggcgcatcggcatacaaaacagaggcaatgcgcgcgctgggcgccgaagtggtctgcctgcccaccgacccgctgagtgcagagctggaagcagccaggcaagccaaggcccagggcgtacctttcgtgtcaccttacaacgacctgcaagtcattgccggccagggcaccataggcatggagttgctcgagcaggcgccagacctggacgcggtgttcgtcgccgtgggcggtggcgggatgatttccggcatcggcgccgccctgcgcgtactcaagccgggcactgagatcatcggctgctggccggcgaatgacccaaccctgcagcaatcactcaaggccggtgaaatcatcgaattggatgcctgcgaaacgctgtcggatggcacggccggcggcgtcgagccaggctccatcaccttcccgctttgccaggcgctgctcaccgataccgtgttggtcagcgaggatgaaatccgctgcgccatgcgcgacatcgccagcagtgagcgctggatcatcgaaggcgctgctgcggttgcggtcgccggcatgcagaggctcgccgaacgctatcagggcaagcgtgtcgccgtgatcctgtgtggccgtaacatcctgctggaaaagttcctcgaggccgttcaatga

SEQ ID NO: 3178 - protein, 350 aa, Pseudomonas putida KT2440
MLFVEYYSMVDKLSTRLQGPVMPATPSVDAQFLDTLHQNIQDAHAALRPAVSITPLLHSPRLSALTGCEVLLKCEHLQHTGSFKFRGASNKMRLLPAEARKQGVIAASSGNHGQALALAGKMAGVPVKVYTTTGASAYKTEAMRALGAEVVCLPTDPLSAELEAARQAKAQGVPFVSPYNDLQVIAGQGTIGMELLEQAPDLDAVFVAVGGGGMISGIGAALRVLKPGTEIIGCWPANDPTLQQSLKAGEIIELDACETLSDGTAGGVEPGSITFPLCQALLTDTVLVSEDEIRCAMRDIASSERWIIEGAAAVAVAGMQRLAERYQGKRVAVILCGRNILLEKFLEAVQ

SEQ ID NO: 3179 - DNA, 1245 bp, Bradyrhizobium japonicum USDA 110
  CDS (1)..(1245)
atggctgacttgtcccaaaccacgtcctccgatctcagcggccttccggtcgcgcctggtgacattcaggcagccgccgagaccatccgcggtgccgtcgtcgagacgccctgcagctacagccgcacgctgagcaacatctgcggctgtgacatctggctcaaattcgagaacctccagttcacctcctcgttcaaggagcgcggcgcgctcaaccgcctcaccgcgctgacgccggaggagcgtatgcgcggcgtcatcgccatgtcggcgggcaaccacgcgcagggcgtcgcctatcacgccaggcggctcggcattcccgccaccatcgtgatgccggtcggcacgcccatggtgaagatcgagaacacgaagcaccacggcgcggaggtggtggtgacgggcgcgacgctggaggaggcggccgcgtttgcgcgcagccacggtgaagctcacggcatgatcttcgtccacccttacgacgatccgcttgtgatcgcggggcagggcaccgtcgggctggagatgttgaaggcggtgccggagctcgacacgctggttgtcccgatcggcggtggcggcctgatcagcgggatcggcattgccgcgaaatcgatcaagccatcgctgcggattcttggcgtcgaggcctggctctatccctcgatgtacaacgccatccatgacggcaatctgccggcgcgcggcgatacgctcgccgagggcatcgcggtgaagtcgcccggcaagatcacgactgaaatcgtccggcgcctcgtcgacgacatcgcgctggtcaacgaggccgagctcgagcgcgcggtcgcgaccctgatctcgatcgagaagacggtcgtcgagggcgccggcgccgccggccttgccgcgctgatgtccgacccgtcccgctttgccggccagaaggtcggcctggtgctgagcggcggcaatatcgacacgcggttgatcgcctccgtcctgacccgcgaactggcgcgcgagggacggttgacccagttgtccctcgacattcctgaccggcccgggcagctggcggcggtggctgcgctgctggccgaggctggcgccaacatcatcgaggtctcgcatcagcggaccttctccgacctgccggccaaggcgacgctactgcaactcgtgatcgagacccgcgacagcgcccatctcgacgaggtcatggcgaggctcagtgcttccggcttgagcgcgcgctgcacctga

SEQ ID NO: 3180 - protein, 414 aa, Bradyrhizobium japonicum USDA 110
MADLSQTTSSDLSGLPVAPGDIQAAAETIRGAVVETPCSYSRTLSNICGCDIWLKFENLQFTSSFKERGALNRLTALTPEERMRGVIAMSAGNHAQGVAYHARRLGIPATIVMPVGTPMVKIENTKHHGAEVVVTGATLEEAAAFARSHGEAHGMIFVHPYDDPLVIAGQGTVGLEMLKAVPELDTLVVPIGGGGLISGIGIAAKSIKPSLRILGVEAWLYPSMYNAIHDGNLPARGDTLAEGIAVKSPGKITTEIVRRLVDDIALVNEAELERAVATLISIEKTVVEGAGAAGLAALMSDPSRFAGQKVGLVLSGGNIDTRLIASVLTRELAREGRLTQLSLDIPDRPGQLAAVAALLAEAGANIIEVSHQRTFSDLPAKATLLQLVIETRDSAHLDEVMARLSASGLSARCT

SEQ ID NO: 3181 - DNA, 1005 bp, Bradyrhizobium japonicum USDA 110
  CDS (1)..(1005)
atgggcgcgataaggttgagtatgaccgaacagccccttccgatcggccccgccgatatcgatgccgcagcacgcgtgatcgcgcccttcgccatccgcaccccgctgttgtcctttcccgtgctcaacgagcgcgtcggcgcaaaagtgttcctgaagccggagatgctccagcgcaccggctccttcaagttccgtggcgccttcaacaaggtcgcctcgatcccgcaggacaagcgcgccggcggcgtcgtggccttctcctccggcaaccatgcccagggcgtggcggccgcggccaagatcctcgacatgcaggcgaccatcgtgatgcccgcggacgcgccgctgtccaagcgcgagcgcaccaagtcctacggcgccgaggtcgtgctgtacgaccgcgatcgcgacgaccgcgaggcgatctcgcgcggcatcgccgagaagcgcggcgcgacgctggtcaggccgtatgacgatcccttcgtgatcgctggccaaggcaccgccggccgggagatcgcggacgacatggcaacgctgggccttagccccgacatcgtggtggcacccgcctccggcggcggcctgatcgccggcgtcgcgaccgcgatcaaggcgcgatatccgctggcgcaggtcgtggttgccgagccggaggcgttcgacgatcacggcatttcgctgactgcaggccatcgcgagccgcatgggccggcaggccgcaccatctgcgacgcgctgatggcgctgatccccggcgagatgacatttgcgatcaacagcaagctgctcgcgcgcggcgtcaccgcatccgacaaggaagtcggtgcggcggtggcgttcgcctatcgcgagctgaagctggtggtggagccgggaggggccgtcggccttgccgcgctgctcgcggggcgtctcgacgtcgccggcaagaacgtcgtcatcgtcctctccggcggcaatgtcgatgccgatctgttcgccgagctcgtggcctga

SEQ ID NO: 3182 - protein, 334 aa, Bradyrhizobium japonicum USDA 110
MGAIRLSMTEQPLPIGPADIDAAARVIAPFAIRTPLLSFPVLNERVGAKVFLKPEMLQRTGSFKFRGAFNKVASIPQDKRAGGVVAFSSGNHAQGVAAAAKILDMQATIVMPADAPLSKRERTKSYGAEVVLYDRDRDDREAISRGIAEKRGATLVRPYDDPFVIAGQGTAGREIADDMATLGLSPDIVVAPASGGGLIAGVATAIKARYPLAQVVVAEPEAFDDHGISLTAGHREPHGPAGRTICDALMALIPGEMTFAINSKLLARGVTASDKEVGAAVAFAYRELKLVVEPGGAVGLAALLAGRLDVAGKNVVIVLSGGNVDADLFAELVA

SEQ ID NO: 3183 - DNA, 1053 bp, Xylella fastidiosa Temecula1
  CDS (1)..(1053): transl_table=11
atggatatacctgatgtagggcacacagttgtcaagcaacccaatgcaagtaacgtcaataccgtgagtgtggccgatgtgttggctgcacaagcccgcttacgtcgttatctaatgcctactccaattcactatgccgagcgtttcggagtgatgctgaagttagaaaatctgcaacgcaccggatcctataaagtgcgcggcgcactgaacgcaatgttagttgcgctggaacgcggcgataaccgccctgtcatttgcgcatcagccggtaaccacgcccaaggcgtagcttggtcagcttaccggcttggtatacaagcaatcactgtcatgcctcacggtgctccggccacaaaggttgcaggtgtttcacattggggggcaacggtacgccaacacggccaaagctatgacgaggcctatacgttcgcatgtgagttggctgagcaaaacgattaccgctttctatcagcattcgatgatccggatgtgattgccggtcagggaactgttggcatagagatcaccgcgcatgaaccggatgtagtcattgtgccgatcggcggcggcggccttgcttcaggcattgctttggtgctgcgctcgcagggagtacgtgtcattggcgctcaggtcgagggcgtggatgcgatggcgcgtgcaatccgtggcgacacacgcgagatcgctccagtttcgaccttagctgacggggtgaaagtcaagattcctggtttcattacccgccatctgtgtgccaacttgttagacgatgtagtaatcgtgcgtgaggctgaactgcgcgaaacattggtgcgtttagtattggaagaacacctgatcgccgaaggggcaggcgcactggcattggccgctggccgccgcgttgcaggtaagcgcaagtgtgcagtggtctccggaggtaatattgacgctgcagtactggccaaactgttgtccgaagtaagaccacggccaccccgcaaaccacgtaggcgtagtgcagatcgccccaacaattgcggcaatttaccgctcccttttaactga

SEQ ID NO: 3184 - protein, 350 aa, Xylella fastidiosa Temecula1
MDIPDVGHTVVKQPNASNVNTVSVADVLAAQARLRRYLMPTPIHYAERFGVMLKLENLQRTGSYKVRGALNAMLVALERGDNRPVICASAGNHAQGVAWSAYRLGIQAITVMPHGAPATKVAGVSHWGATVRQHGQSYDEAYTFACELAEQNDYRFLSAFDDPDVIAGQGTVGIEITAHEPDVVIVPIGGGGLASGIALVLRSQGVRVIGAQVEGVDAMARAIRGDTREIAPVSTLADGVKVKIPGFITRHLCANLLDDVVIVREAELRETLVRLVLEEHLIAEGAGALALAAGRRVAGKRKCAVVSGGNIDAAVLAKLLSEVRPRPPRKPRRRSADRPNNCGNLPLPFN

SEQ ID NO: 3185 - DNA, 1218 bp, Clostridium tetani E88
  CDS (1)..(1218): transl_table=11
atgactatgggattaaaacttggagatgtaaagcaagcgcaaaataatattaaaaaggttgtaagaagaacacccttggtatactcatcaacttttacaaaattaactggatataatatttatattaagtgtgaaaacaagcaaaagacaggtgcttttaaattaagaggagcttataataaaatagtaagtcttaacgaagaagaaaagaaaaaaggggttatagcatcgtcagcgggtaatcacgcacaaggtgttgcctatgcagcatctgcttttggtataaattctacaatagttatgcccgttacagcaccattagctaaagttaatgctacaaaaggttatggtgccaaggtaattcaatgtggagaagtctatgatgaatgttatataaaagcacttcaaacgcaaaaagaaaatgggtatacattcatacatccttttgatgatgaacaggttatagcaggacagggtactataggattagaaatattagaagatatggaagatgtagatgctatagtagtaccagtgggtggaggaggcttaatatcaggaatagcactagctgcaaaatctattaaaccaaatgttaagataataggagtgcaaccatctattatagcttcctctaaagtatccttagagaagggaaaggttaccacattacctggagttaagtccttagcagatggtatatctgttagtactccaggagaaataacatttaaatatatgaatgaatatgtagatgatatagtaaccgtttcagaagatgaaattgcatatagtgtattttgtttattagaaagagggaaacttttagcagaaggtgctggagcggcagctatggcagctatattaagtgataagattaatataaagggtaagaatatagtatctctcataagtggagggaatattgatatagcaacggtttctaaaataatagacagagaacttataagacttagaagaagactaagatttatagtagaaattaaagatagaataggacagttaagtagcataataacagaaattgtatccacgggagccaatgtagtaaaattaaggcaagatactaattggaataaaaaaggattggactatgtaaatgttatgtttgaaatcgaagttcagacagtagaacaatcacaagaacttatagatgctttaacaaagaaaggatacaaactagaaataatatcatag

SEQ ID NO: 3186 - protein, 405 aa, Clostridium tetani E88
MTMGLKLGDVKQAQNNIKKVVRRTPLVYSSTFTKLTGYNIYIKCENKQKTGAFKLRGAYNKIVSLNEEEKKKGVIASSAGNHAQGVAYAASAFGINSTIVMPVTAPLAKVNATKGYGAKVIQCGEVYDECYIKALQTQKENGYTFIHPFDDEQVIAGQGTIGLEILEDMEDVDAIVVPVGGGGLISGIALAAKSIKPNVKIIGVQPSIIASSKVSLEKGKVTTLPGVKSLADGISVSTPGEITFKYMNEYVDDIVTVSEDEIAYSVFCLLERGKLLAEGAGAAAMAAILSDKINIKGKNIVSLISGGNIDIATVSKIIDRELIRLRRRLRFIVEIKDRIGQLSSIITEIVSTGANVVKLRQDTNWNKKGLDYVNVMFEIEVQTVEQSQELIDALTKKGYKLEIIS

SEQ ID NO: 3187 - DNA, 990 bp, Salmonella enterica subsp. enterica serovar Typhi Ty2
  CDS (1)..(990): transl_table=11
atgcacattacatacgatctcccggttgcaattgaagatatcctcgaagcgaaaaaaagactggcggggaagatatataaaacgggaatgcctcgctctaactattttagtgaacgttgcaaaggcgaaatatttctcaagtttgaaaatatgcagcgtacgggttcatttaaaattcgtggcgcttttaacaaacttagctcgttaacggaggcggaaaaacgtaaaggcgtcgtggcctgttccacaggtaatcatgcacagggcgtttctctttcttgcgcaatgctgggtattgacggcaaagtcgtgatgccgaagggcgcgccaaagtcaaaagtggcggccacctgtgattattcggcggaagtggtgctccacggtgacaacttcaatgacaccattgctaaggtgagtgaaattgtcgaaaccgaaggccgcatttttattccgccttacgacgatccaaaagtcattgccgggcagggtactattggtctggaaattatggaagatctgtacgatgtcgataatgtcatcgtgcctattggcggcggcggtttaattgcaggtattgccattgcgattaaatcgattaacccgaccattaaagttatcggcgtacaggccgaaaatgttcacggtatggcggcgtcttattacgctggcgaaataaccgcgcaccgaacgaccggcaccctggcggatggttgtgatgtctcccgcccgggtaatttaacctatgaaattgttcgtgaattagtcgatgacattgttctggttagcgaagatgaaattcgtaacagcatgatcgctttaattcagcgcaataaggttattactgaaggcgctggcgcactggcctgcgccgcactattaagcgggaaattagatagccatattcagaacagaaaaacggtcagtattatttctggcggcaatatcgatctttctcgtgtatcacaaattacgggtttagttgacgcttaa

SEQ ID NO: 3188 - protein, 329 aa, Salmonella enterica subsp. enterica serovar Typhi Ty2
MHITYDLPVAIEDILEAKKRLAGKIYKTGMPRSNYFSERCKGEIFLKFENMQRTGSFKIRGAFNKLSSLTEAEKRKGVVACSTGNHAQGVSLSCAMLGIDGKVVMPKGAPKSKVAATCDYSAEVVLHGDNFNDTIAKVSEIVETEGRIFIPPYDDPKVIAGQGTIGLEIMEDLYDVDNVIVPIGGGGLIAGIAIAIKSINPTIKVIGVQAENVHGMAASYYAGEITAHRTTGTLADGCDVSRPGNLTYEIVRELVDDIVLVSEDEIRNSMIALIQRNKVITEGAGALACAALLSGKLDSHIQNRKTVSIISGGNIDLSRVSQITGLVDA

SEQ ID NO: 3189 - DNA, 1230 bp, Streptomyces avermitilis MA-4680
  CDS (1)..(1230): transl_table=11
atgagctacagcacagctgactccttgcccgcggtgacgctcgacgacgtacggggcgcccagaagatgctggcgggcgtggcgcgcatgaccggcatggagggcagcaggcatctgtcccagctggtgggcgcgccggtgcacttcaagtgcgagaacctccagcggacgggttcgttcaagctgcgcggtgcgtacgtgcgaatcgcgggactgctgcccgaggagcgcgccgccggggtcgtcgccgcgagcgccgggaaccacgcacagggtgtcgccctggcgtcgtcgctgctcggcgtgcgctcgacggtgttcatgccgaaggcggccccgctgcccaagatcagcgcgacccgggagtacggcgccgaggtgcggctgcacggaacggtggtcgacgagacgctggccgccgcgcaggagtacgcggccgagacgggcgcggtgttcatccaccccttcgaccatcccgacatcatcgcaggtcagggcacggtcggcctggagatcctggagcagtgccccgaggtgcgcacgatcgtcgtcgggatcggcggcggcgggctggccgcgggcatcgcgacagccgtgaaggcgctgcgccccgatgtgcggatcgtgggcgtgcaggcggcgggcgcggccgcgtacccgccctcgctggcggccgggcgcccggtgtccgtcgagaacccggcgacgatggccgacggcatcaaggtcggccggcccggcgacgtaccgttccggatcatcggcgatctggtcgacgaggtgcggacggtgtccgagggcaacctgtccagcgcgctgctgctctgcctggagcgggccaagctggtcgtcgagccggccggcgcgagcccggtggcggcgctgctgcgggagccgggcgccttcgaggggccggtcgtcgcggtgctgtcgggcggcaatgtggaccccctgctgatgcagcggatcctgcggcacggcatggccgccgcgggccgctacctggccgtccggctgcggcttacggaccgcccgggcgccctcgcgacgctgctcggggtgctgccgacggtcgacgccaacgtcctcgacgtgagtcatgtacggaccgacccgcggctcgggctcacggaggtggaggtggagctgcacctggagaccaaggggccggaacactgcgccgaggtggagcaggcgctgcgcgaggcgggctacacggtcatcgactga

SEQ ID NO: 3190 - protein, 409 aa, Streptomyces avermitilis MA-4680
MSYSTADSLPAVTLDDVRGAQKMLAGVARMTGMEGSRHLSQLVGAPVHFKCENLQRTGSFKLRGAYVRIAGLLPEERAAGVVAASAGNHAQGVALASSLLGVRSTVFMPKAAPLPKISATREYGAEVRLHGTVVDETLAAAQEYAAETGAVFIHPFDHPDIIAGQGTVGLEILEQCPEVRTIVVGIGGGGLAAGIATAVKALRPDVRIVGVQAAGAAAYPPSLAAGRPVSVENPATMADGIKVGRPGDVPFRIIGDLVDEVRTVSEGNLSSALLLCLERAKLVVEPAGASPVAALLREPGAFEGPVVAVLSGGNVDPLLMQRILRHGMAAAGRYLAVRLRLTDRPGALATLLGVLPTVDANVLDVSHVRTDPRLGLTEVEVELHLETKGPEHCAEVEQALREAGYTVID

SEQ ID NO: 3191 - DNA, 1002 bp, Bacillus cereus ATCC 14579
  CDS (1)..(1002): transl_table=11
atgataactagaaaactaccattacatatagacgatattaaaaaagctcacaaaattctagatagaaatgctcgtaaaacgccattagtaaaatctttttacttgactagtaaaacgggtggagaaattcatttgaaattagaaaatatgcaattaacgggttcttttaaatttcgtggcgcatttaataaaatgtcgcggctcacggatcaagaaaaagaaagaggtgtaattgcatgttcagcaggtaatcatgcacaaggagttgcattatctgctcatttactcggtattaagagtaaaattgttatgccaatttctgcacctcaggcaaaagttgaagcaacaaaaggatatggatctgaagtgattttacatggtgaaacctttgatgatgcaaaggtaaaatgtgaagaaattataagggaaacaggtgaaacatacttacatccatatgatgatgtagaggtaatggctggtcaaggtacaattggattagacattcttgatgatatgtgggatgtagatactgtcattgtaccaataggtggaggcggaattatttctggtatttctgtagcattgaaatcttttaatccatccattaatataattggtgtccaagcagataatgttcatggaatgaaggcatcttacgataaaggagcaatcgtagaacactatgaggcgcctactattgcagatggttgcgcagttaaaataccaggtgaattaacatttgaaattgtaaaagaattagtagatgatattgtaactgtatcagaaaaagagctggaagtagcgatgaaagatttattacaacgtgggaaagctgttgtagaaggtgcaggtgcattagcaactgctgcacttcttgcaggaaaagttgatagttatataaaagggaaaaaagtagtggctgttatatctggtgggaacgtggacttacagcgcatatcaagtgtatgtgagcacttttttgtcgctaatgaagtgaaatag

SEQ ID NO: 3192 - protein, 333 aa, Bacillus cereus ATCC 14579
MITRKLPLHIDDIKKAHKILDRNARKTPLVKSFYLTSKTGGEIHLKLENMQLTGSFKFRGAFNKMSRLTDQEKERGVIACSAGNHAQGVALSAHLLGIKSKIVMPISAPQAKVEATKGYGSEVILHGETFDDAKVKCEEIIRETGETYLHPYDDVEVMAGQGTIGLDILDDMWDVDTVIVPIGGGGIISGISVALKSFNPSINIIGVQADNVHGMKASYDKGAIVEHYEAPTIADGCAVKIPGELTFEIVKELVDDIVTVSEKELEVAMKDLLQRGKAVVEGAGALATAALLAGKVDSYIKGKKVVAVISGGNVDLQRISSVCEHFFVANEVK

SEQ ID NO: 3193 - DNA, 1002 bp, Bacillus anthracis str. Ames
  CDS (1)..(1002): transl_table=11
atgataactaaaaaactaccattacatatagacgatattaaaaaagctcaaagcattctggatagaaatgctcgtaaaactccattagtaaaatcattttatttgactagtaaaacgggtggagaaattcacttgaaattagaaaacatgcaattaacaggttcgtttaaattccgtggtgcgtttaataaaatgtcacagctgacagatcaagaaaaagaaagaggagtaattgcttgttctgctggtaatcatgcgcaaggaattgctttatctgctcatttacttggtattaagagtaaaattgttatgccgatttctgcaccgcaggcgaaagttgatgcgactaaaggatatggatctgaagtagttttacatggtgaaacctttgatgatgcgaaggcaaaatgtgaggagattattagggaaacaggtgaaacatacttacatccatatgacgatgtagaagtaatggcaggtcaaggtacaataggattagatattcttgatgatatgtgggatgttgatacggtcattgtaccaattggtggaggaggaattatttctggaattgctgtcgcattaaaatcttttaatccgtcgattcatataattggtgtgcaagcagaaaatgttcatgggatgaaggcatcttatgacaaaggcaaaattatagaacattatgaggcacctacgatagcagatggttgcgcggtaaaaatacctggcaatttaacttttgaagttgtaaaagaattagtagatgatattgtaacggtatcagaaaaagagctggaagtagcgatgaaagacttattacaacgcgggaaagctgttgtagaaggtgcaggcgcattagctactgctgctctacttgcagggaaagtggatacatatattaaagagaaaaaagtagtagcagttatatctggtgggaacgtagacttacagcgcatatcgagtgtttgtgaacaattttttgtggcgaatgaagtggaatag

SEQ ID NO: 3194 - protein, 333 aa, Bacillus anthracis str. Ames
MITKKLPLHIDDIKKAQSILDRNARKTPLVKSFYLTSKTGGEIHLKLENMQLTGSFKFRGAFNKMSQLTDQEKERGVIACSAGNHAQGIALSAHLLGIKSKIVMPISAPQAKVDATKGYGSEVVLHGETFDDAKAKCEEIIRETGETYLHPYDDVEVMAGQGTIGLDILDDMWDVDTVIVPIGGGGIISGIAVALKSFNPSIHIIGVQAENVHGMKASYDKGKIIEHYEAPTIADGCAVKIPGNLTFEVVKELVDDIVTVSEKELEVAMKDLLQRGKAVVEGAGALATAALLAGKVDTYIKEKKVVAVISGGNVDLQRISSVCEQFFVANEVE

SEQ ID NO: 3195 - DNA, 1227 bp, Helicobacter hepaticus ATCC 51449
  CDS (1)..(1227): transl_table=11
atgaaaaagcagatatatgaaaaagtaataaaagccaagcaacgtttagaaaatgtgattattccctcgcctttaagctatgcacctatgctctctcttttagctcaagctgatatttatcttaaaaaagagaatctgcaactgacgggagcatttaagattcgtggagcgttcaataaaattgcctctttggttgaacaatctactcattcccaaatacagggcgttatcgctgcaagtgctgggaatcacgcgcaaggtgttgcctatgctgcaaagcattttggtataaaagccgtgattgtaatgcccgaagctactcctttacttaaggtaagtgcgacaaaagctcttggtgcggaagtggttttaagtggagataattatgatgaagcctatgctaaagctttgcaggttgctaaagagcgtgatttagtgtttattcacccttttgctgacgaggaggtgattgcagggcagggcagtattgcgcttgagatgatacaagaatgtgaggatttaaatgtagtagttgtgcctattggtggaggtggtttgattagtggtatagggagtgtgtataagcaactatatccgaatgtaagagttataggtgtagtggcaagtggtgcagacgctatgaaacgctcttttgagagtggtgctatccaaaaaatagaatctgtgcggagcattgctgatggtatagctgtgcgtgatgttaatgaggagaattttgcgcttgtgcaagaatgtgttgatgaaatagtgagcgtagatgatgaagaaattgcaaatgctattttatttttgattgaaaaacaaaaacttgttgttgagggtgcaggagcagcgagtgtagcaagtattttgcacaaaaagtttgcacttacaaagcaagataaagtagcacttgtgctaagtggaggaaatattgatattactttgcttaatgttattattgaaaaaggtttattgaaatctaatcggaagatgaagcttgaagtcgtgctcatagataagcccggtagtttgcaagggctaacaaatattttaagtaaagtgggtgcaaatatcgttcagattgaatatgataggacttctgttatgcttaaatatggagatgcacttgtaacaatggcattagagacaaaaaatgaagaacacaaagtgctcattcgcgagcaacttcaacattatggttatcattttaatgagattaattag

SEQ ID NO: 3196 - protein, 408 aa, Helicobacter hepaticus ATCC 51449
MKKQIYEKVIKAKQRLENVIIPSPLSYAPMLSLLAQADIYLKKENLQLTGAFKIRGAFNKIASLVEQSTHSQIQGVIAASAGNHAQGVAYAAKHFGIKAVIVMPEATPLLKVSATKALGAEVVLSGDNYDEAYAKALQVAKERDLVFIHPFADEEVIAGQGSIALEMIQECEDLNVVVVPIGGGGLISGIGSVYKQLYPNVRVIGVVASGADAMKRSFESGAIQKIESVRSIADGIAVRDVNEENFALVQECVDEIVSVDDEEIANAILFLIEKQKLVVEGAGAASVASILHKKFALTKQDKVALVLSGGNIDITLLNVIIEKGLLKSNRKMKLEVVLIDKPGSLQGLTNILSKVGANIVQIEYDRTSVMLKYGDALVTMALETKNEEHKVLIREQLQHYGYHFNEIN

SEQ ID NO: 3197 - DNA, 1218 bp, Bordetella parapertussis 12822
  CDS (1)..(1218): transl_table=11
gtgatcgatcttgccgccatccagaccgcccgggacatcctgcggggacaggtcctcaatacgccgttcacgcattcccgcacgctgtccgatatcctcggcgccgaaatctggctgaagttcgagaacctgcagttcaccgcctcgttcaaggagcgcggcgccctcaaccggatgctcaacctgaccgaggccgagcgcgccgccggcgtgatcgccgtgtcggccggcaaccatgcccagggcgtggcgtaccacgcgcagcgcatgggcgtgccggcggtgatcgtcatgccgcgcttcactcccacggtcaaggtggccaacacgcggcgcttcggcgccgaagtcgtcctggccggcgacaccttcgacgacgccaaggcgcgcggctacgaactggcgcgcgagcgcggcctggtcatgatccatccctacgacgatccagccgtgattgccgggcagggtacggtggcgctcgaaatgctgcaggcgcgcccagacctggacgccatcgtggtgggcatcggcggcggcggcctgatcgcgggcatcgccaccgccgccaaggccatcaagccggacatcgagatcatcggcgtgcagaccgagcgctttccgtccatgtacgccgccgtcaagggcgtggccatggaaagcggccactacacgatcgccgagggcatcgccgtcaagtcacccggcacgctgacccaggagatcgtcacgcgcctggtcgaccacatcgagctggtcaacgaaagcgatatcgagcatgccatcgtggtcctgctggaaatcgagaagaccgtggtcgaaggggccggcgcggccggcctggcggcgctgctgcggctgcaggaacgccgcgacgagcggttccgcggcaagcggctggggctggtgctcacgggcggcaacatcgatcccctgatgctgggcgagctgatcgagcgcggtatggtgcgcgccgggcgcctggcgcgcatccgggtcgacctgcgcgacctgccgggcgcgctggcgcaggccaccaagctgatcgccgacgcgcacgccaacattaccgaggtgcatcaccagcgcgccttcaccaccttgccagtgcgcaatgtcgaggtcgatttcgtgctgcagacgcgtggccatgaccacatccaggaagtcatcgcggtgctcaatgccgcgggcttcgcggccagcaaccacgatcactga

SEQ ID NO: 3198 - protein, 405 aa, Bordetella parapertussis 12822
MIDLAAIQTARDILRGQVLNTPFTHSRTLSDILGAEIWLKFENLQFTASFKERGALNRMLNLTEAERAAGVIAVSAGNHAQGVAYHAQRMGVPAVIVMPRFTPTVKVANTRRFGAEVVLAGDTFDDAKARGYELARERGLVMIHPYDDPAVIAGQGTVALEMLQARPDLDAIVVGIGGGGLIAGIATAAKAIKPDIEIIGVQTERFPSMYAAVKGVAMESGHYTIAEGIAVKSPGTLTQEIVTRLVDHIELVNESDIEHAIVVLLEIEKTVVEGAGAAGLAALLRLQERRDERFRGKRLGLVLTGGNIDPLMLGELIERGMVRAGRLARIRVDLRDLPGALAQATKLIADAHANITEVHHQRAFTTLPVRNVEVDFVLQTRGHDHIQEVIAVLNAAGFAASNHDH

SEQ ID NO: 3199 - DNA, 969 bp, Bordetella parapertussis 12822
  CDS (1)..(969): transl_table=11
atgcagccccaattgcccacttatgccgacgtcgaacaggcggccgccacgctggctggcgtggcgcatcgcacccccgtgctgacctcggccaccgccgacgccatggcgggcgcgcaggtctttttcaagtgcgagaacttccagcgcatgggggcgttcaagttccgcggcggctacaacgccatcgcccgcctgacgcccgaacagcgccgcgccggcgtggtgacgttttcgtcgggcaaccatgcccaggccatcgccctggccgcgcgcctgcagggcgtgcaggccaccatcatcatgccgcaggacgcgccggcggccaagcgcgcggccaccgagggctacggcggccggatcgtcacctacgaccgctacagcgaggaccgcgaggccatcgcgcgccggctgcaggaagaaaccggcgccacgctgatcccgccctatgaccacgccgacgtgatcgccgggcaggggaccgccgccaaggaactgttcgacgaggtcggcgaactcgactacctgttcgtgtgcctgggcggcggcggactgctggcgggctcggccctggcggcgcgggccctcagcccggcctgccgcgtctacggcgtcgagccggcggccggcaacgacagccagcactccttgcgcaagggcgagatcgtcaccatcgccgcccccaagtcgatcgccgacggcgcggtcacgacgcacctgggccggctgaccttcgccatcatccagcagcaggtggcggacatcctgaccgtcagcgatgccgaactggtgcaaagcatgaggttcttcgccgagcgcatgaaaatggtggtcgaacccaccggctgcctggccgccaccgccgcgttgcgcaaactcatccccgaggcggccggcaagcgcgtcggcgtcatcatcagcggcggcaacgtcgacctgccggtctacgcgcgcctgctggccgactga

SEQ ID NO: 3200 - protein, 322 aa, Bordetella parapertussis 12822
MQPQLPTYADVEQAAATLAGVAHRTPVLTSATADAMAGAQVFFKCENFQRMGAFKFRGGYNAIARLTPEQRRAGVVTFSSGNHAQAIALAARLQGVQATIIMPQDAPAAKRAATEGYGGRIVTYDRYSEDREAIARRLQEETGATLIPPYDHADVIAGQGTAAKELFDEVGELDYLFVCLGGGGLLAGSALAARALSPACRVYGVEPAAGNDSQHSLRKGEIVTIAAPKSIADGAVTTHLGRLTFAIIQQQVADILTVSDAELVQSMRFFAERMKMVVEPTGCLAATAALRKLIPEAAGKRVGVIISGGNVDLPVYARLLAD

SEQ ID NO: 3201 - DNA, 987 bp, Bordetella bronchiseptica RB50
  CDS (1)..(987): transl_table=11
atgctcgacgtgacctccgacacctccgccgtacccgacagttccgccatcgcctacctgcacgcccagctgcagcgctgggtgcgcgccacgccgatcctggagaaaaccgatttcgagccggtggccggcatcgcggtgtgcttcaagttcgaactgctgcaggccagcggcaccttcaaggcgcgcggcgccttctcccacctgctggcgctggacgacgcgcaacgccaggccggcgcgacctgcgtctcggccggcaaccatgccgtggccgtcgcctacgcggccatgcggctgggcctgtcggccaaggtagtcatgatcaagaccgccagcccggcgcgcgtggcgctgtgccgccagtacggcgccgaggtcgtcctggccgacgacggcccgcaggccttcgagacggtgcgccgcatcgagaacgaggaaggccgctacttcgtgcatccgttcaatggctaccgcacggtgctgggcaccgccacgctgggccacgaatggctgcagcaggccggcgagctcgatgcggtcatcgtgcccgtcggcggcggcgggctgatctcgggcgtggccaccgcgatcaagctggccgcaccgcaatgccaggtcatcggcgtcgaacccgaaggcgccgacgccatgcaccgcagcttcgcggccggcggcccgatcaggatgggcccgatgcacagcatcgccgacagcctgatggcgccgcacaccgagcagtacacctacgacctgtgccggcgccacgtcgaccggctggtcaaggtggacgaccacgcgctgcgcgccgccatgcggctgctgttcgaccagctcaagctggccaccgagccggcctgcgcggccgccaccgccgcgctggccgggcccttgcgcaacgacctggccggccggcgcgtgggcgtgctgctgtgcggcaccaacaccgatccggccaccttcgcgcgccacctgggcgcggactga

SEQ ID NO: 3202 - protein, 328 aa, Bordetella bronchiseptica RB50
MLDVTSDTSAVPDSSAIAYLHAQLQRWVRATPILEKTDFEPVAGIAVCFKFELLQASGTFKARGAFSHLLALDDAQRQAGATCVSAGNHAVAVAYAAMRLGLSAKVVMIKTASPARVALCRQYGAEVVLADDGPQAFETVRRIENEEGRYFVHPFNGYRTVLGTATLGHEWLQQAGELDAVIVPVGGGGLISGVATAIKLAAPQCQVIGVEPEGADAMHRSFAAGGPIRMGPMHSIADSLMAPHTEQYTYDLCRRHVDRLVKVDDHALRAAMRLLFDQLKLATEPACAAATAALAGPLRNDLAGRRVGVLLCGTNTDPATFARHLGAD

SEQ ID NO: 3203 - DNA, 1218 bp, Bordetella bronchiseptica RB50
  CDS (1)..(1218): transl_table=11
gtgatcgatcttgccgccatccagaccgcccgggacatcctgcggggacaggtcctcaatacgccgttcacgcattcccgcacgctgtccgatatcctcggcgccgaaatctggctgaagttcgagaacctgcagttcaccgcctcgttcaaggagcgcggcgccctcaaccggatgctcaacctgaccgaggccgagcgcgccgccggcgtgatcgccgtgtcggccggcaaccatgcccagggcgtggcgtaccacgcgcagcgcatgggcgtgccggcggtgatcgtcatgccgcgcttcactcccacggtcaaggtggccaacacgcggcgcttcggcgccgaagtcgtcctggccggcgacaccttcgacgacgccaaggcgcgcggctacgaactggcgcgcgagcgcggcctggtcatgatccatccctacgacgatccagccgtgattgccgggcagggtacggtggcgctcgaaatgctgcaggcgcgcccagacctggacgccatcgtggtgggcatcggcggcggcggcctgatcgcgggcatcgccaccgccgccaaggccatcaagccggacatcgagatcatcggcgtgcagaccgagcgctttccgtccatgtacgccgccgtcaagggcgtggccatggaaagcggccactacacgatcgccgagggcatcgccgtcaagtcacccggcacgctgacccaggagatcgtcacgcgcctggtcgaacacatcgagctggtcaacgaaagcgatatcgagcatgccatcgtggtcctgctggaaatcgagaagaccgtggtcgaaggggccggcgcggccggcctggcggcgctgctgcggctgcaggaacgccgcgacgagcggttccgcggcaagcggctggggctggtgctcacgggcggcaacatcgatcccctgatgctgggcgagctgatcgagcgcggtatggtgcgcgccgggcgcctggcgcgcatccgggtcgacctgcgcgacctgccgggcgcgctggcgcaggccaccaagctgatcgccgacgcgcacgccaacattaccgaggtgcatcaccagcgcgccttcaccaccttgccagtgcgcaatgtcgaggtcgatttcgtgctgcagacgcgtggccatgaccacatccaggaagtcatcgcggtgctcaatgccgcgggcttcgcggccagcaaccacgatcactga

SEQ ID NO: 3204 - protein, 405 aa, Bordetella bronchiseptica RB50
MIDLAAIQTARDILRGQVLNTPFTHSRTLSDILGAEIWLKFENLQFTASFKERGALNRMLNLTEAERAAGVIAVSAGNHAQGVAYHAQRMGVPAVIVMPRFTPTVKVANTRRFGAEVVLAGDTFDDAKARGYELARERGLVMIHPYDDPAVIAGQGTVALEMLQARPDLDAIVVGIGGGGLIAGIATAAKAIKPDIEIIGVQTERFPSMYAAVKGVAMESGHYTIAEGIAVKSPGTLTQEIVTRLVEHIELVNESDIEHAIVVLLEIEKTVVEGAGAAGLAALLRLQERRDERFRGKRLGLVLTGGNIDPLMLGELIERGMVRAGRLARIRVDLRDLPGALAQATKLIADAHANITEVHHQRAFTTLPVRNVEVDFVLQTRGHDHIQEVIAVLNAAGFAASNHDH

SEQ ID NO: 3205 - DNA, 1212 bp, Wolinella succinogenes DSM 1740
  CDS (1)..(1212): transl_table=11
atgattccattatctaaaatcgttgaggcgcatgagcgtgtcaaaaaagtgatccaaaaaaccaaactcgcctacgcgccaagactaagtgagttaagcggagccaatgtctatctcaaaaaagagaatctccaacacacgggcgcctacaagctaagaggcgcttataatagaatcgccaccctgagccaagaggagcgagccaagggagtgattgccgctagtgcggggaatcacgctcaaggagtggcctatagcgccaaacaatttgggattcgtgcggtgattgtgatgcctgaggcaactccattgcttaaagtcacgggtgtgaagcgcttgggggctgaggtgatcttagcgggcaacaactacgatgaggcctatgcccatgcactagagtgcgccaaggagcaggagctgtgctttatccacccttttgctgatgatgaggtgatcgcagggcaggggacggtggctttggagatgatcgaggagaagagcaacatccaaaccgtagtgcttcctatcgggggcggggggctcatctcgggcgtggcagcggcgtataagcagatgcttcccaatgtgagaatcattggtgtgacggccaagggagcgccagccatgcacgattctttccatgccaagaaaatcgtttctgtcaaaggcgtgaagacaatcgccgatggaatcgccgtcagagatgtcactcctagaaattttgagtacatcttagagggcgtggatgatgtggtgcaagtggatgatgaggagatcgctaacgcggtcttgtatctattagagaatcaaaagcttgttgttgaaggcgcaggagcggttggtgtggcggctttgttgcacgagaagttgcccgtgagcaagggtgagaatgtcgctatcgtgctaagcggcgggaatatcgatgtgacgatgctcagtgtcatcatcgagaagggtctcatcaaatcccagcgcaagatgaagtttagcgtcatcttggtggacaagcctggaagcctcaaagggctcacggatattctctcgcaagtgggggctaatattgtgcgaatcgactatgatcgcacctctacctctttggcttacggggatgccaatgtcactatcgcgctagagaccaaggggggagagcaccaggaggagattcgccaagagctctggaaatatcactatcgattcgtcgaaatcgattag

SEQ ID NO: 3206 - protein, 403 aa, Wolinella succinogenes DSM 1740
MIPLSKIVEAHERVKKVIQKTKLAYAPRLSELSGANVYLKKENLQHTGAYKLRGAYNRIATLSQEERAKGVIAASAGNHAQGVAYSAKQFGIRAVIVMPEATPLLKVTGVKRLGAEVILAGNNYDEAYAHALECAKEQELCFIHPFADDEVIAGQGTVALEMIEEKSNIQTVVLPIGGGGLISGVAAAYKQMLPNVRIIGVTAKGAPAMHDSFHAKKIVSVKGVKTIADGIAVRDVTPRNFEYILEGVDDVVQVDDEEIANAVLYLLENQKLVVEGAGAVGVAALLHEKLPVSKGENVAIVLSGGNIDVTMLSVIIEKGLIKSQRKMKFSVILVDKPGSLKGLTDILSQVGANIVRIDYDRTSTSLAYGDANVTIALETKGGEHQEEIRQELWKYHYRFVEID

SEQ ID NO: 3207 - DNA, 996 bp, Gloeobacter violaceus PCC 7421
  CDS (1)..(996): transl_table=11
atgtcctcatccgcccccactttgccggtgagtttcggcgatatccaggcggctgctgaccgtttgaggggagtcgctcaccgcacgccggttctgacttcgcgtacggtggacgacctgactggagcgcaggtcttcttcaagtgcgaaaatttccaacgcatgggggcgttcaagttccggggagcctacaatgccctctcgcaactggacaaagcgcaaaggcggcgcggggtgctcgcctactcctccggcaaccacgcccaggcgattgccctggcgggacaaatcctggagattccaacgacgatcgtgatgcccagcgacgctccggcggtcaagcggcgtgccaccgaaggttacggcggcgaggtgatcctttacgagcggtctgaaaccacccgcgaagccctcgccgaccaactggcgcgcgaacggggactggcggtgatcccgccctttgaccacccccaggtggtagcagggcagggaaccgccggattggaacttttcgagcaggtgggggcgctcgatgtgctcgtcgtctgctgcggcgggggcggcttgctctcaggatgcgccatcgccgcggcggccgtgagccccggttgtcaggtagtcggggtcgaacccgcgcaggcggacgatgcgatgcgctcgttttatacgggcgtcctgcacacagtccacaaccccgccacgatcgccgatggggcgcgcactccatcgctgggagccgtcacctttccactggtgcgccactacgttcatcagatggtgaccgtggaggaggaagcgatcgtgcgggcgatgctgtttttgtgggagcggctcaagatcgtcgtggagcccaccggtgcccttggggcggcagcccttttcgaaggccgggtgcaggcagcggacaggcgcgttggagtcattattagcggtggcaacgtcgatttgcagcttctccatgaattcatacgcgatatcgataaggggtacagttaa

SEQ ID NO: 3208 - protein, 331 aa, Gloeobacter violaceus PCC 7421
MSSSAPTLPVSFGDIQAAADRLRGVAHRTPVLTSRTVDDLTGAQVFFKCENFQRMGAFKFRGAYNALSQLDKAQRRRGVLAYSSGNHAQAIALAGQILEIPTTIVMPSDAPAVKRRATEGYGGEVILYERSETTREALADQLARERGLAVIPPFDHPQVVAGQGTAGLELFEQVGALDVLVVCCGGGGLLSGCAIAAAAVSPGCQVVGVEPAQADDAMRSFYTGVLHTVHNPATIADGARTPSLGAVTFPLVRHYVHQMVTVEEEAIVRAMLFLWERLKIVVEPTGALGAAALFEGRVQAADRRVGVIISGGNVDLQLLHEFIRDIDKGYS

SEQ ID NO: 3209 - DNA, 969 bp, Photorhabdus luminescens subsp. laumondii TTO1
  CDS (1)..(969): transl_table=11
atgaaaaatatttctgtttatgatgatgtcattgccgccgcccggcgaatagaagcttatgcttaccgtacgccagtcctgacttcccgcactgctaatgaaatgacaggagccaggttatttttcaaatgtgaaaattatcagcgaatgggagcctttaaatttcgtggtgcttttaatgcgttatcacaatttaatgatgaacagcgccgcaatggggttgtcacttattcatcgggtaatcatgctcaggcaatttcattggcggctcgtatactgaatatttcggcgacaatcatcatgccgttcgatgcgccagtggctaaggtcgccgcgaccgaaggttatggtggcaaaattgttttctatgatcgttatacggacgatcgtgaacaaattagccgtgaattatcagaaaagcagggattgaccttaattcctccctatgatcatccgcatattattgccggacagggaactgcggcaaaagagttgtttgaagaggtcggtgaactgaatgcgttgtttgtctgtctcggtggaggagggctgctttcaggcagtgcgcttgcagctcgccatttctctcctgaatgtaaaatttatggtgtagaaccggaaaccggtaatgacgctcagcaatcatttcgtcagggcaaaattattcacatcgatacgcctaaaactattgctgatggcgcacaaactcaacatcttgggcaatatactttcgatattattcgaaaaaatgttgatgatattttcactgtttctgatgaagaattggtggatgcaatgcgattttatgcagaaagaatgaagatgattgtcgaaccgaccggctgcttgagttttgccgctgcccgcaaaatgtgtgagtcattgcgaggccaaaaggtagggattattgtcagtggcggtaatgtggatatcgaacgttactgctcgttgctggcaaaacaaccttag

SEQ ID NO: 3210 - protein, 322 aa, Photorhabdus luminescens subsp. laumondii TTO1
MKNISVYDDVIAAARRIEAYAYRTPVLTSRTANEMTGARLFFKCENYQRMGAFKFRGAFNALSQFNDEQRRNGVVTYSSGNHAQAISLAARILNISATIIMPFDAPVAKVAATEGYGGKIVFYDRYTDDREQISRELSEKQGLTLIPPYDHPHIIAGQGTAAKELFEEVGELNALFVCLGGGGLLSGSALAARHFSPECKIYGVEPETGNDAQQSFRQGKIIHIDTPKTIADGAQTQHLGQYTFDIIRKNVDDIFTVSDEELVDAMRFYAERMKMIVEPTGCLSFAAARKMCESLRGQKVGIIVSGGNVDIERYCSLLAKQP

SEQ ID NO: 3211 - DNA, 996 bp, Rhodopseudomonas palustris CGA009
  CDS (1)..(996): transl_table=11
atgccggccatgacccattccgctgtgctgcccgtttccgtcgccgatatcgatgcggctgccgaggtgctcgcgcccgtcgcggtgcggacgccgctgctgtcgtcgccggcgctcgatgccgccaccggcgcgcgcgttttccttaaaccggaagtcttgcagcgcaccggctcgttcaagtttcgcggcgcctacaacaaactggcgtcgctgtcgccggagctacggcgtgccggcgtggtcggattcagctccggcaatcacgcccagggcgtcgccgcggcggcgcagctgctcggcgtccacgccaccatcgtgatgccgtcggatgcgcctgcctcgaagcgcgaacgcaccgccggctttggcgccgaggtggtgctgtatgatcgcgaccgcgaggatcgcgaagcgatcgctcgcgacattgccgagcgcagcggcgcgacgttggtgcggccgttcgacgatccgatggtgatcgccgggcagggcacggtcggccgcgagatcgccgaggaccttgctgcgctggggctcgcgccggatctggtggtggcgccggcctccggcggcgggctgatcgccggcacagcgcttgccgtcaaggcgcggtttccccaggcgctggcgatgtcggctgagccggagggcttcgacgaccacgcccgctcgctggtggcgggacgccgcgagtccaatccggccggcggacgcacgatctgcgatgcgttgatgatgtcgatcccgggcgaggtcaccttcgcgatcaatcgcgtgctgctcgccggcggcgtggccgcgtccgatgccgaggtcggcactgcggtcggcttcgcattccgcgagctgaagctggtggtggagccgggcggagcggtggcgctcgcggcattgctcgccggcaagctcgacgtccgcggcaagaccgtcgcgatcgtgctgtcgggcggcaatgtcgatgctgacctgttcagccgcctgatcgcctga

SEQ ID NO: 3212 - protein, 331 aa, Rhodopseudomonas palustris CGA009
MPAMTHSAVLPVSVADIDAAAEVLAPVAVRTPLLSSPALDAATGARVFLKPEVLQRTGSFKFRGAYNKLASLSPELRRAGVVGFSSGNHAQGVAAAAQLLGVHATIVMPSDAPASKRERTAGFGAEVVLYDRDREDREAIARDIAERSGATLVRPFDDPMVIAGQGTVGREIAEDLAALGLAPDLVVAPASGGGLIAGTALAVKARFPQALAMSAEPEGFDDHARSLVAGRRESNPAGGRTICDALMMSIPGEVTFAINRVLLAGGVAASDAEVGTAVGFAFRELKLVVEPGGAVALAALLAGKLDVRGKTVAIVLSGGNVDADLFSRLIA

SEQ ID NO: 3213 - DNA, 1209 bp, Geobacter sulfurreducens PCA
  CDS (1)..(1209): transl_table=11
atgctcccctacacactgattcaggaagccgacgaccgactcaggaagcgggttcgtcgcaccgagctcatccactcccatcacttcagcgagaaactgggaatcccgatctatttcaagtgcgagaacctccagcgcaccggtgcgttcaagatccgaggcgccctgaacttcatgacgtcgcagccgcgggaggcactggcaaagggtgtcattaccgcttctgccggtaaccatgcccaaggagtcgcgttctcggccgacctgctgggagtgccgtccacggtgttcatgccggaaagcacgccgccgcagaaggtctttgccacccgtgactacggcgccgaggtggtactcaccggccgcaacttcgacgaggcatacgctgcagcggtccaggcgcaggaggaacggggcgccctcttcgtccacccctttgacgacccgctcgtgatggccgggcaaggcaccatcggcctggaagttctccaggagcttcccgatgtagccaatatcctcgtccccatcggcggcggcggtctcatcgcgggcatcgccacggccatcagagaaacccacccccacgtgcggatcatcggcgttgaaacagcggcggccccatccgcccactattcgctgcaaaaggggaagatcgtccaggtccccgtgacggtcacccttgccgacggcatcgcggtcaagaagccaggggtgaacacctttcccatcatcagggacttggtggacgaggtggtcttggtggaagaagaggagatcgcccttgccatcgtggcgctgctggagcgaaccaagctcttggtcgagggggccggggccgttccgttggccgcgcttctcaaccggcgggtgactgatctttcgggaaaaacggtctgcgtgctgtcgggcgggaatatcgacgtgaagaccatctcagtagtggtggaacggggtctggtggctgccgggcgctacctgaagctgaaggtggagctggacgatctccccggtgccctggcgcgacttgcgacggaaattgccgaggctaaagccaacatctccatcatcacccatgaccggcgctcgaaatcgctccccatcggcaagaccgaggtcctcatcgagctggagacccgggggttcgagcacattcaggaggttatctctcacctgcagggggtggggtatctggtggatgtgctgaaataa

SEQ ID NO: 3214 - protein, 402 aa, Geobacter sulfurreducens PCA
MLPYTLIQEADDRLRKRVRRTELIHSHHFSEKLGIPIYFKCENLQRTGAFKIRGALNFMTSQPREALAKGVITASAGNHAQGVAFSADLLGVPSTVFMPESTPPQKVFATRDYGAEVVLTGRNFDEAYAAAVQAQEERGALFVHPFDDPLVMAGQGTIGLEVLQELPDVANILVPIGGGGLIAGIATAIRETHPHVRIIGVETAAAPSAHYSLQKGKIVQVPVTVTLADGIAVKKPGVNTFPIIRDLVDEVVLVEEEEIALAIVALLERTKLLVEGAGAVPLAALLNRRVTDLSGKTVCVLSGGNIDVKTISVVVERGLVAAGRYLKLKVELDDLPGALARLATEIAEAKANISIITHDRRSKSLPIGKTEVLIELETRGFEHIQEVISHLQGVGYLVDVLK

SEQ ID NO: 3215 - DNA, 1212 bp, Bdellovibrio bacteriovorus HD100
  CDS (1)..(1212): transl_table=11
atgaaagtcagctttgcagacatccaaaaagcccgtgaacttctgaaagacatcatctgtccaaccgagatgagtcattccatcagcgccagcaacctgcttaaaagcgaagtgtacctgaagtttgaaaacactcagcgcacgggaagttttaaattccgcggggcctataacaaaatctccaatctgacagccgacgaaaaagcccgcggtgtggtcgccagctctgccggaaatcacgcgcaaggtgtcgccctgtcagcgaaactggccggagtcaaatccaccatcgtgatgccggagacagcctcgatcagcaaagcttccgcgacccgtgattacggcgccaacgtcgtgcttaaaggcgagatctacgacgaggctttcgaacatgcccagaaactggaaaaagaacacggctacaccttcgtgcacccttatcaggacccttatgtgatcgctggccagggaaccatcgggatcgagatcctggaaaaggttccagacctggatacggtgattgtgcccatcgggggtggcggtctgatcagtggtgtggcgttggcggtgaaggccatcaatccaaagatccgcgtgatcggtgtgcaaagcgaccgctctccgggaatggcgcatctttataacaaacagcctttgtcccagatcaaacgtgccgccacgattgctgacggcattgcgatcaaaaacccttcccaggtgatgctggacagtttcatttccaagtatgtcgatcaggtggtgacagtcagtgatgacgagatcgctgaagcgattgtgttcctgatggaaagagccaaaaccgtagctgaaggctctggcgcagcggcgatggcagctgcgatgtcccgcggactggatctgggtaaaaagacctgtgtgattatcagcggtggaaatatcgatctgaacatcgtttcaaagatcatcgaccgtggtcagattctgcgcggacgcctgtgtgagttgtccgtgattgtggatgaccttccggggaatttgagccgtttgactcaggcaattgcctctcaaaaagccaacatcctggaagtgcgtcacgaccgtgtgtcgaaggggctttcactgcgtgaaacccgcatcgacttcgttctagagactacgagcattgaacatgttgaacggattaagcgggctcttgaggaaactggagccaaggttatccaaagcacctaa

SEQ ID NO: 3216 - protein, 403 aa, Bdellovibrio bacteriovorus HD100
MKVSFADIQKARELLKDIICPTEMSHSISASNLLKSEVYLKFENTQRTGSFKFRGAYNKISNLTADEKARGVVASSAGNHAQGVALSAKLAGVKSTIVMPETASISKASATRDYGANVVLKGEIYDEAFEHAQKLEKEHGYTFVHPYQDPYVIAGQGTIGIEILEKVPDLDTVIVPIGGGGLISGVALAVKAINPKIRVIGVQSDRSPGMAHLYNKQPLSQIKRAATIADGIAIKNPSQVMLDSFISKYVDQVVTVSDDEIAEAIVFLMERAKTVAEGSGAAAMAAAMSRGLDLGKKTCVIISGGNIDLNIVSKIIDRGQILRGRLCELSVIVDDLPGNLSRLTQAIASQKANILEVRHDRVSKGLSLRETRIDFVLETTSIEHVERIKRALEETGAKVIQST

SEQ ID NO: 3217 - DNA, 1227 bp, Mycoplasma mycoides subsp. mycoides SC str. PG1
  CDS (1)..(1227): transl_table=4
atgtcgcatccattttcagtagatgaaattaaacaaattcatcaagaaatttctaaaataattcattatacacctttacattatgcagataaattatcagctttaactggtaataatatttatttaaaattagaaaatttacaaaaaacaggaagctttaaattaagaggagcaactaataaaattaataaactaactaatgaagaaaaagaacatggaattattgcagctagtgctggaaatcatgcacaaggtgtagcttatgcagctactaatttagggttaaaatcaacaattgttatgcctgaaaatgccccaatggcaaaaattcaagcaacagaaaaatatggtggaaaagttgttctaagtggaagattttttgatgatgctttagctaaagcaattgaattaaaagaaaaagaaaatctaactttaattcatgcttttgatgatattgaaattattaaaggtcaagctactattacatatgaaattgatcaacaaattaaaaacatcgattattgtttagtaccaattggtggtggtggattaatgagtggtattgctacttatttaaaacaagttaatccaaatattaaaatgattggtgttgaagctgctaatgttaattcctatcaacaagcaaaagctttgagtagaccagtgatggttgattctaaaccatcaatagcagatggaattgctgttaaaaaagttagtgatttaactttttcaatattaaatcaatatgttgatgatgtagttgttgtaagtgaagaagaaattgctgaagcaatgttatttttaatggaaaattgtaagtttgtaactgaaggttcaggagcagttactgctgctgctttaatgtttgataaattaaatattaaaaatcaaaataaaacaatagttggtttagttagtggtggaaatattgatattgcaatggttggtaatattattaataaagctttaattaaaactaatagaagattagtattatcagttaatataacatcagataataaagaaatactaaaaataattaatattattaattcttgtggagctaaaatttttaaaataaaaactaatagagatattatgtatttagaattaagtgaaattcatgcaacatttattattgatttatcaaatactgatcaacaacagcaaatcattgacaaaattattcaagctaattacaaaattacaagcattacagattaa

SEQ ID NO: 3218 - protein, 408 aa, Mycoplasma mycoides subsp. mycoides SC str. PG1
MSHPFSVDEIKQIHQEISKIIHYTPLHYADKLSALTGNNIYLKLENLQKTGSFKLRGATNKINKLTNEEKEHGIIAASAGNHAQGVAYAATNLGLKSTIVMPENAPMAKIQATEKYGGKVVLSGRFFDDALAKAIELKEKENLTLIHAFDDIEIIKGQATITYEIDQQIKNIDYCLVPIGGGGLMSGIATYLKQVNPNIKMIGVEAANVNSYQQAKALSRPVMVDSKPSIADGIAVKKVSDLTFSILNQYVDDVVVVSEEEIAEAMLFLMENCKFVTEGSGAVTAAALMFDKLNIKNQNKTIVGLVSGGNIDIAMVGNIINKALIKTNRRLVLSVNITSDNKEILKIINIINSCGAKIFKIKTNRDIMYLELSEIHATFIIDLSNTDQQQQIIDKIIQANYKITSITD

SEQ ID NO: 3219 - DNA, 1002 bp, Bacillus cereus ATCC 10987
  CDS (1)..(1002): transl_table=11
atgataactaaaaaactaccattacatatagacgatattaaaaaagcgcaaaacattctggatagaaatgctcgtaaaactccattagtaaaatcattttacttgactagtaaaacaggcggagaaattcacttgaaattagaaaatatgcaattaacaggttcgtttaaattccgtggtgcgtttaacaaaatgtcacagctgacagatcaagaaaaagagaggggagtaattgcttgttctgctggtaatcatgcgcaaggaattgctttatcagctcatttactcggtattaaaagtaaaattattatgccaatttctgcacctcaggcgaaagttgaagcaacaaaaggatatggatctgaagtgattttacatggtgaaacctttgatgatgcaaaggcaaaatgtgaagagataataagagaaacaggtgaaacatatttacatccatatgatgatgtagaggtaatggctggtcaaggtacaattggattagacattcttgatgatatgtgggatgtagatactgtcattgtaccaataggtggaggcggaattatttctggtattgctgtagcattgaaatcttttaatccatcaatcaatataattggtgtacaagcagaaaatgttcatgggatgaaggcttcttatgacaaaggtacgattgtagagcattatgaggcacctacaatagcagatggttgcgcagttaaaatacctggtaacttaacttttgaagtagtaaaagaattagtagatgatattgtaacagtatcagaaggtgaattagaagtagcgatgaaagacttattacaacgtggtaaagctgttgtagaaggggctggcgcattagctactgctgctctacttgcagggaaagttgatagttatataaaagggaaaaaagtagtagctgttatatctggtgggaacgtggacttacagcgcatatcaagtgtatgtgagcacttttttgtcgctaatgaagtgaaatag

SEQ ID NO: 3220 - protein, 333 aa, Bacillus cereus ATCC 10987
MITKKLPLHIDDIKKAQNILDRNARKTPLVKSFYLTSKTGGEIHLKLENMQLTGSFKFRGAFNKMSQLTDQEKERGVIACSAGNHAQGIALSAHLLGIKSKIIMPISAPQAKVEATKGYGSEVILHGETFDDAKAKCEEIIRETGETYLHPYDDVEVMAGQGTIGLDILDDMWDVDTVIVPIGGGGIISGIAVALKSFNPSINIIGVQAENVHGMKASYDKGTIVEHYEAPTIADGCAVKIPGNLTFEVVKELVDDIVTVSEGELEVAMKDLLQRGKAVVEGAGALATAALLAGKVDSYIKGKKVVAVISGGNVDLQRISSVCEHFFVANEVK

SEQ ID NO: 3221 - DNA, 990 bp, Yersinia pestis biovar Medievalis str. 91001
  CDS (1)..(990): transl_table=11
ttgaaaataaaatttaaaggaatcgagatgaatacgttgtttgatgccatcagagaggcccaccagatattacgcccacaagtgagagtcacgccgttggagcatagcccactgctatctcaacacagcggttgtgagatctatcttaaatgtgagcacctgcagcacaccggttcttttaaatttcgtggggccagtaacaagttacgtttactcaatgaggcacaacgccagcaaggtgtgatcaccgcctccaccggtaaccatgggcaaggtgtggcgctggccgcaaaactggcggggattaaatccactatttacgccccagaacaggcggcagccatcaagctggatgtgatccgtgcactgggggggcaaattgaattagtctccggagatgccttaaatgctgaactggccgccggtatcgccgctgagcaacaaggtaaagtgtatatctcaccgtataacgacccgcaggtcattgccgggcaaggcacctgtggcatggagatggtcgaacagcagcccgatcttgatgcggtgtttgttgccgttggtggtggtggcctgatttcaggtattgcgaccgtattgaaaacattatcggataaaacgcaggtgattggttgctggccagccaatgccaccagcctgtatacctgtctggagaaaggacagattcaggaggtggcagagcaagaaacgctgtctgacggaaccgccggtggtatcgaaccgggagcgatcacctttgcactgtgccaacagttaatcgatcagaaggtgctggtgagtgagcaagaaatcaaagaggccatgggtttgattgcccgtactgaccgctggatgattgaaggtgccgccggtgtggcactggctgcggcactgaaattggctccgcaatggcaaggtaagaaagtggcggtggtgttgtgcggtaaaaatatcgtgctggagaaatatctgggagctgtcagcggatgctaa

SEQ ID NO: 3222 - protein, 329 aa, Yersinia pestis biovar Medievalis str. 91001
MKIKFKGIEMNTLFDAIREAHQILRPQVRVTPLEHSPLLSQHSGCEIYLKCEHLQHTGSFKFRGASNKLRLLNEAQRQQGVITASTGNHGQGVALAAKLAGIKSTIYAPEQAAAIKLDVIRALGGQIELVSGDALNAELAAGIAAEQQGKVYISPYNDPQVIAGQGTCGMEMVEQQPDLDAVFVAVGGGGLISGIATVLKTLSDKTQVIGCWPANATSLYTCLEKGQIQEVAEQETLSDGTAGGIEPGAITFALCQQLIDQKVLVSEQEIKEAMGLIARTDRWMIEGAAGVALAAALKLAPQWQGKKVAVVLCGKNIVLEKYLGAVSGC

SEQ ID NO: 3223 - DNA, 1020 bp, Oryza sativa (japonica cultivar-group)
  CDS (1)..(1020)
atggggagcagaggtggaagtggcggcgatggcgcagaaagccatggctatgccgcggacatccactccatcagggaggcgcaggctcgcatcgcaccatacgtgcacaagacgcccgttctgtcatcaacatcgatcgatgccatagtggggaagcagctgttcttcaagtgcgagtgcttccagaaggcaggggcgttcaagatccgaggcgcttccaattcgatatttgcgcttgatgatgatgaggcatccaagggcgttgtgacgcatagcagtgggaaccatgctgctgcagtggctcttgctgcaaagctacgcggaatacctgcttacattgtcattccaagaaatgcaccggcatgtaaggttgacaatgttaagcggtacggtggccatattatctggagtgatgtctccattgaatcaagagaatctgttgctaaaagagttcaggaggaaactggtgctattcttgttcacccattcaataataaaaacactatcagtggtcaaggtacagtgtctctcgaacttttggaggaagtccctgaaattgacacaataattgttccaatcagtggtggtggtttaatttctggtgtggcactggctgccaaggccataaacccttcaatacgtattctggcagcagaaccaaagggtgctgatgattctgcccagtccaaggctgctggaaagatcataacattgccttcaaccaacaccattgctgatggacttcgagcttttcttggtgacctgacatggccggtggtgcgcgacttggtggatgatatcattgttgtggatgacaatgccattgtggacgccatgaaaatgtgctacgagatgctgaaggtggctgttgagccgagtggagcaataggcctcgcagccgccctctctgacgagtttaagcaaagctctgcttggcatgagagcagtaagatagggatcattgtttctggaggcaatgttgacctcggtgtcctctgggagtctctctataaacgttga

SEQ ID NO: 3224 - protein, 339 aa, Oryza sativa (japonica cultivar-group) [sequence omitted]

SEQ ID NO: 3225 - DNA, 972 bp, Yarrowia lipolytica CLIB99
  CDS (1)..(972)
atgactggcgaaggaatcacctacaaggatgtcaagcacgcacacaagcgactcgacaaggtcgccgtcaagacacccgtgctgtcgatccagctcgacgacactcaatactttctcaagtgcgagaatatccagcgaaccggagccttcaagttccgtggagcctacaatgccttgtcgcagttctcgtccaagcaaaaggccggtggagtactaacgtactcatctggtaaccatgctcaggccattgcccatgctgctgccatgctcggaatcaaggccaccatcatcatgcccacggatgcccctaaaagcaagttgcaaggtaccaaggacctgggggctacaattgtgccctacgacagatacaaacaggaccgtgacgaggtagccaatgcaattctcacggaacatcccgaaatgacgctcattcctccatatgatcatcccgacatcatcgcaggacaaggtacagtggtcaaggagctgctagaggaaacaggacctctggacgatatctttgtgccgctgggtggaggaggactgctggcaggctcccttctggcagcagaaaaactcgctccaaagtgtaaggtgtggggtgtggagcccgagacaggaaacgacggtaagctgtcacttcaaagaggccaaatcgtgcatattgacaccccggtgacgattgccgacggtgctcagacccagcatctgggagaactcaccttccccatcattcagagacttgtcacggatatcaagacggtcaacgagggagagatgattgctatgacgcaatggtacgcccgaaagatgaagctggtggtggagccaactggatgcatggctttggcagcggcgttctcgtgctgtggaggcacccacaagaagcgagtgggagtcatcatcagtggaggaaacgtggatctcgataagtatgccacctatctaaccactccggtcgttcagcattga

SEQ ID NO: 3226 - protein, 323 aa, Yarrowia lipolytica CLIB99
MTGEGITYKDVKHAHKRLDKVAVKTPVLSIQLDDTQYFLKCENIQRTGAFKFRGAYNALSQFSSKQKAGGVLTYSSGNHAQAIAHAAAMLGIKATIIMPTDAPKSKLQGTKDLGATIVPYDRYKQDRDEVANAILTEHPEMTLIPPYDHPDIIAGQGTVVKELLEETGPLDDIFVPLGGGGLLAGSLLAAEKLAPKCKVWGVEPETGNDGKLSLQRGQIVHIDTPVTIADGAQTQHLGELTFPIIQRLVTDIKTVNEGEMIAMTQWYARKMKLVVEPTGCMALAAAFSCCGGTHKKRVGVIISGGNVDLDKYATYLTTPVVQH

SEQ ID NO: 3227 - DNA, 936 bp, Thermus thermophilus HB27
  CDS (1)..(936): transl_table=11
atgccttccctccaagacctctacgccgccttccgccgcatcgccccccacacccaccgcacccccctcctcacctcccgcctcctggacgggcttttgggaaagcgcctcctcctcaaggccgagcacctgcagaaaacggggagcttcaaggcccggggagcgctttccaaggccctcgccctggaaaaccccaaggggctcctcgccgtctccagcggcaaccacgcccagggggtggcctacgccgcccaggtgctcggggtgaaggccctggtggtcatgcccgaggacgcgagcccctacaagaaggcctgcgcccgggcctacggggccgaggtggtggaccggggggtgacggcggagaaccgggaggaggtggcccgggcccttcaggaggaaacgggctacgccctgatccacccctttgacgaccccttggttatcgccgggcaagggacggcggggcttgagcttctggcccaggcggggcggatgggggtcttccccgaggccgtcctcgcccccgtggggggcggggggctcctcgcgggcctggccacggcggtgaaggccctctcccccacgaccctcctcctcggggtggagcccgaggtcgcggacgacgccaggaggagcctggaggcgggaaggcttttccgcttggaagcgccccccaggacccgggcggacggggtgcggacgctaagcctgggggagcacaccttccccatcctcaaggagaaggcggacgggatccttgtggtgagcgaggaggcgatcctcgaggcggagcgcctcctcttcacccgcaccaagcaggtggtggagcccacgggggcccttcccctggccgcggtgctggagcacggggcgaggcttccccaaaccctcgccctcctcctctccgggggcaaccgggacttctctccctag

SEQ ID NO: 3228 - protein, 311 aa, Thermus thermophilus HB27
MPSLQDLYAAFRRIAPHTHRTPLLTSRLLDGLLGKRLLLKAEHLQKTGSFKARGALSKALALENPKGLLAVSSGNHAQGVAYAAQVLGVKALVVMPEDASPYKKACARAYGAEVVDRGVTAENREEVARALQEETGYALIHPFDDPLVIAGQGTAGLELLAQAGRMGVFPEAVLAPVGGGGLLAGLATAVKALSPTTLLLGVEPEVADDARRSLEAGRLFRLEAPPRTRADGVRTLSLGEHTFPILKEKADGILVVSEEAILEAERLLFTRTKQVVEPTGALPLAAVLEHGARLPQTLALLLSGGNRDFSP

SEQ ID NO: 3229 - DNA, 1206 bp, Picrophilus torridus DSM 9790
  CDS (1)..(1206): transl_table=11
atggaattcgatgatatattatatgcaaaatcagttgtatcaaggtatctgcacaggacgcctgtttttcattcaaagaccttcagcgacatgttccacggagatatattttttaaaatggagaatttccagaagaccggctcatttaaatcaaggggtgcagttacaaagttctcaaggttaagcgatgaggaactaaaaaacggtgtcataacggcaagcgctggaaaccatgcgcagggcgttgcatatgccgcatcgatctttaaaacagatgcaaagatagtaatgcctgaaaacacaacaccggcaaaggtaaacgctgttgaggcatacggcggccatgtgatactaaccgggagatcatacgatgaatcacatagccatgcattaaaaatagcaatggatgaaaatagaacatttatagaggcatacaatgatgaggccattatagcaggccagggtacaatagcacttgagctctttgaggatcttggaaatcttgatcagataatagtgcccattgggggtggcggtttaatatccgggatagcctttgccgcaaagcacataaatccaaatgtaaaaatcataggggtcgaatcagaaaaggcaaatgcaatgatgctatcattaagggaaaacagaatagttccatacacaagctctgatacaatagccgatggcatagccgtgaaatatcccggggatataacatttgacattgtaaaaaactatgttgacgatgttgttacagtaaatgatgaaagcatagcctattcattgtttaaactgcttgagcgtgaaaaggttcttgttgagccatccggggcagttggtcttgccgcactctacgagggtaagatagactcagaatcaaagaaaactgcaataatactatcaggcggaaacataaattttctgctgctatcaaaaattatatacaaatccatggagatggagaataaattaataaggcttgagttcaaccttcctgacaggccgggaaccatggtaaaaatagtaaacgcaatatcaagcgttggcgcaaatatataccatgccgaggtcgataatttaaaaaagaacacgcctataggctatcaaaatcttacatttaccgtaaacatagttgacgcaaatagaatagaaaaactattgaacgcactggactcccttggatataaatataatataataaattaa

SEQ ID NO: 3230 - protein, 401 aa, Picrophilus torridus DSM 9790
MEFDDILYAKSVVSRYLHRTPVFHSKTFSDMFHGDIFFKMENFQKTGSFKSRGAVTKFSRLSDEELKNGVITASAGNHAQGVAYAASIFKTDAKIVMPENTTPAKVNAVEAYGGHVILTGRSYDESHSHALKIAMDENRTFIEAYNDEAIIAGQGTIALELFEDLGNLDQIIVPIGGGGLISGIAFAAKHINPNVKIIGVESEKANAMMLSLRENRIVPYTSSDTIADGIAVKYPGDITFDIVKNYVDDVVTVNDESIAYSLFKLLEREKVLVEPSGAVGLAALYEGKIDSESKKTAIILSGGNINFLLLSKIIYKSMEMENKLIRLEFNLPDRPGTMVKIVNAISSVGANIYHAEVDNLKKNTPIGYQNLTFTVNIVDANRIEKLLNALDSLGYKYNIIN

SEQ ID NO: 3231 - DNA, 1002 bp, Bacillus thuringiensis serovar konkukian str. 97-27
  CDS (1)..(1002): transl_table=11
atgataactaaaaaactaccattacatttagacgatattaaaaaagctcaaagcattctggatagaaatgctcgtaaaactccattagtaaaatcattttatttgactagtaaaacgggtggagaaattcacttgaaattagaaaacatgcaattaacaggttcgtttaaattccgtggtgcgtttaataaaatgtcacagctgacagatcaagaaaaagagagaggagtaattgcttgttctgctggtaatcatgcgcaaggaattgctttatctgctcatttactcggtattaaaagtaaaattgtaatgccgatttctgcacctcaggcgaaagttgatgcaacgaaaggatatggatctgaagtggttttacatggtgaaacctttgatgatgcgaaggcaaaatgtgaggagattattagagaaacaggtgaaacatacttacatccatatgacgatgtagaagtaatggctggtcaaggtacaataggattagatattcttgatgatatgtgggatgttgatacggtcattgtaccaattggtggaggaggaattatttctggaattgctgtcgcattaaaatcttttaatccgtcgattcatataattggtgtgcaagcagaaaatgttcatgggatgaaggcatcttatgacaaaggcaaaattatagaacattatgaggcacctacgatagcagatggttgcgcggtaaaaataccaggcaatttaacttttgaagttgtaaaagaattagtagatgatattgtaacagtatcagaaaaagagctggaagtagcgatgaaagacttattacaacgcgggaaagctgttgtagaaggtgcaggcgcattagctactgctgctctacttgcagggaaagtggatacatatattaaagagaaaaaagtagtagcagttatatctggtgggaacgtagacttacagcgcatatcgagtgtttgtgaacaattttttgtggcgaatgaagtgaaatag

SEQ ID NO: 3232 - protein, 333 aa, Bacillus thuringiensis serovar konkukian str. 97-27
MITKKLPLHLDDIKKAQSILDRNARKTPLVKSFYLTSKTGGEIHLKLENMQLTGSFKFRGAFNKMSQLTDQEKERGVIACSAGNHAQGIALSAHLLGIKSKIVMPISAPQAKVDATKGYGSEVVLHGETFDDAKAKCEEIIRETGETYLHPYDDVEVMAGQGTIGLDILDDMWDVDTVIVPIGGGGIISGIAVALKSFNPSIHIIGVQAENVHGMKASYDKGKIIEHYEAPTIADGCAVKIPGNLTFEVVKELVDDIVTVSEKELEVAMKDLLQRGKAVVEGAGALATAALLAGKVDTYIKEKKVVAVISGGNVDLQRISSVCEQFFVANEVK

SEQ ID NO: 3233 - DNA, 1005 bp, Erwinia carotovora subsp. atroseptica SCRI1043
  CDS (1)..(1005)
atgacaagcaaataccaaagagcaaccgactctgtaacgttgaaagatatttacacggcatctcagcagattaaaacgacgatacgcagaacgccgctagaccgctcgcaggaattatccgctcttgttggtgcagaaattcggctcaagatggaaaacctccaacagaccggtagcttcaagttacgtggcgcggcaaacgttcttgccaatctgggtgcagaacaacgccgtattggcgtcatcgccccaacggcaggaaatcacggattagggctcgcctatgccggacaagtggcgggcgtccccgtaaccatctttttgccacgctcagcagacccgatgaaagtcgcggccatgaaaggttgtggtgcccacattacgttttttgatgacatcgaagaagcgaggcaggcggcaatagcagcagcgcaacagtctagtgctaccttcgtttcagcctacgataatccgcatatgattgctggtggcggcaccgtcggccttgagattatggaagactggatggatgcagagataatcctggtgaatatcggcggcggcgggcttatttcggggattgcgacggcagtaaaagcaatcaaccccgcgatcgaagtatgggggatacaaagtgaagtcagcccgacatttgcccgttggaaagacgccggtgaaacgcttcccgtcgaactgactccctccatcgctgagggcgttagcggctatattgagcccagtgcgatgacctggccgctggttcgtgaccgtgtcgatcgcgtgctcacggtatcagaagttgaaatcaaagccgcaatgctgtcaatgctcgaacttcaccgtcatgttgtcgaaccttcaggggtgccagccgtcgcgggagccattcgctacgcgaaggagattgggggacgtaaaaccgtctgcgttgtcaccggtaggaacatttcgagttcacgttatctcacgctgcttaatgaggcgacggccggtgtagataagtag

SEQ ID NO: 3234 - protein, 334 aa, Erwinia carotovora subsp. atroseptica SCRI1043
MTSKYQRATDSVTLKDIYTASQQIKTTIRRTPLDRSQELSALVGAEIRLKMENLQQTGSFKLRGAANVLANLGAEQRRIGVIAPTAGNHGLGLAYAGQVAGVPVTIFLPRSADPMKVAAMKGCGAHITFFDDIEEARQAAIAAAQQSSATFVSAYDNPHMIAGGGTVGLEIMEDWMDAEIILVNIGGGGLISGIATAVKAINPAIEVWGIQSEVSPTFARWKDAGETLPVELTPSIAEGVSGYIEPSAMTWPLVRDRVDRVLTVSEVEIKAAMLSMLELHRHVVEPSGVPAVAGAIRYAKEIGGRKTVCVVTGRNISSSRYLTLLNEATAGVDK

SEQ ID NO: 3235 - DNA, 975 bp, Erwinia carotovora subsp. atroseptica SCRI1043
  CDS (1)..(975)
atgagcgacttacgcctcccaaccttcgacgatgtggtagccgcagcggaacgcattgatggctatgccaataaaacgccagtgatgacatcacgcacggtcaatgatgccttcggcgcagaggttttcttcaagtgtgaaaactttcagcgtatgggcgcattcaagttccgcggagccatgaacgcgctgttgcagttctcagatgagcagaaagccgcaggcgtggtcaccttttcttccggtaaccatgcgcaggccattgccctttccgccaaattacttggcattccggcaacgatcgttatgccgcacgatgcacccgcagcaaaggtcgctgcgacacgtggctatggcggaaacgtggtggaatataatcgatataccgaagatcgtgagcagatcggtagagatctggctgaaaagcagggtctgacgctcattcccccttatgaccacccgcacgtcattgcaggacaaggtacggctgcgaaagagctgttggaagaaaccggtgagctggacgccctgttcgtctgcttgggcggcggtggattgttggcaggttccgcactgtccgcgcgtcagctgtctccacgctgtaaaatttatggcgtcgaacctctcgcgggcaacgacgggcagcaatctttccgcagcggcaatattgtgcatatcgatacgcccaaaaccatcgccgatggcgcacagactcaacatctgggcaactataccttcccgctgattcgccagaacgtcgacgatattctgaccgtgacggatgacgacctgattgacgcaatgcggttttacgctgagcgcatgaagatcgtcgttgagccgacggggtgcctcagttttgcggcggcgcgtaatctcagggaatcactacacggcaaacgtatcggtatcattatcagcggcgggaatgtcgatatcagccgctacggcgcatttctgaccggcagcgtttga

SEQ ID NO: 3236 - protein, 324 aa, Erwinia carotovora subsp. atroseptica SCRI1043
MSDLRLPTFDDVVAAAERIDGYANKTPVMTSRTVNDAFGAEVFFKCENFQRMGAFKFRGAMNALLQFSDEQKAAGVVTFSSGNHAQAIALSAKLLGIPATIVMPHDAPAAKVAATRGYGGNVVEYNRYTEDREQIGRDLAEKQGLTLIPPYDHPHVIAGQGTAAKELLEETGELDALFVCLGGGGLLAGSALSARQLSPRCKIYGVEPLAGNDGQQSFRSGNIVHIDTPKTIADGAQTQHLGNYTFPLIRQNVDDILTVTDDDLIDAMRFYAERMKIVVEPTGCLSFAAARNLRESLHGKRIGIIISGGNVDISRYGAFLTGSV

SEQ ID NO: 3237 - DNA, 1251 bp, Leifsonia xyli subsp. xyli str. CTCB07
  CDS (1)..(1251): transl_table=11
gtgaccgatcccacgcgcaccccgttcgccggccccagcctggccgctttcgaggctgcgcgcgcgatcgtggcgacggtggcccagccgaccccgctggagagctcccgctatctcgcgggcgtgctcggtgcgcccgtcctgctgaagtgcgagaatctgcaacgcaccggctcctacaagatccgtggcgcctacaaccgcatgtccaagcttaccgccgaggaacgtaatcgtggggtcgtcgccgcctccgccggaaaccacgcacagggcgtggccttcgcggcccgggagctcggcatccacgccacgatcttcatgccggtcggtgtggccatccccaagttccaggcgacgcgggcgtacggcgctgatgtggtcctgagcggcagcattgtggatgaggcgctgcgcgcggcggcggatttcgcggccgagaccggcgctgtgctcatcccgccgttcgaccacccggacgtggtggccggtcagggcacgctcggcctcgagatcctcgacgaggtccccgacgtgagcacgatcgtcgtcccgatcggtggtggcggactcatctccggcatcgccagcgcggtcaagcagcgttccgcacgcgagggccgcacggtgcgcgtgatcggcgtgcaggccgccaacgccgccgcctacccgccctcactcgaagccggcgcccccaccgagatctccctcgtcgcgaccatcgccgacggcatcgccgtcagccgcccgggcgcgctcaacttccagatcgttcaggacgcggtggatgccgtggtcacggtcaccgaggacgacatcgcccgagccctcctcgtcctcctcgaacgcgcgaagctcgtggtcgagcccgccggggccgcggccgtcgccgccgtcctcgccgggcacatccccgccgatggcacgacggtcgtcatcctctccggtggcaacatcgacccgttgctgatgcagcgtgtgatcagccacggtctcgccgcctcagaccgctacctcaagctgtcgatcatgctgcccgaccggccgggccagctggctcgcatcgcggagatcctcgcgggcgtcaacgcgaatgtggtcgaagtgctgcacacccggcatggccgcgggctgcagctcagtcaggtcgaactcgatgtctccgtggagacccgcggctccgagcaccgtcagcaggtcatctccgttctccgcgccgcgggatacgatccggtcctcgaagaggactga

SEQ ID NO: 3238 - protein, 416 aa, Leifsonia xyli subsp. xyli str. CTCB07
MTDPTRTPFAGPSLAAFEAARAIVATVAQPTPLESSRYLAGVLGAPVLLKCENLQRTGSYKIRGAYNRMSKLTAEERNRGVVAASAGNHAQGVAFAARELGIHATIFMPVGVAIPKFQATRAYGADVVLSGSIVDEALRAAADFAAETGAVLIPPFDHPDVVAGQGTLGLEILDEVPDVSTIVVPIGGGGLISGIASAVKQRSAREGRTVRVIGVQAANAAAYPPSLEAGAPTEISLVATIADGIAVSRPGALNFQIVQDAVDAVVTVTEDDIARALLVLLERAKLVVEPAGAAAVAAVLAGHIPADGTTVVILSGGNIDPLLMQRVISHGLAASDRYLKLSIMLPDRPGQLARIAEILAGVNANVVEVLHTRHGRGLQLSQVELDVSVETRGSEHRQQVISVLRAAGYDPVLEED

SEQ ID NO: 3239 - DNA, 963 bp, Yersinia pseudotuberculosis IP 32953
  CDS (1)..(963): transl_table=11
atgaatacgttgtttgatgccatcagagaggcccaccagatattacgcccacaagtgagagtcacgccgttggagcatagcccactgctatctcaacacagcggttgtgagatctatcttaaatgtgagcacctgcagcacaccggttcttttaaatttcgtggggccagtaacaagttacgtttactcaatgaggcacaacgccagcaaggtgtgatcaccgcctccaccggtaaccatgggcaaggtgtggcgctggccgcaaaactggcggggattaaatccactatttacgccccagaacaggcggcagccatcaagctggatgtgatccgtgcactgggggggcaaattgaattagtctccggagatgccttaaatgctgaactggccgccggtatcgccgctgagcaacaaggtaaagtgtatatctcaccgtataacgacccgcaggtcattgccgggcaaggcacctgtggcatggagatggtcgaacagcagcccgagcttgatgcggtgtttgttgccgttggtggtggtggcctgatttcaggtattgcgaccgtattgaaaacattatcggataaaacgcaggtgattggttgctggccagccaatgccaccagcctgtatacctgtctggagaaaggacagattcaggaggtggcagagcaagaaacgctgtctgacggaaccgccggtggtatcgaaccgggagcgatcacctttgcactgtgccaacagttaatcgatcagaaggtgctggtgagtgagcaagaaatcaaagaggccatgggtttgattgcccgtactgaccgctggatgattgaaggtgccgccggtgtggcactggctgcggcactgaaattggctccgcaatggcaaggtaagaaagtggcggtggtgttgtgcggtaaaaatatcgtgctggagaaatatctgggagctgtcagcggatgctaa

SEQ ID NO: 3240 - protein, 320 aa, Yersinia pseudotuberculosis IP 32953
MNTLFDAIREAHQILRPQVRVTPLEHSPLLSQHSGCEIYLKCEHLQHTGSFKFRGASNKLRLLNEAQRQQGVITASTGNHGQGVALAAKLAGIKSTIYAPEQAAAIKLDVIRALGGQIELVSGDALNAELAAGIAAEQQGKVYISPYNDPQVIAGQGTCGMEMVEQQPELDAVFVAVGGGGLISGIATVLKTLSDKTQVIGCWPANATSLYTCLEKGQIQEVAEQETLSDGTAGGIEPGAITFALCQQLIDQKVLVSEQEIKEAMGLIARTDRWMIEGAAGVALAAALKLAPQWQGKKVAVVLCGKNIVLEKYLGAVSGC

SEQ ID NO: 3241 - DNA, 1233 bp, Symbiobacterium thermophilum IAM 14863
  CDS (1)..(1233): transl_table=11
gtgacggtaacctttgcggacatcgagaaggcgcgcattctgctgagcggacacatcaagcggacacccatgcttcagagccctggcatcaccgagcacctgggacttccggtctacctgaaggccgagaacctgcagcgggccgggtcgttcaaggtgcggggagcgctcaacaagatccactcgctgactgaggaagagaaggcgcgcggcgtcatcgcggcgtcggccggcaaccacgcgcagggcgtggccctggcggcgtccagtctcggcatccggtcggtcatctgcatgccggagggcgccccgatcgccaagctggaggcgacccagggctacggcgcccaggtggtcctgcacggcgagacctacgacgacgcctaccagaaggcgcgggcgctgcaggcggagcacgggtacacgttcatccacggcttcgatgacccgtacaccatcgccggccaggggacggtcgggctggagatcgtggaggacctgcccgacatcgcgacggtggtggtgccgatcggcggcggcggcctcatggcgggcgttgccctggcggtcaagtccctgaagcccggcgtacgggtggtgggggtccaggccgcgggcgcgccggcggtcttcctcagccggcagcagggcaagctggtggcgaccgactcggtccacaccatcgcggacggcattgccatcaagaagccgggggcgctgtgctgggagattatccgggaacacgtggacgacatcgtgctggtggacgaggaggagatcgcacagtcgatcctcttcctgctggagcgtgcgaaggtcatcgtcgagggcgccggcgccgtgggcatggccgcgctcctcggcgacaagatcccggatctgcagggaccggtctgcgtcgtgctctcgggcggcaacattgacgtgaacatcatctcccgcatcatcgagcgcggtctggtgaaggcggggcggtacatccggatctccacgttcgtgcccgaccggcccggcgggctgcagcagctcctcgcgaccgtggcccaggccggggccaacgtgatcgacgtgcgtcatgagcgctggctgaacaaggtgaccatcggcgaggtggagatcaccctggcgctggagactcgcaacgcccgccatgtcgatgagattctcgccaccctcaaggcgaaggggtatcatgtctggatcattccgccgtatcgtcccaacgactggtag

SEQ ID NO: 3242 - protein, 410 aa, Symbiobacterium thermophilum IAM 14863
MTVTFADIEKARILLSGHIKRTPMLQSPGITEHLGLPVYLKAENLQRAGSFKVRGALNKIHSLTEEEKARGVIAASAGNHAQGVALAASSLGIRSVICMPEGAPIAKLEATQGYGAQVVLHGETYDDAYQKARALQAEHGYTFIHGFDDPYTIAGQGTVGLEIVEDLPDIATVVVPIGGGGLMAGVALAVKSLKPGVRVVGVQAAGAPAVFLSRQQGKLVATDSVHTIADGIAIKKPGALCWEIIREHVDDIVLVDEEEIAQSILFLLERAKVIVEGAGAVGMAALLGDKIPDLQGPVCVVLSGGNIDVNIISRIIERGLVKAGRYIRISTFVPDRPGGLQQLLATVAQAGANVIDVRHERWLNKVTIGEVEITLALETRNARHVDEILATLKAKGYHVWIIPPYRPNDW

SEQ ID NO: 3243 - DNA, 1002 bp, Bacillus cereus E33L
  CDS (1)..(1002): transl_table=11
atgataactaaaaaactaccattacatatagacgatattaagaaagctcaaagcattctggatagaaatgctcgtaaaacgccattagtaaaatcattttatttgactagtaaaacgggtggagaaattcacttgaaattagaaaatatgcaattaacaggttcgtttaaattccgtggtgcgtttaataaaatgtcacagctgacagatcaagaaaaagagagaggagtaattgcttgttctgctggtaatcatgcgcaaggaattgctttatctgctcatttactcggtattaaaagtaaaattgtaatgccgatttctgcccctcaagcgaaagttgatgcaacgagaggatatggatctgaagtggttttacatggtgaaacctttgatgatgcgaaggcaaaatgtgaggagattattagagaaacaggtgaaacatacttacatccatatgacgatgtagaagtaatggctggtcaaggtacaataggattagatattcttgatgatatgtgggatgttgatacggtcattgtaccaattggtggaggaggaattatttctggaattgctgttgcattaaaatcttttaatccgtcgattcatataattggtgtccaagcagaaaatgttcatgggatgaaggcatcttatgacaaaggtacaattatagaacattatgaggcacctacgatagcagatggttgcgcggtaaaaataccaggcaatttaacttttgaagttgtaaaagaattagtagatgatattgtaacagtatcagaaaaagagctggaattagcgatgaaagacttattacaacgcgggaaagctgttgtagaaggtgcaggcgcattagctactgctgctctacttgcagggaaagtggatacatatattaaagagaaaaaagtagtagcagttatatctggtgggaacgtagacttacagcgcatatcgagtgtttgtgagcaattttttgtggcgaatgaagtgaaatag

SEQ ID NO: 3244 - protein, 333 aa, Bacillus cereus E33L
MITKKLPLHIDDIKKAQSILDRNARKTPLVKSFYLTSKTGGEIHLKLENMQLTGSFKFRGAFNKMSQLTDQEKERGVIACSAGNHAQGIALSAHLLGIKSKIVMPISAPQAKVDATRGYGSEVVLHGETFDDAKAKCEEIIRETGETYLHPYDDVEVMAGQGTIGLDILDDMWDVDTVIVPIGGGGIISGIAVALKSFNPSIHIIGVQAENVHGMKASYDKGTIIEHYEAPTIADGCAVKIPGNLTFEVVKELVDDIVTVSEKELELAMKDLLQRGKAVVEGAGALATAALLAGKVDTYIKEKKVVAVISGGNVDLQRISSVCEQFFVANEVK

SEQ ID NO: 3245 - DNA, 1056 bp, Burkholderia mallei ATCC 23344
  CDS (1)..(1056): transl_table=11
gtggctgcgcgcggcgcgcgaagctgggacaatggccgcttccttgtccaacgcgttttcgcactcgccgccatgtccgttcaatccgcctccgaccttattttgccgaccttcgacgacgtgaccgacgcagccgcccggctcgccggcgtcgcgcatcgcacgcccgtcctcacgtcgagcaccgccgacgcgcgcgcgggcgcgacgatcttcttcaaatgcgagaacttccagcggatgggcgcgttcaagtttcgcggcgcatacaacgcgatttcgcacttcgacgccgagcagcgccgcgcgggcgtgctcacgtattcgtcgggcaaccatgcgcaggcgatcgcgctcgccgcgcgtctcgcgggcatccgcgcgacgatcgtgatgccgcacgacgcgccggccgcgaaggtcgcggcgacgaagggctacggcggcgaagtcatcacctacgatcgctacacggaaagccgggaggagatcggcgcgcggctcgcgcaggagcgcggcatgacgctcgtgccgccgtacgatcacccgcacgtgatcgccggccaggggacggccgcgaaagagctgatcgacgaagtcggcgagctcgacatgctcgtcgcgccgctcggcggcggcgggctgatcgcgggcaccgcgctgtcggccgccgcgctgtcggcgggctgcgcggtgatcggcgtcgagccggaggcgggcaacgacgcgcagcagtcgctcgagcgcggcgaggtcgtgcgcattccggtgccgcggacgatcgcggacggcgcggcgtcgacgcacgtcggcgcgtacaactttccggtcatccagcggctcgtcaagcggatcgtcacggcgagcgacgcgcagctcgtcgatacgatgcgttttttcgcggagcggatgaaactcgtcgtcgagccgaccggctgcctcggcgcggccgcggtgcttgacggcgtgctgcccgtcgcgggcaggcgcatcggcgtgatcctgagcggcggcaacgtcgatctcgcgcgctacggcgagttcctgcgcgggtga

SEQ ID NO: 3246 - protein, 351 aa, Burkholderia mallei ATCC 23344
MAARGARSWDNGRFLVQRVFALAAMSVQSASDLILPTFDDVTDAAARLAGVAHRTPVLTSSTADARAGATIFFKCENFQRMGAFKFRGAYNAISHFDAEQRRAGVLTYSSGNHAQAIALAARLAGIRATIVMPHDAPAAKVAATKGYGGEVITYDRYTESREEIGARLAQERGMTLVPPYDHPHVIAGQGTAAKELIDEVGELDMLVAPLGGGGLIAGTALSAAALSAGCAVIGVEPEAGNDAQQSLERGEVVRIPVPRTIADGAASTHVGAYNFPVIQRLVKRIVTASDAQLVDTMRFFAERMKLVVEPTGCLGAAAVLDGVLPVAGRRIGVILSGGNVDLARYGEFLRG

SEQ ID NO: 3247 - DNA, 984 bp, Burkholderia pseudomallei K96243
  CDS (1)..(984): transl_table=11
atgtccgttcaatccgcctccgaccttattttgccgaccttcgacgacgtgaccgacgcagccgcccggctcgccggcgtcgcgcatcgcacgcccgtcctcacgtcgagcaccgccgacgcgcgcgcgggcgcgacgatcttcttcaaatgcgagaacttccagcggatgggcgcgttcaagtttcgcggcgcatacaacgcgatttcgcacttcgacgccgagcagcgccgcgcgggcgtgctcacgtattcgtcgggcaaccatgcgcaggcgatcgcgctcgccgcgcgtctcgcgggcatccgcgcgacgatcgtgatgccgcacgacgcgccggccgcgaaggtcgcggcgacgaagggctacggcggcgaagtcatcacctacgatcgctacacggaaagccgggaggagatcggcgcgcggctcgcgcaggagcgcggcatgacgctcgtgccgccgtacgatcacccgcacgtgatcgccggccaggggacggccgcgaaagagctgatcgacgaagtcggcgagctcgacatgctcgtcgcgccgctcggcggcggcgggctgatcgcgggcaccgcgctgtcggccgccgcgctgtcggcgggctgcgcggtgatcggcgtcgagccggaggcgggcaacgacgcgcagcagtcgctcgagcgcggcgaggtcgtgcgcattccggtgccgcggacgatcgcggacggcgcggcgtcgacgcacgtcggcgcgtacaactttccggtcatccagcggctcgtcaagcggatcgtcacggcgagcgacgcgcagctcgtcgatacgatgcgttttttcgcggagcggatgaaactcgtcgtcgagccgaccggctgcctcggcgcggccgcggtgcttgacggcgtgctgcccgtcgcgggcaggcgcatcggcgtgatcctgagcggcggcaacgtcgatctcgcgcgctacggcgagttcctgcgcgggtga

SEQ ID NO: 3248 - protein, 327 aa, Burkholderia pseudomallei K96243
MSVQSASDLILPTFDDVTDAAARLAGVAHRTPVLTSSTADARAGATIFFKCENFQRMGAFKFRGAYNAISHFDAEQRRAGVLTYSSGNHAQAIALAARLAGIRATIVMPHDAPAAKVAATKGYGGEVITYDRYTESREEIGARLAQERGMTLVPPYDHPHVIAGQGTAAKELIDEVGELDMLVAPLGGGGLIAGTALSAAALSAGCAVIGVEPEAGNDAQQSLERGEVVRIPVPRTIADGAASTHVGAYNFPVIQRLVKRIVTASDAQLVDTMRFFAERMKLVVEPTGCLGAAAVLDGVLPVAGRRIGVILSGGNVDLARYGEFLRG

SEQ ID NO: 3249 - DNA, 1263 bp, Haloarcula marismortui ATCC 43049
  CDS (1)..(1263): transl_table=11
atgacacataccgaatcggacacgctacccgtcacatacgcagacatcgaacgagcccgcgaacgtctggacgacgacacagttgtaaagaagacgccagtcgaacggagctcgtcccttggtgggttcgtcgacgccgaggtgtacctgaagatggagcacctccagtggacagggtcgttcaaaaccagaggcgcgtacaacaagatctcgcaggacgttgccgatgacgtggagtccttcgtcgccgccagcgccgggaaccacgcccagggtgtcgctctcgccgcgacgaaatgtggggcagagtcaacgattttcatgccggagaacgcgccacaggccaagatcgacgccacgagggcctacggcggaagcgtcgaactggtcggcaacgactttcaggagacgatgtcccacgccaaagctgtcgtcgaggagaccgacgccgagttcgttcacgcctatgacgatctggacatcattgctggacaggggaccctcggaacggaaatgtaccacgactgccccgatgtcgacacagtcatcgtccccattggcggcggcggacttatcagcggtgtctcgaccgcaatcaagcacctctcgcccgagacgcgcgtcatcggtgtgcaggcgaccggcgctgagacggtgcatgaaagcctcgacaaagggattccggtcgtgcttgatgaagtcgacaccatcgccgacggtatcgctacgggcggtatctcggagacgacgctcgacatcatcgaggcgaacgtcgacgaagtcgtgacggtttcggacaccgatatcgcacaggcgattctcctgttgatggaacgagccaaacaggtcgtggaaggtgccggggccgcctccgtggctgccatactgagtgacagcctcgacgtgtcgggtgaaacggtgatgccgctgctctgtggcgggaacctcgatatgacacagatgcgagaagttctcattcatgcactcacggagcgccagcagctcctccagctccgggttcggatcgatgaccagccgggtgtgatggaggagatatctggcgtcatcgccagacagggagccaacatccacgacgttcggcacgaacggtccgtcgagaatctcgaaatcggggaggcgtatctcgtattcaacgtcgaaacgagtggtgccgagcacgcacagagtattatcacggcgatacgtgatgcgggctatcccgtcgataacgttgcacgggaggccaaaagtggcgcactgtga

SEQ ID NO: 3250 - protein, 420 aa, Haloarcula marismortui ATCC 43049
MTHTESDTLPVTYADIERARERLDDDTVVKKTPVERSSSLGGFVDAEVYLKMEHLQWTGSFKTRGAYNKISQDVADDVESFVAASAGNHAQGVALAATKCGAESTIFMPENAPQAKIDATRAYGGSVELVGNDFQETMSHAKAVVEETDAEFVHAYDDLDIIAGQGTLGTEMYHDCPDVDTVIVPIGGGGLISGVSTAIKHLSPETRVIGVQATGAETVHESLDKGIPVVLDEVDTIADGIATGGISETTLDIIEANVDEVVTVSDTDIAQAILLLMERAKQVVEGAGAASVAAILSDSLDVSGETVMPLLCGGNLDMTQMREVLIHALTERQQLLQLRVRIDDQPGVMEEISGVIARQGANIHDVRHERSVENLEIGEAYLVFNVETSGAEHAQSIITAIRDAGYPVDNVAREAKSGAL

SEQ ID NO: 3251 - DNA, 1212 bp, Haloarcula marismortui ATCC 43049
  CDS (1)..(1212): transl_table=11
atgctctcatttgaggatgtcctcgcggcacaggacaccgtctccgagacggccagacacacaccgcttgattactcgcacacgttttcggcgatgacgggcgcggatatccatctcaaactcgaactgttccagcgtacggggtcgttcaagatacggggtgcgaccaaccgtatcgcgtcgctttcagatgctgaacgggaggctggcgtcgtcacagcgagcgccggcaaccacgctcagggggtcgcgctggccgccacgcgaatcggcgtcgactcgaagattgtgatgccggagcgggccccggtatcgaaagtgaaggccacccggagctacggcggtaacgtggtccttcacggtcgggactacgacgcggccgccgaacacgcccacgaactcgaacgcgaggaaggccggacatacgtccatgccttcgacgacgagaaagtgatggcagggcaggggaccatcggactggagatctacgaggacctccccggcgttgatacggtcgtcgtccctatcggcggcggcggacttattagtggcatcgccacggcgctcaaaggcaaggacgaacgtatccgcgtcatcggcgtgcaggccgagggagcgtccagcgtggccgaatccctggagaagggccaccgcatcgagcgtgacagcgtcgaaactatcgccgacggtatcgccacccgcactgtcggcgagcagacgttcgaggtcatcagcgaccgcgtcgacgaggtcgtgacggtgtcggactcggaaatcgcagtcgcgctgacgacactgttagagcgctcgaaaacgcttgccgagggcgcgggtgccgtcgcgctggctgccgtcatggaagagaagttcgacttcgaggacgacgagacgatcgttcccgcgctgtgtggcgggaacatcgacctgaacaccctgaccaacgtcatcatgcgcggcctcgttgagactggccggtatctcaaaatccggaccgtccttcaggaccggcccggcgcgctggaagagctcgtcgaggtcctgtcacgcgagcaggtcaacatctacggcatcgagcacgaccggaccagtcgcgacgtggcgatgagttcggccgaggtcgaactggacctggagacccgcggccacgaccacgtcgccgaactcatcgacgcgctcaccgacgaggggtatgaggtcgacgtgctcgtctga

SEQ ID NO: 3252 - protein, 403 aa, Haloarcula marismortui ATCC 43049
MLSFEDVLAAQDTVSETARHTPLDYSHTFSAMTGADIHLKLELFQRTGSFKIRGATNRIASLSDAEREAGVVTASAGNHAQGVALAATRIGVDSKIVMPERAPVSKVKATRSYGGNVVLHGRDYDAAAEHAHELEREEGRTYVHAFDDEKVMAGQGTIGLEIYEDLPGVDTVVVPIGGGGLISGIATALKGKDERIRVIGVQAEGASSVAESLEKGHRIERDSVETIADGIATRTVGEQTFEVISDRVDEVVTVSDSEIAVALTTLLERSKTLAEGAGAVALAAVMEEKFDFEDDETIVPALCGGNIDLNTLTNVIMRGLVETGRYLKIRTVLQDRPGALEELVEVLSREQVNIYGIEHDRTSRDVAMSSAEVELDLETRGHDHVAELIDALTDEGYEVDVLV

SEQ ID NO: 3253 - DNA, 936 bp, Thermus thermophilus HB8
  CDS (1)..(936): transl_table=11
atgccttccctccaagacctctacgccgccttccgccgcatcgccccctacacccaccgcacccccctcctcacctcccgcctcctggacgggctcctgggaaagcgcctcctcctcaaggccgagcacctgcagaagacggggagcttcaaggcccggggggcgctttccaaggccctcgccctggaaaaccccaaggggctcctcgccgtctccagcggcaaccacgcccagggggtggcctacgccgcccaggtgctcggggtaaaggccctggtggtcatgcccgaggacgcgagcccctacaagaaggcctgcgcccgggcctacggggccgaggtggtggaccggggggtgacggcaaagaaccgggaggaggtggcccgggcccttcaggaggagacgggctacgccctgatccacccctttgacgaccccctggtcatcgccgggcaggggacggcggggcttgagcttctggcccaggcggggcggatgggggtcttccccggggccgtcctcgcccccgtggggggcggggggctcctcgcgggcctggccacggcggtgaaggccctctcccccacaaccctcgtcctcggggtggagcctgaggccgcggacgacgccaagagaagcctggaggcgggaaggatcctccgcctggaagcgccccccaggacccgggcggatggggtgcggacgctaagcctgggggagcgcaccttccccatcctgcgggaaagggtggacgggatccttacggtgagcgaggaggccctcctcgaggcggagcgcctcctcttcacccgcaccaagcaggtggtggagcccacgggggcccttcccctggccgcggtgctggagcacggggcgaggcttccccaaaccctcgccctcctcctctccgggggcaaccgggacttctctccctag

SEQ ID NO: 3254 - protein, 311 aa, Thermus thermophilus HB8
MPSLQDLYAAFRRIAPYTHRTPLLTSRLLDGLLGKRLLLKAEHLQKTGSFKARGALSKALALENPKGLLAVSSGNHAQGVAYAAQVLGVKALVVMPEDASPYKKACARAYGAEVVDRGVTAKNREEVARALQEETGYALIHPFDDPLVIAGQGTAGLELLAQAGRMGVFPGAVLAPVGGGGLLAGLATAVKALSPTTLVLGVEPEAADDAKRSLEAGRILRLEAPPRTRADGVRTLSLGERTFPILRERVDGILTVSEEALLEAERLLFTRTKQVVEPTGALPLAAVLEHGARLPQTLALLLSGGNRDFSP

SEQ ID NO: 3255 - DNA, 1209 bp, Geobacillus kaustophilus HTA426
  CDS (1)..(1209): transl_table=11
atgttgacattagcagacattgaacaagcgcgagcgaaaatgaaaggcatcgtccatcaaacgccgcttgagcattcgcaaacgttcagccggctgtctggcaatgatgtatatatgaaactcgaaaatttgcaaaaaacgggctcgtttaaagtaagaggttcattcaataaaattatgtcgctcacggaagaagagagggcgcgcggcgtcatcgccgcttcggccggcaaccacgcccaaggggtcgcctatgcgagcggcatgcttcatattccgtgcacgatcgtcatgccaaaaggcgcgccgctcagcaaaattgaagcgacgaaaagctacggggcggaagtcgtgctgtacggcgatgtgtttgacgagtctttggaatatgcgttagagttgcagcgtgaacgggggatgacgtttgttcatccgtttgacgacttggcggtgatggccggccaagggacgatcggcttagagctgatcgagcagcttcccgacgtcgatgtcgttctttgtccagtcggcggcggcgggttgcttgcgggggtggcgcttacgttaaaacagctgaagccgtcggttgaagtgtacggcgttgagtcatcggcttgccccggcatgacggcggccatacgccataaacagcccgtctccattgccgcatcgaatacgatcgccgatgggattgccgtgaaaaagccgggcaatattacgtaccaatacattgagcaatacgtcgatggcgttgtatgcgtggaagaggcggaaatttcgcggacgatgctgtatgtgctcgagcggaacaagctgttgatcgaaggggcggcagcttgtccgctggcggcattgttgtatcaaaagctgccgtttcgcggcaaaaaagtcgccgccattttaagcggcggcaacgtcgatgtgacgctcatttcccgcatcatcgagcgggggctcgtcgaagccgggcgattcgttacgtttacaacggtcatctccgacaagccgggccagttgaacaagctgctgcgcattattgcggagcttgaggcaaacgtgatgtcgattcatcatcagcgcatcggcgccaaagtgctgccaggtcaggcggaaattcacttttcgctcgagacaaaaaacgaagaccacattcagcaaatctaccaagtgttgttgaaagaaggctacgatgtacagttttaccgatga

SEQ ID NO: 3256 - protein, 402 aa, Geobacillus kaustophilus HTA426
MLTLADIEQARAKMKGIVHQTPLEHSQTFSRLSGNDVYMKLENLQKTGSFKVRGSFNKIMSLTEEERARGVIAASAGNHAQGVAYASGMLHIPCTIVMPKGAPLSKIEATKSYGAEVVLYGDVFDESLEYALELQRERGMTFVHPFDDLAVMAGQGTIGLELIEQLPDVDVVLCPVGGGGLLAGVALTLKQLKPSVEVYGVESSACPGMTAAIRHKQPVSIAASNTIADGIAVKKPGNITYQYIEQYVDGVVCVEEAEISRTMLYVLERNKLLIEGAAACPLAALLYQKLPFRGKKVAAILSGGNVDVTLISRIIERGLVEAGRFVTFTTVISDKPGQLNKLLRIIAELEANVMSIHHQRIGAKVLPGQAEIHFSLETKNEDHIQQIYQVLLKEGYDVQFYR

SEQ ID NO: 3257 - DNA, 1272 bp, Geobacillus kaustophilus HTA426
  CDS (1)..(1272): transl_table=11
atggaacaacagctgaaacggaagcaaggggcggtatacgtcgaggacattttgatcgcgtatcatacgctgaaggatgttgttttccatacgccgctgcaaaaaaatccgctgttatccgagcgctacgagtgcaatgtctacttaaagcgcgaggatttgcaagtcgtgcgttcgtttaagttgcgcggggcgtacaaccggatgaagcatttaaccgatgaggagcggagaaacggggtggtatgcgccagcgccggcaaccatgcccaaggggtggcctattcatgccgggcgcttggcgtgcacgggaaaatttatatgccggcgacgacgcctcggcaaaaagtgtcgcaagtgcagctgtttggcaaagacatggtcgagatcgtgcttgtcggcgacacgtttgacgattcctacaacgaagcggtgaagtgcgccgaggcggaagggcggacgttcatccatccgtttgatgatgaatacgtcattgccggacaggggacgattggcgtcgaggtgttaaacgactgtgatgaaccgatcgactttttgttcgccagcatcggcggcgggggattgatggccggactagggacgtatgtgaaaagcatttctccgtccaccaaagtcatcggggtcgagccggctggcgccccatcgatgaaagcggcgctcgagcgcggacatgtggtgacgctcgatgaaatcgacaagttcgttgacggcgctgccgtcaagacggtcggggaaaagacattcgccttatgccgcggggtgcttgatgacatcgtcgtcgttccggaaggaaaagtatgcacgacgattttggagctgtacaacgaaaacgccattgtcgctgaaccggcaggggcgctgccgatcgccgcgcttgatttttacaaggaacaaatccgaggcaaaacagtcgtctgcgtcataagcggcggcaacaacgacatcgaccggatgcaggaaatcaaagagcgttcgatgatttacgaaggactgcagcactatttcatcgtcaacttcccgcagcgggctggggcgttgcgtgagtttttggatgaagtgcttgggccgaccgatgacatcacccggtttgaatacacgaagaaaaacaacaaagaaagcggaccggcgcttgtgggcatcgaactgaaacggcgcgaagactacgcgccgctcatcgagcggatgaagaaaaaaggcttcccgttccaagaagtgaacaaagacccgaacttgttccatttattgatctaa

SEQ ID NO: 3258 - protein, 423 aa, Geobacillus kaustophilus HTA426
MEQQLKRKQGAVYVEDILIAYHTLKDVVFHTPLQKNPLLSERYECNVYLKREDLQVVRSFKLRGAYNRMKHLTDEERRNGVVCASAGNHAQGVAYSCRALGVHGKIYMPATTPRQKVSQVQLFGKDMVEIVLVGDTFDDSYNEAVKCAEAEGRTFIHPFDDEYVIAGQGTIGVEVLNDCDEPIDFLFASIGGGGLMAGLGTYVKSISPSTKVIGVEPAGAPSMKAALERGHVVTLDEIDKFVDGAAVKTVGEKTFALCRGVLDDIVVVPEGKVCTTILELYNENAIVAEPAGALPIAALDFYKEQIRGKTVVCVISGGNNDIDRMQEIKERSMIYEGLQHYFIVNFPQRAGALREFLDEVLGPTDDITRFEYTKKNNKESGPALVGIELKRREDYAPLIERMKKKGFPFQEVNKDPNLFHLLI

SEQ ID NO: 3259 - DNA, 1242 bp, Azoarcus sp. EbN1
  CDS (1)..(1242): transl_table=11
atgtcgtccatcccggtgccgctcacattgcccgatctcgtcgccgcgcgcgaacgcatccgcgatgcggtcgtccgtaccggccagtggcagaatgacgcgctgtccgacgaactcggcgtgccgctgcaactgaagctcgaaaacatgcagcgcaccggctcgttcaagctgcgcggcgcgacgcacaagatcggccgcctgctggaagccggtgctcggcccgccggcgtcgtcgcggcgtcggccggcaaccacgcgcagggcgttgcgcgcgcggctgcgcgggtcggcctcggggcggtcgtcgtgatgccggcgaacgcgccgctgacgaagatccaggcgtgtcgcaagctcggtgccgacgtgcgcctcgtcggcgacacgctcgaagccgccagcgacgaagcgcgccggctggccgacggcgaagggctcgcgctgatccatccctacgacgactgggacgtgatcgccggccaggcgagctgcggcctggagatgctcgaagacgcgccggacatgaccgtcgcgatcgtgccgctcggcggcggcgggctgctctccggcgtcgcgctggcgctgaagctgcagaatccggcgatccgcgtcatcggcgtgcagaccgacgcggtcgcgccgtggcggcatttcttgcgcgacggcaccctcgaggcggtgcggccggacgcccacacgatcgccgacggcatcaaggtgaaacggccgggaatgctgacgcggcaggtgatcgcgcgccacgtcgacgacatcgtcaccgtcgacgacaacgcgatcgccgaggcgatcgtcacgctgctcgaacgcacgcgcacgatcggcgaaggtgcgggcgtggtcgggctcgcggcgctgctgcagcgcaaggtccgcctcgggcccgacgaccgcgcggtggtcgtgatttcgggcggcaacgtcgatatgacgctcgtcgggcgttcgatcgactacggcctcgcgtcgagcgggcggctgatgagcgtcgcggtgatgatttccgatgcgccgggccagttgctcgcgctgctggcgacagtcgccgaactcggcatgaacgtgcgccatgtcgagcaccgccgcggcgaactgcacgtcgcggtcggcatgaccgaagtgatcctgcagatcgagacgcgcgatgccgagcaccagcacgcgctgctgacgcactttgccgcccagggccttgccgtgcgcaacctgctcgcgggatga

SEQ ID NO: 3260 - protein, 413 aa, Azoarcus sp. EbN1
MSSIPVPLTLPDLVAARERIRDAVVRTGQWQNDALSDELGVPLQLKLENMQRTGSFKLRGATHKIGRLLEAGARPAGVVAASAGNHAQGVARAAARVGLGAVVVMPANAPLTKIQACRKLGADVRLVGDTLEAASDEARRLADGEGLALIHPYDDWDVIAGQASCGLEMLEDAPDMTVAIVPLGGGGLLSGVALALKLQNPAIRVIGVQTDAVAPWRHFLRDGTLEAVRPDAHTIADGIKVKRPGMLTRQVIARHVDDIVTVDDNAIAEAIVTLLERTRTIGEGAGVVGLAALLQRKVRLGPDDRAVVVISGGNVDMTLVGRSIDYGLASSGRLMSVAVMISDAPGQLLALLATVAELGMNVRHVEHRRGELHVAVGMTEVILQIETRDAEHQHALLTHFAAQGLAVRNLLAG

SEQ ID NO: 3261 - DNA, 1239 bp, Zymomonas mobilis subsp. mobilis ZM4
  CDS (1)..(1239): transl_table=11
atggtaagcttggataatccagagactcttcccgtttcacttgatgatatcaaacaggcgcatcaacgcattaagaatgccattattagaaccccgaccctttacagtcggactttgtctgacttgattggtgccggtgtctggctgaaatttgaaaatttccagtttaccgccgcctataaagaacggggtgcgttaaataaattattgtcgctggacaaggttgcccgcgaaagaggggttattgccgcttcggccggaaatcatgcccaaggtctcgcctatcacgggaatcgtttggatattccggtcacgatcgtgatgcctgtccataccccgacggtaaaagtcgagcagacccgtggacatggtgcgaatatcgtcctttatggcgaacaattcgatgaatcccttgcccatgcgttagaattggctgaaaaagacaatctgacctttgtccatcctttcaatgatccagctattattgccggtcagggcacggttgcccttgaaatgttggaagatgccccagcgattgacactctggttgtgccagtgggtggcggcggcctgatttcaggctgtgctgtggttgccaaaaacgcagatcggcctttggatgttattggtgccgaagccgagctttatccttcgatgtatgattatatcaaagggaaaaatctgccttgcggtggggatactctggcagaagggatcgcggttcaggttcccgggcagttaactcgccgttttgttgaagccttggtcgatgatattttgctggtcagtgaaagcaatatcgaacatgctttgtctttgattgttcagattgaaaagacgattgttgaaggggctggcgcggctggtttgggggcgttgctatcgcatcccgaacgattccaaggcagacaggtaggcattatcttttctggcggtaatatcgacacccgcttgttagccaatgttctattgcgtgatttggcacgctctggtcgtctggcgcggttgcgggtcagaatgaaagatcaagcaggtcagctttacaaagtagcgcgtgttttccacgatcagcaggcgaatattgtcgaaatttcttatcagcgcatctttacaaccctgcccgctaagggattatgtgccgatattgaatgtgaaacgcgcgatcaggctcatttgcggcatttaatcgatgctttacgtgaagcgggttatggtgtgaccttgattgaaccggcctga

SEQ ID NO: 3262 - protein, 412 aa, Zymomonas mobilis subsp. mobilis ZM4
MVSLDNPETLPVSLDDIKQAHQRIKNAIIRTPTLYSRTLSDLIGAGVWLKFENFQFTAAYKERGALNKLLSLDKVARERGVIAASAGNHAQGLAYHGNRLDIPVTIVMPVHTPTVKVEQTRGHGANIVLYGEQFDESLAHALELAEKDNLTFVHPFNDPAIIAGQGTVALEMLEDAPAIDTLVVPVGGGGLISGCAVVAKNADRPLDVIGAEAELYPSMYDYIKGKNLPCGGDTLAEGIAVQVPGQLTRRFVEALVDDILLVSESNIEHALSLIVQIEKTIVEGAGAAGLGALLSHPERFQGRQVGIIFSGGNIDTRLLANVLLRDLARSGRLARLRVRMKDQAGQLYKVARVFHDQQANIVEISYQRIFTTLPAKGLCADIECETRDQAHLRHLIDALREAGYGVTLIEPA

SEQ ID NO: 3263 - DNA, 954 bp, Silicibacter pomeroyi DSS-3
  CDS (1)..(954): transl_table=11
atgtatataccgacctttgaggacatgcttgccgcgcatgcgcggatcgaaccccatatccgccgcacgccggttcgggtctcggattacctcaacgagctgaccggtgcgcagctgttcttcaaatgcgagaactttcaggagccgggcgcgttcaagatacgcggcgctaccaacgcggtgtttggcctggacgatgcccaggccgcaaagggggtcgccacgcattcatcgggcaatcatgcctcgtgtctgagctatgccgcgatgctgcgcggtatcccctgcaacgtggtgatgccaagcaccgcgccgcaggccaagaaggacacggtgcgccgttatggcggggtcatcaccgaatgcgccccctcgaccagcgcgcgcgaagagacctttgcccgggtgcaggcgcaaaccgggggcgatttcgtgcatccctataacgacccccgggtgatcgcggggcaggggacatgcgcgcgcgaactgatggaacagaccgatggtctggatatcgtggtggcaccgatcggcggtggcggcatgatctctggcacctgcctgaccctgtcgacactggcgcccgagacccgagtgatcgcggccgaaccggaacaggccgatgacgcctatcgcagcttcaaggcgggccatatcatcgccgatgacgcacccaagaccattgccgatggtctgctggtaccgctcaaggatctgacctggcatttcgtcagcaaccatgtggccgaaatctacacggcctccgagcaggagatcatcgaggcgatgaagctgacatggaaacacctgcgcgtggtgatggaaccctccagcgcggtgccgctggcgacgatcctgaagaaccgcaaggcatttgcgggcaagcgcgtgggcgtaatcattaccggcggcaacgtcgatctggacaaacttccttggatgaacgggtga

SEQ ID NO: 3264 - protein, 317 aa, Silicibacter pomeroyi DSS-3
MYIPTFEDMLAAHARIEPHIRRTPVRVSDYLNELTGAQLFFKCENFQEPGAFKIRGATNAVFGLDDAQAAKGVATHSSGNHASCLSYAAMLRGIPCNVVMPSTAPQAKKDTVRRYGGVITECAPSTSAREETFARVQAQTGGDFVHPYNDPRVIAGQGTCARELMEQTDGLDIVVAPIGGGGMISGTCLTLSTLAPETRVIAAEPEQADDAYRSFKAGHIIADDAPKTIADGLLVPLKDLTWHFVSNHVAEIYTASEQEIIEAMKLTWKHLRVVMEPSSAVPLATILKNRKAFAGKRVGVIITGGNVDLDKLPWMNG

SEQ ID NO: 3265 - DNA, 975 bp, Silicibacter pomeroyi DSS-3
  CDS (1)..(975): transl_table=11
atgagcacccttgaactgatcgaagccgctgccgagcggctgtcgggccatgtccgccgcacaccgctgctctcctcgccctttctggacgagatcgccgggcgccgggtactggtgaaacccgaatgcctgcaacataccggcagcttcaagtttcgcggcgcatggtcggccatttccgcgctggaccccgaggcgcgcgcgcgcggggtcatcgccttttcctcgggcaaccatgcgcaaggggtcgcccatgcggccacgctgcatggcatcgcctcggtcatcgtgatgccctcggacgcgccccggctcaagatcgacaacacaagagcgctgggggccgaggtggtgctgtatgaccggggccgcgaaagccgcgaagagatcggcaccgcgctggccggtgaacgcgggctgacgctgatccggccctatgacgaaccgcaggtgatcgccggtcaggccagcgtcgggctggaactggccgaacaggcgggcgaactgggggtcgagagcggcgatgtgctggtctgttgcggcggtggcgggttgacctcgggcgtggcactggcgctggaggcgcgggcgccgggcctgagggcgcgcccggtcgagcccgaggggtttgacgatgtgaaacgctcgcttgccggcgggaccatcagccgcaacaattcggaaaccggcaatatttgcgacgcgatcctgacgccggaaccgggcaggattacctttccgatcctcagccggctctgtggccccggcctggccgttaccgaggacgaagccctgcgcgccatggcgctagcctttctgcgcctcaagatcgtgctggaaccgggcggggcggtctcgctggcggcggccctgtttcacccggaccaggtcgaaggcgacaccgtgctggccgtggcctcgggcggcaatgtcgacgcggccctgttccgcaccgcgctggagctccacgcgtga

SEQ ID NO: 3266 - protein, 324 aa, Silicibacter pomeroyi DSS-3
MSTLELIEAAAERLSGHVRRTPLLSSPFLDEIAGRRVLVKPECLQHTGSFKFRGAWSAISALDPEARARGVIAFSSGNHAQGVAHAATLHGIASVIVMPSDAPRLKIDNTRALGAEVVLYDRGRESREEIGTALAGERGLTLIRPYDEPQVIAGQASVGLELAEQAGELGVESGDVLVCCGGGGLTSGVALALEARAPGLRARPVEPEGFDDVKRSLAGGTISRNNSETGNICDAILTPEPGRITFPILSRLCGPGLAVTEDEALRAMALAFLRLKIVLEPGGAVSLAAALFHPDQVEGDTVLAVASGGNVDAALFRTALELHA

SEQ ID NO: 3267 - DNA, 1008 bp, Silicibacter pomeroyi DSS-3
  CDS (1)..(1008): transl_table=11
atgacgacgaaaatcactcttcaggacagcatcagggcgcgggcgcggattgccgggcgtatccgcgaaacccctttggtggaatcgccctctctcagcagtctgagcggcaggcaagtcctgctaaagctggaaagcaggcagatcaccggcagcttcaagctgcgcggcgccaccaatgcggtcttgtcgctgacggatacgcagcgcgcggcgggcgtggttggggtatctaccggcaaccacgggcgcggactggcctatgcggcggcagaggccgaggtgcgttgcatcatctgcatgtcggaactggtgccgcagaacaaggttgacggcatcagatcccatggcgccgaggtgcgtatcctgggccggtctcaggacgatgcgcagcaggaagtcgaccggctggtcagagatggcatgaccatgctgcccccctttgaccatccggatatcattgccggccagggcaccgtcgcgctggaaatgctggatcaggcgccagaccttgaaaccgtgttggttcccctgtcgggtggcgggctgatttccggtgtcggcatggttctgaaagcggcgaacccggatatccgggtgatcggcgtcagcatggaacgcggcgccgcgatgtatgaatgcctgcaggcgggcaggcccgttcaggttgcggaactgcccacattggccgactctctgggcggggggatcgggctggacaatgcctatacattcgaaatgaccaaggcgtttgtcgatgaggtggtgctggtgtccgaggctgaaatcgccgccgccatccgccatgcctatttcgaggaacgcgaggtgatcgaagggtccggcagcgtcggcatcgcggcgctgctggccggcaagatcggcaatcccggccgttgtgtgtcgctggtgagcggtcagaacatcgctatggacctgcacaaacgcatcatcgacggtgaagacgtggatgtggaagccgacatcaaaggaggcgcagatgcctga

SEQ ID NO: 3268 - protein, 335 aa, Silicibacter pomeroyi DSS-3
MTTKITLQDSIRARARIAGRIRETPLVESPSLSSLSGRQVLLKLESRQITGSFKLRGATNAVLSLTDTQRAAGVVGVSTGNHGRGLAYAAAEAEVRCIICMSELVPQNKVDGIRSHGAEVRILGRSQDDAQQEVDRLVRDGMTMLPPFDHPDIIAGQGTVALEMLDQAPDLETVLVPLSGGGLISGVGMVLKAANPDIRVIGVSMERGAAMYECLQAGRPVQVAELPTLADSLGGGIGLDNAYTFEMTKAFVDEVVLVSEAEIAAAIRHAYFEEREVIEGSGSVGIAALLAGKIGNPGRCVSLVSGQNIAMDLHKRIIDGEDVDVEADIKGGADA

SEQ ID NO: 3269 - DNA, 1245 bp, Bacillus clausii KSM-K16
  CDS (1)..(1245): transl_table=11
atgaccacgcatttacaggatattattcgagcaaatcaacaaattaaagatgtcgtgacgcatacacctttgcaaaaagatcaggttttgtctgaacgatatgattgcacagtttatttaaaacgagaagacatgcaagttgtcagatcttttaaaattcgcggcgcctattaccaaatttcttctctttcaaaagaagaacttgccgctggggttgtatgcgcaagcgctggaaaccatgcacaaggggttgcctactcatgccgcgctttaaaagtcaaaggtgttattttcatgccgactaccacgccaaagcaaaaagtcgcacaagtgaaattttttggcagggactatgtggacgttagattaattggcgatacgtttgatgattcttatgcggacgccattcaatactgcgaagagcaggaaatgacgttcatccacccatttaaccaagacaaagtgattgctgggcaaggaacagtcgggcttgaaattatgaatgacattgaggaaacgccagactttgtgttttcatcaatcggcggtggtgggcttattagtgggatggcaacgtatataaaaagcgttagcccgtctacgaaaatgattggctgtgaaccagccggtgctgcatcgatgacagaatcaattaagcaaggcaacgttgttgagttagacgaaatcgataaatttgtcgatggggcagctgtgaagaaagtcggcgacaaaacatttgaaatttgcaaagagctgctagatgacattattgttgttccagaaggaaaaatttgcacaacgattttaaacctttacaatgagaatgcgctagtcgctgaaccggcaggggctatgcctattgctgctcttgatttgtatacggaacaaattaagggaaaagtcgttgtctgtattgttagtggcggcaacaacgacatcgggcgcatggaggaaatccgggaacgttcgctcatttatgaaggattgcagcattactttatcgttgaatttccacagcgagctggggcgctacgtgagtttattaccgatgtgctcggcccggaagacgacattactcgctttgaatatacaaagaaaaacaataaatcgaacggtccagtattaattgggattgaactgaaatgcagcaaagattatgatgggttaatcgaaagaatggaaaagattggatttgcctataatgaagtcaacaaggatgaaaatttgttttctttgctgatttga

SEQ ID NO: 3270 - protein, 414 aa, Bacillus clausii KSM-K16
MTTHLQDIIRANQQIKDVVTHTPLQKDQVLSERYDCTVYLKREDMQVVRSFKIRGAYYQISSLSKEELAAGVVCASAGNHAQGVAYSCRALKVKGVIFMPTTTPKQKVAQVKFFGRDYVDVRLIGDTFDDSYADAIQYCEEQEMTFIHPFNQDKVIAGQGTVGLEIMNDIEETPDFVFSSIGGGGLISGMATYIKSVSPSTKMIGCEPAGAASMTESIKQGNVVELDEIDKFVDGAAVKKVGDKTFEICKELLDDIIVVPEGKICTTILNLYNENALVAEPAGAMPIAALDLYTEQIKGKVVVCIVSGGNNDIGRMEEIRERSLIYEGLQHYFIVEFPQRAGALREFITDVLGPEDDITRFEYTKKNNKSNGPVLIGIELKCSKDYDGLIERMEKIGFAYNEVNKDENLFSLLI

SEQ ID NO: 3271 - DNA, 1212 bp, Campylobacter jejuni RM1221
  CDS (1)..(1212): transl_table=11
gtgttagagcttaataaaatttacaaagcaaaacaacaaatttcagggtttgtaaacaaaactcctttcatatactcttcttttttaagtgatatttgtcaaagtgagatttatcttaaaaatgaaaatttacaaattacaggtgcttataaaattcgtggagcttataataaaatagccaatcttagcgctgaacaaaaacaacacggagtcattgcggcaagtgcaggaaaccatgctcaaggcgtggccattagtgcaaaaaaatttggcattaaagcagttattgtaatgccagaatccactccgctcttaaaagtttctgctacaaaagccttaggagcagaggtgatactcaaaggagacaattttgatgaagcttatgtctttgcaacctcttatgctaaagaaaataatcttagttttatccatccttttgaagatgaatttgtaatggcaggacaaggaactttgatgcttgaaatgcttgatgaaataagcgatcttgatatgattatcgcacctgttggaggtggaggacttataagtggtatcgcaagtgcagctaaacaaatcaatccaaacattaaaatcatcggagttggagccaaaggagctcctgcaatgtatgaaagttttcatgccaaaaaaatcaaaaatgcaaaaagcgtacgcactatagccgatggtattgctgtgcgtgatgcaaatcctattaattttaatattattttagaatgcgtagatgattttatccaagttgatgatgaagaaatcgctaatgcggtattgtttttacttgaaaaacataaaatcatagttgaaggcgcaggagctgcgagtgtagccaccctacttcatcaaaaaataaatacacaaaatcataaaaaaattggcgtagttttaagcggaggcaatatcgatgcacaaatgctaaatatcatcatagaaaaaggtttatttaaatcctacagaaaaatgcaaattcatgttactttagtagataaacctggggcattattacaccttacagacagcttaaaaatagccaatgcaaatatagtaaaaatcgactatgatagattttccaccaagcttgattatggcgatgcgatgatttcaattaccctagaaaccaaaggtaaagaacatcaagaagaaataagaaaaattttaacccaaaaggcctttaatttctatgaaagtttttaa

SEQ ID NO: 3272 - protein, 403 aa, Campylobacter jejuni RM1221
MLELNKIYKAKQQISGFVNKTPFIYSSFLSDICQSEIYLKNENLQITGAYKIRGAYNKIANLSAEQKQHGVIAASAGNHAQGVAISAKKFGIKAVIVMPESTPLLKVSATKALGAEVILKGDNFDEAYVFATSYAKENNLSFIHPFEDEFVMAGQGTLMLEMLDEISDLDMIIAPVGGGGLISGIASAAKQINPNIKIIGVGAKGAPAMYESFHAKKIKNAKSVRTIADGIAVRDANPINFNIILECVDDFIQVDDEEIANAVLFLLEKHKIIVEGAGAASVATLLHQKINTQNHKKIGVVLSGGNIDAQMLNIIIEKGLFKSYRKMQIHVTLVDKPGALLHLTDSLKIANANIVKIDYDRFSTKLDYGDAMISITLETKGKEHQEEIRKILTQKAFNFYESF

SEQ ID NO: 3273 - DNA, 1206 bp, Carboxydothermus hydrogenoformans Z-2901
  CDS (1)..(1206): transl_table=11
gtggtagaaattaaagatgttcaggaagcaaggattaggctattgggggttgctcaccgcactttaaccgcttattcggcaacctttagccggctggcgggagcggaagtgtattttaaatatgaaaacctgcaaaaaaccggttcctttaagctgaggggagcttataataaagttgccagtctgcccgtaaaggagcgggaacggggcgttgtagcggcctcggcgggtaaccatgcccagggggtagcttttgcttcgtttagtgccggaattcccgcaactatcgtgatgccggaaggcgctccgctggctaagattcaggcgacccagagctacggagcaaaggtaattttacacggggttagctatgatgatgcttttttaaaagcgaaagaaatcatggaaaaggaaggagcaacttttgtccatgcctttgacgaccccaaagtgattgccgggcaggggaccatagccttagaaatgctcgaagatgttcctgaactggatatgctggtggctccggttggtggtggcggactgatagccggtcttgcagtggcagcgaaagcgataaaaccgcatctgaaagtcataggggttcaggccaagggggcaccatcggcgtatgcttctttaaaagaacgcaggaaagtaacgttggcttcggtgtcgacaattgctgacggaattgccgtcaaaactccgggggagttgacctcgaaaattatttttgatttggtagacgacattgtcctggtggatgatgaggaaattgcccaggcaatattaatgatgttagaacggggtaaagtaatgttagaaggagcaggagcggtgggggtggcagcgcttttagcccagaaaattccggtacgggggcataaagtcggcgttgttttgtccggtggaaatatcgatgttcataccatctcgatcataatcgaacggggtctggtaaaatccggtagatatgtacggataaaaactattttagatgataaaccgggagccttacaaaagcttttggagttaattgccagggaaaaggccaatataatttttatcaaccatgaccgcattgctccccacgtgccgataaagcaggcggaggttgagctggctctggaaacaagggatttatctcacattgaaaaaattctggcggttttaagagaagcgggttatcagattctacaaaattaa

SEQ ID NO: 3274 - protein, 401 aa, Carboxydothermus hydrogenoformans Z-2901
MVEIKDVQEARIRLLGVAHRTLTAYSATFSRLAGAEVYFKYENLQKTGSFKLRGAYNKVASLPVKERERGVVAASAGNHAQGVAFASFSAGIPATIVMPEGAPLAKIQATQSYGAKVILHGVSYDDAFLKAKEIMEKEGATFVHAFDDPKVIAGQGTIALEMLEDVPELDMLVAPVGGGGLIAGLAVAAKAIKPHLKVIGVQAKGAPSAYASLKERRKVTLASVSTIADGIAVKTPGELTSKIIFDLVDDIVLVDDEEIAQAILMMLERGKVMLEGAGAVGVAALLAQKIPVRGHKVGVVLSGGNIDVHTISIIIERGLVKSGRYVRIKTILDDKPGALQKLLELIAREKANIIFINHDRIAPHVPIKQAEVELALETRDLSHIEKILAVLREAGYQILQN

SEQ ID NO: 3275 - DNA, 1230 bp, Carboxydothermus hydrogenoformans Z-2901
  CDS (1)..(1230): transl_table=11
atggtttcactagaagaagtaaaaaaagccagtgaaattttaggcaaaattgcccacaagacacctctcgtgtataataccactctaagtgaaatgactggtaaccatatctatttaaaaatggaaaacttacagcgtactggttcatttaagttaagaggggcttattataaaatagcgagtttaagtgaaaatgaaaagaaaagaggagttgttgcttcatctgctggcaaccacgcccaaggtgtagctctggcagcaaccctttatggaatccgttccactattgtcatgccaagacacgctccattgtccaaaataaaggctacaagtcaatatggagcaaaagtagtattgcatggtaacgtttatgatgaagcgtatgaagaagctaaacgaattcagttagaaacaaaagctaccttcattcatccatttaatgatccacaagttattgcaggtcagggaactatagcgttagaaattttagaagatttaccagatgtggaagtagttgtagtgcctatcggaggtggtggtttaattgcaggaattgcagttgccataaaaaacttaagaccaaaggtgcatgttattggtgttcaagctaaaaatatgccttccatggcagagtcattagcccgaggacaacttacaaatataagtggccaccccacaattgctgatggtattgcggttagaaaccctggggacttaacttttgaaattgtaaaacattatgtagatgatattgttactgttgatgaagatgaaatcgctagtgctatattgtttttgatggaaagggcgaaaaccgtagctgaaggggctggagcggtatccgttgcagctgttttaaatcgattatctcattataaaaaaagtaaaattgtagcacttataagtggtggaaatattgacgtaaatcttttatcacgcattattaacagaggtttagtaaaggatggcagaaaaattttcttgaataccgttattccggacaagccaggaactctaagccaattactccagataattgccagcacaggagccaacgtgttatcagtaattcacaatcgagaagctataaatgtcccattgggttcggctcaggtagaattggagcttgaaacagctgaacctgaacaggttgaagagattcaaagtcttttaaaacagcaccattattttgtcaatatttccccaacgcttacttcattggatgtataa

SEQ ID NO: 3276 - protein, 409 aa, Carboxydothermus hydrogenoformans Z-2901
MVSLEEVKKASEILGKIAHKTPLVYNTTLSEMTGNHIYLKMENLQRTGSFKLRGAYYKIASLSENEKKRGVVASSAGNHAQGVALAATLYGIRSTIVMPRHAPLSKIKATSQYGAKVVLHGNVYDEAYEEAKRIQLETKATFIHPFNDPQVIAGQGTIALEILEDLPDVEVVVVPIGGGGLIAGIAVAIKNLRPKVHVIGVQAKNMPSMAESLARGQLTNISGHPTIADGIAVRNPGDLTFEIVKHYVDDIVTVDEDEIASAILFLMERAKTVAEGAGAVSVAAVLNRLSHYKKSKIVALISGGNIDVNLLSRIINRGLVKDGRKIFLNTVIPDKPGTLSQLLQIIASTGANVLSVIHNREAINVPLGSAQVELELETAEPEQVEEIQSLLKQHHYFVNISPTLTSLDV

SEQ ID NO: 3277 - DNA, 1209 bp, Geobacter metallireducens GS-15
  CDS (1)..(1209): transl_table=11
atgctcccctacaccctgatccaggaagcgtcagaccgcctcaaaaagcgggtccggcgcaccgagctgatccactcccaccacttcagcgagcggttcggcttcccccttctcttcaagtgcgagaacctccagcggaccggcgccttcaagatccggggagccctcaacttcatgacctcccagccccgggaggccctgacaaagggggtcatcaccgcctcggccggcaaccacgcccagggggtcgccttttccgccgacctcctgggggcgcaggccaccgtcttcatgcccgagagcaccccgccccagaaggtgcaggccaccaaggagtatggcgccgacgtagtcctcaccggcaggaacttcgacgaggcctatgccgccgcagtccaggcccagaaggagaccggcgccctcttcgtgcaccccttcgacgatcccctggtcatggccggccagggtaccatcggcctcgaaatcctcgatgaactccccgacgtctcagccatcctggtccccatcgggggaggcgggctcatcgccggcattgccacggcggtaaaggagactcacccccacgtgcggatcatcggcatcgaatccaaggccgcaccctccatgcacttctccctcaagaagggaaagatcgtggaggcccccctcacggttacccttgccgacgggatcgccgtgaagaaggtgggacggaacaccttccccatcatccgggaactggtggacgacgtggtgctcgtggaggaagaggagatcgccctggccatcgtggggctcctggagcggacgaaactcctcgtggaaggggctggagccgtgaccctggcggcccttctgaacggcaaggcggggaaactgccggggaagacggtctgcgtcctctccggcggaaacatcgacgtgaagaccatttccaccgtggtggagcggggccttgtggcggcggggcgctatctgaagctgcaggtggtgctggacgacattcccggttccctggcggggctggccacggaggtggctgctgtccgggccaacatcttcctcatcaaccacgagcgccgctccctggaccttcccctcggcaagaccgaggtccttctggaactggagacccggggctacgaacacatccaggagatcatcggccacctggggcgacggggctatgaggtggatgtcgtaaaatga

SEQ ID NO: 3278 - protein, 402 aa, Geobacter metallireducens GS-15
MLPYTLIQEASDRLKKRVRRTELIHSHHFSERFGFPLLFKCENLQRTGAFKIRGALNFMTSQPREALTKGVITASAGNHAQGVAFSADLLGAQATVFMPESTPPQKVQATKEYGADVVLTGRNFDEAYAAAVQAQKETGALFVHPFDDPLVMAGQGTIGLEILDELPDVSAILVPIGGGGLIAGIATAVKETHPHVRIIGIESKAAPSMHFSLKKGKIVEAPLTVTLADGIAVKKVGRNTFPIIRELVDDVVLVEEEEIALAIVGLLERTKLLVEGAGAVTLAALLNGKAGKLPGKTVCVLSGGNIDVKTISTVVERGLVAAGRYLKLQVVLDDIPGSLAGLATEVAAVRANIFLINHERRSLDLPLGKTEVLLELETRGYEHIQEIIGHLGRRGYEVDVVK

SEQ ID NO: 3279 - DNA, 1221 bp, Desulfitobacterium hafniense Y51
  CDS (1)..(1221): transl_table=11
ttgaccatgtccacactgctgacgttagaacagattcaagaggcacaacaggccattcacccttatattcaccggacacttctggatcattcaagcaatctaagcgccctggccgggacggagatctaccttaagctggagaatctgcagaagaccggttcctttaaagttcggggggctatgaataaagccttgaagctttctgaagaggagaagaaaaaaggaatcctggccgcttccgccggcaatcatgcccaaggggtagccatggcggctgcccgtatcggtattcccgcaacaattgtcatgccggaaaatgcccccctagccaaagtgtccgctacggaagggtacggagcccaggtcattctgtccggagcggtttttgatgatgcttatcagaaggcagtagagatccaaaaggaaacaggagccacgtttatccatgcctttgatgatctggaagttatggccgggcagggaaccatcggcttggaagtttttgaggagctgcctgaagtggatacggttcttgtccccatcgggggaggagggctgatcgcaggggttgctgtggctttgaaatccctgaagccttccgtgcgcgtgatcggtgtccaagcggccggagcggcaagcatggctcacgcgctgagcataggcaggcccgagccattagggcaggccagtactttggcagatggcattgcggtgaaaagggcaggtgatctaaccttcgcagcagtccgccattatgtggatgagatggtgacggttgaagaagaagagattagtcaagctattctcctgttgatggagcgcaccaaaacccttgctgaaggagccggggcggttgccgtagcggcggcgcttcagggtaagctggatcttaaggagcagaaaacggttctcatcctgagcgggggaaatattgacgtgaatttcctggcccagattatcgagcgggggctgaggcgttccgggcgtaccatggcctgtcagcttcttttgccggatcaacccggcaacttggaaaaagtgatcgagcttatagcccaggaacgggccaatatcatcaacatcgaacactcccgctatgatttagccgttcccctgcgctcagcccgtgttcatatgctgttggaaacccaaagctttgaacatcaaaagcgcattatccagcgtttagaaggtgccgggtatcccttgactgttaactga

SEQ ID NO: 3280 - protein, 406 aa, Desulfitobacterium hafniense Y51
MTMSTLLTLEQIQEAQQAIHPYIHRTLLDHSSNLSALAGTEIYLKLENLQKTGSFKVRGAMNKALKLSEEEKKKGILAASAGNHAQGVAMAAARIGIPATIVMPENAPLAKVSATEGYGAQVILSGAVFDDAYQKAVEIQKETGATFIHAFDDLEVMAGQGTIGLEVFEELPEVDTVLVPIGGGGLIAGVAVALKSLKPSVRVIGVQAAGAASMAHALSIGRPEPLGQASTLADGIAVKRAGDLTFAAVRHYVDEMVTVEEEEISQAILLLMERTKTLAEGAGAVAVAAALQGKLDLKEQKTVLILSGGNIDVNFLAQIIERGLRRSGRTMACQLLLPDQPGNLEKVIELIAQERANIINIEHSRYDLAVPLRSARVHMLLETQSFEHQKRIIQRLEGAGYPLTVN

SEQ ID NO: 3281 - DNA, 1218 bp, Myxococcus xanthus DK 1622
  CDS (1)..(1218): transl_table=11
atggtcaccctcgaggacatccaggccgcgcgcgagcgccttcgctcggccatccgccccacgccgtgcccgcagtcggactactacacggagcggacggagtgcgccgcggtgttcttcaagctggagaacctccagcgcaccggggccttcaaggagcgcggcgccctcaacaagctgctgacgctgaccgaggacgagcggcgccggggcgtcatcgccgcgtccgccggaaaccacgcgcagggtgtcgcgtaccacgcgcgtcggctgggcgtgagtgccaccatcgtcatgccggagcgcaccccgctcatcaaggtgtcgcgcacgcgggatgactacggcgcgcgcgtggtgctcaagggcaccaactacgacgaggcctacgcggaggcgctgcgcatccagaaggcggaggaccgcgtcttcatccaccccttcaatgacgcgcacgtcatcgccggccagggcaccatcggcctggagctgctggagcagtgccccgacctggaggtggtgctcgtccccattggcggcggcgggctcatctccggcatcgcgtgcgcgctgaaggagacgcggcccgacatccgcgtggtgggcgtgcaggcggagaccatcgccagcatgaaggcgtcggtggaggcgggcgagcgcgtgctgctggccgccgcgggcaccaccatcgcggacggcatcgccgtcaagcgcgtgggcgacctcaccttccccatggtgcagaagtacgtggacgaggtggtggccgtggacgaggaggaaatcgccgccgccatcctcaccctcctggagcaggagaagagcgtggtggagggcgccggcgcggtgggcctggcggcgctgctcagcggtgacgttcccgccgcgaggggccggcgcaccgccatcatcttgagcggtggcaacatcgacatgaacgtcatcagccgcatcatcgagcgcggtctggtgaaggctggccgcttggtgcagttggaggtccggctgccggaccggcccggaatgctggcgaagctcaccacgcaggtggccgacctgcgcgccaatgtcgtggagatccaccacgagcgcgccttctccaaggcgggcctgggcgaggccatggtggaggtgacgctggagaccaccgggcccgcgcaaatcgaggagctggagcgcgcgctccaccggctgggctggcaggtggcccgcaagtag

SEQ ID NO: 3282 - protein, 405 aa, Myxococcus xanthus DK 1622
MVTLEDIQAARERLRSAIRPTPCPQSDYYTERTECAAVFFKLENLQRTGAFKERGALNKLLTLTEDERRRGVIAASAGNHAQGVAYHARRLGVSATIVMPERTPLIKVSRTRDDYGARVVLKGTNYDEAYAEALRIQKAEDRVFIHPFNDAHVIAGQGTIGLELLEQCPDLEVVLVPIGGGGLISGIACALKETRPDIRVVGVQAETIASMKASVEAGERVLLAAAGTTIADGIAVKRVGDLTFPMVQKYVDEVVAVDEEEIAAAILTLLEQEKSVVEGAGAVGLAALLSGDVPAARGRRTAIILSGGNIDMNVISRIIERGLVKAGRLVQLEVRLPDRPGMLAKLTTQVADLRANVVEIHHERAFSKAGLGEAMVEVTLETTGPAQIEELERALHRLGWQVARK

SEQ ID NO: 3283 - DNA, 1209 bp, Clostridium perfringens ATCC 13124
  CDS (1)..(1209): transl_table=11
gtgattattttgtatttagaaaaaattattaaagcaaaaaaaaatatagaagatgtagttataaaaacacctttaatatacagcgaggttttttcaaggaaatctggaaaccaagtgtatatgaaatgtgaaaatttacaattaacaggtgcttacaaaataagaggtgccttaaataaaataagatccttatcagatgaagacaaagcaaaaggggttgtttgctcttctgctggaaatcatgctcaaggcgtagcttttgcagcatcacaagctaatgttaaatcaactatagtaatgccaaagactactcctctactaaaaatccaatcaacaaaggatttaggaggaaatgttgttttatcaggttatgtttatgatgatgcttttaatgaggctaaaagaattgaacaggaacaaggagccttatttatacacccatttaatgatattgatgtaatttgtggacaaggcacagtagccttagaaatatttgaagatttaaaggatgtagatgttattctctgccctataggtggcggtggcttaataagtggagttaccttagctgctaaggccttaaaccctaatgttaaagtaattggagtacaagcagaaggggcaaatgcaatggttaaaagttttaaggcaggagaaataattgctttagactctgttgataccattgctgacggaattgcagtaaaaagacctggtgatttaacatttaaatttataaaagaatatgttgacgatataataactgtatcagaccatgaaattgttgaagcattctttactttaagtgaaaaacataaacttctagcagaagcttcaggagctgtatcattagcagcctcttctaaattaaattttaaaggtaaaaatgtagtatcaataataagtggtggtaatatagatatggttactataaccgcattaataaatagtgcattagtagctaagggaagactttttggttttagtctagaagttcctcataaaccaggccaaatattaaaaattgctaaagttcttgctgatactaatgctaatatagtaaaacttgaacatgatcattttaaagcaacagatgctcttaagaacatggttatagaagtaaccttagagaccaatggccactctcatatagatgaaattaaaaaagctttaacagatcaaaactatgtaataaaacaaatttactaa

SEQ ID NO: 3284 - protein, 402 aa, Clostridium perfringens ATCC 13124
MIILYLEKIIKAKKNIEDVVIKTPLIYSEVFSRKSGNQVYMKCENLQLTGAYKIRGALNKIRSLSDEDKAKGVVCSSAGNHAQGVAFAASQANVKSTIVMPKTTPLLKIQSTKDLGGNVVLSGYVYDDAFNEAKRIEQEQGALFIHPFNDIDVICGQGTVALEIFEDLKDVDVILCPIGGGGLISGVTLAAKALNPNVKVIGVQAEGANAMVKSFKAGEIIALDSVDTIADGIAVKRPGDLTFKFIKEYVDDIITVSDHEIVEAFFTLSEKHKLLAEASGAVSLAASSKLNFKGKNVVSIISGGNIDMVTITALINSALVAKGRLFGFSLEVPHKPGQILKIAKVLADTNANIVKLEHDHFKATDALKNMVIEVTLETNGHSHIDEIKKALTDQNYVIKQIY

SEQ ID NO: 3285 - DNA, 1233 bp, Rhodococcus sp. RHA1
  CDS (1)..(1233): transl_table=11
atgctggcccgcgtggagcctgtcacgctggatcagatcagagcagctcgtaagctgctggaccccgtcatgcgccggacgccggtgatcgcgtcccgggcgctgtcggaacgatgcgggcacgtcgtgtcgttgaagtgcgaaaacttacagcgcacagggtctttcaaaccgcgcggtgcgtacaatcggatcgcgaacctgtcggtcgccgaacgggcctgcggggtggtggcggccagcgcgggcaatcacgcgcagggcgtggcctgggcggccacggaactgggtatcccgtccaccgtgttcatgccaaccggcgcaccccttccgaaactcgtcgctaccaaggcgtacggcgccaccgtccacctcacgggcgacacggtggacgacgcgctcgtcgccgcgaaggagttcgcgaacgagaccggcgccgtcctcatccacccgttcgatcacgtcgacatcgtcgccggacaggggaccgtggggctcgagatcctcgagcaggaacccgacgtcggcacgctcgtcgtcccgaccggtggcggtggactgatcgcgggtatcgccgcggcggtgaaggccacccggcccgacgtgcggatcgtcggcgtccaggccgagcaggcggccgcctggccgcgttcgctggcggagggccgcccgataccgctggagaccatgtcgaccatggccgacggcattgcggtcggccggcccggcgacgttccgttcgcgcacgtcggctcgcaggtcgacgccatcgtcacggtcagcgaggacgccctgtcccgggcgctgctgctgtgcctcgaacgcgcgaagctcatcgtggagcctgcgggcgcggccgcggtggccgcgttgatcagctgctcgacggacgagctgggactcaccgggaaggtgtgcgcggtgctgtcgggtggcaacatcgacccgttgctgctcacccatgtcgtcaatcacggtctccgggctgccggacggtatctcggtgtgcacgtgaccattccggaccgaccgggtggtctggtcagtctcctcggcgtgatcagcggcaacggcgccagcgtcgtggacgtcgtccactcccgcaccggtggcgcgctcgcgctcgacgaggtggaggtgttcctcaccgtcgagacccgtggtcccggacaccggcaggatctccttgacgccctgcgcgacgcccagtacacgattcggctgcaggagtag

SEQ ID NO: 3286 - protein, 410 aa, Rhodococcus sp. RHA1
MLARVEPVTLDQIRAARKLLDPVMRRTPVIASRALSERCGHVVSLKCENLQRTGSFKPRGAYNRIANLSVAERACGVVAASAGNHAQGVAWAATELGIPSTVFMPTGAPLPKLVATKAYGATVHLTGDTVDDALVAAKEFANETGAVLIHPFDHVDIVAGQGTVGLEILEQEPDVGTLVVPTGGGGLIAGIAAAVKATRPDVRIVGVQAEQAAAWPRSLAEGRPIPLETMSTMADGIAVGRPGDVPFAHVGSQVDAIVTVSEDALSRALLLCLERAKLIVEPAGAAAVAALISCSTDELGLTGKVCAVLSGGNIDPLLLTHVVNHGLRAAGRYLGVHVTIPDRPGGLVSLLGVISGNGASVVDVVHSRTGGALALDEVEVFLTVETRGPGHRQDLLDALRDAQYTIRLQE

SEQ ID NO: 3287 - DNA, 1215 bp, Nocardioides sp. JS614
  CDS (1)..(1215): transl_table=11
atgactgaggtcccgacggtcgggctggccgacatcgaggaggcccgccgggtcctggccggcgtcgcgatccagaccccgatggaggagtcccgctggctctcggcgatcgccggcgggccggtgtggctcaagtgcgagaacctccagcgcaccgggtccttcaagccccgcggcgcctacgtgcgcatctcccggctcacccccgaggagcgggcccgcggggtcgtggcggcctcggcgggcaaccacgcgcagggcgtggcgctggccgcgcagctgctcggcatcaaggccaccgtcttcatgcccgagggggcgccgatccccaaggagaaggcgacccgcgggtacggcgcggaggtgctcttccacggccggtacctcgaggacgcgctggccgaggcgaccgtgttcgccgagcgcaccggcgcggtgctgatccaccccttcgaccacgccgacgtcgtcgccggccagggcacggccggcctcgagatcctcgagcaggcgcccgacctgcagacggtgctggtccccaccggcggtggtgggctgctggcgggggtcgcgatcgcggtgaaggcgcggcgccccgacgtccgggtgatcggggtgcaggcggccggcgccgcggcgtaccccggctcgctcgccgaggggcaccccgtcgccctgacctcgatgaagacgatggccgacggcatcgccgtgggcctcccggggcaggtcaccttcgcggcggtgcgcgaccacgtcgacgagatcgtcacggtctccgagaactcgctgtcccgctcggtgctggccgtgctggagcgcgcgaagatgctggtcgagcccgccggagcggccgcggtcgccgccgtgctggaccggccggacatcttcgcgacccccgcggtggtcgtgctctcgggcggcaacatcgaccccctgctgctcggcaaggtgatccggcacggcatggcggccgccggccgctacctgaacctacgggtctgcatccccgacctgccgggcgggctcgcgcagctgctcaccgacatctccgcggtcggagcgaacgtgctcgaggtcgcgcacgagcggatctcacccacgctgaacctcgacgaggtcgaggtgcacgtccagctcgagacccgcggggagccgcacaccgcgcaggtgctggcgcgcctgcgcgagcgcggctaccgcgtgtacgagtag

SEQ ID NO: 3288 - protein, 404 aa, Nocardioides sp. JS614
MTEVPTVGLADIEEARRVLAGVAIQTPMEESRWLSAIAGGPVWLKCENLQRTGSFKPRGAYVRISRLTPEERARGVVAASAGNHAQGVALAAQLLGIKATVFMPEGAPIPKEKATRGYGAEVLFHGRYLEDALAEATVFAERTGAVLIHPFDHADVVAGQGTAGLEILEQAPDLQTVLVPTGGGGLLAGVAIAVKARRPDVRVIGVQAAGAAAYPGSLAEGHPVALTSMKTMADGIAVGLPGQVTFAAVRDHVDEIVTVSENSLSRSVLAVLERAKMLVEPAGAAAVAAVLDRPDIFATPAVVVLSGGNIDPLLLGKVIRHGMAAAGRYLNLRVCIPDLPGGLAQLLTDISAVGANVLEVAHERISPTLNLDEVEVHVQLETRGEPHTAQVLARLRERGYRVYE

SEQ ID NO: 3289 - DNA, 978 bp, Rhodobacter sphaeroides 2.4.1
  CDS (1)..(978)
atgagcgacatcgcgatgatcgaggctgcagcggcccggcttgcgggccatgcccggcggacgccgcttctctcctcgccctttctcgacgagatcgcggggcggcgggtgctggtgaaggccgagtgcctgcagcacacgggctcgttcaagttccgcggcggctggtcggcgctctcggcgctggagccggcccggcgcgcgcagggcgtgatggcctattcctcgggcaaccatgcgcagggcgtggcgctggccgcggcccgccacggcgcgcccgccgtgatcgtcatgcccgccgatgcgccgcagctgaagatcgagaacacccgcgcgctcggcgccgaggtggtgctctacgaccgcgcgaccgaggaccgcgatgcgatcggcgcgcggctggccgacgagcggggtctcaccctgatccgccccttcgacgagcccctcgtgatcgccggtcagggcacgaccgggctcgagatcgccgagcaggcggccgaggagggcgtgacctctgccgatgtcctcacctgctgcggcggcggcgggctcaccgcgggcatcgcgctggcgctcgaggcgcgcgcgcccggcctccgggtccgcccggtcgagccggtggggttcgacgatacggcacgcagcctcgccgccggcgagatccggtcgaacgcggcgctctcgggctcgatctgcgatgcgatcgtgacgccccagccgggccggatcacctttccgatcctcgcgcggctctgcgggccgggcctcgccgtcaccgacgcggaggcgctccgcgccatggcgctggccttcctgcggctcaagatcgtgctcgagcccggcggggcggtggcgctggccgcggcgctcttccggcccgacgcgctcgagggcgacgccgtgatctgcaccgcctcgggcggcaatgtggatccgcccctctttgcccgcgccctcgcggaggccgccgactga

SEQ ID NO: 3290 - protein, 325 aa, Rhodobacter sphaeroides 2.4.1
MSDIAMIEAAAARLAGHARRTPLLSSPFLDEIAGRRVLVKAECLQHTGSFKFRGGWSALSALEPARRAQGVMAYSSGNHAQGVALAAARHGAPAVIVMPADAPQLKIENTRALGAEVVLYDRATEDRDAIGARLADERGLTLIRPFDEPLVIAGQGTTGLEIAEQAAEEGVTSADVLTCCGGGGLTAGIALALEARAPGLRVRPVEPVGFDDTARSLAAGEIRSNAALSGSICDAIVTPQPGRITFPILARLCGPGLAVTDAEALRAMALAFLRLKIVLEPGGAVALAAALFRPDALEGDAVICTASGGNVDPPLFARALAEAAD

SEQ ID NO: 3291 - DNA, 1053 bp, Xylella fastidiosa Dixon
  CDS (1)..(1053)
atggatatacctgatgtaggtcacaccgttgtcaagcaatccaatgcaagtaacgtcaataccgtgagtgtggccgatgtgttggctgcacaagcccgcttacgtcgttatctaatgcctaccccaattcactatgccgagcgtttcggagtgatgctgaagttagaaaatctgcaacgcaccggatcctataaagtgcgcggcgcactgaacgcaatgttagttgcgctggaacgcggcgataaccgcccagtcatttgcgcatcagccggtaaccacgcccaaggcgtagcttggtcagcttaccggctgggtatacaagcaatcactgtcatgcctcacggtgctccggccacaaaggttgcaggtgtttcacattggggggcaacggtacgccaacacggccaaagctatgacgaggcctatacgttcgcatgtgagttggctgagcaaaacgattaccgctttctatcagcattcgatgatccggatgtgattgccggtcagggaactgttggcatagagatcaccgcgcatgaaccggatgtagtcattgtgccgatcggcggcggcggccttgcttcaggcattgctttggtgctgcgctcacagggagtacgtgtcattggcgctcaggtcgagggcgtggatgcgatggcgcgtgcaatccgtggcgacacacgcgagatcgctccagtttcgaccttagctgacggggtgaaagtcaagattcctggtttcattacccgccatctgtgtgccaacttgttagacgatgtagtaatcgtgcgtgaggctgaactgcgcgaaacattggtgcgtttactattggaagaacacctgatcgccgaaggggcaggcgcactggcattggccgctggccgccgcgtttcaggtaagcgcaagtgtgcagtggtctccggaggtaatattgacgctgcagtactggccaaactgttgtcagaagtaagaccacggccaccacgcaaaccacgcagacgtagtgcagatcgccccaacaattccggcaatttaccgctcccttttaactga

SEQ ID NO: 3292 - protein, 350 aa, Xylella fastidiosa Dixon
MDIPDVGHTVVKQSNASNVNTVSVADVLAAQARLRRYLMPTPIHYAERFGVMLKLENLQRTGSYKVRGALNAMLVALERGDNRPVICASAGNHAQGVAWSAYRLGIQAITVMPHGAPATKVAGVSHWGATVRQHGQSYDEAYTFACELAEQNDYRFLSAFDDPDVIAGQGTVGIEITAHEPDVVIVPIGGGGLASGIALVLRSQGVRVIGAQVEGVDAMARAIRGDTREIAPVSTLADGVKVKIPGFITRHLCANLLDDVVIVREAELRETLVRLLLEEHLIAEGAGALALAAGRRVSGKRKCAVVSGGNIDAAVLAKLLSEVRPRPPRKPRRRSADRPNNSGNLPLPFN

SEQ ID NO: 3293 - DNA, 975 bp, Nostoc punctiforme PCC 73102
  CDS (1)..(975)
atgtcacaaactaattccgttactataactgatgtgcaagcagcacaagagcgaattttgggaattgcccatcgcacgccggtgctaacttctagaatggttaacgatcgcaccaatagccaagtattctttaaatgcgagaactttcaacgcaccggggcatttaaatttagaggggcgtataatgccttagcgcaactatcggtagcccaaaaacaaacaggcgttatcacctattcatcaggaaatcatgctcaagcgatcgctctagctggtaaactcctcaatatccctaccactattgtcatgcctgatgatgcacccactgtcaaacaaactgcgactcgtggttatggtgcagagataattttatacaatcgccaggaggcaaaccgagaagaattagcccaaagtttagcaagcgatcgctctttgacactcatccctccttacgatcatccccatgtagtcgccggacagggaacaactgctttagaactgattcaagaagttggtgaattggacttgctattagtttgttgtggcggtggcggattactttcaggatgtgcgatcgcagctaaagcacttttacccaattgtaaagtaatcggggtagaaccagcacttgccgacgatgctacccgctcttttcacaccaaaaccctgcaaactgtcaagaatcctgataccatcgccgatggtgcgcggactcctagccttggtaaaattactttccccttagtgctgcattacgtcgatgatatggtgacggtatctgaagaagcaattcttcgcaccatgtttttcttgtgggaacgtctgaaaattgtagttgaacccaccggagtacttgcagccgcagccttactcgaaggtgtggtgacagcaccagagtcgaggattggtgtgatcatcagtggtggaaatgtcgatttggcgcaagttggtaaattgttttctggtggattttga

SEQ ID NO: 3294 - protein, 324 aa, Nostoc punctiforme PCC 73102
MSQTNSVTITDVQAAQERILGIAHRTPVLTSRMVNDRTNSQVFFKCENFQRTGAFKFRGAYNALAQLSVAQKQTGVITYSSGNHAQAIALAGKLLNIPTTIVMPDDAPTVKQTATRGYGAEIILYNRQEANREELAQSLASDRSLTLIPPYDHPHVVAGQGTTALELIQEVGELDLLLVCCGGGGLLSGCAIAAKALLPNCKVIGVEPALADDATRSFHTKTLQTVKNPDTIADGARTPSLGKITFPLVLHYVDDMVTVSEEAILRTMFFLWERLKIVVEPTGVLAAAALLEGVVTAPESRIGVIISGGNVDLAQVGKLFSGGF

SEQ ID NO: 3295 - DNA, 1266 bp, Bifidobacterium longum DJO10A
  CDS (1)..(1266)
atggaacaaaaggatgttttgaaggcgctgcaacgtgatcatgcagccgaactgaagctggccgccgaacgactcaaaggcactgcccgccacacggagatcattccttctccggtgctgagcgagatgaccggccatgagattctcctgaagccggaaaacctgcaggtcaccggatccttcaagatccgcggtgcctataacaagattgcttcgctcaccgaagagcagatcgctcacggcatcgtcaccgcgtctgccggcaaccatgcccagggtgtggcctatgcggcccgcgagcgtggagccaaggccaccatctgcatgccgcagatcaccccgccgctgaaggtcgatgccaccaaggcctacggtgccgacgtggtgctgtacggcgatgtgttcgatgaatccgccgcccacgctgctgagctcgccgacaaggaaggcatgatttacgtgccgccattcgacgattacgaagtcatctgcggccaaggcaccatcggtctggagatccttgaagacgtgccgaacgtcactgacgtggtcgtgccgctcggtggtggtggcctgggtgccggcgtggcgctcgccatcaagacattcaagcctgaagtgcgcgtaatcggtgcgattccggagggctcaccggcctggaaggactcgctggccgcgggtcgtgtgtctccggctgaccatgtggttacctccgccgaaggtgttgcggtcaagcaccccggcgacctgcccttcgctctgattaacgagttcctggacgatctggtcaccgtcaccgagcgcgacatcaacgaaatgattctgctcatgctcgagaagcataagctggtggtcgaggcggccggcgccgtttcgctggctgcgctggaacacctgaacctgcgttcgcgcaagttcgccgccgccaccggcccgcacgtggtggttccgattatgtccggcggcaatatcgacaccgtgaccatgggtgcggtgattcagaaaggtatgatcgcccgcggccgcatcatgaacttcgaggtcgagctgccggatactccgggccagctcgtcaaggtggccaccctgcttgccgagcagcgcgccaacgtcattcagcttgatcacgaccagttcaaggcatccggccactacaccaacgcggtgtctctcggcgtcacggtcgagaccaacggccccgagcacatcgaccgcatcctcgcggcactcagggaagccggattccagcccaagcgcatctactga

SEQ ID NO: 3296 - protein, 421 aa, Bifidobacterium longum DJO10A
MEQKDVLKALQRDHAAELKLAAERLKGTARHTEIIPSPVLSEMTGHEILLKPENLQVTGSFKIRGAYNKIASLTEEQIAHGIVTASAGNHAQGVAYAARERGAKATICMPQITPPLKVDATKAYGADVVLYGDVFDESAAHAAELADKEGMIYVPPFDDYEVICGQGTIGLEILEDVPNVTDVVVPLGGGGLGAGVALAIKTFKPEVRVIGAIPEGSPAWKDSLAAGRVSPADHVVTSAEGVAVKHPGDLPFALINEFLDDLVTVTERDINEMILLMLEKHKLVVEAAGAVSLAALEHLNLRSRKFAAATGPHVVVPIMSGGNIDTVTMGAVIQKGMIARGRIMNFEVELPDTPGQLVKVATLLAEQRANVIQLDHDQFKASGHYTNAVSLGVTVETNGPEHIDRILAALREAGFQPKRIY

SEQ ID NO: 3297 - DNA, 981 bp, Psychrobacter sp. 273-4
  CDS (1)..(981)
atgatcacaaatgatgatggattagtgattccaacccttgatgatatgctagaggcgcatgagcgcattaagccatatatccatcgcactcctgttttgacctctcgctttttaaacgaaatggcaggctgtgagatgttctttaaatgtgagaactttcaaaaagcgggtgcctttaaagtacgcggcgcatcaaacgcggtgtttggtctgtctgacgaagccgcaaaaaatggcgtctgtacacacagctcaggcaaccatgccctgtctttatcttatgcagcgggtcgacgcggcgtaccgtgtcatgtggtgatgccgcatagtgcaccagaagctaaaaaagcggcagtccgtggctatggtggtatcattactgagtgtgagccatcaaccacttcacgcgaagaagtgtttgccagagttcaagcagaaacaggcggcgactttgtccatccgtacaatgatccacgcgtaatcgccggacaagcgacttgctcacgtgaatttctagagcaaatggaagagatcggtcaaaaacctgacatggttgtggcacctattggtggtggtggcatgatttcaggcacttgcttaacgctatcgaacctagcccctgatgtcaaaatttatgctgcagagccagtaaatgctgatgatgctgcacgctcatttaaagccggttatattatcgctgatgatgcacccgatactatcgctgatggcttaaaagtaccgcttaaagatttgacctggcattttgtcagtaattatgtgactgacattttgactgcgactgaagaagaaatcgttgaagcgatgaagctgacttggactcatatgaaaattatcatcgagccaagttgtgcagtaccgcttgctgtcatcttgaagaacaaagacgtttttgcaggtaaaaaggttggcgtcatcatcactggtggtaacgttgatctagacaaattgccttggaactaa

SEQ ID NO: 3298 - protein, 326 aa, Psychrobacter sp. 273-4
MITNDDGLVIPTLDDMLEAHERIKPYIHRTPVLTSRFLNEMAGCEMFFKCENFQKAGAFKVRGASNAVFGLSDEAAKNGVCTHSSGNHALSLSYAAGRRGVPCHVVMPHSAPEAKKAAVRGYGGIITECEPSTTSREEVFARVQAETGGDFVHPYNDPRVIAGQATCSREFLEQMEEIGQKPDMVVAPIGGGGMISGTCLTLSNLAPDVKIYAAEPVNADDAARSFKAGYIIADDAPDTIADGLKVPLKDLTWHFVSNYVTDILTATEEEIVEAMKLTWTHMKIIIEPSCAVPLAVILKNKDVFAGKKVGVIITGGNVDLDKLPWN

SEQ ID NO: 3299 - DNA, 969 bp, Ralstonia eutropha JMP134
  CDS (1)..(969)
atgaccgaactgaagctaccaacgtacgcagacgtccaggaagccgcgaagcgccttgatggcgttgccaaccgcacgccggtcaatacgtcgcgcacgctcaatgacatgctcggcgccgaagtcttcttcaaatgcgagaatttccagcgcatgggagcgttcaagttccgcggcgcgtacaacgcgctggcgaagttcagccccgcgcaacgccgagcgggtgtggtggcgttctcgtcgggcaaccatgcgcagggcatcgcgctgtcggcaaagctgcttggcattcccgccaccatcgtgatgccgcacgacgcaccggcggccaaggtcgcggccaccaaaggctacggcgccaatgtcgtgatctacgaccgctacaccgaggaccgcgaagccatcgggcgccgcctggccgacgaacacggcttcacgctgattccgccctatgaccatccggacgtcctgtccggccagggcacggcagcaaaggaactgttcgaggcggtcggcgcactggacgtcgtgctgacgccgctcggcggcggtggattgctatccggcaccgcactgaccacacgcgcgctgtcgccgcaatgcaagctctttggcgtcgaacctgaagccggcaacgatggacagcagtcgttccgcagcggcgccatcgtgcacatcgataccccgaagaccattgcggacggcgcccagacgcagcatctcgggcagtacacgttcagcatcatcaagcgggacgtcgacgatatcctgacggcgtccgatgcccaactggtggaagcgatgaagttctacgccacacgcatgaagatgatcgtcgagcccacgggctgcctaggcctggccgccgccatgcatatgaaggatgcgctgaagggcaagcgcatcggcatcatcatcagcggcggcaatatcgacctggagcggttctgcgaactggtgtcggcgtaa

SEQ ID NO: 3300 - protein, 322 aa, Ralstonia eutropha JMP134
MTELKLPTYADVQEAAKRLDGVANRTPVNTSRTLNDMLGAEVFFKCENFQRMGAFKFRGAYNALAKFSPAQRRAGVVAFSSGNHAQGIALSAKLLGIPATIVMPHDAPAAKVAATKGYGANVVIYDRYTEDREAIGRRLADEHGFTLIPPYDHPDVLSGQGTAAKELFEAVGALDVVLTPLGGGGLLSGTALTTRALSPQCKLFGVEPEAGNDGQQSFRSGAIVHIDTPKTIADGAQTQHLGQYTFSIIKRDVDDILTASDAQLVEAMKFYATRMKMIVEPTGCLGLAAAMHMKDALKGKRIGIIISGGNIDLERFCELVSA

SEQ ID NO: 3301 - DNA, 948 bp, Mesorhizobium sp. BNC1
  CDS (1)..(948)
atgtacattccgaatcttaccgacgtgcttgcagcacgagccttaatcgaaccccatattcatcgcacacccgttctcacatcgacattcatcaatggacttgctggcgccgaactcttcttcaagtgcgagaaccttcagaaggctggggccttcaaagcgcgcggcgcgtcgaacgcggtgtttggcctgaacgacgagcaggcgaagaagggtgttgcaacgcactcgtccggcaatcacggaacctgcctttcctatgcagctggtcggcgcggcattccctgcaccgtagtgatgccgcgcaccgcgccgcaggctaagaaggatgcggtccggggctacggcggtcgtgtcgtcgaatgcgagccgtcaacctcgtcgcgtgaggccgtctttgccgaggttgttgccgagaccggcgcggaattcgtgcatccctataacgaccatcgtgtcatcgccgggcaggcgacctgctctgccgagttgatcgagcaggtcgacggtctcgacgccgtggtcgcgccgattggcggcggcggcatggtgtcgggaagctgcctgacgctctccaatctcgcgcccggcgtaaagatctacgccgccgagcccgagcaggccaacgacgcctaccgtagcttcaaggccggccgcatcatcgccgacgacgcgccagaaacggtcgccgacggcctgaaagtgccgctgaaggaactgacctggcatttcgtgaagaacaacgtcaccgacatcctgacggcttccgagcaggagatcgtcgacgcgatgaagctgatctggaagcgcatgaagatcgtgatggagccgtccagcgccgtgccgctggcgaccatcctgaagaaccctgatgtctttgccggcaagcgcgtcggcgtgatcgtgacgggcggcaatgtggatctcgacaaattaccgtggaactga

SEQ ID NO: 3302 - protein, 315 aa, Mesorhizobium sp. BNC1
MYIPNLTDVLAARALIEPHIHRTPVLTSTFINGLAGAELFFKCENLQKAGAFKARGASNAVFGLNDEQAKKGVATHSSGNHGTCLSYAAGRRGIPCTVVMPRTAPQAKKDAVRGYGGRVVECEPSTSSREAVFAEVVAETGAEFVHPYNDHRVIAGQATCSAELIEQVDGLDAVVAPIGGGGMVSGSCLTLSNLAPGVKIYAAEPEQANDAYRSFKAGRIIADDAPETVADGLKVPLKELTWHFVKNNVTDILTASEQEIVDAMKLIWKRMKIVMEPSSAVPLATILKNPDVFAGKRVGVIVTGGNVDLDKLPWN

SEQ ID NO: 3303 - DNA, 975 bp, Mesorhizobium sp. BNC1
  CDS (1)..(975)
atgaccgacattgccatgatcgaagccgcgcggagccgcattgcgggccatgtgcgccgcacaccgctccttttctcgccgtttttcgatgaaatcgcaggccggcgtgttcttgtgaagaccgagtccctccagcttaccggctctttcaagttccgcggtgcctggtcggcgatatcggcgctggacccggacgttcgggcgaaaggcgtgctcgccttttcctcgggcaatcatgcgcaggccgtggcgctcgccgcgcgaatgcacggcatttcttccaccatagtcatgccatccgacgcgccgaagctgaagatcgaaaacacgcgggcctatggcgccgaagtggtgctctatgatcgcgcgaaagaggaccgtgatgcgatcggtgtgaagctcgcggctgaaaggggacttacgctgatcaagcccttcgacgagccgctggtcattgccggccagggcactacgggccttgagctcgcggagcaggccaaggaaataggcgtggaaagggcggaagtgcttgtcccctgtggaggtggcggactcacctccggcatagcgctagcgcttgaagcgcgtgcaccccggctcaaggcgcgcccctgcgagcccgcgggcttcgacgatgtgacccgctccctcgcttccgggaagatcgagcgcaatgcggcgatgtcaggttcgatctgcgacgccattgtcacgccgtcgcccggcacgatcacctttccgatcctgaggcggctttgcggcgcgggaatcgtcgtaaccgacgaggaggcgctgcatgcaatggcgctggccttcacccggctcaagatcgtggtagagccgggcggcgcggtggcgctcgcggcagcactgttccatggcgaggagatggcggctgacacggttatcgcggttgcctccggcggcaatgtggatgccgccttgtttcggcaggctctggaacggtttgcttag

SEQ ID NO: 3304 - protein, 324 aa, Mesorhizobium sp. BNC1
MTDIAMIEAARSRIAGHVRRTPLLFSPFFDEIAGRRVLVKTESLQLTGSFKFRGAWSAISALDPDVRAKGVLAFSSGNHAQAVALAARMHGISSTIVMPSDAPKLKIENTRAYGAEVVLYDRAKEDRDAIGVKLAAERGLTLIKPFDEPLVIAGQGTTGLELAEQAKEIGVERAEVLVPCGGGGLTSGIALALEARAPRLKARPCEPAGFDDVTRSLASGKIERNAAMSGSICDAIVTPSPGTITFPILRRLCGAGIVVTDEEALHAMALAFTRLKIVVEPGGAVALAAALFHGEEMAADTVIAVASGGNVDAALFRQALERFA

SEQ ID NO: 3305 - DNA, 990 bp, Anabaena variabilis ATCC 29413
  CDS (1)..(990)
atgtcacagcttaactctgtaaccataactgatgtgcaagcagcacagcagcgtcttgctggtattgcccatcgcacacctgtgttaacttccacaactgtcaacgatcgcactcataatcaagtctttttcaagtgcgaaaattttcaacgcacaggtgcttttaaatttaggggtgcttataatgccttagcacagctatcaccaacacaaaaacacaaaggtgtgttgactttttcttcggggaatcatggacaagcgatcgcccttgcaggtaagttactcaacatccccacaactattgtcatgcctgatgatgcacctgtcatcaagcaaacagctaccaaaagttacggtgcagaggtaattttatataatcgccaagaaacgaatcgggaagaattggcgcaaaatctcgcaagcgatcgcggtttaaccctaattcctccatacgatcatccccatgtgatcgctggacaaggtacagccgcattagaactggtgcaagaaattggtgaactggatttgctgttagtttgttgtggcggtgggggattaatttccggttgtgcgatcgccgctaaagctcttttacctaatttgcgcgtaattggtgtagaaccaacactcgctgatgatgctactcgttccttttacaccaaaaccctacaaaccgtcacaaatccccatactatcgctgatggtgcgcggactcctagcctgggacagatgacatttcccctagttttacaatacgttgatgatatggtgacggtatcagaggaagcaattattcgcaccatgtttttcctctgggaacggctgaaaatagtcgttgaacccacaggcgtattagccgcagccgctttacttgaaaatgtagtcaaagcacaaggaaagagaattggtgtgattatcagtggtggaaatgtagatttaaccaaagttgctagttatgtcaacttagtcactgaatttggtaatgggtga

SEQ ID NO: 3306 - protein, 329 aa, Anabaena variabilis ATCC 29413
MSQLNSVTITDVQAAQQRLAGIAHRTPVLTSTTVNDRTHNQVFFKCENFQRTGAFKFRGAYNALAQLSPTQKHKGVLTFSSGNHGQAIALAGKLLNIPTTIVMPDDAPVIKQTATKSYGAEVILYNRQETNREELAQNLASDRGLTLIPPYDHPHVIAGQGTAALELVQEIGELDLLLVCCGGGGLISGCAIAAKALLPNLRVIGVEPTLADDATRSFYTKTLQTVTNPHTIADGARTPSLGQMTFPLVLQYVDDMVTVSEEAIIRTMFFLWERLKIVVEPTGVLAAAALLENVVKAQGKRIGVIISGGNVDLTKVASYVNLVTEFGNG

SEQ ID NO: 3307 - DNA, 1044 bp, Burkholderia cepacia R1808
  CDS (1)..(1044)
  misc_feature (977)..(977): n is a, g, c or t
atgtcgactgaatcaacgggcccggcccatacgacgatcgacggcgagccgattccgacgctcgacgaaatcgccgcgcagcatttcgcgttgtcgccctgggtcgcgcgcacgccggtattcgaacgcgccgatctgccgacgctcgaaggtacgcacgtcaacttcaagttcgagctgctgcaggcgagcggcagcttcaaggcgcgcggcgcgttcacgcacgtgctcgcgctcgacgaagcgcgcaagaacgccggcgtcacctgcgtgtcggccggcaatcatgcggcggccgtcgcatatgcggcgatgcggctcggcagcagcgccaaggtcgtgatgccccataccgcgagcccggtgcgcatcgcgcagtgccgcgcgtatcgcgcggaagtcgtgctggccggcagcgcgtcgcaggcattcgacctcgtgcggcgcgtcgaggccgaggaaggccgcttcttcatccatccgttcaacggctatcgcacgattctcggcacggcgacgctcggctacgaatgggcgacgcagacgcccgacctcgatgcggtgatcgtgccgatcggcggcggcggcctcgcggccggcatggccaccgcattgcgcctcgcgaatccgcgcgtgcacgtgtacggcgtcgagcccgaaggcgccgacgcgatgtgccgcagcttcgcggcgaaccacacgatcaagatgggcgcgatgcagagcatcgccgattcgctgatggcgccgcacaccgaggaatacagctatcagctgtgccggcgtcacgtcgaccggatcgtcacggtgtcggacgacgcgctgcgcgcggcgatgctgttcctgttctcgcatctgaagctagcggtcgagccccgcgtgcgcggccgcgctcgcggggctgctcggcccgctgcgcgaaacgctgcagggcaagcgggtcggcgtgctgctgccgggcacgaacaccgatccgnccacgctcggcatgcatctcgcgcacgcgcagatgcagcgctgaacccgctcgcgacgctcaggtag

SEQ ID NO: 3308 - protein, 347 aa, Burkholderia cepacia R1808
  misc_feature (326)..(326): The Xaa at location 326 stands for Ala, Asp, Gly, or Val.
MSTESTGPAHTTIDGEPIPTLDEIAAQHFALSPWVARTPVFERADLPTLEGTHVNFKFELLQASGSFKARGAFTHVLALDEARKNAGVTCVSAGNHAAAVAYAAMRLGSSAKVVMPHTASPVRIAQCRAYRAEVVLAGSASQAFDLVRRVEAEEGRFFIHPFNGYRTILGTATLGYEWATQTPDLDAVIVPIGGGGLAAGMATALRLANPRVHVYGVEPEGADAMCRSFAANHTIKMGAMQSIADSLMAPHTEEYSYQLCRRHVDRIVTVSDDALRAAMLFLFSHLKLAVEPRVRGRARGAARPAARNAAGQAGRRAAAGHEHRSXHARHASRARADAALNPLATLR

SEQ ID NO: 3309 - DNA, 978 bp, Burkholderia cepacia R1808
  CDS (1)..(978)
atgaccaacccgacccttcccacctacgacgacgtcgcggccgccgccgcgcgcctgcagggccacgcgcaccgcacgcccgtgatgacgtcgagcacgctcgacgacgcgctcggcgcgcaagtgttcttcaagtgcgagaacctgcagcgcatgggtgcgttcaagttccgcggcgcgttcaacgcgctgtcgcgcttcgacgccacgcagcgccgcaacggcgtggtcaccttctcgtcgggtaaccacgcgcaggcgatcgcgctgtcggcgcgcatgctcggcatcccggcgacgatcgtgatgccgcaggacgcgccggccgcgaagatggccgccacgcgcggctacggcggcaacgtcgtgacctacgaccgctatacggaagaccgcgagcagatcggccgcgagctggcggagaagcacgggctcacgctgatcccgccgtacgaccatgcggacgtgatcgccggccagggcacggcggcgaaggagctgttcgacgaagtcgggccgctggacgcggtgttcgcgccgctcggcggcggcggcctgctgtccggcaccgcgctcgcgacgcgggcgctgtcgccgcaagcgaagctgtacggcgtcgagcccgaagccggcaacgacggccagcaatcgttccgcagcggcgcgatcgtgcacatcgacacgccgcgcacgatcgccgacggcgcgcagacgcagcatctgggcaacctcacgttccagatcctgcgacgcgacgtcgacgacatcctgacagcgaccgacgccgaactggtcgacagcatgcggttcttcgcaacccggatgaagctcatcgtcgagccgaccggctgcctgtcgctcgcggccgcacgcaagatgaaggacgaactcgcgggcaagcgcgtcggcatcgtgatcagcggcggcaacgtcgacctcgcgaacttcgccgcactggtttccagtcccgccgcatga

SEQ ID NO: 3310 - protein, 325 aa, Burkholderia cepacia R1808
MTNPTLPTYDDVAAAAARLQGHAHRTPVMTSSTLDDALGAQVFFKCENLQRMGAFKFRGAFNALSRFDATQRRNGVVTFSSGNHAQAIALSARMLGIPATIVMPQDAPAAKMAATRGYGGNVVTYDRYTEDREQIGRELAEKHGLTLIPPYDHADVIAGQGTAAKELFDEVGPLDAVFAPLGGGGLLSGTALATRALSPQAKLYGVEPEAGNDGQQSFRSGAIVHIDTPRTIADGAQTQHLGNLTFQILRRDVDDILTATDAELVDSMRFFATRMKLIVEPTGCLSLAAARKMKDELAGKRVGIVISGGNVDLANFAALVSSPAA

SEQ ID NO: 3311 - DNA, 1002 bp, Bacillus cereus G9241
  CDS (1)..(1002): transl_table=11
atgataactaaaaaactaccattgcatatagacgatattaaaaaagctcaaactattttggacagaaatgttcgtaaaactccattagtaaaatcattttatttgactagtaaaacaggtggagaaattcacttgaaattagaaaatatgcaattaacaggttcgtttaaattccgtggtgcgtttaataaaatgtcacagcttacagatcaagaaaaagaaagaggagtaattgcttgttctgctggtaatcatgcgcaaggaattgctttatctgctcatttacttggtattaagagtaaaattgttatgccgatttctgcaccgcaggcgaaagttgatgcgactaaaggatatggatctgaagtagttttacatggtgaaacctttgatgatgcgaaggcaaaatgtgaggagattattagggaaacaggtgaaacatatttacatccatatgacgatgtagaagtaatggcaggtcaaggtacaataggattagatattcttgacgatatgtgggatgttgatactatcattgtaccaattggtggaggtggaattatttctggtattgctgttgcattaaaatcttttaatccatcgattcatataattggtgtccaagcagataatgttcatgggatgaaggcatcttatgacaaaggtacaattgtagaacattataaggcacctactatagcagatggttgcgcggttaaaataccaggcaatttaacttttgaagttgtaaaagaattagtagatgatattgtaacagtatcagaaggcgaattagaagtagcgatgaaagacttattacaacgtgggaaagctgttgtagaaggggcgggggcattagctactgctgctctacttgcagggaaagtggatacatatattaaggggaaaaaagtagtagcggttatatctggtgggaacgtagacttgcagcgcatttcaagtgtttgtgagcaattttttgtagctaatgaagtgaaatag

SEQ ID NO: 3312 - protein, 333 aa, Bacillus cereus G9241
MITKKLPLHIDDIKKAQTILDRNVRKTPLVKSFYLTSKTGGEIHLKLENMQLTGSFKFRGAFNKMSQLTDQEKERGVIACSAGNHAQGIALSAHLLGIKSKIVMPISAPQAKVDATKGYGSEVVLHGETFDDAKAKCEEIIRETGETYLHPYDDVEVMAGQGTIGLDILDDMWDVDTIIVPIGGGGIISGIAVALKSFNPSIHIIGVQADNVHGMKASYDKGTIVEHYKAPTIADGCAVKIPGNLTFEVVKELVDDIVTVSEGELEVAMKDLLQRGKAVVEGAGALATAALLAGKVDTYIKGKKVVAVISGGNVDLQRISSVCEQFFVANEVK

SEQ ID NO: 3313 - DNA, 1239 bp, Rubrivivax gelatinosus PM1
  CDS (1)..(1239)
ttgacctcagccgagtcgccggcgacggtgaccctggcggacgtcgaggccgctgcacgccggctggccggacaggtgctcgacacaccgtgtgtcgagtcgaagacgctgtccgagatcaccggcgcgcaggtcttcctgaagttcgagaacctgcagttcaccgcttccttcaaggagcgcggcgcgttgaacaagctgctggcgctggtcgccgcgcgcgacgacggcaccgccgcgttgaagggcgtgatcgccgcctccgccggcaaccatgcgcagggcgtggcgcatcacgcgcagcggctgggcctgcgcgcggtcatcgtgatgccccggcacacgccgacggtgaaggtcgagcgcacgcgcggcttcggtgccgaggtgctgctgcacggcgagagcttcgacgaggctcgcgcgcacgcgctggaggtggccgcggcgcagggcctgagcttcgtgcaccccttcgacgatccgctggtgatcgccggccagggcacgatcggcctggagatgctgcgcgcgcaaccgacgctcgacactctggtcatcgccgtcggcggcggcgggctgatctccggcatcgcgaccgtcgcccgggcgctgaagcccgggctggagatcgtcggggtgcagacggcgcgctttccggcgatggtgaacctcgtcaagggccgcacccatccgcaaggcaccagcacgatcgccgagggcattgccgtcggtgagccggggcggatcacgcgggcgatcgttcgcgacctcgtcgacgacatggtgctggtggacgaagcggacatcgagcatgccctggtgatgctgctggagatcgagaagacgctggtcgagggggccggcgccgcgggtctggctgcgctgctgaaggcgcccgggcgctacgccgggcgacgcgtgggcctggtgctgtgcggcggcaacatcgatccgctgctgctgtcggcgatcatcgagcgcggcatggtgcgggcggggcggctggcacgcatccgcgtcgacgcgcgcgacgcccccggcgcgctggcgcgcatcaccgccaccgtggccgaggccggcgcgaacatcgaggaagtgcatcaccagcgggccttcaccacgctgtcggcgcagaacgccgaggtggagttggtgttgcagacgcgcaatcacgcccatatcggcgcagtgatcgcgtccctggtggctcaggggttcgaggccaaggcctactga

SEQ ID NO: 3314 - protein, 412 aa, Rubrivivax gelatinosus PM1
MTSAESPATVTLADVEAAARRLAGQVLDTPCVESKTLSEITGAQVFLKFENLQFTASFKERGALNKLLALVAARDDGTAALKGVIAASAGNHAQGVAHHAQRLGLRAVIVMPRHTPTVKVERTRGFGAEVLLHGESFDEARAHALEVAAAQGLSFVHPFDDPLVIAGQGTIGLEMLRAQPTLDTLVIAVGGGGLISGIATVARALKPGLEIVGVQTARFPAMVNLVKGRTHPQGTSTIAEGIAVGEPGRITRAIVRDLVDDMVLVDEADIEHALVMLLEIEKTLVEGAGAAGLAALLKAPGRYAGRRVGLVLCGGNIDPLLLSAIIERGMVRAGRLARIRVDARDAPGALARITATVAEAGANIEEVHHQRAFTTLSAQNAEVELVLQTRNHAHIGAVIASLVAQGFEAKAY

SEQ ID NO: 3315 - DNA, 993 bp, Rhodospirillum rubrum
  CDS (1)..(993)
atgacccggcccttgcccgagactcccggggtcggcgcccaggacgtggtcgatgccggccaccgcctgaagggtcttgtcgtcaccacgccgcttgtcgaaagcccggtgctcaacgccagcatcggtggccggctgctggtcaaggccgaatgcctgcagcggacgggatcgttcaagatgcgcggggcgaccaacgccctggcccagatggacgacgcggcgcgggcgcgcggcgtcatcacccattcgtcgggcaatcatggtcaggccttggcctcggccgcccgggccttcggcctgcgggcgaccgtggtgatgcccgatgacgcgcccgccctcaagatcgagctgacccgggcccatggcgccgaggtggtcttctgtccgcgccacgcccgcgagcagacggtggcccggctagccggcgaaagcggcgccgtggtgatccatccctatgagacccccgccgtcatcgccggccaggggacggtgggcctggaaatcgtcgagcaatgcgccgccatcggcgtggtgcccgatcaggtgctggtctgctgtggcggcggcggtctgaccgccggggtggccctggccatcgaccggctgctgcccggcgtgccggtgatcgccgtcgagcccgagggctgggacgataccaagcgctccctggccgccggtgctatcgtcgccaatgacggtctgacggccacggcctgcgacgccttgcaggcgatgtgtccgggcaccctcagcttctcgctcaatcgccatctgctggccggggcggtgagcgtggacgaggcgatggtgcgccacgccatgcgccaagccttcgttcatctcaagctggtggccgaacccggcggcgccgtggccctggccgccgccctggccggcaaggtcgagaccgccgatcgcctcagcgtcgtcgtgctctcgggcggcaatgtcgatcccggccgcttcgcgagcgtgctggccggggattag

SEQ ID NO: 3316 - protein, 330 aa, Rhodospirillum rubrum
MTRPLPETPGVGAQDVVDAGHRLKGLVVTTPLVESPVLNASIGGRLLVKAECLQRTGSFKMRGATNALAQMDDAARARGVITHSSGNHGQALASAARAFGLRATVVMPDDAPALKIELTRAHGAEVVFCPRHAREQTVARLAGESGAVVIHPYETPAVIAGQGTVGLEIVEQCAAIGVVPDQVLVCCGGGGLTAGVALAIDRLLPGVPVIAVEPEGWDDTKRSLAAGAIVANDGLTATACDALQAMCPGTLSFSLNRHLLAGAVSVDEAMVRHAMRQAFVHLKLVAEPGGAVALAAALAGKVETADRLSVVVLSGGNVDPGRFASVLAGD

SEQ ID NO: 3317 - DNA, 1269 bp, Rhodospirillum rubrum
  CDS (1)..(1269)
atgtcgcccttccccccgtttccggccgcttcggccgtccccgccgtcaccctggccgatgtggaagccgcggcccggctgatcgcccatgccgtgccccataccccgctgctcccctcgcgcaccctgtcgcggctgaccggggccgaggttttcatcaaattcgagaaccaccagttcaccgcctcgttcaaggagcgcggcgcgctcaaccggttgagcgcgctgagcgagaccgagcgggcgcgcggcgtcatcgccatgagcgcgggcaatcacgcccagggcgtggcctatcacgcccagcgcctgggcattcccgccgttatcgtcatgcccgctgacacgcccttcgtaaaggtcaagcacacccgtgatttcggcgcccgcgtggtgctggaaggcgagaccgtggccgaatcgcggctggtggccgagcgcatccgcgaggaggagggactgaccttcgttcatccctataatgatccctgggtgatcgccggccaggggacggtggccttggaaatgcttgccgatcagcccgacctcgacatcctggtcgccccgatcggcggcggcggcctgctgggcggcatggcggtggcggccaaggcggtcaaaccggccattgagatgatcggcgttcaggtcgggctttatccttcggcctataacgccctccacggcctgccgccttgcaccggcggcgccacggtggccgagggcatcgccgtcaaggaaccgggcgatctgaccttgccgctgctgcgcgctttggtctcgcgcatcatcctggtcgatgagacggcggtcgaggaagccatctcgctctatctctcggtcgaaaagaccgtggccgagggggcgggggcggcgtcgctcgccgccctgttgaccgagccccagcgctttcgcggcaaaaaggtcggtctggtgctgagcggcggcaatatcgatccgcggatcatggcctcggtcatcatgcgcagccttgtgcgcgagggccgaatcgcccatctctcgatcaggatcggcgacaagccggggcaactcgcccgggtggcgacggtgatcggcgaaaccggcggcaatatcgtcgaggtccgccatgaacgcctgacctcggatatttcggtcaaatccaccgatctgcgggtgatcctggagacccgcgaccatacccatctggccgagatccttgaacgcctcgccgccgccggttttccggccaacgaacgctcgttcagcggcccggccgccggcgattaa

SEQ ID NO: 3318 - protein, 422 aa, Rhodospirillum rubrum
MSPFPPFPAASAVPAVTLADVEAAARLIAHAVPHTPLLPSRTLSRLTGAEVFIKFENHQFTASFKERGALNRLSALSETERARGVIAMSAGNHAQGVAYHAQRLGIPAVIVMPADTPFVKVKHTRDFGARVVLEGETVAESRLVAERIREEEGLTFVHPYNDPWVIAGQGTVALEMLADQPDLDILVAPIGGGGLLGGMAVAAKAVKPAIEMIGVQVGLYPSAYNALHGLPPCTGGATVAEGIAVKEPGDLTLPLLRALVSRIILVDETAVEEAISLYLSVEKTVAEGAGAASLAALLTEPQRFRGKKVGLVLSGGNIDPRIMASVIMRSLVREGRIAHLSIRIGDKPGQLARVATVIGETGGNIVEVRHERLTSDISVKSTDLRVILETRDHTHLAEILERLAAAGFPANERSFSGPAAGD

SEQ ID NO: 3319 - DNA, 969 bp, Ralstonia metallidurans CH34
  CDS (1)..(969)
atgacgaccctgcaactgcccacctacgccgacgtcgaagccgccgccaaacggatcgaaggctttgccaaccgcacgccggtcaacacgtcgcgcacgctcaacgaaatgctcggcgcggaagtcttcttcaagtgcgagaacttccagcgcatgggcgccttcaagttccgaggcgcgttcaacgcgctggcgaagttcaccgccgagcaacgccgtggcggcgtggtcgcgttctcgtccggcaatcacgcgcagggcatcgcgctgtccgcgaagctgctgaacatgcccgccacgatcgtgatgccccacgacgctccggccttgaaggtagcggcgacgcgggggtatggcgcgaccgtggtgagctatgaccgctacaaggaagaccgtgaagccatcggccgcgatctggccgaaaagcacggcatgacgctgatcccgccgtatgaccatccggatgtgctgacgggccagggcaccgccgccaaggaactgttcgaggaagtgggcgcgctcgacgccatcttcaccccgctgggcggcggcggactgctctccggcaccgcattgaccacgcgcgcgctggcgccacagtgccagatctacggcgtggagcccgaggcgggcaacgacggccagcaatcgttccgcagtggttcgatcgtccatatcgacaccccgcagaccattgccgatggcgctcagacgcagcacctgggtcagtacacgttcagcatcatcaagcgtgacgtgactgatatcctgaccgcaacagacgcgcaactggtcgaggccatgcgcttctacgccgaacggatgaagatgattgtcgagccgaccggctgcctgggcctggcggcggtcatgcagatgaaggacgcgctcaagggcaagcgcgtgggcgtagtgatcagcggcggcaacgtcgacctggagcgattctgctcgctgctgtcagcctga

SEQ ID NO: 3320 - protein, 322 aa, Ralstonia metallidurans CH34
MTTLQLPTYADVEAAAKRIEGFANRTPVNTSRTLNEMLGAEVFFKCENFQRMGAFKFRGAFNALAKFTAEQRRGGVVAFSSGNHAQGIALSAKLLNMPATIVMPHDAPALKVAATRGYGATVVSYDRYKEDREAIGRDLAEKHGMTLIPPYDHPDVLTGQGTAAKELFEEVGALDAIFTPLGGGGLLSGTALTTRALAPQCQIYGVEPEAGNDGQQSFRSGSIVHIDTPQTIADGAQTQHLGQYTFSIIKRDVTDILTATDAQLVEAMRFYAERMKMIVEPTGCLGLAAVMQMKDALKGKRVGVVISGGNVDLERFCSLLSA

SEQ ID NO: 3321 - DNA, 966 bp, Burkholderia fungorum LB400
  CDS (1)..(966)
atgcaagcgcttcccgctcccactttcgacgacgtactcgacgccgctgcgcgtcttgaaggcgtcgcccaccgcactcccgtgctgacctcgagcacgtttgacgaacgaacgggcgcgtcggtgttcttcaagtgcgagaattttcagcgcatgggcgccttcaagtttcgcggtgcctataacgcgatctcgcatttcgacgcggagcaacgcaaagccggcgtgctgacgtattcgtcgggtaaccacgcgcaggcaattgcattgtcggcgcggcttgccggcattcgcgcgacgatcatcatgccgcacgacgcaccggccgccaaagtcgcggcaaccaaaggctacggcggcgaagtgatcacctacgaccgctacaccgagaaccgcgaagagatcggccggcgtctcgccggagagcgtggcatgacgctgattccaccatacgatcatccacatgtgatcgccgggcagggcacggcggtgaaagaactgatcgaggaaaccggcccgctcgacatgctgttcgtgtgcctcggcggcggcgggctgatcagcggcagcgcgttgtccgccgcggcgttgagcccggcgtgcacggtgatcggcgtcgagccggaggcgggtaacgacggccagcagtcgctggcgcgcggcgagatcgtgcatatcgacacgccgcgcacgatcgccgacggcgccgcctccacgcatctgggcgactacacgtttgcgatcatccgcaagctggttgcgcggatcgaaacggtcagcgacgggcaactgatcgacacgatgcgctttttcgcgcagcgcatgaagatcgtggtcgagccgacgggttgtctcgccgcggcggcggtgctcaacggcatcgtgccggtgaagggcaagcgtgtcggcgtggtggtcagcggcggcaacgtcgatctggaaaagctcgcgcagtatctcgcctga

SEQ ID NO: 3322 - protein, 321 aa, Burkholderia fungorum LB400
MQALPAPTFDDVLDAAARLEGVAHRTPVLTSSTFDERTGASVFFKCENFQRMGAFKFRGAYNAISHFDAEQRKAGVLTYSSGNHAQAIALSARLAGIRATIIMPHDAPAAKVAATKGYGGEVITYDRYTENREEIGRRLAGERGMTLIPPYDHPHVIAGQGTAVKELIEETGPLDMLFVCLGGGGLISGSALSAAALSPACTVIGVEPEAGNDGQQSLARGEIVHIDTPRTIADGAASTHLGDYTFAIIRKLVARIETVSDGQLIDTMRFFAQRMKIVVEPTGCLAAAAVLNGIVPVKGKRVGVVVSGGNVDLEKLAQYLA

SEQ ID NO: 3323 - DNA, 1035 bp, Burkholderia fungorum LB400
  CDS (1)..(1035)
atgtccgttccttcgctggccgatctatcgttagccgatgtctaccgcgcacgccgccgtatcgaggggcgtgtgcgccatgcgccgctcgtcgaatcgcagagcctgtcggcgctcgcgggcgtgccggtgtttctcaaactcgaaaccgtgcagccgactggcagcttcaaggtgcgcggcgcgacaaacgcgctcggtcatctcgccgaacagggctgccggaaagtcgtgaccgcgtcgacgggcaatcacgggcgcgcggttgcgcatgcggcccgcacgctcggtatcgacgcgacggtctgcatgtcggcgctcgtgccggccaataaggtcgacgcggtgcgcgcgctcggcgcgcacgtgcggattgtcggcaaaagccaggacgaggccgagcacgatgcgttgagactggtacgcgaagaaggcttcgcttatgttccgccgttcgacgatccccatgtgatcgccggtcaggcgacgatcggtctggaaatcgtcgaggcgttgccggatgtagccaacatcgtcgtgccgctatcgggcggcggcctgttcgcgggcgtcgcgttcgccgccagaagcgcgaatcgcgcgatcggcctgaccggcgtgacgatggcgcgcggtgcggcgatgcatgccagtctggtggccggccagccggtgctggtcgaagaagtggcaacgctcgccgattcgctcggcggcggcatcgggctggaaaaccgctacacgtatgcgctcacgcgcgatctgatcgaccagaccgtgctgctcgatgaggcctcgatcgcgcgcggcatcgcgcatgcgtaccggcatgaacggctcgtcgtggaaggcgcggcggcggtgggcattgccgcgttgctcgatggcgtgctgcccgccggacgtatcgggcgcgggccgctcgtgctcatcgtgaccggcgccaacatcgatatggacctgcatcggcggatcgtcgatgcggattccatgcaacccgactcgacgcaatccggtttacatcccatctcatga

SEQ ID NO: 3324 - protein, 344 aa, Burkholderia fungorum LB400
MSVPSLADLSLADVYRARRRIEGRVRHAPLVESQSLSALAGVPVFLKLETVQPTGSFKVRGATNALGHLAEQGCRKVVTASTGNHGRAVAHAARTLGIDATVCMSALVPANKVDAVRALGAHVRIVGKSQDEAEHDALRLVREEGFAYVPPFDDPHVIAGQATIGLEIVEALPDVANIVVPLSGGGLFAGVAFAARSANRAIGLTGVTMARGAAMHASLVAGQPVLVEEVATLADSLGGGIGLENRYTYALTRDLIDQTVLLDEASIARGIAHAYRHERLVVEGAAAVGIAALLDGVLPAGRIGRGPLVLIVTGANIDMDLHRRIVDADSMQPDSTQSGLHPIS

SEQ ID NO: 3325 - DNA, 933 bp, Thermobifida fusca
  CDS (1)..(933)
atgacgtcacgcatcactgtgtcccgtcaggtccccacgaccttcgacgtgcacctcgctgtccaacgcaccgctccctatctgcgtcgcaccccgctcctgcgcactcgtctgcggggccgccccctgctgctgaagctggagcatttgcagctcaccggtgcgtttaaactacgcggcgccttgaatgcgctactcaccggggacaggggtgaacgggtggttaccgcctcgggtggcaaccacggcctcggagtggccaccgccgcgcacctgctcggcggtacggccaccgtgtacgtacccgagaccgttcccgcggtcaaggagcggcggttgcgggacgccggtgccgacgtggttcgggccggcaccgagtacgcggcagcggaagccgcagcccgcgcctacgcggacaccgaagggctccgctacatccacgcctacaacgacccggacgtggtcgcaggccaaggcacgctcggccacgagatcgtcgccgacgcacccgactgcgatgcagtcgccgtggccgtaggcggcggcggtctcgccgcaggcgtgagcctgggcatcggcgacgaacggctcaccgtcgcggtagagccgcgcggctgcgccagcctgcacgccgcattcgccgccggcgagcccgtggacaccccggtcgattcagtagcggcctcggccttgggcgcctcccgggtgggcgacatcccgttcgcggtactgcgcgaccgcaacgtgacctccaccctcgtctcggaccccgagatccttgccgcccgcgacctgctgtgggaggaattccggatcgcggtggagcccgccgcggctactcccatggctgcctggctggccgggcacgtccccggcgaactgccgtgcgtggtgatctgcggcgccaacgccgactggcgtcccctggactga

SEQ ID NO: 3326 - protein, 310 aa, Thermobifida fusca
MTSRITVSRQVPTTFDVHLAVQRTAPYLRRTPLLRTRLRGRPLLLKLEHLQLTGAFKLRGALNALLTGDRGERVVTASGGNHGLGVATAAHLLGGTATVYVPETVPAVKERRLRDAGADVVRAGTEYAAAEAAARAYADTEGLRYIHAYNDPDVVAGQGTLGHEIVADAPDCDAVAVAVGGGGLAAGVSLGIGDERLTVAVEPRGCASLHAAFAAGEPVDTPVDSVAASALGASRVGDIPFAVLRDRNVTSTLVSDPEILAARDLLWEEFRIAVEPAAATPMAAWLAGHVPGELPCVVICGANADWRPLD

SEQ ID NO: 3327 - DNA, 1206 bp, Ferroplasma acidarmanus
  CDS (1)..(1206)
atgttaagttatgatagaatagtcagagcaggaaatgagataaaggggaagatacatagaacgccattattccattcaacaacattcagcaatatgttttcatgtgacgtttactttaaaatggagaattttcagaagacggggtctttcaaatccagaggagctatggtaaaattttcaacgttgaccgctgaacagaaaaaaaatggagtaataaccgccagtgcaggaaatcacgcacagggagtggcttttgcggcttcctattatggcgttgatgcaaaaattgtcatgcctgaaacaacaccgcctgccaaggtaaacgctgtccaatcctatggcggcacagttatactaaagggcaatagctacgacgaagcacatgaatatgcggtacaggtttcagtggacgagaaaagggaatttattgaagcttataacgatgaggatgttattgccgggcaggggacaataggccttgaaattttagaagatgtgaaaccggacattgtaatagtgccaataggtggtggagggcttatttcagggatatcatttgcaattaaatcaaaaaacaaggatataaaaataataggggtagagtccgaaaaggcaaatgccatggaattatctataaaggaaggcaaaatagttccatacaccagcaacgatacaattgctgatggaatcgccgtaaaatatccgggaaatataacatttgaactggtaaagaaatatgtggatggagttgttacagtatcggatgagaatattgcatatgcactattcaagctgcttgaaagggaaaaagtgcttgtggagccttccggcgcagctggccttgcagcattatttgaaaataaaattgatgttaagggcaagaaagttgttattgtactttcaggagggaacgtaaacttcctactgctgtcaaacataatatacagggcgcttgaaatggaaaacaagttgcttcgccttgaattcaatctgcctgaccacccgggtataatggaaaaaatagtaaatgccatatcatcttccggagccaatatataccatgctgaggtggataatttaaacaaggatacgcctataggataccagtatctcctattcacaataaacatccttgacaaatcgagaatagatgaattgctcgggagcctcgataaacttggctataaataccggataataggatag

SEQ ID NO: 3328 - protein, 401 aa, Ferroplasma acidarmanus
MLSYDRIVRAGNEIKGKIHRTPLFHSTTFSNMFSCDVYFKMENFQKTGSFKSRGAMVKFSTLTAEQKKNGVITASAGNHAQGVAFAASYYGVDAKIVMPETTPPAKVNAVQSYGGTVILKGNSYDEAHEYAVQVSVDEKREFIEAYNDEDVIAGQGTIGLEILEDVKPDIVIVPIGGGGLISGISFAIKSKNKDIKIIGVESEKANAMELSIKEGKIVPYTSNDTIADGIAVKYPGNITFELVKKYVDGVVTVSDENIAYALFKLLEREKVLVEPSGAAGLAALFENKIDVKGKKVVIVLSGGNVNFLLLSNIIYRALEMENKLLRLEFNLPDHPGIMEKIVNAISSSGANIYHAEVDNLNKDTPIGYQYLLFTINILDKSRIDELLGSLDKLGYKYRIIG

SEQ ID NO: 3329 - DNA, 1056 bp, Pediococcus pentosaceus ATCC 25745
  CDS (1)..(1056)
atgttagtagagaaagaacccagaaaccaagttgtagcagcaaccgataatttattaaatctaaaccagattgaagaagcccgcgaggttattaaaaaatatgcgcgtcggacaccattagttaagtccatgtttttgagcaacaacgttgtccatggggatgtctatttaaaattagagaatatgcaattaaccggttcttttaaatttagaggggcgaataacaaaattaaccacttgaatgaagaagaaaaacaacgaggcgtaattacagcttcagctggaaatcatgcacaaggagtagctttgaccggtaagttgctgggaattaaaactacggtagtgatgccggatgaggcgccccaaatgaagcgcgatgcaacccgaggatatggagcggaagtagatattcatggcgcaacttttgatgacgctcacgaatggatgcgagaaagagctgaaaaagaaggaaaaaccattgtagatccgtttaatgatgctttaatttgtgctggacaaggaactatcggtttggaaattctagaagatttagtggatgtagaaaccgttgtagttccagtcgggggcggtggtctaatttcaggaatcgccacggctttaaaatcaatcaatccttcaattcatatcgtcggagttcaatcggaaaatgtgcatggcatgaaggcgtctgttgatgcaggcaaaattgttaaacatcaccaagattttacgctagcagacggaactgatgtagcaaccccaggtaatattacatttgggattgtttccaaactagtggatgagattgtcttggttagtgaagaagaaatttcaaaagcgatgaaagatttaatgcagagaaccaaggtggttgctgaaggagcaggagcattgccaacggccgctttagaagcaggtaagattgatccaaaatggactaaagataagaaggttgtagctttagtttccggtggaaatgtggatctacagcgagtttcacagattattgatcacttctttactcctgttgatacgcataaaggtgccattgggtaa

SEQ ID NO: 3330 - protein, 351 aa, Pediococcus pentosaceus ATCC 25745
MLVEKEPRNQVVAATDNLLNLNQIEEAREVIKKYARRTPLVKSMFLSNNVVHGDVYLKLENMQLTGSFKFRGANNKINHLNEEEKQRGVITASAGNHAQGVALTGKLLGIKTTVVMPDEAPQMKRDATRGYGAEVDIHGATFDDAHEWMRERAEKEGKTIVDPFNDALICAGQGTIGLEILEDLVDVETVVVPVGGGGLISGIATALKSINPSIHIVGVQSENVHGMKASVDAGKIVKHHQDFTLADGTDVATPGNITFGIVSKLVDEIVLVSEEEISKAMKDLMQRTKVVAEGAGALPTAALEAGKIDPKWTKDKKVVALVSGGNVDLQRVSQIIDHFFTPVDTHKGAIG

SEQ ID NO: 3331 - DNA, 966 bp, Silicibacter sp. TM1040
  CDS (1)..(966)
atgaaggacaccgcaatgtatatcccaacctacgaggacatgctggcggcgcatcaacgtatcgcgccacacatccaccgcaccccggtgcgccagtccgcctacctcaacgaactgaccggcgcgcagctgtttttcaaatgcgaaaactttcaggagccgggggccttcaaggtgcgtggcgccaccaatgcagtctttggtctggacgcagcacaggcggccaagggcgtggcgacgcattccagcggcaaccatgcctcctgcctgtcctatgcggcgatgctgcgcggcattccctgcaacgtggtgatgccgcgcaccgcgccgcaggccaaaaaagacaccgtgcgccgctatggcgggaagatcaccgaatgtgagccctcgaccacctcgcgcgaggagacatttgcccgcgtacaggccgaaaccggtggcgattttgtgcatccctacaacgatcctcgggtgatcgctggccaaggcacctgcgccaaggagtttgtcgagcagaccgacgggcttgattgtgtgctcgcgccgattggcggcggcggcatgatttcgggcacctgtctgacgctgtcgacgctggcacccgaaacacggatcatcgccgccgagcccgagcaggctgatgacgcctaccgcagcttcaaggcgggctacatcattgccgatgatgcgcccaggaccatcgccgacgggctgctggtgccgctcaaggatctgacctggcattttgtgtcgaaccatgtgtccgacattctgaccgcatctgaccctgagatcatcgacgcgatgaagctcatctggaagcacctgcgcgtggtgatggagccctcctctgcggtgccgctcgccaccatcctgaaaaaccccgagacctttcgcggcaaacgcgttggcatcgttttgaccggtggcaatgtcgatctggatcgtctgccctggacgatttga

SEQ ID NO: 3332 - protein, 321 aa, Silicibacter sp. TM1040
MKDTAMYIPTYEDMLAAHQRIAPHIHRTPVRQSAYLNELTGAQLFFKCENFQEPGAFKVRGATNAVFGLDAAQAAKGVATHSSGNHASCLSYAAMLRGIPCNVVMPRTAPQAKKDTVRRYGGKITECEPSTTSREETFARVQAETGGDFVHPYNDPRVIAGQGTCAKEFVEQTDGLDCVLAPIGGGGMISGTCLTLSTLAPETRIIAAEPEQADDAYRSFKAGYIIADDAPRTIADGLLVPLKDLTWHFVSNHVSDILTASDPEIIDAMKLIWKHLRVVMEPSSAVPLATILKNPETFRGKRVGIVLTGGNVDLDRLPWTI

SEQ ID NO: 3333 - DNA, 1236 bp, Chloroflexus aurantiacus
  CDS (1)..(1236)
atgagccgattcgcaattgaactggccgatattcagtctgcacggcgggcgttgcgggatattatcctacccacgccagtattgccggcaacccgcctgagtgctgaactgggtgggtcaattttttacaaggctgaaaatacccagcagagtggttcgttcaaaattcgtggtgcttacaacacgatcattcatctgtcacctgaagagaaacaacgcggcgtgattgcaccgtctgccgggaatcacgctcagggtgtcgcgcaggcagcccagttattgggggtaaaagcaacaattgtgatgcctgagcgcgctccattgaccaaagtggtggcaacccgccggttgggcgccgaggtcattctgcacggcgccaccttcgatgatgcgatggcctacgcacacgctctcaaagaagaacgtggcttaacctacgtccatgccttcgatcatccacgggtgattgcaggtcagggaacgattggcctggaactggttgaagccctgcccgatttaaaccaactggtcgtaccaatcggcggtggtggcctgatcagcgggattgccctggccgtgaagacattgttgccgcacgtgcgtatcatcggtgtgcaggctgccggctgtgcgccggtgccggcctcgctcgccgccggtcatccggtgacggcaccgactgcgcatacgattgcagatggtattgccgtgaagcgtcccggcgaactcaccctgccgatgatccaggccctggttgatgacgttgtcaccgttgatgacgaagagattgtgatggcaatcgcgcacgtgttgcaatacagtcgtctggtggtcgagggagccggcgccgcaggtgttgctgccctgctcagtggtaaggtgccggtacaaccacaccaggtgacggcgacgatcctttgcggtgggaatatcgatgcgaatctgctgatgcgggtgattgagtatgccctggttcgccagggacgctacctcttgctccgcaccagcgtcgatgatcgtccgggcggcctggccggcctggtcaatcacgttgcctcgaccggtgccagcgtcatggatctcttccatcgccgtgggatgtggcgagtgccaatcgaccgtgccggcgttgaactcatcctcgaagtccgtgatgaagaacacgctcagatggtcatcaattctctcgaacaggccggctaccattgcgagcgcgaaccgaactggccgatataa

SEQ ID NO: 3334 - protein, 411 aa, Chloroflexus aurantiacus
MSRFAIELADIQSARRALRDIILPTPVLPATRLSAELGGSIFYKAENTQQSGSFKIRGAYNTIIHLSPEEKQRGVIAPSAGNHAQGVAQAAQLLGVKATIVMPERAPLTKVVATRRLGAEVILHGATFDDAMAYAHALKEERGLTYVHAFDHPRVIAGQGTIGLELVEALPDLNQLVVPIGGGGLISGIALAVKTLLPHVRIIGVQAAGCAPVPASLAAGHPVTAPTAHTIADGIAVKRPGELTLPMIQALVDDVVTVDDEEIVMAIAHVLQYSRLVVEGAGAAGVAALLSGKVPVQPHQVTATILCGGNIDANLLMRVIEYALVRQGRYLLLRTSVDDRPGGLAGLVNHVASTGASVMDLFHRRGMWRVPIDRAGVELILEVRDEEHAQMVINSLEQAGYHCEREPNWPI

SEQ ID NO: 3335 - DNA, 993 bp, Chloroflexus aurantiacus
  CDS (1)..(993)
atgtctaccgagaaaaccattacccctgccgacatcctggctgctcgccgtcgcatcagcggtatcgttcaaccaactccgcttgaggtgagtcgccccttgagcgccctgaccggtgccgaggtctggttgaagctggaactggcacaggtgaccggcagttttaagctgcgtggtgcagccaatgctctgcgccagttaccacctgccacgcatgtcgtggcctgctcggcgggcaatcacgcgctcggtgttgcccataccgccgcgttgaccggtacgccggccaccctggtggtgccgacaaccgcctcgccggcgaaggtcaccgcattgcgacgctatccggttgaggtgatattgcacggtgccggctacgacgaggctgaaaccgaagcgctccggctggcagcccaccacggctggcattttgtgtcaccctacaacgacccggcagtgattgccgggcagggaacgctggcaattgaggtctgggacgcattgcccgacgtcgatatggtggtagtcgcggtcggtggcggtgggttagccagcggcgttggtatctgggccagagcgatgaacccgcgcgtccgcatcattggcgtacaggcagccgcttccgcggcaatggcggcggcgttgcgggccgggcgggtcgttccggcacctgatgaaccaacgctggccgacggtctggctggaggtatcgccagcgataccatcacgctcccgatcctgcaacaggttttagacgagatgatcctggtcgaagaggcagctattgcccgcgctatgcgctggttaatcgacgaacaccatctgattgtagaagggagtgctgcggtgacggtggcagccctgctcgaaggtcagatcacccatcttgtcggcaaacggatcgtggcactgctctgcgggcgtaatgttgccatttccaccttgcaccacattctcgcagttccgcccaaagacggagcatcatcccattga

SEQ ID NO: 3336 - protein, 330 aa, Chloroflexus aurantiacus
MSTEKTITPADILAARRRISGIVQPTPLEVSRPLSALTGAEVWLKLELAQVTGSFKLRGAANALRQLPPATHVVACSAGNHALGVAHTAALTGTPATLVVPTTASPAKVTALRRYPVEVILHGAGYDEAETEALRLAAHHGWHFVSPYNDPAVIAGQGTLAIEVWDALPDVDMVVVAVGGGGLASGVGIWARAMNPRVRIIGVQAAASAAMAAALRAGRVVPAPDEPTLADGLAGGIASDTITLPILQQVLDEMILVEEAAIARAMRWLIDEHHLIVEGSAAVTVAALLEGQITHLVGKRIVALLCGRNVAISTLHHILAVPPKDGASSH

SEQ ID NO: 3337 - DNA, 975 bp, Polaromonas sp. JS666
  CDS (1)..(975)
atgctgcaacttcccgtttacgacgacgtcctcgccgcagccgcgcggcttgagggccacgcgcaccgcacgccggtactgacctccgccacggccgatgcccgctggggttcccagtttttcttcaagtgcgaaaacttccagcgcatgggggcgtttaagttccgtggagcgttcaatgcgctgtcaaagttcgacgcgggccagcgccgggccggggcgatcgcgttttcgtcgggcaaccatgcacaggcggtggcgctgtcggcgcggctgctcggcatgcccgcgttgatcgtgatgccgcaggacgcaccggctgccaagctggccgcgacgcgtggctacggcgccgaggtggtgctgtacgaccgcttcagcgaagaccgcgaggcgctcacgcagcggctggcggccgagcggggtatgaccctgattccgccctatgaccatcccgacgtgattgccggccagggcacggccgccaaggaactgcttgaagagaccggtccgctcgaccgcctgtatgtctgcctgggcggtggcgggctgaccagcggctcggcgctggccgcgcgggccctggcgccgcaatgcaaggtgtatggcgtggagcccgaagccggcaacgatggccagcagtcgctgcgcgcgggccggattgttcatatcgaaacgcccaagaccattgccgacggtgcgcaaacccagcatctgggtcagtacaccttcggcatcattcgacgcgatgttgatgacatcctcacggtgagcgacgcgcagctggtcgaggccatgcgcttttttgccgagcgcatgaagatggtggttgagcctaccggttgcctggcgtttgccggggcctgcgcggcgcttgaagcggacgcggccctcaagggcaggcgtgttggcgtcatcgtgagcggcggcaatgtcgacctggcgcgctacgcggagctgctggctgcacgctga

SEQ ID NO: 3338 - protein, 324 aa, Polaromonas sp. JS666
MLQLPVYDDVLAAAARLEGHAHRTPVLTSATADARWGSQFFFKCENFQRMGAFKFRGAFNALSKFDAGQRRAGAIAFSSGNHAQAVALSARLLGMPALIVMPQDAPAAKLAATRGYGAEVVLYDRFSEDREALTQRLAAERGMTLIPPYDHPDVIAGQGTAAKELLEETGPLDRLYVCLGGGGLTSGSALAARALAPQCKVYGVEPEAGNDGQQSLRAGRIVHIETPKTIADGAQTQHLGQYTFGIIRRDVDDILTVSDAQLVEAMRFFAERMKMVVEPTGCLAFAGACAALEADAALKGRRVGVIVSGGNVDLARYAELLAAR

SEQ ID NO: 3339 - DNA, 1203 bp, Polaromonas sp. JS666
  CDS (1)..(1203)
atgctcagtctgaccgatattgaacaagccgcccagcgcctgcagggccatttgctggataccccctgcgtggagtccaggacgctgtcacagctgaccggggcgcagatttacctgaaatttgaaaacctgcagtacacggcctctttcaaggagcgtggcgcctgcaacaaacttgcgcaactctcaggcgacgaacggcgccgcggcgtgatcgcgatgagcgccggcaaccatgcccagggtgtggcttatcatgcccagcgcctgggcctgagggccgtcatcgtgatgccgcgcttcacgcccggcgtcaagaccgagcgtacccgcggctttggcgcggaggtggtgctgcacggcgacacgctggaggagtcgcgcgcccacgcgctgatgctggccgagcgcgagggcctggtgtttgtgcacccctacgacgacgaagctatcgtggcgggccagggcaccgtggggctggaaatgctgcacgccgtccccggcctggacacgctggtcgtcgccgtgggcggcggcgggctgatcgcgggcatggccatcgccgccaaggccctgaagcccgagattgaaatcgtgggggtgcagacctcgcgctttccggccatggtcaacgccatcaagggcacgcaccacccgcagggcaccagcaccattgccgagggcatcgccgtgggcacgccgggggtcatcccgcaagccatcattgaaaagctggtggacgacctggtgctggtcgatgaaggggatatcgagcaggccatggtgatgctgctggaaattgaaaaaaccctggtcgagggtgcgggcgcggccggcttggcggcggtgctcaaatacccggcgcgctttgccggcaagaaagtcgggctggtgctgtgcggcggcaatatcgacccgctgctgctggcggccatcatcgagcgcggcatggtgcgcgccgggcggctggcccgcatcaaggtcagcgtgcgtgacgtgccaggctcgctggccaagatcaccgcgacggtagccgatgcgggcgccaacatcgacgaggtacaccaccagcgcgccttcaccacgctgtcggtccagaatgtggagatcgagctggtgatccagacgcgcgggcgcgagcacatcgcgcaggtgctggcggcgctggccgcagccggatttgaggcgtccgagcagcactga

SEQ ID NO: 3340 - protein, 400 aa, Polaromonas sp. JS666
MLSLTDIEQAAQRLQGHLLDTPCVESRTLSQLTGAQIYLKFENLQYTASFKERGACNKLAQLSGDERRRGVIAMSAGNHAQGVAYHAQRLGLRAVIVMPRFTPGVKTERTRGFGAEVVLHGDTLEESRAHALMLAEREGLVFVHPYDDEAIVAGQGTVGLEMLHAVPGLDTLVVAVGGGGLIAGMAIAAKALKPEIEIVGVQTSRFPAMVNAIKGTHHPQGTSTIAEGIAVGTPGVIPQAIIEKLVDDLVLVDEGDIEQAMVMLLEIEKTLVEGAGAAGLAAVLKYPARFAGKKVGLVLCGGNIDPLLLAAIIERGMVRAGRLARIKVSVRDVPGSLAKITATVADAGANIDEVHHQRAFTTLSVQNVEIELVIQTRGREHIAQVLAALAAAGFEASEQH

SEQ ID NO: 3341 - DNA, 1212 bp, Campylobacter lari RM2100
  CDS (1)..(1212): transl_table=11
atggttgaattaaataaaatttatcaagcaaaacagaaaatcgcagattttgtattaaaaaccccttttgtacactcttcttttttgagtgagtttttagaaactgatgtttttttaaaatgtgaaaatttgcaaaaaacaggtgcttataaaatcagaggagcttataatacaatagctaatttaactaaagaacaaaaacaagcaggcgtaatagctgcaagtgcaggaaatcacgcacaaggagtagcaattagtgctaaaaaatttggcatagaagctgtgattgttatgcctgaagccacgcctttgttaaaagtaagtgcgactaaaaatttaggtgcaaaagtgattttaaaaggagataattttgatgaggcttatgcttatgcactaaattatgccaaagaacatcatttaaatttcattcatccttttgaaaatgaaagtattatagcagggcagggtactttaatgcttgaaatgcttgatgaaataagtgatttagatatgattttagctccagttggtggaggaggtttgattagtggagtggcaagtgctgctaagcaaattaatcctgctataaaagtcattggagtgagtgctaaaggagctcctgcgatgtatgagagttttaaaagtaaaaaaatgattaactcaaaagctgttagaactatagctgatggtatagcagtgcgtgatgtgaataaaattaattttgatattattcttgaatgtgttgatgattttattcaagttgatgatgaggaaatagctaatgcggtattgtatttacttgaaaaacataaaatcacagttgagggagcaggcgcatcagcagtagctgcgcttttgcataaaaaaatagatttaaaaaatcataaaaaaattggcgtgattttaagtggtggaaatatcgatgtgcaaatgttaaatatcattatagaaaaaggcttgtttaaagcttttagaaaaatgcttattaatgttactttgattgataaaccaggggctttgagtgctttgagtgatgcgatcaaagaagcgcaggctaatatagttaaaattgattatgatagattttcaactaaactcgaatacggcgatgcaatgatttcaatcactttagaaaccaaaggaaaggaacatcaagaattagttagaaaaatactttatgataaaggttttaattttaatgaaattttatga

SEQ ID NO: 3342 - protein, 403 aa, Campylobacter lari RM2100
MVELNKIYQAKQKIADFVLKTPFVHSSFLSEFLETDVFLKCENLQKTGAYKIRGAYNTIANLTKEQKQAGVIAASAGNHAQGVAISAKKFGIEAVIVMPEATPLLKVSATKNLGAKVILKGDNFDEAYAYALNYAKEHHLNFIHPFENESIIAGQGTLMLEMLDEISDLDMILAPVGGGGLISGVASAAKQINPAIKVIGVSAKGAPAMYESFKSKKMINSKAVRTIADGIAVRDVNKINFDIILECVDDFIQVDDEEIANAVLYLLEKHKITVEGAGASAVAALLHKKIDLKNHKKIGVILSGGNIDVQMLNIIIEKGLFKAFRKMLINVTLIDKPGALSALSDAIKEAQANIVKIDYDRFSTKLEYGDAMISITLETKGKEHQELVRKILYDKGFNFNEIL

SEQ ID NO: 3343 - DNA, 1215 bp, Desulfitobacterium hafniense DCB-2
  CDS (1)..(1215): transl_table=11
atgcctacactactgactttagaacagatccaagaagcacaacaagctattcagccctatattcaccggacacttctggatcattcaagcaatttgagcgccctggctgggacggagatctacctcaagctggaaaatctgcagaagaccggttcctttaaagttcggggggctatgaataaagccttgaagctttctgaagaggagaagaaaaaaggaatcctggccgcttccgccggcaatcatgcccaaggggtagccatggcggctgcccgtatcggtattcccgccacgattgtcatgccggaaaatgcccccctagccaaagtgtccgctacggaagggtacggagcccaggtcattctgtccggagcggtttttgatgatgcttatcagaaggcagtagagatccaaaaggaaacaggagccacgtttatccatgcttttgatgatctggaagttatggccgggcagggaaccatcggcttggaagtttttgaggagctgcctgaagtggatacggttcttgtccctatcgggggaggagggctgatcgcagggattgctgtggctttgaaatccctgaagccttccgtgcgcgtgatcggtgtccaagcggccggagcggcaagcatggctcacgcgctgagcataggcaggcccgagccattagggcaggccagtactttggcagatggcattgcggtgaaaagggcaggtgatctaaccttcgcagcagtccgccattatgtggatgagatggtgacggttgaagaagaagagattagtcaagctattctcctgttgatggagcgcaccaaaacccttgctgaaggagccggggcggttgccgtagcggcggcgcttcagggtaagctggatcttaaggagcagaaaacggttctcatcctgagcgggggaaatattgacgtgaatttcctggcccagattatcgaacggggactgaggcgttccgggcgtaccatggcctgccagcttcttttgccggatcaacccggcaacttagaaaaggtgatcgagcttatagcccaggaacgggccaatatcatcaacgtcgaacactcccgctatgatttagccgttcctctgcgttcagcccgtgttcatatgctgctggaaacccaaagttttgaacatcaaaagcgcattattcagcgtttagaaggtgccggatatcccctgaccgttaactga

SEQ ID NO: 3344 - protein, 404 aa, Desulfitobacterium hafniense DCB-2
MPTLLTLEQIQEAQQAIQPYIHRTLLDHSSNLSALAGTEIYLKLENLQKTGSFKVRGAMNKALKLSEEEKKKGILAASAGNHAQGVAMAAARIGIPATIVMPENAPLAKVSATEGYGAQVILSGAVFDDAYQKAVEIQKETGATFIHAFDDLEVMAGQGTIGLEVFEELPEVDTVLVPIGGGGLIAGIAVALKSLKPSVRVIGVQAAGAASMAHALSIGRPEPLGQASTLADGIAVKRAGDLTFAAVRHYVDEMVTVEEEEISQAILLLMERTKTLAEGAGAVAVAAALQGKLDLKEQKTVLILSGGNIDVNFLAQIIERGLRRSGRTMACQLLLPDQPGNLEKVIELIAQERANIINVEHSRYDLAVPLRSARVHMLLETQSFEHQKRIIQRLEGAGYPLTVN

SEQ ID NO: 3345 - DNA, 1038 bp, Leuconostoc mesenteroides
  CDS (1)..(1038): transl_table=11
atgacgactgagggaaagctaacggctgaagaaatagatgaggcgcatcgagtcttgtcaaaggtagtaacgcatacgccattggcatatgatgactatctatcaaaaaaatacagagctaatgtgtatcttaaacgagaagatatgcaacgggttcgttcgttcaaaattcgtggtgcctactacaatatcattaaggcagagaaagaaaaactcaataatggggttgttgctgcttcagctggaaaccacgcgcaaggcgtagccgatacatgtcataatttaaagatacaagcaactatttttatgccagtcactacaccaaatcaaaaagtagaagcggttaaacgttttggtagtcaatatgttacggtaatcctagtcggtgatacctttgacgaagcacaaagtgcagcgtttgaatacactgaaaaacataatatgttctttgtagcaccatttgatgatcggcgtaccatggctgggcaaggcacggtggcggttgaggtatttgaagatgctgtagagcaaaatattaatgttgattatttgattgcttctgttggtggtggcggtttaatcggtggtctgtcgacctattctaaaaaggtatcaccacaaaccacagtagtaggtgtcgaaccagaaacggcacagtcaatgaaagcggattttcaagctcaaaaacctaccaccgtcgagaatattgatcactttgttgatggtgctgccgttgcgcgtgtcagtcagtttacctataatcaagcacagcagtatgttgacaaactgctggctatccctgaaggaaaggttgctcaagcagtattagacttgtacacttatgaggcgatagttgccgaaccagctggagcgatgcctatcgctagtttggattttatggccagtgatatcgtagggaaaaacgtcgttctagttgtttctggtggaaacaatgatatcggccgtatgcaagaaatggaacaaaaggcattaatgtataagggtcgccaacagttttacttagttgagtttccgtaa

SEQ ID NO: 3346 - protein, 345 aa, Leuconostoc mesenteroides
MTTEGKLTAEEIDEAHRVLSKVVTHTPLAYDDYLSKKYRANVYLKREDMQRVRSFKIRGAYYNIIKAEKEKLNNGVVAASAGNHAQGVADTCHNLKIQATIFMPVTTPNQKVEAVKRFGSQYVTVILVGDTFDEAQSAAFEYTEKHNMFFVAPFDDRRTMAGQGTVAVEVFEDAVEQNINVDYLIASVGGGGLIGGLSTYSKKVSPQTTVVGVEPETAQSMKADFQAQKPTTVENIDHFVDGAAVARVSQFTYNQAQQYVDKLLAIPEGKVAQAVLDLYTYEAIVAEPAGAMPIASLDFMASDIVGKNVVLVVSGGNNDIGRMQEMEQKALMYKGRQQFYLVEFP

SEQ ID NO: 3347 - DNA, 990 bp, Edwardsiella tarda
  CDS (1)..(990): transl_table=11
atgcatattacatatgatcttcccgttagtattgatgatattcaagcagcaaaaaaaagactctccggaaaaatatataaaacagggatgccgcgctctaattatcttagcgaacgctgtaagggcgaaatatttttgaagtttgaaaatatgcagcgtaccggttcgtttaaaattcgcggtgcgttcaataagctgagctccctgacggagagcgaacgccgcaagggggtggtggcctgctccgccggtaaccatgcccagggagtttcactctcctgcgccatgctggggatcgacggtaaagtcgtcatgccgacctgtgcgcccaaatccaaggtcgcggccacctgcgactattcggcggaggtcgtgctgtatggcaataacttcaacgacaccattagcaaggtgagtgagatcgtcgagatggaagggcggatatttattccaccttacgatgatccgatggtgattgctggtcagggaaccatcggtctggagattttagaagatctctatgatgtcgataatgttattgtaccggtcggcggcggtgggctgattgccggtattgcgattgcgattaaatcgattaacccgaccatccgtatcatcggcgtgcagtcggaaaacgtacacggtatggcggcatcctattacgccggggagatcgcgacccatcgtacgagcggtacgctggccgacggctgcgatgtttcgcgtccaggaaacctgacctttgagattgcccgcgagctggttgacgacatggttctggtcagcgaagaggagatccgggccagcatggtggcgctgatccagcgtaataaggtgattaccgaaggggccggtgccttagcctctgccgcactgctgagtggaaagctcgatcagtatattaaagggcgtaaaagcgtcagcatcatctccggtgggaatattgacctctcccgtgtttcgcaaattaccgggctggtagacgcctga

SEQ ID NO: 3348 - protein, 329 aa, Edwardsiella tarda
MHITYDLPVSIDDIQAAKKRLSGKIYKTGMPRSNYLSERCKGEIFLKFENMQRTGSFKIRGAFNKLSSLTESERRKGVVACSAGNHAQGVSLSCAMLGIDGKVVMPTCAPKSKVAATCDYSAEVVLYGNNFNDTISKVSEIVEMEGRIFIPPYDDPMVIAGQGTIGLEILEDLYDVDNVIVPVGGGGLIAGIAIAIKSINPTIRIIGVQSENVHGMAASYYAGEIATHRTSGTLADGCDVSRPGNLTFEIARELVDDMVLVSEEEIRASMVALIQRNKVITEGAGALASAALLSGKLDQYIKGRKSVSIISGGNIDLSRVSQITGLVDA

SEQ ID NO: 3349 - DNA, 1137 bp, Sorghum bicolor
  CDS (1)..(1137)
atgcatgtgattgattgcttcctcgtcctacctagatttgggagttccaccgccaccgtcgtcgtcctcgttctcctttctcctagtccttggcgcgttgtggcgaactggagaggcctgatgggaagcagagatggcaccggtgacagcacgggacgccagggctatgctgccgacattgattccatcagggaggcgcaggcacgcattgcgccgtacgttcacaggacgcccgttctgtcgtcggcgtccatcgatgccatggtggggaagcagctcttcttcaagtgcgagtgcttccagaaagcaggggcattcaagatccgaggtgcttcgaattcgatattcgcacttgacgatgagcaggcatcaaagggcgttgtgacacatagcagtgggaaccatgccgccgccgtggctttggctgcaaagctgcgtggcatacctgcacacattgtcataccaagaaatgcaccagcgtgtaaggttgaaaatgttaagcggtatggtggtcatattatccggagcgatgtcagcattgaatcgagagaatctgtttgtaaaagagtccaggaggagactggtgctgttcttatccatcccttcaatgataaatacactatcagtggtcagggtacagtatctcttgaacttttggagcaagtccctgaaattgacacaataattgttcctattagtggcggtggtttaatttctggtgtgacccttgctgcaaaggccataaacccttcgatacgcattctggcagcagaaccaaaaggtgctgatgattctgcccagtctaaggctgctggaaagatcatcacattgccttccacaaacaccattgctgatggtctacgagcttttcttggtgacttgacatggcctgtggtgcgtgacttggtggacgatgttatcgttgtggatgacacagcgattgtggacgccatgaaaatgtgctacgagatcctgaaggtggctgttgagcctagtggcgcaattggcctggccgcagcactgtccgacgagtttaagcaaagctctgcttggcacgagagcagcaagataggaataattgtttccggaggcaatgttgacctcggcactctttgggagtctctgtacaaacaatga

SEQ ID NO: 3350 - protein, 378 aa, Sorghum bicolor
MHVIDCFLVLPRFGSSTATVVVLVLLSPSPWRVVANWRGLMGSRDGTGDSTGRQGYAADIDSIREAQARIAPYVHRTPVLSSASIDAMVGKQLFFKCECFQKAGAFKIRGASNSIFALDDEQASKGVVTHSSGNHAAAVALAAKLRGIPAHIVIPRNAPACKVENVKRYGGHIIRSDVSIESRESVCKRVQEETGAVLIHPFNDKYTISGQGTVSLELLEQVPEIDTIIVPISGGGLISGVTLAAKAINPSIRILAAEPKGADDSAQSKAAGKIITLPSTNTIADGLRAFLGDLTWPVVRDLVDDVIVVDDTAIVDAMKMCYEILKVAVEPSGAIGLAAALSDEFKQSSAWHESSKIGIIVSGGNVDLGTLWESLYKQ

SEQ ID NO: 3351 - DNA, 1002 bp, Saccharopolyspora spinosa
  CDS (1)..(1002): transl_table=11
atgaccttcaagcaacaccaggatgccagcggttttacgctgcctttcgaagcgattaccgctgcacatgatcgaattcgagaacgaatcatcgaaacgccgctgctggagagcgcggccctcaacgcactggtcggcgcacgagttctggtcaaagccgagtcgttgcagaagacgggctcgttcaagtttcgtggggcttgcaatcgcgcgctgcaactcgcgccgcacgagcggtccggcggaatcgtcgcctggtcgtccgggaatcacgcgctggcgatctcggccgtatgtgcggaactgggcgtgccggccaccatcctcatgcccttggacgcaccccgggcgaaggtcgacggcgccaagagctacggggccgaggtccggctttacgaccggcaaaccgaggatcgagaggcactcggcagggagatcgccgaccggacgaacgcggtcatcgttccgccttatgacgatccggagatcatggccggtcagggaacggtcggactcgaactcctcgcccaggcgcgcgaggccggtctaaagcccgacgccgtactcgccagtgcgagcggcggagggctgatcgccggcgtggcaaccgctgtgcgcacgaccctgcctgatgcacaggtattcgcggtcgaacctgaaggcttcgacgaccacgcacgttcccttgccgcaggcgcacgtgtgcggaacgaaccgggggcgcagtcgatctgcgactcgctccacgtgcccacgccaggagaactcacgttctccgtcaaccaccgccttctcactggtggcctcacggtcagcgacaccgaagttcgccgagcgatgcgggtggctttcgagacgctcaagctcgtggcggagcccggaggcgccgcacccctcgccgccctcctcgcggggaagttggacgtgtccggcaagaccgtcgtgacggtgctcagtggcggcaatgtcgatgcggacatgttccagtccgcattctcctga

SEQ ID NO: 3352 - protein, 333 aa, Saccharopolyspora spinosa
MTFKQHQDASGFTLPFEAITAAHDRIRERIIETPLLESAALNALVGARVLVKAESLQKTGSFKFRGACNRALQLAPHERSGGIVAWSSGNHALAISAVCAELGVPATILMPLDAPRAKVDGAKSYGAEVRLYDRQTEDREALGREIADRTNAVIVPPYDDPEIMAGQGTVGLELLAQAREAGLKPDAVLASASGGGLIAGVATAVRTTLPDAQVFAVEPEGFDDHARSLAAGARVRNEPGAQSICDSLHVPTPGELTFSVNHRLLTGGLTVSDTEVRRAMRVAFETLKLVAEPGGAAPLAALLAGKLDVSGKTVVTVLSGGNVDADMFQSAFS

SEQ ID NO: 3353 - DNA, 972 bp, Rhizobium sp
  CDS (1)..(972): transl_table=11
atgcgcaattaccccaccattcaggacatccgtgaagcccgggaacggctgagaccacacgtcaggcacacgccgctgttgcgcgcggacaagattgagaaagctgctggttgtcagctctatctcaaacccgaaaccctgcagattactggcgccttcaagatccgcggcgccctgaacaaggctctctcgctctcgagagaagagatcgcaaacggcatcatcgcgacgtcgtcgggcaaccatgcccaggggctttcttacgcggccaagatgctcggcgtaaaggtgatattggtacttccggtgaccacacccaaaatcaagattgaaaatacaaaagcccttggcgcggaagtcattctttttgatggtgataatgctgctagatggaaaaaggtctacgaaatcgctgaaggaaacaagtatgcggttattcacggctttgaagaccccattgtaatggctggccagggaacgatcgggtgcgagatactcgaagacttggacgatgtggacacggtcatcgtccccttaggcggcggaggcctaatctcgggaatcgctaccgccataaaagaaacgaaaccatcggtgcgcgttatcggggcagagcctgccttgacaccgaagtattatcacagccggatcaacaaggagcgcacatcgcttccgttgaagaacaccattgcggatggcttgaggttaagtgttccgggtaaaaacccgtatccgattatcgaaaaatatgtggacgagattgttcttgttgaagacgagcacatcatctccgggatgcgcgcgcttgccagggatgcgaagttgatcgctgaaccagccgcctcgattggcattggagccttgttggcgggcagcatagacgtcaagcccgatgaaaaagtctgtgcggtgttgtctggcggcaactgggacctaggcgatcttgcagagatatacaaggcagcggggtaa

SEQ ID NO: 3354 - protein, 323 aa, Rhizobium sp
MRNYPTIQDIREARERLRPHVRHTPLLRADKIEKAAGCQLYLKPETLQITGAFKIRGALNKALSLSREEIANGIIATSSGNHAQGLSYAAKMLGVKVILVLPVTTPKIKIENTKALGAEVILFDGDNAARWKKVYEIAEGNKYAVIHGFEDPIVMAGQGTIGCEILEDLDDVDTVIVPLGGGGLISGIATAIKETKPSVRVIGAEPALTPKYYHSRINKERTSLPLKNTIADGLRLSVPGKNPYPIIEKYVDEIVLVEDEHIISGMRALARDAKLIAEPAASIGIGALLAGSIDVKPDEKVCAVLSGGNWDLGDLAEIYKAAG

SEQ ID NO: 3355 - DNA, 969 bp, Acinetobacter baumannii
  CDS (1)..(969): transl_table=11
atgaaaaatttaacccttccaaattatgaagatgtcgcagccgctgctgaacgtataaaaggttttgtaaataaaactcctgttttaacttcacgtacggtgaacaatgaatttgaagcagaagtgttctttaaatgtgagaattttcagcgtgtaggcgctttcaaatttcgtggtgccatgaatgcacttttgcaatttaatgagactcaaaagaaagcaggtgtagttgctttttcttcgggaaatcatgcacaagctattgcgctttcatcaaaaattcttggtattccagcaaccattatcatgcctaaagatgcacctgctgcaaaaatggcagcaacgcgagaatacggcggtaatattgttgaatttgaccgttatacggaagatcgggaaaaaattggaaaagagattgccgaacaaaatggtctaacattaattccgtcttatgaccatccgcatgtgattgcaggtcaaggtacagctgctaaagagttatttgaagaagtcggtgatttagattacctgtttgtatgtttaggtggcggcggtttgttggcaggttctgccctgtcggctcgccagctttctccgaactgtaaaatatatggcgttgaaggtgcgctaggaaatgatgggcaaatgtcttttagaaaaggcgaaattgttcatattgataccccattaaccattgccgatggcgcgcagactcaatatttgggcaaattgacctttcctattattcaacagaaagttgatgatattttgacggtcacagacgaagaactcattaacgctatgaagttctttgctgaaagaatgaagatggtggttgaaccgacaggatgtctcggatttgcggctgcccgtaatttaaaacatgagttaaaaggcaaacgtatcggcattattattagtggtggcaatgtcgatatttctaaatacgcggagtttttatctgcctaa

SEQ ID NO: 3356 - protein, 322 aa, Acinetobacter baumannii
MKNLTLPNYEDVAAAAERIKGFVNKTPVLTSRTVNNEFEAEVFFKCENFQRVGAFKFRGAMNALLQFNETQKKAGVVAFSSGNHAQAIALSSKILGIPATIIMPKDAPAAKMAATREYGGNIVEFDRYTEDREKIGKEIAEQNGLTLIPSYDHPHVIAGQGTAAKELFEEVGDLDYLFVCLGGGGLLAGSALSARQLSPNCKIYGVEGALGNDGQMSFRKGEIVHIDTPLTIADGAQTQYLGKLTFPIIQQKVDDILTVTDEELINAMKFFAERMKMVVEPTGCLGFAAARNLKHELKGKRIGIIISGGNVDISKYAEFLSA

SEQ ID NO: 3357 - DNA, 1206 bp, Thermotoga sp
  CDS (1)..(1206): transl_table=11
gtgatcacactcgaggatataaaagaagcccaaagaacgctgaagaatgtggtgcacaggaccgctcttgcttacagctctgttctgagcgaagtgacaggtggagagatctacctgaagatggaaaatctccagaagaccggttcgttcaaaataaggggagcgtacaataaaatagcccacctgagcgaagaggaaagaaagagaggagtcgttgccgcgtccgctggaaaccacgcgcagggagtggcacttgctgctcaaatcttcggtattcacgctaccatcgtgatgccgaagtacgctcctctttctaaaatcaccaaaacgaggaatcttggagctcaagtgattcttgaggggaacatctttgatgaggcctacgaagcagctctcagaatacaggagaaaacaggtgcggtttttgtgcatcccttcaacgatcctcatgtcatcgctgggcagggaaccatagggttggaaataatggaagatcttccggatgtggaagtggtggtagtgcccgttggtggaggtggtttgatttcgggagtatccgttgcgatcaaatcgatgaatcctgaggttaaagtaataggcgttcaaacggagaacatgccttccatgatcgcttcactgagaaggggcagggcagagcgggtcgagggtaaacccacgcttgccgatggaatagccgtgaaaaagcccggtgacctgaccttcgagctggtgaagaagtacgtcgatgagatggtcgtggtgaacgaagaagaaatagcggatgccatccttttccttcttgagcaagcaaaggtggttgctgaaggtgcaggagcagtgggggtggccgctgttttgaacaaactggatgtgaagggaaagaaggtagcgatcgtgataagcggtggcaacatagatgtgaacatgatagacagaatcataaacaaaggactcgtgaagagcggaaggaaagtgttcatagaaacgttcgtgatggacagacctggtgccctgaaagagcttctcgggatagtggcggaactcggcgcaaacgtcctttccgtttttcacaatcgctccgcaaaggaagttcccattggttttgccaaaatagagctcgagcttgagacggtcgatgaaaaacacgttgaagagatagagagggtgttgatcgcaaagggatacgaggtgagaatagtcgtgtga

SEQ ID NO: 3358 - protein, 401 aa, Thermotoga sp
MITLEDIKEAQRTLKNVVHRTALAYSSVLSEVTGGEIYLKMENLQKTGSFKIRGAYNKIAHLSEEERKRGVVAASAGNHAQGVALAAQIFGIHATIVMPKYAPLSKITKTRNLGAQVILEGNIFDEAYEAALRIQEKTGAVFVHPFNDPHVIAGQGTIGLEIMEDLPDVEVVVVPVGGGGLISGVSVAIKSMNPEVKVIGVQTENMPSMIASLRRGRAERVEGKPTLADGIAVKKPGDLTFELVKKYVDEMVVVNEEEIADAILFLLEQAKVVAEGAGAVGVAAVLNKLDVKGKKVAIVISGGNIDVNMIDRIINKGLVKSGRKVFIETFVMDRPGALKELLGIVAELGANVLSVFHNRSAKEVPIGFAKIELELETVDEKHVEEIERVLIAKGYEVRIVV

SEQ ID NO: 3359 - DNA, 981 bp, Burkholderia pickettii
  CDS (1)..(981): transl_table=11
atgacccagctagacaccaccactcttcccgacctgtccgccatcgccggcctgcgcgcccggctgaaacaatgggtgcgcaccacgcccgtattcgacaagaccgacttcgaacccgtgccgggcacggcggtgaacttcaagctcgaactgctgcaggccagcggcaccttcaaggcgcgcggcgcgttctcgaacctgctagcgctggacgacgatcagcgcgcggccggcgtcacctgcgtgtcggcaggcaaccatgccgttggggtggcctacgccgccatgcgcctgggcatcccggccaaggtggtcatgatcaagaccgccagcccggcccgcgtggcgctgtgccgccagtacggcgccgaagtggtgctggccgaaaacggccagacggcattcgataccgtgcaccgcatcgaaagcgaggaagggcgcttcttcgtgcaccccttcaatggctaccgcacggtgctgggcaccgccacgctaggtcacgaatggctggagcaggctggcgcgctcgacgccgtgatcgtgcccatcggcggcggcgggctgatggcgggcgtcagcacggcggtgaaactgctggcgccgcaatgccaggtcatcggcgtagagcccgaaggcgccgacgccatgcaccgcagctttgaaaccggcggccccgtcaagatgggctccatgcagagcatcgccgacagcctgatggcgccgcacaccgagcaatacagctacgaactgtgccgccgcaacgtcgaccgcctggtcaaggtgtccgacgatgaactgcgcgccgccatgcgcctgctgttcgaccagctcaagctggccaccgagccggcatgtgccaccgccacggccgcgctggtcggcgggctgaaggccgaactggccggcaagcgggttggcgtgctgctgtgcggcaccaacaccgacgccgccaccttcgcgcggcacctgggcctcggctga

SEQ ID NO: 3360 - protein, 326 aa, Burkholderia pickettii
MTQLDTTTLPDLSAIAGLRARLKQWVRTTPVFDKTDFEPVPGTAVNFKLELLQASGTFKARGAFSNLLALDDDQRAAGVTCVSAGNHAVGVAYAAMRLGIPAKVVMIKTASPARVALCRQYGAEVVLAENGQTAFDTVHRIESEEGRFFVHPFNGYRTVLGTATLGHEWLEQAGALDAVIVPIGGGGLMAGVSTAVKLLAPQCQVIGVEPEGADAMHRSFETGGPVKMGSMQSIADSLMAPHTEQYSYELCRRNVDRLVKVSDDELRAAMRLLFDQLKLATEPACATATAALVGGLKAELAGKRVGVLLCGTNTDAATFARHLGLG

SEQ ID NO: 3361 - DNA, 1023 bp, Homo sapiens
  CDS (1)..(1023)
atgtgtgctcagtattgcatctcctttgctgatgttgaaaaagctcatatcaacattcgagattctatccacctcacaccagtgctaacaagctccattttgaatcaactaacagggcgcaatcttttcttcaaatgtgaactcttccagaaaacaggatcttttaagattcgtggtgctctcaatgccgtcagaagcttggttcctgatgctttagaaaggaagccgaaagctgttgttactcacagcagtggaaaccatggccaggctctcacctatgctgccaaattggaaggaattcctgcttatattgtggtgccccagacagctccagactgtaaaaaacttgcaatacaagcctacggagcgtcaattgtatactgtgaacctagtgatgagtccagagaaaatgttgcaaaaagagttacagaagaaacagaaggcatcatggtacatcccaaccaggagcctgcagtgatagctggacaagggacaattgccctggaagtgctgaaccaggttcctttggtggatgcactggtggtacctgtaggtggaggaggaatgcttgctggaatagcaattacagttaaggctctgaaacctagtgtgaaggtatatgctgctgaaccctcaaatgcagatgactgctaccagtccaagctgaaggggaaactgatgcccaatctttatcctccagaaaccatagcagatggtgtcaaatccagcattggcttgaacacctggcctattatcagggaccttgtggatgatatcttcactgtcacagaggatgaaattaagtgtgcaacccagctggtgtgggagaggatgaaactactcattgaacctacagctggtgttggagtggctgctgtgctgtctcaacattttcaaactgtttccccagaagtaaagaacatttgtattgtgctcagtggtggaaatgtagacttaacctcctccataacttgggtgaagcaggctgaaaggccagcttcttatcagtctgtttctgtttaa

SEQ ID NO: 3362 - protein, 340 aa, Homo sapiens
MCAQYCISFADVEKAHINIRDSIHLTPVLTSSILNQLTGRNLFFKCELFQKTGSFKIRGALNAVRSLVPDALERKPKAVVTHSSGNHGQALTYAAKLEGIPAYIVVPQTAPDCKKLAIQAYGASIVYCEPSDESRENVAKRVTEETEGIMVHPNQEPAVIAGQGTIALEVLNQVPLVDALVVPVGGGGMLAGIAITVKALKPSVKVYAAEPSNADDCYQSKLKGKLMPNLYPPETIADGVKSSIGLNTWPIIRDLVDDIFTVTEDEIKCATQLVWERMKLLIEPTAGVGVAAVLSQHFQTVSPEVKNICIVLSGGNVDLTSSITWVKQAERPASYQSVSV

SEQ ID NO: 3363 - DNA, 1020 bp, Mus musculus
  CDS (1)..(1020)
atgtgtgctcagtactgcatctcctttgctgatgttgaaaaagctcatatcaacattcaagactctatccacctcaccccagtgctaacaagctccattttgaatcaaatagcagggcgcaatcttttcttcaaatgtgagctcttccagaaaactgggtcttttaagattcgaggtgcccttaatgccatcagaggcttaattcctgacacgccagaagagaagcccaaagccgtagttactcacagcagcggaaaccatggccaagctctcacctatgctgctaaactggaaggaattcctgcttacattgtggttccccaaacagctcccaactgcaagaaactggcaatccaagcctatggagcatcgatagtatactgtgacccaagtgacgagtccagagaaaaggtcactcaaagaattatgcaagaaacagaaggcatcttggtccatcccaaccaggagcctgcagtgatagctggacaaggaacaattgccctggaagtgctgaaccaggttcccttggtagatgcactggtggtaccagtaggaggaggaggaatggttgctggaatagccattacaattaaggccctgaaacctagtgtgaaggtatacgctgctgagccctcgaatgcagatgactgctaccagtctaaactgaaaggagaactgacccccaatcttcatcctccagaaaccatagcagatggtgtcaaatccagcattggcttgaatacctggcctattataagagaccttgtggatgatgtcttcactgtcaccgaagatgaaatcaagtatgcaacccagctggtgtgggggagaatgaaactgctcattgagccgactgctggcgtggcactggctgcagtgctgtctcagcatttccaaacagtctctccagaagtaaagaacgtctgcattgtactcagtggggggaatgtagacctaacctccctgaactgggtggggcaggctgaacggccagctccttaccagacggtttctgtttaa

SEQ ID NO: 3364 - protein, 339 aa, Mus musculus
MCAQYCISFADVEKAHINIQDSIHLTPVLTSSILNQIAGRNLFFKCELFQKTGSFKIRGALNAIRGLIPDTPEEKPKAVVTHSSGNHGQALTYAAKLEGIPAYIVVPQTAPNCKKLAIQAYGASIVYCDPSDESREKVTQRIMQETEGILVHPNQEPAVIAGQGTIALEVLNQVPLVDALVVPVGGGGMVAGIAITIKALKPSVKVYAAEPSNADDCYQSKLKGELTPNLHPPETIADGVKSSIGLNTWPIIRDLVDDVFTVTEDEIKYATQLVWGRMKLLIEPTAGVALAAVLSQHFQTVSPEVKNVCIVLSGGNVDLTSLNWVGQAERPAPYQTVSV

SEQ ID NO: 3365 - DNA, 990 bp, Salmonella typhimurium
  CDS (1)..(990): transl_table=11
atgcacattacatacgatctcccggttgcaattgaagatatcctcgaagcgaaaaaaagactggcggggaagatatataaaacgggaatgcctcgctctaactattttagtgaacgttgcaaaggcgaaatatttctcaagtttgaaaatatgcagcgtacgggttcatttaaaattcgtggcgcttttaacaaacttagctcgttaacggaggcggaaaaacgtaaaggcgtcgtggcctgttccgcaggtaatcatgcacagggcgtttctctttcttgcgcaatgctgggtattgacggcaaagtcgtgatgccgaagggcgcgccaaagtcaaaagtggcggccacctgtgattattcggcggaagtggtgctccacggtgacaacttcaatgacaccatcgctaaggtgagtgaaattgtcgaaaccgaaggccgcatttttattccgccttacgacgatccaaaagtcattgccggacagggcactattggtctggaaattatggaagatctgtacgatgtcgataatgtcatcgtgcctattggcggcggcggtttaattgcaggtattgccattgcgattaaatcgattaacccgaccattaaagttatcggcgtacaggccgaaaatgttcacggtatggcggcgtcttattacactggcgaaataaccacgcaccgaacgaccggcaccctggcggatggttgtgatgtctcccgcccgggtaatttaacctatgaaatcgttcgtgaattagtcgatgacattgtcctggttagcgaagatgaaattcgtaacagcatgatcgctttaattcagcgcaataaggttattactgaaggcgctggcgctctggcttgcgccgcactattaagtgggaaattagatagccatattcagaacagaaaaacggtcagtattatttctggcggcaatatcgatctttctcgggtatcacaaattacgggtttagttgacgcttaa

SEQ ID NO: 3366 - protein, 329 aa, Salmonella typhimurium
MHITYDLPVAIEDILEAKKRLAGKIYKTGMPRSNYFSERCKGEIFLKFENMQRTGSFKIRGAFNKLSSLTEAEKRKGVVACSAGNHAQGVSLSCAMLGIDGKVVMPKGAPKSKVAATCDYSAEVVLHGDNFNDTIAKVSEIVETEGRIFIPPYDDPKVIAGQGTIGLEIMEDLYDVDNVIVPIGGGGLIAGIAIAIKSINPTIKVIGVQAENVHGMAASYYTGEITTHRTTGTLADGCDVSRPGNLTYEIVRELVDDIVLVSEDEIRNSMIALIQRNKVITEGAGALACAALLSGKLDSHIQNRKTVSIISGGNIDLSRVSQITGLVDA

SEQ ID NO: 3367 - DNA, 999 bp, Rhizobium sp
  CDS (1)..(999): transl_table=11
gtgaatgaattgtcgaacttaagtctagaatcgatcgagcgagcgcgtgagcggatcgaagagcacgtcttccgtacccctctgacgacatcaaggtcgctaaccgaacttaccggaactcaggtcagcctcaagctcgagcactatcagcgcactggtagctttaagctgcggggtgcgacaaacgcaattcttcaactcagcccgtcggatcgggcacgtggggttattgcggcatctacgggcaatcacggacgggctctttcctacgccgcaaaagcggtcggctctcgcgccaccatctgcatgtcggatcttgttccagaaaacaaggtttccgagatccggaagcttggcgcgacagttcggatagtgggatcgtcacaagacgatgcgcaagtcgaagtcgagcggctcgtcgcggaggaaggcctcagcatgatcccgcctttcgatcacccgcatatcatcgccggccagcgaaccgtcggtcttgagatcgttgaggcgatgccggacgtcgcgatggtactgcttccactgtcgggtggcggcttggctgcaggcgttgcagcagcggtgaaggcactgcggcctcatgcgaggatcatcggtgtcactatggatcgaggcgccgcgatgaaggccagcatcgaagctgggcatccggtacaagtgaaggagtatcggagcttggctgattctttaggtggaggaatcggcatggccaacgcttggacctttcaaatgtgcagagcccttctggacgatgttgtcctcgttaatgaaggcgaaatagccgcgggaattagacatgcttatgagcatgagcgtcagatactcgagggcgccggcgctgtcggtatcgcagcgcttctctccggcaaggtggctgctcgcggaggttcagtaggagtcgttttgtcaggtcaaaacatcgacatgggcctgcatcgggaggtcattaacggagttgtcagagcgaccgaggaggattga

SEQ ID NO: 3368 - protein, 332 aa, Rhizobium sp
MNELSNLSLESIERARERIEEHVFRTPLTTSRSLTELTGTQVSLKLEHYQRTGSFKLRGATNAILQLSPSDRARGVIAASTGNHGRALSYAAKAVGSRATICMSDLVPENKVSEIRKLGATVRIVGSSQDDAQVEVERLVAEEGLSMIPPFDHPHIIAGQRTVGLEIVEAMPDVAMVLLPLSGGGLAAGVAAAVKALRPHARIIGVTMDRGAAMKASIEAGHPVQVKEYRSLADSLGGGIGMANAWTFQMCRALLDDVVLVNEGEIAAGIRHAYEHERQILEGAGAVGIAALLSGKVAARGGSVGVVLSGQNIDMGLHREVINGVVRATEED

SEQ ID NO: 3369 - DNA, 972 bp, Schizosaccharomyces pombe
  CDS (1)..(972)
atgagcgataacctggtgcttcctacctatgatgatgttgcttcagctagtgagcgaattaagaaattcgccaacaaaaccccagtactcacgtcgagcacagtaaataaagagtttgtggcagaagtgttttttaaatgtgaaaatttccaaaaaatgggtgctttcaaatttcgcggtgcccttaatgctctttctcaactcaatgaagctcaacgtaaagctggtgttttgacgttttcttctggtaatcatgctcaggccattgcactgtcggcaaagatcttgggaattccagcaaaaatcattatgccactcgatgcacccgaagccaaggtcgctgccacgaaaggctatggtggtcaagtaatcatgtatgatagatacaaagatgatagagaaaagatggccaaagaaatttctgaaagagaaggtcttaccattatccctccttacgatcacccccatgtacttgctggtcaaggaaccgcagctaaggaactgtttgaagaggttggccctcttgatgcactttttgtttgtctcggaggcggtggcttgctttctggatcagcacttgctgctcgccattttgctccaaactgcgaagtttatggagttgaacctgaagctggaaacgatgggcaacagtcctttaggaaaggatctatcgtacatattgatacaccaaaaactatagccgatggtgctcaaactcaacatttgggtaactacacgttttccattataaaagaaaaggtcgatgatatattgactgtgtccgacgaggaactaattgactgtcttaagttttatgccgcacgtatgaaaattgtagtcgaacccactggatgtcttagctttgcggcagcgcgcgctatgaaggaaaagctaaagaataaacgaattggtatcattataagtggaggaaacgtagacattgagcgttatgcccatttcttatcacagtaa

SEQ ID NO: 3370 - protein, 323 aa, Schizosaccharomyces pombe
MSDNLVLPTYDDVASASERIKKFANKTPVLTSSTVNKEFVAEVFFKCENFQKMGAFKFRGALNALSQLNEAQRKAGVLTFSSGNHAQAIALSAKILGIPAKIIMPLDAPEAKVAATKGYGGQVIMYDRYKDDREKMAKEISEREGLTIIPPYDHPHVLAGQGTAAKELFEEVGPLDALFVCLGGGGLLSGSALAARHFAPNCEVYGVEPEAGNDGQQSFRKGSIVHIDTPKTIADGAQTQHLGNYTFSIIKEKVDDILTVSDEELIDCLKFYAARMKIVVEPTGCLSFAAARAMKEKLKNKRIGIIISGGNVDIERYAHFLSQ

SEQ ID NO: 3371 - DNA, 981 bp, Saccharomyces cerevisiae
  CDS (1)..(981)
atgattgttcccacttatggagacgttttggatgccagcaacagaattaaagaatatgtaaataaaacaccggttctcacttcacgaatgcttaatgatcgacttggagcacaaatatactttaaaggtgagaatttccaacgagtgggagcgttcaagtttcgtggagcaatgaatgctgtttcaaaattaagtgatgaaaaaagaagtaagggagtaattgccttctcatcaggaaaccatgcacaggctattgctcttagtgcaaaactattaaatgtacctgcaacaattgttatgcccgaggatgcgcccgcccttaaagttgctgctacagccggttacggagcacatatcataaggtataacaggtatactgaagatcgcgagcagattgggcgtcaactagcagccgaacatggttttgcattgattccgccctacgatcatcctgatgttattgcagggcaaggtacgtcggcaaaagagctattagaagaggttggacaacttgatgcattatttgttcctttgggcggtggtgggctcctttcaggatctgcacttgccgctagaagcctttctccaggctgcaaaatttttggggttgaacctgaagctggtaacgatggacaacaatccttcagatcgggttccattgttcatatcaatacgccaaaaactatcgcagatggcgctcaaacacaacacctcggtgagtacacatttgccattattcgcgaaaatgtcgatgatattttaacggttagcgaccaagagctagtaaaatgcatgcactttcttgcggaacgcatgaaggtggttgttgagcccacagcttgtttgggatttgcaggtgcacttctaaaaaaggaagagctagttgggaagaaagtaggcataatactaagtggaggtaatgtagacatgaagagatatgctactttaatctctgggaaggaagatggcccaacgatttag

SEQ ID NO: 3372 - protein, 326 aa, Saccharomyces cerevisiae
MIVPTYGDVLDASNRIKEYVNKTPVLTSRMLNDRLGAQIYFKGENFQRVGAFKFRGAMNAVSKLSDEKRSKGVIAFSSGNHAQAIALSAKLLNVPATIVMPEDAPALKVAATAGYGAHIIRYNRYTEDREQIGRQLAAEHGFALIPPYDHPDVIAGQGTSAKELLEEVGQLDALFVPLGGGGLLSGSALAARSLSPGCKIFGVEPEAGNDGQQSFRSGSIVHINTPKTIADGAQTQHLGEYTFAIIRENVDDILTVSDQELVKCMHFLAERMKVVVEPTACLGFAGALLKKEELVGKKVGIILSGGNVDMKRYATLISGKEDGPTI

SEQ ID NO: 3373 - DNA, 1138 bp, Brassica napus
  CDS (7)..(1005)
taagaaatggaagcaaagaagaggcatgaatatgctgcggatttatcttccataaagaaagctcatgaacgtatcaagccgtacatacacaaaactccagtgctaacatctgaatccttgaattcaatctctggaagaagcttgttctttaagtgcgagtgctttcagaaaggtggagctttcaagtttcgtggagcatgcaatgctgtcttgtctcttgatgctgaacaagcagccaaaggggttgtaacacacagcagtggaaaccatgctgctgcgttgtctttggctgcgaagatgcaggggatccctgcgtatatcgttgtaccaaaaggtgctccgaagtgcaaagtagataatgtgatccggtatggtggtaaggttatatggagtgaagcaacaatgtcttctcgagaggaagtagcttccagagttttgcacgaaacaggttctgttctcatccacccatataatgatggacgcatcataagtggtcagggtactgttgcgttggaactgttggagcaaatccaagagattgacactataattgtgccgataagcggggggggtttgatctctggtgtggcgctggctgctaagtcaattaagccgagcatccggattatagcagctgaaccaaaaggagctgatgatgcggctcagtctaaggttgctggtagaatcatcactttacctgtggctaataccatagcggatggccttcgtgcttctctaggagacttaacatggcctgtagtgagagatatggtagatggtgttgtagttgtggaggatggggaaataattgaagccatgagaatgtgctatgagatgctgaaagtctctgtggaaccaagtggtgccattggcctagcagcagttttatcaactagtttccgtagcaatccttgttggaaagattgtaaaaacatagggattgtactcccaggaggtaatgtcgatttgggtgttctgtgggattcacttaagagttcagagtaattaaacatcttggttactgcatttgtttcactattgatgtcgatgtgagaattgtctgtagaattttgaacaaaaggattcatgttcttgcaagaaactccaaattagtacagagtccaaaaaaaaaaaaaaa

SEQ ID NO: 3374 - protein, 332 aa, Brassica napus
MEAKKRHEYAADLSSIKKAHERIKPYIHKTPVLTSESLNSISGRSLFFKCECFQKGGAFKFRGACNAVLSLDAEQAAKGVVTHSSGNHAAALSLAAKMQGIPAYIVVPKGAPKCKVDNVIRYGGKVIWSEATMSSREEVASRVLHETGSVLIHPYNDGRIISGQGTVALELLEQIQEIDTIIVPISGGGLISGVALAAKSIKPSIRIIAAEPKGADDAAQSKVAGRIITLPVANTIADGLRASLGDLTWPVVRDMVDGVVVVEDGEIIEAMRMCYEMLKVSVEPSGAIGLAAVLSTSFRSNPCWKDCKNIGIVLPGGNVDLGVLWDSLKSSE

SEQ ID NO: 3375 - DNA, 1290 bp, Brassica napus
  CDS (1)..(1290)
atggcggtgctcatggcttcaaggtttaacagtgaagctaggatcgcgtctcgatgcctttcaacactcttgagaaatcaaagagtcctgatagcctcaccatcatcatcatccatggcatccgcatcttcttcctctgctctcctccttaacccgttgacttcctccactctccgtcacttcagatcctcttcggagatctcttctctctccttctctgcttccggcttccctctagcgatgaagagccagcagagtcggagctatggagatgtctcgaaacgagatccgtgcgaggccgttaagcgtgagaatggagctgatgagctcaacatcgctgagaatgtgtctcagctcattgggaaaactcctatggtgtacttgaacagtatggcgaagggttgtgtagcgaacattgctgctaagctcgagatcatggagccttgttgcagtgtcaaggataggattgggtacagtatggttactgatgctgagcaaaaaggattcatatcacctggaaagagtgttcttgtggaacctacaagtggaaacacgggtattggacttgcgtttatcgctgcttcaagaggctaccgactcatcttgacaatgccatcatccatgagtatggagagaagagttcttctaaaggcgtttggagctgagcttgtgctgactgatcctgctaaaggcatgaccggtgcagttcagaaggctgaggaaatcttgaaatcaactcctgatgcttacatgctccaacagtttgacaaccctgccaatccaaagatccattatgagactactggtcctgagatatgggaagatacaaagggaaaggtggatatatttgttgctgggattggaactggtgggactatcactggtgttggtcggttcattaaagagaaaaaccccaaagtgcaggttattggtgttgaaccaactgaaagcgacatactttctggtggcaaaccgggacctcacaagattcaagggattggagctggatttatacctaagaatttggatcgggcaattatggatgaagtcatagcgatttcaagtgaggaagctatagaaactgcaaagcaactagctctcaaagaaggcttgatggttggaatatcatctggagctgctgctgctgctgcaatcatggtagcaaagagacctgagaatgcagggaaactcattgctgttgttttcccgagctttggagagcgatatttatcaacccctctgttccagtctatccgggaagaggttgagaaaatgcagcctgagatatga

SEQ ID NO: 3376 - protein, 429 aa, Brassica napus
MAVLMASRFNSEARIASRCLSTLLRNQRVLIASPSSSSMASASSSSALLLNPLTSSTLRHFRSSSEISSLSFSASGFPLAMKSQQSRSYGDVSKRDPCEAVKRENGADELNIAENVSQLIGKTPMVYLNSMAKGCVANIAAKLEIMEPCCSVKDRIGYSMVTDAEQKGFISPGKSVLVEPTSGNTGIGLAFIAASRGYRLILTMPSSMSMERRVLLKAFGAELVLTDPAKGMTGAVQKAEEILKSTPDAYMLQQFDNPANPKIHYETTGPEIWEDTKGKVDIFVAGIGTGGTITGVGRFIKEKNPKVQVIGVEPTESDILSGGKPGPHKIQGIGAGFIPKNLDRAIMDEVIAISSEEAIETAKQLALKEGLMVGISSGAAAAAAIMVAKRPENAGKLIAVVFPSFGERYLSTPLFQSIREEVEKMQPEI

SEQ ID NO: 3377 - DNA, 1259 bp, Zea mays
  CDS (95)..(1111)
cccctctcctagtctttggcgcgtagtggcgaactggagaggtgtacaatcgtccggcgatccggacttcgattggttctctgctgttggtctgatgggaagtaaagacggcaccggtgacatatcggaagcccaaggctatgctgccgacattgattccatcagggaggcgcaggcccgcattgcgccgtacgttcacaggacgcccgttatgtcgtcgacgtccatcgatgccatggtggggaagaagctcttcttcaagtgcgagtgcttccagaaagcgggcgcattcaagatccgaggtgcttcgaattcgatattcgcacttgacgatgagcaggtatcaaagggcgttgtgacacatagcagtgggaaccatgccgctgctgtggctttggctgcaaagctgcgtggcatacctgcgcacattgtcattccaagaaatgcaccagcgtgtaaggttgaaaatgttaagcgctacggtggtcatattatttggagcgatgccagcattgaatcgagagaatatgtttgtaaaagagtccaggaggagaccggcgctgttcttattcatcccttcaatagtaaatacactatcagtggtcagggtacagtatcccttgaacttttggagcaagtccctgaaattgacacaataattgttcccattagtggtggtggtttaatttctggtgtggcccttgctgcaaaggccataaacccttcgatacgcattctagcagcagaaccaaaaggtgctgatgattctgctcagtctaaggctgctggaaagatcatcacattgccttccacaaacaccattgctgatggactacgagcttttcttggagacctgacatggcctgtggtgcgtgacttggtggacgatgttatcgttgtggatgacactgccattgtggacgccatgaaaatgtgctatgagatcctgaaggtggctgttgagcccagtggcgcaattggcctggccgcagcactgtccgacgagtttaagcaaagctctgcttggcacgagagcagcaagatagggataattgtttctggagggaatgttgaccttggcactctctgggagtctatgtacaaacactgattggagagagtaggaccgatgatattgcccttgaatttcaaacgtgatagttttagacaagtcgtttgtaaacttggaatagttcgttgtaaacatcacttattacctgtttttttatcaatgggttattcagtgcagccaaaaaaaa

SEQ ID NO: 3378 - protein, 338 aa, Zea mays
MGSKDGTGDISEAQGYAADIDSIREAQARIAPYVHRTPVMSSTSIDAMVGKKLFFKCECFQKAGAFKIRGASNSIFALDDEQVSKGVVTHSSGNHAAAVALAAKLRGIPAHIVIPRNAPACKVENVKRYGGHIIWSDASIESREYVCKRVQEETGAVLIHPFNSKYTISGQGTVSLELLEQVPEIDTIIVPISGGGLISGVALAAKAINPSIRILAAEPKGADDSAQSKAAGKIITLPSTNTIADGLRAFLGDLTWPVVRDLVDDVIVVDDTAIVDAMKMCYEILKVAVEPSGAIGLAAALSDEFKQSSAWHESSKIGIIVSGGNVDLGTLWESMYKH

SEQ ID NO: 3379 - DNA, 1325 bp, Zea mays
  CDS (112)..(1128)
cctcgactcctcgttctcccctctcctagtctttggcgcgtagtggcgaactggagaggtgtacaatcgtccggcgatccggacttcgattggttctctgctgttggtctgatgggaagtaaagacggcaccggtgacatatcggaagcccaaggctatgctgccgacattgattccatcagggaggcgcaggcccgcattgcgccgtacgttcacaggacgcccgttatgtcgtcgacgtccatcgatgccatggtggggaagaagctcttcttcaagtgcgagtgcttccagaaagcgggcgcattcaagatccgaggtgcttcgaattcgatattcgcacttgacgatgagcaggtatcaaagggcgttgtgacacatagcagtgggaaccatgccgctgctgtggctttggctgcaaagctgcgtggcatacctgcgcacattgtcattccaagaaatgcaccagcgtgtaaggttgaaaatgttaagcgctacggtggtcatattatttggagcgatgccagcattgaatcgagagaatatgtttgtaaaagagtccaggaggagaccggcgctgttcttattcatcccttcaatagtaaatacactatcagtggtcagggtacagtatcccttgaacttttggagcaagtccctgaaattgacacaataattgttcccattagtggtggtggtttaatttctggtgtggcccttgctgcaaaggccataaacccttcgatacgcattctagcagcagaaccaaaaggtgctgatgattctgctcagtctaaggctgctggaaagatcatcacattgccttccacaaacaccattgctgatggactacgagcttttcttggagacctgacatggcctgtggtgcgtgacttggtggacgatgttatcgttgtggatgacactgccattgtggacgccatgaaaatgtgctatgagatcctgaaggtggctgttgagcccagtggcgcaattggcctggccgcagcactgtccgacgagtttaagcaaagctctgcttggcacgagagcagcaagatagggataattgtttctggagggaatgttgaccttggcactctctggcagtctatgtacaaacactgattggagagagtaggaccgatgatattgcccttgaatttcaaacgtgatagttttagacaagtcgtttgtaaacttggaatagttcgttgtaaacatcacttattacctgtttttttatcaatgggttattcagttgcagccacatcgatcactgaaaccgaaggctggggcagcagtttttccttccaaaaaaaaaa

SEQ ID NO: 3380 - protein, 338 aa, Zea mays
MGSKDGTGDISEAQGYAADIDSIREAQARIAPYVHRTPVMSSTSIDAMVGKKLFFKCECFQKAGAFKIRGASNSIFALDDEQVSKGVVTHSSGNHAAAVALAAKLRGIPAHIVIPRNAPACKVENVKRYGGHIIWSDASIESREYVCKRVQEETGAVLIHPFNSKYTISGQGTVSLELLEQVPEIDTIIVPISGGGLISGVALAAKAINPSIRILAAEPKGADDSAQSKAAGKIITLPSTNTIADGLRAFLGDLTWPVVRDLVDDVIVVDDTAIVDAMKMCYEILKVAVEPSGAIGLAAALSDEFKQSSAWHESSKIGIIVSGGNVDLGTLWQSMYKH

SEQ ID NO: 3381 - DNA, 1192 bp, Zea mays
  CDS (145)..(1161)
ctgtacattctcttcctcgactcctcgttctcccctctcctagtctttggcgcgtagtggcgaactggagaggtgtacaatcgtccggcgatccggacttcgattggttctctgctgttgaattgattgtctgtgctaggtctgatgggaagtaaagacggcaccggtgacatatcggaagcccaaggctatgctgccgacattgattccatcagggaggcgcaggcccgcattgcgccgtacgttcacaggacgcccgttatgtcgtcgacgtccatcgatgccatggtggggaagaagctcttcttcaagtgcgagtgcttccagaaagcgggcgcattcaagatccgaggtgcttcgaattcgatattcgcacttgacgatgagcaggtatcaaagggcgttgtgacacatagcagtgggaaccatgccgctgctgtggctttggctgcaaagctgcgtggcatacctgcgcacattgtcattccaagaaatgcaccagcgtgtaaggttgaaaatgttaagcgctatggtggtcatattatttggagcgatgctagcattgaatcgagagaatctgtttgtaaaagagtccaggaggagaccggcgctgttcttattcatcccttcaatagtaaatacactatcagtggtcagggtacagtatctcttgaacttttggagcaagtccctgaaattgacacaataattgttcccattagtggtggtggtttaatttctggtgtggcccttgctgcaaaggccataaacccttcgatacgcattctagcagcagaaccaaaaggtgctgatgattctgctcagtctaaggctgctggaaagatcatcacattgccttccacaaacaccattgctgatggactacgagctttccttggagacctgacatggcctgtggtgcgtgacttggtggacgatgttatcgttgtggatgacactgccattgtggacgccatgaaaatgtgctatgagatcctgaaggtggctgtcgagcccagtggcgcaattggcctggccgcagcactgtccgacgagtttaagcaaagctctgcttggcacgagagcagcaagatagggataattgtttcgggaggcaatgttgaccttggcactctctggcagtctatgtacaaacactgattggagagagtaggaccgatgatatcgccct

SEQ ID NO: 3382 - protein, 338 aa, Zea mays
MGSKDGTGDISEAQGYAADIDSIREAQARIAPYVHRTPVMSSTSIDAMVGKKLFFKCECFQKAGAFKIRGASNSIFALDDEQVSKGVVTHSSGNHAAAVALAAKLRGIPAHIVIPRNAPACKVENVKRYGGHIIWSDASIESRESVCKRVQEETGAVLIHPFNSKYTISGQGTVSLELLEQVPEIDTIIVPISGGGLISGVALAAKAINPSIRILAAEPKGADDSAQSKAAGKIITLPSTNTIADGLRAFLGDLTWPVVRDLVDDVIVVDDTAIVDAMKMCYEILKVAVEPSGAIGLAAALSDEFKQSSAWHESSKIGIIVSGGNVDLGTLWQSMYKH

SEQ ID NO: 3383 - DNA, 24 bp, Artificial sequence
  primer
atgcatattacatacgatctgccg

SEQ ID NO: 3384 - DNA, 23 bp, Artificial sequence
  primer
ttaagcgtcaacgaaaccggtga

SEQ ID NO: 3385 - protein, 343 aa, Artificial sequence
  consensus sequence
  Variant (2)..(10): Xaa in position 2 to 10 is any amino acid
  Variant (11)..(13): Xaa in position 11 to 13 is any or no amino acid
  Variant (16)..(18): Xaa in position 16 to 18 is any amino acid
  Variant (20)..(28): Xaa in position 20 to 28 is any amino acid
  Variant (29)..(33): Xaa in position 29 to 33 is any or no amino acid
  Variant (35)..(35): Xaa in position 35 is any amino acid
  Variant (37)..(38): Xaa in position 37 to 38 is any amino acid
  Variant (40)..(41): Xaa in position 40 to 41 is any amino acid
  Variant (43)..(43): Xaa in position 43 is any amino acid
  Variant (46)..(46): Xaa in position 46 is any amino acid
  Variant (50)..(50): Xaa in position 50 is any amino acid
  Variant (52)..(55): Xaa in position 52 to 55 is any amino acid
  Variant (57)..(60): Xaa in position 57 to 60 is any amino acid
  Variant (61)..(68): Xaa in position 61 to 68 is any or no amino acid
  Variant (71)..(73): Xaa in position 71 to 73 is any amino acid
  Variant (75)..(75): Xaa in position 75 is any amino acid
  Variant (81)..(82): Xaa in position 81 to 82 is any amino acid
  Variant (84)..(85): Xaa in position 84 to 85 is any amino acid
  Variant (87)..(89): Xaa in position 87 to 89 is any amino acid
  Variant (91)..(96): Xaa in position 91 to 96 is any amino acid
  Variant (99)..(101): Xaa in position 99 to 101 is any amino acid
  Variant (103)..(104): Xaa in position 103 to 104 is any amino acid
  Variant (106)..(112): Xaa in position 106 to 112 is any amino acid
  Variant (113)..(113): Xaa in position 113 is any or no amino acid
  Variant (115)..(116): Xaa in position 115 to 116 is any amino acid
  Variant (117)..(119): Xaa in position 117 to 119 is any or no amino acid
  Variant (121)..(139): Xaa in position 121 to 139 is any amino acid
  Variant (140)..(146): Xaa in position 140 to 146 is any or no amino acid
  Variant (148)..(152): Xaa in position 148 to 152 is any amino acid
  Variant (154)..(160): Xaa in position 154 to 160 is any amino acid
  Variant (166)..(168): Xaa in position 166 to 168 is any amino acid
  Variant (170)..(182): Xaa in position 170 to 182 is any amino acid
  Variant (183)..(188): Xaa in position 183 to 188 is any or no amino acid
  Variant (194)..(195): Xaa in position 194 to 195 is any amino acid
  Variant (197)..(205): Xaa in position 197 to 205 is any amino acid
  Variant (207)..(208): Xaa in position 207 to 208 is any amino acid
  Variant (209)..(215): Xaa in position 209 to 215 is any or no amino acid
  Variant (217)..(241): Xaa in position 217 to 241 is any amino acid
  Variant (242)..(244): Xaa in position 242 to 244 is any or no amino acid
  Variant (248)..(269): Xaa in position 248 to 269 is any amino acid
  Variant (270)..(279): Xaa in position 270 to 279 is any or no amino acid
  Variant (281)..(296): Xaa in position 281 to 296 is any amino acid
  Variant (298)..(300): Xaa in position 298 to 300 is any amino acid
  Variant (302)..(303): Xaa in position 302 to 303 is any amino acid
  Variant (305)..(308): Xaa in position 305 to 308 is any amino acid
  Variant (310)..(310): Xaa in position 310 is any amino acid
  Variant (311)..(312): Xaa in position 311 to 312 is any or no amino acid
  Variant (314)..(323): Xaa in position 314 to 323 is any amino acid
  Variant (324)..(337): Xaa in position 324 to 337 is any or no amino acid
  Variant (342)..(342): Xaa in position 342 is any amino acid
AXXXXXXXXXXXXTPXXXSXXXXXXXXXXXXXXKXEXXQXXGXFKXRGAXNXXXXLXXXXXXXXXXXXGVXXXSXGNHAQXXAXXAXXXGXXXXXXMPXXXPXXKXXXXXXXXGXXXXXVXXXXXXXXXXXXXXXXXXXXXXXXXXGXXXXXPXXXXXXXAGQGTXXXEXXXXXXXXXXXXXXXXXXXGGGGLXXGXXXXXXXXXPXXXXXXXXXGXXXXXXXXXXXXXXXXXXXXXXXXXXXXADGXXXXXXXXXXXXXXXXXXXXXXXXXXXXXXXXVXXXXXXXXXXXXXXXXKXXXEXXGXXXXAXXXAXXXXXXXXXXXXXXXXXXXXXXXXSGGNXD

SEQ ID NO: 3386 - protein, 23 aa, Artificial sequence
  protein pattern
  Variant (2)..(2): Xaa in position 2 is any amino acid
  Variant (4)..(5): Xaa in position 4 to 5 is any amino acid
  Variant (7)..(8): Xaa in position 7 to 8 is any amino acid
  Variant (10)..(10): Xaa in position 10 is Ala or Ser
  Variant (11)..(11): Xaa in position 11 is Phe or Tyr
  Variant (13)..(13): Xaa in position 13 is any amino acid
  Variant (17)..(19): Xaa in position 17 to 19 is any amino acid
  Variant (20)..(22): Xaa in position 20 to 22 is any or no amino acid
KXEXXQXXGXXKXRGAXXXXXXL

SEQ ID NO: 3387 - protein, 42 aa, Artificial sequence
  protein pattern
  Variant (2)..(5): Xaa in position 2 to 5 is any amino acid
  Variant (6)..(6): Xaa in position 6 is any or no amino acid
  Variant (8)..(8): Xaa in position 8 is Ala, Ser or Thr
  Variant (13)..(13): Xaa in position 13 is any amino acid
  Variant (14)..(14): Xaa in position 14 is Ala, Cys, Gly or Ser
  Variant (15)..(15): Xaa in position 15 is Ile, Leu or Val
  Variant (16)..(16): Xaa in position 16 is Ala or Ser
  Variant (17)..(18): Xaa in position 17 to 18 is any amino acid
  Variant (19)..(19): Xaa in position 19 is Ala, Cys, Gly or Ser
  Variant (20)..(25): Xaa in position 20 to 25 is any amino acid
  Variant (26)..(26): Xaa in position 26 is Ala, Cys, Gly, Ser, Thr or Val
  Variant (27)..(27): Xaa in position 27 is any amino acid
  Variant (28)..(28): Xaa in position 28 is Ile, Leu or Val
  Variant (29)..(29): Xaa in position 29 is any amino acid
  Variant (30)..(30): Xaa in position 30 is Ile, Leu, Met or Val
  Variant (31)..(33): Xaa in position 31 to 33 is any amino acid
  Variant (34)..(34): Xaa in position 34 is Ala, Ser, Thr or Val
  Variant (35)..(37): Xaa in position 35 to 37 is any amino acid
  Variant (38)..(38): Xaa in position 38 is Lys or Arg
  Variant (39)..(41): Xaa in position 39 to 41 is any amino acid
  Variant (42)..(42): Xaa in position 42 is Ala, Cys, Thr or Val
GXXXXXSXGNHAXXXXXXXXXXXXXXXXXXXXXXXXXXXXXX

SEQ ID NO: 3388 - protein, 16 aa, Artificial sequence
  protein pattern
  Variant (2)..(6): Xaa in position 2 to 6 is any amino acid
  Variant (7)..(7): Xaa in position 7 is any or no amino acid
  Variant (12)..(12): Xaa in position 12 is any amino acid
  Variant (13)..(13): Xaa in position 13 is Ala, Gly, Ser or Val
  Variant (14)..(14): Xaa in position 14 is any amino acid
  Variant (15)..(15): Xaa in position 15 is Asp or Glu
  Variant (16)..(16): Xaa in position 16 is Phe, Ile, Leu, Met or Val
DXXXXXXGQGTXXXXX

SEQ ID NO: 3389 - protein, 13 aa, Artificial sequence
  protein pattern
  Variant (5)..(5): Xaa in position 5 is Ile, Leu or Met
  Variant (6)..(6): Xaa in position 6 is any amino acid
  Variant (7)..(7): Xaa in position 7 is Ala, Gly or Ser
  Variant (9)..(9): Xaa in position 9 is any amino acid
  Variant (10)..(12): Xaa in position 10 to 12 is any or no amino acid
GGGGXXXGXXXXA

SEQ ID NO: 3390 - DNA, 561 bp, Escherichia coli
  CDS (1)..(561)
atgatgacaaggcaggcatcaatgaaaggcttcccaattgcgcatatttttcacccttcaatcccgccaatgcacgcagtggttaacaatcacaatagaaatattgattattggacggtaaaaagaaagtttgcagaaattgtctccaccaatgacgttaataaaatttacagtataagtaatgaactgcggagagtattatctgcaataactgcattgaatttctatcatggcgatgttccttctgtcatgatccgaatccaaccggaaaatatgagtccattcattatagatatttctacaggagaacatgatgattatatcatacaaacattagatgtaggcacttttgcaccttttggtgaacaatgtacttgctcagccgtcaataaaaaagagctggaatgtattaaggagacgatttctaagtattgtgcaaaattcacccgaaaagaagccatcttaaccccccttgtgcactttaataaaaccagcattacttcagattgttggcaaattctctttttttcacccgatcattttaataatgatttttattaa

SEQ ID NO: 3391 - protein, 186 aa, Escherichia coli
MMTRQASMKGFPIAHIFHPSIPPMHAVVNNHNRNIDYWTVKRKFAEIVSTNDVNKIYSISNELRRVLSAITALNFYHGDVPSVMIRIQPENMSPFIIDISTGEHDDYIIQTLDVGTFAPFGEQCTCSAVNKKELECIKETISKYCAKFTRKEAILTPLVHFNKTSITSDCWQILFFSPDHFNNDFY

SEQ ID NO: 3392 - DNA, 540 bp, Escherichia coli
  CDS (1)..(540): transl_table=11
atgaaaggcttcccaattgcgcatatttttcacccttcaatcccgccaatgcacgcagtggttaacaatcacaatagaaatattgattattggacggtaaaaagaaagtttgcagaaattgtctccaccaatgacgttaataaaatttacagtataagtaatgaactgcggagagtattatctgcaataactgcattgaatttctatcatggcgatgttccttctgtcatgatccgaatccaaccggaaaatatgagtccattcattatagatatttctacaggagaacatgatgattatatcatacaaacattagatgtaggcacttttgcaccttttggtgaacaatgtacttgctcagccgtcaataaaaaagagctggaatgtattaaggagacgatttctaagtattgtgcaaaattcacccgaaaagaagccatcttaaccccccttgtgcactttaataaaaccagcattacttcagattgttggcaaattctctttttttcacccgatcattttaataatgatttttattga

SEQ ID NO: 3393 - protein, 179 aa, Escherichia coli
MKGFPIAHIFHPSIPPMHAVVNNHNRNIDYWTVKRKFAEIVSTNDVNKIYSISNELRRVLSAITALNFYHGDVPSVMIRIQPENMSPFIIDISTGEHDDYIIQTLDVGTFAPFGEQCTCSAVNKKELECIKETISKYCAKFTRKEAILTPLVHFNKTSITSDCWQILFFSPDHFNNDFY

SEQ ID NO: 3394 - DNA, 22 bp, Artificial sequence
  primer
atgatgacaaggcaggcatcaa

SEQ ID NO: 3395 - DNA, 28 bp, Artificial sequence
  primer
ttaataaaaatcattattaaaatgatcg

SEQ ID NO: 3396 - DNA, 2382 bp, Escherichia coli
  CDS (1)..(2382)
atgttaaaaaaaacgttactggcctacaccattggttttgccttttctcccccagccaatgcagatggtatagagattgccgctgttgattttgatcgggaaacattaaaatcactaggtgtagatcctaatatatcgcattatttttcccgttcagcccgttttttgccaggtgaatattcactgatagtatcagtaaatggcgaaaaaaaaggcaacattgctacgcgctttgatgaaaatggcgacatttgtcttgatcaggcatttctgcaacaagccggtttaaaaattccttctgaagaaaaaaatggctgttacgactatatattgtcctacccgggtaccacaatcacaccattacctaaccaggaagcgttagatattatcgtttcaccacaggcgatcattcccatagggttggatctcacaaacgcagcaactggtggaacagctgcgctgctaaactactctctgatgagcagccgtgcagaattttctaatgggagttcggactactcccaggctgcacttgaaggcgggattaatattaatgactggatgttacgcagccatcagttccttacacaaacaaatggcacattcagtaaccagaactcgtcaacctaccttcaacgtacctttacagatcttaaaacactcatgcgagcaggtgaagttaacctcaataatagcgtgttggaaggagccagtatttacggtatcgaaatcgcaccggacaacgcattgcaaaccagcggcagtggtgtgcaagttactggtatagccaacacctctcaggctcgtgtcgagattcgtcaacaaggagttttaattcattccattctggttcctgcgggcgcattcactatccctgatgtacctgttcgcaatggtaatagtgatcttaatgtcaccgttgtcgaaacagacggtagttcgcacaactatattgttccctccaccctgtttaatcagcatgtagaaagcttccagggttatcgcttcgcgatagggcgggtagacgatgactatgacgaatcaccttgggtaattagtgcatcgagcggatggaatctgacacgctggagtgcaatgaacggcggcgttatcgtagcagaaaattatcaggcggcatcaatccggtcgagtctggttcccctgcccgatttaacagtgagcagccaaattagtacatcgcaggatacgaaagactcactgcaaggacagaaatatcgtcttgacgcgaactacaatctcccattttcacttgggctaacaaccagcctcactcgatctgatcgccattatcgcgaactgtctgaagcgattgatgatgattataccgatccgactaaaagcacttatgcgcttggtttaaactggtctaactccattctgggtggtttcaacatcagtggctataaaacatatagttacgacggtgacaatgactcaagcaaccttaatattaactggaacaaagcgttcaaacacgccacggtttccgtcaactggcagcatcaacttagtgcttcagaaaataatgaagacgatggtgatctgttctacgtcaacatcagtattccatttggcagatcaaacaccgccacactgtatactcgccatgacgatcataaaacccactatggtactggtgtcatgggagtcgtctcagatgagatgtcctactatgtgaatgctgaacgagatcacgacgaacgtgaaacgagcttgaacggcagtatcagttccaatctccattacacccaagtcagccttgccgcaggagcaagcggcagtgatagccgtacttacaacggtacgatgtcaggtggtattgccgtacatgatcagggagtgaccttttcaccgtggactatcaatgacactttcgccatcgcaaaaatggataacaatattgcaggtgtcagaattacatctcaggcaggcccagtatggacagattttcggggtaatgccgtcattccatcaatccagccgtggcgaacatcaggagttgagatcgataccgccagcttgccaaaaaatgtcgatatcggtaacggcacaaaaatgatcaaacaaggccgtggtgcagtagggaaagtcggattcagtgcgataacacaacgccgtgcattactcaatatcacactttccgacggcaaaaaactgcccagaggcgttgcgattgaagatagtgaaggcaactatctgacaacatcagtggatgacggtgttgtattcctcaataacatcaaaccggacatggtgctagatataaaagatgagcagcaatcatgccgtattcaccttacattcccagaagatgcaccaaaagatgtgttctatgagacagcaacaggagagtgccaataa

SEQ ID NO: 3397 - protein, 793 aa, Escherichia coli
MLKKTLLAYTIGFAFSPPANADGIEIAAVDFDRETLKSLGVDPNISHYFSRSARFLPGEYSLIVSVNGEKKGNIATRFDENGDICLDQAFLQQAGLKIPSEEKNGCYDYILSYPGTTITPLPNQEALDIIVSPQAIIPIGLDLTNAATGGTAALLNYSLMSSRAEFSNGSSDYSQAALEGGININDWMLRSHQFLTQTNGTFSNQNSSTYLQRTFTDLKTLMRAGEVNLNNSVLEGASIYGIEIAPDNALQTSGSGVQVTGIANTSQARVEIRQQGVLIHSILVPAGAFTIPDVPVRNGNSDLNVTVVETDGSSHNYIVPSTLFNQHVESFQGYRFAIGRVDDDYDESPWVISASSGWNLTRWSAMNGGVIVAENYQAASIRSSLVPLPDLTVSSQISTSQDTKDSLQGQKYRLDANYNLPFSLGLTTSLTRSDRHYRELSEAIDDDYTDPTKSTYALGLNWSNSILGGFNISGYKTYSYDGDNDSSNLNINWNKAFKHATVSVNWQHQLSASENNEDDGDLFYVNISIPFGRSNTATLYTRHDDHKTHYGTGVMGVVSDEMSYYVNAERDHDERETSLNGSISSNLHYTQVSLAAGASGSDSRTYNGTMSGGIAVHDQGVTFSPWTINDTFAIAKMDNNIAGVRITSQAGPVWTDFRGNAVIPSIQPWRTSGVEIDTASLPKNVDIGNGTKMIKQGRGAVGKVGFSAITQRRALLNITLSDGKKLPRGVAIEDSEGNYLTTSVDDGVVFLNNIKPDMVLDIKDEQQSCRIHLTFPEDAPKDVFYETATGECQ

SEQ ID NO: 3398 - DNA, 2601 bp, Escherichia coli; 0157:H7
  CDS (1)..(2601)
ttgtaccagtttactcatcaaaaaagccgtatcccgaaaaaaacgctacttgcggcctgttgtgccctgttttatagcagcaacggtgctgcggcggacaccgtggaatatgacagttcctttttaatgggaactggcgcatcaacgattgatgttaaacgttatgctcaaggcaacccgacaccgccgggtctctataatgtccgcgtatttgtaaacggtcaggcgacttccagcttagaaattccgtttgtggatattggcgaaaacagtgcggcggcctgtcttacccataaaaacctggcgcaacttcacattaagcaacctgaacagcctgtcactttactcgccagagaaggtgaagaagaggattgtctggatctggcaaagtcatacgaaaaggcggatgtgtgctttgacggtagtgaccagtttctcgatctgacgatccctcaggcctatgttctgaaaagctatggcggctacgttgacccttctttatgggaatcgggaattaacgctgccacactggcatataccctgaacgcgtatcacacaagttcagataacgacaatagtgacagcgtctatggcgcgttcaactcaggtatcaatttaggagcctggcactttcgtgcgcgcggtaactataactggacaacagataacggcagcgatttcgatttccaggatcgttacttacagcgtgacattccggcaatccgttcccagataattatgggtgatgcctataccaccggtgaaacgtttgactctgtcaacgtccgtggtgttcgcctgtacagcgacagccgtatgctgccttcggcgctggccagttacgctccgaccatccgcggtgtagcaaactccaacgccaaagtcaccgtgacgcaaagcggatataaaatttatgaaaccaccgttccgcccggtgaatttgttatagacgacattagcccttccggctttggtagcgaactggtcgtgaccattgaagaagcggatggttccaaacgcacctttacgcaacccttctcgtcggttgtacaaatgcaacgtcctggtgtgggccgttgggatttcagcgcgggtaaagtcattgatgacagtctgcgatccgaacccaatatggggcaagcctcttattactatggtctgaataacctcttcacgggttataccggcattcagttcaccgataataactatcttgccgggctgttaggtgtgggtatcaacaccagcatcggcgcctttgcggtagacgttacccattcccgtgctgaaattccggatgataaaacctaccaggggcaaagttatcgcgtgacctggaacaaacttttccaggataccgggacatcatttaacctcgcggcgtaccgctattccacccaggattacctgggcctgcatgatgcgttagtcctcattgacgacgccaagcatttgtctgccgatgaagacaaaaacaccatgcagacgtactcacgtatgaaaaaccagtttaccgtcagcattaaccagccattgaatatcgcctatgaagattacggttcgctgtttatttccggtagctggacgtattactgggcggcgaacaatagccgcactgaatataatgttggttacagtaaaagcgtttcgtggggcagtttcagcgtcaacctacaacgtagctggaatgaagacggcgagaaagatgacgcgatgtacgtcagcgttagcgtacctattgagaatattttaggtggcaaacgtaagtcttctggtttccgcaatttaaatactcagctcaataccgatttcgatggttcacatcagttgaatgttaacagttccggtaacactgaaaacaatctggtgaactacagtgtcaacgcaggttatagcctcgataaaaacgccggcgatttagcctctgttggtggttatctcaactatgaatctgggttaggcggtatttccgcttcggcctcggccacttctgataacagccaacagtactccatctcaaccgatggcggctttgtattacacagtggtggtttaacgttcactaacaacagtttcagcagtaacgacacgctggtgttaatcaacgccctaggtgctaaaggcgcacgaatcaataacagtaataacgaaatcgatcgctggggatatgccgtgacgtcctctgtcagcccatatcgtgaaaaccgggtaggtctgaacattgaaacactggaaaacgatgttgaactgaaaagtaccagcgccaccaccgtaccacgtagcggctccgttgttttgacccgtttcgaaactgacgaggggcgttctgccgtgctgaatattactgccgccaatggcaaatccattccgtttgctgcggaggtttaccagggtgaggtgatgatcggcagcatgggccagggtggtcaggcatttgtacgcggtattaacgacagcggggaattaatcgtgcgctggtatgaaaacaaccaaaccattgactgtaagttgcactaccagttcccggcgcagccacaaacgcagggaagcaccaacaccttattacttaacaatcttacctgtcaggtagcaaatcactaa

SEQ ID NO: 3399 - protein, 866 aa, Escherichia coli; 0157:H7
LYQFTHQKSRIPKKTLLAACCALFYSSNGAAADTVEYDSSFLMGTGASTIDVKRYAQGNPTPPGLYNVRVFVNGQATSSLEIPFVDIGENSAAACLTHKNLAQLHIKQPEQPVTLLAREGEEEDCLDLAKSYEKADVCFDGSDQFLDLTIPQAYVLKSYGGYVDPSLWESGINAATLAYTLNAYHTSSDNDNSDSVYGAFNSGINLGAWHFRARGNYNWTTDNGSDFDFQDRYLQRDIPAIRSQIIMGDAYTTGETFDSVNVRGVRLYSDSRMLPSALASYAPTIRGVANSNAKVTVTQSGYKIYETTVPPGEFVIDDISPSGFGSELVVTIEEADGSKRTFTQPFSSVVQMQRPGVGRWDFSAGKVIDDSLRSEPNMGQASYYYGLNNLFTGYTGIQFTDNNYLAGLLGVGINTSIGAFAVDVTHSRAEIPDDKTYQGQSYRVTWNKLFQDTGTSFNLAAYRYSTQDYLGLHDALVLIDDAKHLSADEDKNTMQTYSRMKNQFTVSINQPLNIAYEDYGSLFISGSWTYYWAANNSRTEYNVGYSKSVSWGSFSVNLQRSWNEDGEKDDAMYVSVSVPIENILGGKRKSSGFRNLNTQLNTDFDGSHQLNVNSSGNTENNLVNYSVNAGYSLDKNAGDLASVGGYLNYESGLGGISASASATSDNSQQYSISTDGGFVLHSGGLTFTNNSFSSNDTLVLINALGAKGARINNSNNEIDRWGYAVTSSVSPYRENRVGLNIETLENDVELKSTSATTVPRSGSVVLTRFETDEGRSAVLNITAANGKSIPFAAEVYQGEVMIGSMGQGGQAFVRGINDSGELIVRWYENNQTIDCKLHYQFPAQPQTQGSTNTLLLNNLTCQVANH

SEQ ID NO: 3400 - DNA, 2517 bp, Escherichia coli
  CDS (1)..(2517): transl_table=11
atgccacaacgacaccaccagggacataaacgcacaccgaaacagttggcgctcattatcaaacgctgtttgccgatggtgctcactggcagcggcatgctttgcactaccgctaacgccgaagagtattatttcgaccccattatgctggaaaccacaaaaagtggtatgcaaacaaccgatctgtcacgtttttcaaaaaaatacgcacaactaccaggaacttatcaggttgatatctggctgaataaaaagaaggtttcacagaaaaaaattacatttaccgccaatgcagagcaacttctgcagccacagtttacggtagaacaactacgtgagctgggtattaaggtggatgaaatcccggcgctggctgaaaaagatgacgatagcgtgatcaactcgcttgaacaaatcattcccggtacagctgctgaatttgatttcaatcatcagcgacttaatttgagcattccccaaattgcactgtaccgtgatgcaagaggttacgtctccccttctcgttgggacgatggtataccaacgctgtttaccaactactcgtttacaggttctgataaccgttaccgccagggcaatcgtagccaacgacagtacctaaatatgcaaaatggtgccaattttggcccctggcgattacgtaactattctacgtggacacgcaacgatcaggcgtcaagctggaacactatcagtagttatttacaacgtgatatcaaggcgttgaagtctcagttgcttctgggagaaagcgccaccagcggcagtattttttccagctacaactttactggcgtgcaactcgcttccgacgataatatgttgccaaacagccagcgcggatttgccccaacggtacgcggtatcgcaaacagtagtgcaatcgtgactatcaggcaaaatggttatgtgatctatcaaagcaacgtgccagcgggtgcctttgaaattaacgatctctacccctcttccaacagcggcgatttagaagtcacgattgaagaaagtgacggtacgcaacgtcgctttatccagccttattcttcattacccatgatgcagcgacctgggcatctaaaatatagcgcgaccgctggacgctatcgcgctgatgcaaacagtgatagcaaggaacccgaatttgctgaagccacggcaatatatggtttgaataatacttttacgctgtatggcggcctgctcggttctgaagattattatgcgctggggatcggtatcggcggcacacttggcgcactgggcgcgttgtcgatggatatcaacagagctgacacccaattcgataaccagcactcttttcatggctatcaatggcgtacgcagtacatcaaagatatcccggaaaccaacaccaatatcgctgtcagctactatcgctataccaacgatggctattttagttttgatgaagccaatacccgcaattgggactataacagtcgccaaaaaagtgaaattcaattcaacatcagccagacaatatttgatggggtaagtctgtatgcctccggttcacagcaagactattggggcaataacgagaaaaacaggaatatctctgttggggtttccggccagcaatggggaattggttacagcctgaattatcaatacagccgctacactgatcaaaataatgaccgcgcactctctttgaatctcagtattccgttagaacgctggttaccgcgtagccgggtttcctatcagatgaccagccagaaagatcgcccaacccaacatgaaatgcgtcttgatggctcactgctggatgatggtcgcctgagctatagtctggaacaaagtctggatgacgataacaaccataacagtagcgtgaacgccagttaccgttcaccttatggaaccttcagtgccggatacagttacggtaatgacagtagccaatacaattacggcgttaccggcggcgtggttatccatcctcatggtgtgacgctctcgcaatatctgggcaacgcttttgcgcttattgatgctaacggggcatctggcgtgaggatacaaaactatccggggattgctactgatccctttggctatgcagtggttccttatctcacaacttatcaggaaaaccgtctctcggtagatactacgcagctgcccgataacgtcgatcttgaacaaacaacacagtttgtggtgcccaacagaggtgcaatggtagcggcgcgtttcaacgccaatatcggttatcgcgtacttgttacagtcagcgatcgcaacggtaaaccgttgccctttggcgctcttgccagcaacgatgatacggggcaacaaagtatcgtcgatgagggcggcatactatatctctctgggatatcgagtaaatcacaaagctggactgtacgctggggaaatcaggcagatcaacaatgtcagtttgcttttagtacaccggattcagaaccaacaacctctgtattacaaggcacagcgcagtgccattaa

SEQ ID NO: 3401 - protein, 838 aa, Escherichia coli
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQRLNLSIPQIALYRDARGYVSPSRWDDGIPTLFTNYSFTGSDNRYRQGNRSQRQYLNMQNGANFGPWRLRNYSTWTRNDQASSWNTISSYLQRDIKALKSQLLLGESATSGSIFSSYNFTGVQLASDDNMLPNSQRGFAPTVRGIANSSAIVTIRQNGYVIYQSNVPAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFDEANTRNWDYNSRQKSEIQFNISQTIFDGVSLYASGSQQDYWGNNEKNRNISVGVSGQQWGIGYSLNYQYSRYTDQNNDRALSLNLSIPLERWLPRSRVSYQMTSQKDRPTQHEMRLDGSLLDDGRLSYSLEQSLDDDNNHNSSVNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 3402 - DNA, 2520 bp, Pseudomonas aeruginosa PAO1
  CDS (1)..(2520): transl_table=11
gtggccatatttaggaaaaagttcgacttcgaggtgtccgtctattccaggtcttcctgtctcgtggccttgggattggctttgcctgccgtaaccttcgcggtggaattcaacgccgagttcctgaacaacgagggcggggcgcccgttgaactgaagtatttcgagaacggcaactcggtgtcgcccggcacttacagcgtcgacattcatttgaaccagatcatgatccggcgcgaagatgtcgtgttcagtgccgattccgaaaccggaagcgtccgcccggtcatccgggtggggctgctcaaggagattggggtcgatattgcccggctgactcgggacaagctcattccggccaacctggaaaacaatacgcccctgaatgtcgccgaactcatccctggtgcatccgtcgagttcgacgtcaacagtctttccctgttggtcagcattccacagctgtatgtacagcggcactcgcgtggctatgtggatccctctctttgggatgacggtgtcaccgcgttgttttccaactaccaggccaacttcacgcgcaacaccaattttggccagaacagcgattaccgctacctgggcctgcgcaatggcttcaacctatttggctggcgcctgcgcaacgactcctccctgagcgggggtaccggcatgcgcaacaagttcagtagcaaccgtacctatgtggaacgtgacattcgtgccctgaaggggaccttgtccctcggtgagttgtatacctccgctcagggggatgctttcgagagcgtgcgtatgcgcggcgtgcaactgcaatccgatatcggcatgctgcccgacaacgagatcagctataccccggtggtgcgcggtatcgctgaaaccaatgcgacggtcgaggtgagccagaatggcttcgtgatctattccaccaacgtaccgcccggtgcgttcgagatcaccgacatctatcccagcggctccaatggcgacctagaggtcaagatcatcgaggcggacggacgccagcggtccttcaagcagtcctattcctacctgccggtcatgacccgcaaggggaacctgcgctatggcctggccgccggtgaataccataatgacggccagccgtcggtcaacctgctccagggatcggctgtgtatggcttgtccgacagggttaccggctttggcggcctgctggctgccgagaagtacaatgccaccaacctgggcctcggcttcaacacgcccctgggcggtctttctgcggacgtgacccatagccagtcccgcacgcgacggggtgggcgcaaccaggggcagagtctgcggcttctctattccaagaccatcaacgccaccgaaaccagctttaccgtggtgggctatcgctattccacggaaggctaccgtactctcagccagcatatcgacgacatgtccgacgagagctacctctatggctcaagttccagtcggcagaagagccgcatagacctgacggtgaaccagacgctgttccgacgcagttcgctctatctcacggcgggcgaaaccacatattggaatcgccccggcagcagccgtcgcgtgcagttcggcttcagcagcggcatcaagcgcgcgagctacagcctggcggtttcccgtacccaggagacggggtcgttcgggcgctccgatacccagttcacggcctccgtcagcatccccttgggcggtagcgcacgctccagtcaggtatatgccaatgccgtgagttcacagcatggtgattcgagtctgaacaccggtatctccggatacctggatgaagccaatgcgttcaactacagcgcacaggccaactacagcaaggacggcggcaactccggcagcgtcggcctgggttgggacacgtccaaggccaagttgtccgccaattacagccaggggcgcgacaacaagcagatcaacctgggagcaagcggttcggtagtggtgcatccggggggagtgaccttcggccagccggtgggggaaacgttcggcctggtggaggttccggaggtcggcggcgtcggcctcgacggctactcttcggttcgcaccgacggccgtggctatgccgtgctcccctacatgcaaccctatcgttacaactgggtgaacctggataccaatacccttggaagcgataccgagatcagcgacagcacgcaaatggccgtgccgacccggggcgccgtgatcgccaagcgtttctccgcggagtccggtcggcgggtgcagttcgacctgagcatggactctggaggaaagattcccttcggtgcacaggcatacgacaaggaagagcgggtcgtgggaatggtcgacaacctgtcccgtttgctggtgttcggtattgaggaccaggggcgcctgtccattcgctggagcgatggctcctgttccgtcgactatcagttgccgcccaggaacaaggacctgacttacgaacgagttgcgctcagttgccgtcggtcctcgatctga

SEQ ID NO: 3403 - protein, 839 aa, Pseudomonas aeruginosa PAO1
MAIFRKKFDFEVSVYSRSSCLVALGLALPAVTFAVEFNAEFLNNEGGAPVELKYFENGNSVSPGTYSVDIHLNQIMIRREDVVFSADSETGSVRPVIRVGLLKEIGVDIARLTRDKLIPANLENNTPLNVAELIPGASVEFDVNSLSLLVSIPQLYVQRHSRGYVDPSLWDDGVTALFSNYQANFTRNTNFGQNSDYRYLGLRNGFNLFGWRLRNDSSLSGGTGMRNKFSSNRTYVERDIRALKGTLSLGELYTSAQGDAFESVRMRGVQLQSDIGMLPDNEISYTPVVRGIAETNATVEVSQNGFVIYSTNVPPGAFEITDIYPSGSNGDLEVKIIEADGRQRSFKQSYSYLPVMTRKGNLRYGLAAGEYHNDGQPSVNLLQGSAVYGLSDRVTGFGGLLAAEKYNATNLGLGFNTPLGGLSADVTHSQSRTRRGGRNQGQSLRLLYSKTINATETSFTVVGYRYSTEGYRTLSQHIDDMSDESYLYGSSSSRQKSRIDLTVNQTLFRRSSLYLTAGETTYWNRPGSSRRVQFGFSSGIKRASYSLAVSRTQETGSFGRSDTQFTASVSIPLGGSARSSQVYANAVSSQHGDSSLNTGISGYLDEANAFNYSAQANYSKDGGNSGSVGLGWDTSKAKLSANYSQGRDNKQINLGASGSVVVHPGGVTFGQPVGETFGLVEVPEVGGVGLDGYSSVRTDGRGYAVLPYMQPYRYNWVNLDTNTLGSDTEISDSTQMAVPTRGAVIAKRFSAESGRRVQFDLSMDSGGKIPFGAQAYDKEERVVGMVDNLSRLLVFGIEDQGRLSIRWSDGSCSVDYQLPPRNKDLTYERVALSCRRSSI

SEQ ID NO: 3404 - DNA, 2499 bp, Escherichia coli O157:H7 EDL933
  CDS (1)..(2499): transl_table=11
  misc_feature (726)..(726): r is g or a
gtggaatatgacagttcctttttaatgggaactggcgcatcaacgattgatgttaaacgttatgctcaaggcaacccgacaccgccgggtctctataatgtccgcgtatttgtaaacggtcaggcgacttccagcttagaaattccgtttgtggatattggcgaaaacagtgcggcggcctgtcttacccataaaaacctggcgcaacttcacattaagcaacctgaacagcctgtcactttactcgccagagaaggtgaagaagaggattgtctggatctggcaaagtcatacgaaaaggcggatgtgtgctttgacggtagtgaccagtttctcgatctgacgatccctcaggcctatgttctgaaaagctatggcggctacgttgacccttctttatgggaatcgggaattaacgctgccacactggcatataccctgaacgcgtatcacacaagttcagataacgacaatagtgacagcgtctatggcgcgttcaactcaggtatcaatttaggagcctggcactttcgtgcgcgcggtaactataactggacaacagataacggcagcgatttcgatttccaggatcgttacttacagcgtgacattccggcaatccgttcccagataattatgggtgatgcctataccaccggtgaaacgtttgactctgtcaacgtccgtggtgttcgcctgtacagcgacagccgtatgctgccttcrgcgctggccagttacgctccgaccatccgcggtgtagcaaactccaacgccaaagtcaccgtgacgcaaagcggatataaaatttatgaaaccaccgttccgcccggtgaatttgttatagacgacattagcccttccggctttggtagcgaactggtcgtgaccattgaagaagcggatggttccaaacgcacctttacgcaccccttctcgtcggttgtacaaatgcaacgtcctggtgtgggccgttgggatttcagcgcgggtaaagtcattgatgacagtctgcgatccgaacccaatatggggcaagcctcttattactatggtctgaataacctcttcacgggttataccggcattcagttcaccgataataactatcttgccgggctgttaggtgtgggtatcaacaccagcatcggcgcctttgcggtagacgttacccattcccgtgctgaaattccggatgataaaacctaccaggggcaaagttatcgcgtgacctggaacaaacttttccaggataccgggacatcatttaacctcgcggcgtaccgctattccacccaggattacctgggcctgcatgatgcgttagtcctcattgacgacgccaagcatttgtctgccgatgaagacaaaaacaccatgcagacgtactcacgtatgaaaaaccagtttaccgtcagcattaaccagccattgaatatcgcctatgaagattacggttcgctgtttatttccggtagctggacgtattactgggcggcgaacaatagccgcactgaatataatgttggttacagtaaaagcgtttcgtggggcagtttcagcgtcaacctacaacgtagctggaatgaagacggcgagaaagatgacgcgatgtacgtcagcgttagcgtacctattgagaatattttaggtggcaaacgtaagtcttctggtttccgcaatttaaatactcagctcaataccgatttcgatggttcacatcagttgaatgttaacagttccggtaacactgaaaacaatctggtgaactacagtgtcaacgcaggttatagcctcgataaaaacgccggcgatttagcctctgttggtggttatctcaactatgaatctgggttaggcggtatttccgcttcggcctcggccacttctgataacagccaacagtactccatctcaaccgatggcggctttgtattacacagtggtggtttaacgttcactaacaacagtttcagcagtaacgacacgctggtgttaatcaacgccctaggtgctaaaggcgcacgaatcaataacagtaataacgaaatcgatcgctggggatatgccgtgacgtcctctgtcagcccatatcgtgaaaaccgggtaggtctgaacattgaaacactggaaaacgatgttgaactgaaaagtaccagcgccaccaccgtaccacgtagcggctccgttgttttgacccgtttcgaaactgacgaggggcgttctgccgtgctgaatattactgccgccaatggcaaatccattccgtttgctgcggaggtttaccagggtgaggtgatgatcggcagcatgggccagggtggtcaggcatttgtacgcggtattaacgacagcggggaattaatcgtgcgctggtatgaaaacaaccaaaccattgactgtaagttgcactaccagttcccggcgcagccacaaacgcagggaagcaccaacaccttattacttaacaatcttacctgtcaggtagcaaatcactaa

SEQ ID NO: 3405 - protein, 832 aa, Escherichia coli O157:H7 EDL933
MEYDSSFLMGTGASTIDVKRYAQGNPTPPGLYNVRVFVNGQATSSLEIPFVDIGENSAAACLTHKNLAQLHIKQPEQPVTLLAREGEEEDCLDLAKSYEKADVCFDGSDQFLDLTIPQAYVLKSYGGYVDPSLWESGINAATLAYTLNAYHTSSDNDNSDSVYGAFNSGINLGAWHFRARGNYNWTTDNGSDFDFQDRYLQRDIPAIRSQIIMGDAYTTGETFDSVNVRGVRLYSDSRMLPSALASYAPTIRGVANSNAKVTVTQSGYKIYETTVPPGEFVIDDISPSGFGSELVVTIEEADGSKRTFTHPFSSVVQMQRPGVGRWDFSAGKVIDDSLRSEPNMGQASYYYGLNNLFTGYTGIQFTDNNYLAGLLGVGINTSIGAFAVDVTHSRAEIPDDKTYQGQSYRVTWNKLFQDTGTSFNLAAYRYSTQDYLGLHDALVLIDDAKHLSADEDKNTMQTYSRMKNQFTVSINQPLNIAYEDYGSLFISGSWTYYWAANNSRTEYNVGYSKSVSWGSFSVNLQRSWNEDGEKDDAMYVSVSVPIENILGGKRKSSGFRNLNTQLNTDFDGSHQLNVNSSGNTENNLVNYSVNAGYSLDKNAGDLASVGGYLNYESGLGGISASASATSDNSQQYSISTDGGFVLHSGGLTFTNNSFSSNDTLVLINALGAKGARINNSNNEIDRWGYAVTSSVSPYRENRVGLNIETLENDVELKSTSATTVPRSGSVVLTRFETDEGRSAVLNITAANGKSIPFAAEVYQGEVMIGSMGQGGQAFVRGINDSGELIVRWYENNQTIDCKLHYQFPAQPQTQGSTNTLLLNNLTCQVANH

SEQ ID NO: 3406 - DNA, 2547 bp, Salmonella typhimurium LT2
  CDS (1)..(2547): transl_table=11
atgcgcaaaaggcaacaccgggtattttatttatcgcgctgcgctgtgtgtatcgcgctgggcagcacgttcacacacgttgcatgggcgcgcgactatttcaatccggcatttattgaaaaccatgggcaggcgaatcgcacaagcgtcgatctgtcgacatttgataacgacaaaagccagctgcctggcacctattacgtcactatcaatatcaataaaacagaaatcggcgcacgaaacgttgattttcaactcgcgacgctcagtgacggtcaacaggcattacagggctgtttacggctccaggaactaaaagataacggcgtcaaaaccgacctttttccaacgctggagagtgaaaaaggctgcgtcgatctcagcgttatccccggcgccagccagcggtttgattttcagcaacaggcattatcagtaagcatcccgcaactctacatcgccaacaacgcacgcggctacgtaccgccggaaaagtggcaggaggggattaccgcgctgatgctgaactacagcttcagcggctataaagagtacggttccagtgaggattccgacgatgcggaatcgaagtatctcgctctccagccgggttttaacctcgggccgtggcgttttcgcaactacagtaactggagttcaaataacggcgagaacggtagctggaacagcgtttataactatttacagcgcgacattatcgcgctgaaaagccagttcaccgccggagacagcaatacgccatccgacgtgttcgacagcgtaccttttcgcggcctccagctcacctctgacgatcaaatgcagcccaacagccagcgtggttacgccccgacgattcgcggcatcgcccgctcaaacgcgcaggttatcgtgcggcaaaacggctatatcgcctatcagaccgccgtttcgccgggcgaatttgaaatcaacgatatgtttcccaccggcagcaacggcgactatgacgtgacggtaaaagaagccgacggcagcgaacagcattttatcgtgccctactcttcgctgccgattctgcagcgcaccggacgggcaaaatacagcgtgaccgtgggtaaatatcgcgattataacaaccacgcgctggacgacttcggccaggcgaccctgctgtacggcctgccgtggggcatcaccctgtacggcggcagccagattgccggcgataaataccagtccgtcgccttcggcgtcgggcaaaatatgcagatgctgggggccatttccctggacggcatctggtcgcacgccaaatttgacgatggccgcaaagaaatcgggcaatcctggcacgtccgctacagcaagggcgtcgtcagtacgggcaccacgttttcgctggccggctatcgttacgccagcgaaaactacaattcgctgagcgaggtgatcaacccggacgacgatttttatgataactacggcaagcgccataatcgtttcgaagcttcggtcaaccagcaaattagcaatacgctcggttccttaacgctaagttgggtcaaagaagattactggcacagcgcgcagcagatggaatccctgagcgccagctacaacaatagctggggtccggtgagctatacgctgagctacagctataacaaaaacacctaccagtaccgttcggacaatgacgatgatgacaacgacgacgatcgttataaccagaacgatcggctgttcacgctgtcgctgcacgttccgtttacggtgttcgattccaggctatacgccagctatatgctgaacacgcgtaagcacgatgccacggtgaacagcaccacccttagcggcaccgcgctgcgtgacagaaacctgaactggtcgttacagcaaagccacagcacacaagacggtgattccggcggggtaaacgccagctataaaggcacttatgccaacctcaacgccggttacaatcagtcgccagatagccaacaagtcagctacggcatcagcggcggcattctggcgcacgaaaacggtattaccctgagccagccgattaccggcgcggcgattttaattaaagcgcccggcgccagcggcgtttcggttgaaaaccagaccggcgtcgccaccgacttccggggttatacggtgatccccaacgtcacgccgtattatcgctacgatatctcgctcgacagcagcacgtttgctgacaacgtggatattccgctcaacaaccagaccgtctacccgacgcgtaatgcggtggtgcgcgcggcgtatgacacgcataagggctatcgcgtgttgttaacgctgacgcgcagcaatggcgagcccgtgccctttggcgcgacggcaagcgtcgatgggcaggatgcgaacctggccagtatcgtcggcgataaaggccaggtcttcctcagcggcctgccggaagagggcctgctgctggtgaactggggaagcgcctcttgccgcgcggattaccgcctggatatcagcaaaaatatgaacggcatagtgatggcgaacgccgtctgccagtga

SEQ ID NO: 3407 - protein, 848 aa, Salmonella typhimurium LT2
MRKRQHRVFYLSRCAVCIALGSTFTHVAWARDYFNPAFIENHGQANRTSVDLSTFDNDKSQLPGTYYVTININKTEIGARNVDFQLATLSDGQQALQGCLRLQELKDNGVKTDLFPTLESEKGCVDLSVIPGASQRFDFQQQALSVSIPQLYIANNARGYVPPEKWQEGITALMLNYSFSGYKEYGSSEDSDDAESKYLALQPGFNLGPWRFRNYSNWSSNNGENGSWNSVYNYLQRDIIALKSQFTAGDSNTPSDVFDSVPFRGLQLTSDDQMQPNSQRGYAPTIRGIARSNAQVIVRQNGYIAYQTAVSPGEFEINDMFPTGSNGDYDVTVKEADGSEQHFIVPYSSLPILQRTGRAKYSVTVGKYRDYNNHALDDFGQATLLYGLPWGITLYGGSQIAGDKYQSVAFGVGQNMQMLGAISLDGIWSHAKFDDGRKEIGQSWHVRYSKGVVSTGTTFSLAGYRYASENYNSLSEVINPDDDFYDNYGKRHNRFEASVNQQISNTLGSLTLSWVKEDYWHSAQQMESLSASYNNSWGPVSYTLSYSYNKNTYQYRSDNDDDDNDDDRYNQNDRLFTLSLHVPFTVFDSRLYASYMLNTRKHDATVNSTTLSGTALRDRNLNWSLQQSHSTQDGDSGGVNASYKGTYANLNAGYNQSPDSQQVSYGISGGILAHENGITLSQPITGAAILIKAPGASGVSVENQTGVATDFRGYTVIPNVTPYYRYDISLDSSTFADNVDIPLNNQTVYPTRNAVVRAAYDTHKGYRVLLTLTRSNGEPVPFGATASVDGQDANLASIVGDKGQVFLSGLPEEGLLLVNWGSASCRADYRLDISKNMNGIVMANAVCQ

SEQ ID NO: 3408 - DNA, 2409 bp, Salmonella typhimurium LT2
  CDS (1)..(2409): transl_table=11
gtgaagtatttaaaactgccgctatacatcaaaactgcgctttattgctcactggcaaccacgacgttttcagctctggcggaggagctgaattttgacatgggtattctcacctccagaggcattagccccaacgtcgcacaatatttttcccgcgcgccgcgctttctaccaggcagccacaccgtcatggtaaagatcaatggcgtaaatagagggtcgttggtcgcgcgtttcgacacagaaggccagctttgcgtggatgacgatttcctcagcgccagcgggctcgtttcgcttaatatcagcgccaaagaaacctgccatagcctacaagaagattatccctcagcgattattaccccactgccaaacagtgaatcgctggagctttttgttccggcacaggctctggataataacttactatcgctaaacaacgtgattaaaggcggcaccgccgggttatttaactataacctgtacgccagtcgcagcgagtcatccggtagcgatagccgaaactatgcccaggcaaaccttgaagctggcttaaacttcgcggaatggacgctgcgcagccgctacatgctgacgaataatgatggagaataccgtaccgatagtctatatacctatgcggagcacgtatttcaggcacaaaaaatgcgtgcgcaagttgggcagatcaacgtcaactccagtctattcagtggcgcgccgatcaacggcgtacagcttatccctgaacaagggctggcacaggatacacaaggcgtaaccattaacggtattgcccgaacccaccaggctcgcgttgaagttcgtcagtccggacagattatttataccgcaccagtgaacgctggggcatttacccttgaaaatgtccccatcatacgcagcaataccgaccttaacgtcagcgtcgttgaaaccgatggctcaacgacaaccttcacggtgccggcagtatcctttaatttacgcgaactcacgcccgcaggcttaacaatgtccatagggcgcatacgtgataccaccagcgactattcgctcccctggatctataacatcagcgatggttggaaactgagtgaaaactggctggcgcaggcgtctggcgtactggcacaagactatcaagcggcaggagggatgctgcaatggcttccaaccaataaatggacgttttccggctcaatgctgggcagtaaagcgtcctttggcgaatctctgcagggtgcgaaaagtgaactacgcgccagcatggcgctgcccggggaaattagacttgacgtcagtaccgcccgctacagcgacggatatcgtgagttaacggatgcgctcaataaagatgcttacgaatatcaaagtagctccagtgctaatattgcctggaaccataatctgttaggtaccttctctctgggttattacacttatcaggctacggataatgacaacgactctcgcagtataatggcttcctggggcaaaacgtttaaatatgcctcaattaccgctaactggcagcacgctgttaatcaggatgatgagaatcataacgacagtaatgatgatgatatgttttacatcaacatcagcattccactaggtgagcagcgcgtcggcgcttatatgcgtaatcaaggtgataaaacaacctacgggctacaaaataatggttcgctgagtaaagatacccattactatatttctgcggatcgtgatgcaaaaaaccagcaaaatagcttcaacggtaatctcaatagcaatcttcattacactcaactcagcgtgggcggcggcactgatggcgataattaccgcaactataacgcaaccttcagcggaggcatcgctgcacacgaacatggcataacgttctcgccttatacaatcaaaaatacctttgctatcgcacgcctgagtgaaccagaaagcggcattgaaatcgccacgccacaggggcgaatctggactgaccactgggggcaagccgtcattccggggctaactgaatggcggaaatcccgcgtagaggttaatgcgaatacgctaccaaagagtatggaactggcaaacggtattaagaatattaccgtcgcgcacagcgcttttcgggtactggatttcaacgtgctgaatacacgccgtgtgatgctggcagtaaagcgtccggatggctcatggctacctaaaggcaccagcattgtagatgaaaaaaataactatttggtcagcgctgtcgacagcggacgcgtatttatcaccgatgttggggataatcctgcgttatatgccgctgatgatgatatgaatcgtctgtgtcgcatccactacacgctgcagaaaacccaggataaagaggcattttatgaaacggcaaagggagtctgtcaatga

SEQ ID NO: 3409 - protein, 802 aa, Salmonella typhimurium LT2
MKYLKLPLYIKTALYCSLATTTFSALAEELNFDMGILTSRGISPNVAQYFSRAPRFLPGSHTVMVKINGVNRGSLVARFDTEGQLCVDDDFLSASGLVSLNISAKETCHSLQEDYPSAIITPLPNSESLELFVPAQALDNNLLSLNNVIKGGTAGLFNYNLYASRSESSGSDSRNYAQANLEAGLNFAEWTLRSRYMLTNNDGEYRTDSLYTYAEHVFQAQKMRAQVGQINVNSSLFSGAPINGVQLIPEQGLAQDTQGVTINGIARTHQARVEVRQSGQIIYTAPVNAGAFTLENVPIIRSNTDLNVSVVETDGSTTTFTVPAVSFNLRELTPAGLTMSIGRIRDTTSDYSLPWIYNISDGWKLSENWLAQASGVLAQDYQAAGGMLQWLPTNKWTFSGSMLGSKASFGESLQGAKSELRASMALPGEIRLDVSTARYSDGYRELTDALNKDAYEYQSSSSANIAWNHNLLGTFSLGYYTYQATDNDNDSRSIMASWGKTFKYASITANWQHAVNQDDENHNDSNDDDMFYINISIPLGEQRVGAYMRNQGDKTTYGLQNNGSLSKDTHYYISADRDAKNQQNSFNGNLNSNLHYTQLSVGGGTDGDNYRNYNATFSGGIAAHEHGITFSPYTIKNTFAIARLSEPESGIEIATPQGRIWTDHWGQAVIPGLTEWRKSRVEVNANTLPKSMELANGIKNITVAHSAFRVLDFNVLNTRRVMLAVKRPDGSWLPKGTSIVDEKNNYLVSAVDSGRVFITDVGDNPALYAADDDMNRLCRIHYTLQKTQDKEAFYETAKGVCQ

SEQ ID NO: 3410 - DNA, 2379 bp, Yersinia pestis KIM
  CDS (1)..(2379): transl_table=11
gtggtcgcccgttgtattaatctccagtgtatcgcattcttattctctttttttcctacgctggctttccctgtcacagaagagggtgaggtggtttttgacatagaaacgctggagagattaggttattcagctgaattggcaaaattcttcagcggtcaggatagatttctacccggccaacatgatgtcactatcattattaatgccagcaagacctaccgtattgcagcgaccttcgatagcgaagggaaactgtgtatggataaagcattactgatggccttgaaattacgaaatacagagagtgacggcagttgtgagaatatggaagcccggtggccgggtatggttgttaaactctttcccggccagttccgggtggaaataacattgccgcaagaggcgtttgatcccgaaatggaaggaagtgagtatcagcaaggagggcatgcactattgcttaattacaatatctttggccaacgggtcgaaagtaacaatagccgctttaatcttgttcaggggcaatttgaaccggggattaattttaaaaattgggtactgagaaaccgaggttcctacagttataatcaaggagtgagccaatactataatcaggaaacctctgctttacgcgcggttgaatcattgaaatccgtggttcaactgggtgaatttggtttagtgggtaacaccttttctggtttacccgtaaccggcattcagttgtattccgataacgcacaacgggatgatacacaattgatcgtacccatcgaggggattgccaataccaatgccaccattgaaatccgtcagcgtgggcgggttatttatcgtaccatagtggcaccaggtcctttttcgttatccaatatcagtaacttctcaagtggtgttaacaccgatgtcagtattatcgaagaggatggcactcaacagaattttacggtgacgagcgcccttgatattaacgctgaacaacaggcatccatctaccaactggccgtgggccgttaccgggacatgtttaccggtgaggacaggccgtcaccgctgctgctttccggagaaatgtcattcaatccggcggctaccttttatatgacgtcggctgggttactgtcctctggctatcaaaatatccgtgtgcaaaatctttacagtggatgggatcaggcctggttttcagcggcagcaagttatgctaataccaaagatgcaggacagggataccaatttagcgttcagaatcagatgacgattaacggtaattttggtgtttcatggtcctcggtttatggctcggccaattactggttaccggatgatgccctaagcagtagcaataatctgaatgacctgatgtttggaaaattaaaaaatgcaacgtcggtagccgtgagctgggtgcacccacgttggggggcattctcctatgctttatcaaataatatgtattatcaggcttctggtcgtacttaccatattttctcaattagcgaacaatttggccgggcgactaccatcttgagttctcaattaagttcgcaagggcaaaattcgctctatgttggtatcaatatgccattgggtaatgggacgttaagtggccgggtgcaacgtaacaatggcaatgtggcacttggtagtacttatcaagggcgatggggtgacaacaaagattattcggtagggatcagcggtgacaataggcaacggcgtatcaatggttcgatgaatataaggacggcctattcacaattaaccggtggggtttctcaagcgacaaacaatagccggtctgcatatctgtcatcgcgtggttcagtggcttacgtgaataacacctttgccacatcgtcgtcatcggttggcgatacttttgcggtggtgaacatacccaaccaacccggtttgcgcgtttcatcgccgagcagcggtattgcgattacggattatgctgggatagccttgctgccattagtgaggccttacaccgcttcgaaagtacaaataagcacgcaaacattgccgctgaatattcggcttaataacaccagtgccgatttgctgatgactcgaggctcggtagcaacccatcattttgagacaacagaaacccgccaattgctgctaaccatccgtggtagtgatggtgaaatgctgccgattggtgccaatgtattggatgaaaaaggtaactttctggggacgattatcggtgacggaaactttatgctggaaaataaggcgattggcgtgacattacgtgttaaggcaaataaccgcgatgaatgtcgcgttaactaccgtgaacctgaaaaatttgaccccgatgtattgtatgaagttgccgatgcggtctgtcagtaa

SEQ ID NO: 3411 - protein, 792 aa, Yersinia pestis KIM
MVARCINLQCIAFLFSFFPTLAFPVTEEGEVVFDIETLERLGYSAELAKFFSGQDRFLPGQHDVTIIINASKTYRIAATFDSEGKLCMDKALLMALKLRNTESDGSCENMEARWPGMVVKLFPGQFRVEITLPQEAFDPEMEGSEYQQGGHALLLNYNIFGQRVESNNSRFNLVQGQFEPGINFKNWVLRNRGSYSYNQGVSQYYNQETSALRAVESLKSVVQLGEFGLVGNTFSGLPVTGIQLYSDNAQRDDTQLIVPIEGIANTNATIEIRQRGRVIYRTIVAPGPFSLSNISNFSSGVNTDVSIIEEDGTQQNFTVTSALDINAEQQASIYQLAVGRYRDMFTGEDRPSPLLLSGEMSFNPAATFYMTSAGLLSSGYQNIRVQNLYSGWDQAWFSAAASYANTKDAGQGYQFSVQNQMTINGNFGVSWSSVYGSANYWLPDDALSSSNNLNDLMFGKLKNATSVAVSWVHPRWGAFSYALSNNMYYQASGRTYHIFSISEQFGRATTILSSQLSSQGQNSLYVGINMPLGNGTLSGRVQRNNGNVALGSTYQGRWGDNKDYSVGISGDNRQRRINGSMNIRTAYSQLTGGVSQATNNSRSAYLSSRGSVAYVNNTFATSSSSVGDTFAVVNIPNQPGLRVSSPSSGIAITDYAGIALLPLVRPYTASKVQISTQTLPLNIRLNNTSADLLMTRGSVATHHFETTETRQLLLTIRGSDGEMLPIGANVLDEKGNFLGTIIGDGNFMLENKAIGVTLRVKANNRDECRVNYREPEKFDPDVLYEVADAVCQ

SEQ ID NO: 3412 - DNA, 2496 bp, Pseudomonas putida KT2440
  CDS (1)..(2496): transl_table=11
atggtcctccccccactacgctggcgcactatgcgccgccagcgcagcgcattgctgtgcctgctgggtagctccaccttgctctcagcgccctactcccaggcagactccgggttccagagcggcttcctgcgccaagtgcctggccaaccgcaagcagcgagtgcctggtcgctgagcatgttgaccagcgatcaggggctcgcgcctggccgctaccgggtagaggtacaggtcaatcttgaacctgccggccagcatgagctggatttccagccaggcccggacggtgagctgcagccatgcctgccagccaggctgcttggcgaatggggaatgcgcctggacgcactggccaatccagaggatcaggcgagtgcctgcctggacttgctgactgtcgttcctggtgcacaaatcgtcttcacccctacggagctgcacctggccatctcgattccgcagatctccatgcgccggaacaccgctaaccaggtcgacccttcccgctgggacagtggtatcaatgccgctttcatcaactatcaggcctccaccctgaacggccgcaaccgctcctctggccgttacaccagcaacgacctgtacctgaacagtggtatcaacctgggcgaatggcgcctgcgcagtacccagtcctggcgccagggcagccagggcaagactgaatggacccgggcacagacctacgcacagcgcgatataccgggtaccctcgccaatctgacgattggcgaaaccttcacggacagggaggtgttccgttcggtgccgatatcaggcgtgcgcgtggcctcggacatgggcatgctggccgacaaccagcgcggttatgccccgatcattcgcggcgtggcccagagccgggcgaaagtcgagatctggcagcatggttatccgatctactcgacgtacgtcagcgccggcccctacgccatcgacgacctgagtaccgcaggcagcggcgagctggaagtcgtcgtgaccgaggccgatggccaggtccgccgcttcatccagccgtactcgaccatgagcaatctgctgcgcccaggcgtatggcgttacagtgccacggtcgggcgctacaacccctccagcgacctcgagaccccgctgctctggcaaggcacgctggccgtaggctcctactgggacaccacggtttacggcggcttgatggccagcgaattctaccgcgcgggcaacctggggtttagcaaggacctgggccacttgggcgcagtggccttcgatgtaacgcaggcgtccagcgcaatcgacaatgcccatgagcgcgaggtgcagggttccagttacgccctgaagtatgccaaggccttcaccactcaaaccaacctgcgctttgccggatatcgctattcgacccaaggctaccgtgacttcgatgaagtggtgcgccagcgcagccaggacactacgttcagcggcagtcgccgcagccgcctggaggcctcggtccaccagagcctgggcaggaccagctcgctgaccctgacgctgtcgcaacaggactactggcgcagcaatgccacccaacggcaataccagttcaacttcaatacccagcatcggggtgtaggctacaacctgttcgcctcacaatcgttgaccgaccgttacggcaatgatcgtcagtttggcctgagcgtgacggtacccttgcatttcggtcaccgcgccaatgcgaccttcgacctgcagcacaacgccaacggctacagccagcgtgccacgctcagcggcagcgacagcgcgcgcgcgctgagctacagcaccagcctgagccgtgacgaacacgcccgcaagacagcggcactgtcgctcggccatcaggccccctatgccagcgtgagtgctggctataccgaagccgacaactaccgcagcctgtcattgaatgccagtggtgcggtgctgctgcatgctgacgggctggagttcggccgatacctgggagataccgcggccttgatcgaagtccctggcgtggccaatgtgggcctgcaaaacgcaacgggtacgcgcaccaattcacgcggttatgcacttttgccctacctgcaaccgtaccggaccaattcggtggtcctggaaaccgaccgtctcgatcctgatgtggaaatcgacaacggcatcgcccaggtagtgcctcgccagggtgcagtggtcaagcaccgcttcgaggcacgccgcgtttcacgccttgtactgaccctgcacgatacccagggtcaaccgctgccctttggggcccaggtgctggccgagaacggtacccaactgggcatggtcgggcaggcgggcctggtaatgctcaccaaccccagccaggagcaaccgctgcaggtgagttggggcgaacagcccaacgccggctgccaggtgcatctcgatgaactggacgctcccgtcgtcgacggctatcgccagcaaaccctgacctgtatctag

SEQ ID NO: 3413 - protein, 831 aa, Pseudomonas putida KT2440
MVLPPLRWRTMRRQRSALLCLLGSSTLLSAPYSQADSGFQSGFLRQVPGQPQAASAWSLSMLTSDQGLAPGRYRVEVQVNLEPAGQHELDFQPGPDGELQPCLPARLLGEWGMRLDALANPEDQASACLDLLTVVPGAQIVFTPTELHLAISIPQISMRRNTANQVDPSRWDSGINAAFINYQASTLNGRNRSSGRYTSNDLYLNSGINLGEWRLRSTQSWRQGSQGKTEWTRAQTYAQRDIPGTLANLTIGETFTDREVFRSVPISGVRVASDMGMLADNQRGYAPIIRGVAQSRAKVEIWQHGYPIYSTYVSAGPYAIDDLSTAGSGELEVVVTEADGQVRRFIQPYSTMSNLLRPGVWRYSATVGRYNPSSDLETPLLWQGTLAVGSYWDTTVYGGLMASEFYRAGNLGFSKDLGHLGAVAFDVTQASSAIDNAHEREVQGSSYALKYAKAFTTQTNLRFAGYRYSTQGYRDFDEVVRQRSQDTTFSGSRRSRLEASVHQSLGRTSSLTLTLSQQDYWRSNATQRQYQFNFNTQHRGVGYNLFASQSLTDRYGNDRQFGLSVTVPLHFGHRANATFDLQHNANGYSQRATLSGSDSARALSYSTSLSRDEHARKTAALSLGHQAPYASVSAGYTEADNYRSLSLNASGAVLLHADGLEFGRYLGDTAALIEVPGVANVGLQNATGTRTNSRGYALLPYLQPYRTNSVVLETDRLDPDVEIDNGIAQVVPRQGAVVKHRFEARRVSRLVLTLHDTQGQPLPFGAQVLAENGTQLGMVGQAGLVMLTNPSQEQPLQVSWGEQPNAGCQVHLDELDAPVVDGYRQQTLTCI

SEQ ID NO: 3414 - DNA, 2475 bp, Photorhabdus luminescens subsp. laumondii TTO1
  CDS (1)..(2475): transl_table=11
atgataagacaaaaaattagtccgttagctctgataataagtacccttctgtatacagattgtttatgctatgccacaacatttaatactgactttctggttggtgaatcggcaaaagcggatttatcccgattttattccacttcagagctacccgctggtcgttatggtattgacatatatctgaataatgactggaaaggaagatttgatattaatatccagaacgatggcaaagatatttacttacttaatgaagatcttcccaggttaggtataaaaattgataaaaaccaattaccagaatcgaatttatccaaagatgaaattcttcttactaaaataatacatgaaggaaccgctaatctcgatgttcctaaactcagcctgcatctggtcgtcccgcaggcatatatcaaaaacgagctaaaaggctatatcgatcctgcgttctgggacagaggtatccccggcgctatgctgtcctacaatgccaactattaccatactcagaataggaataaacaaaaccgcgaccgtgaagatgaagataatgcttacgtgtcacttaatagcggtttgaatctatttggctggcaattacgtgatcaatcctcttatcactatacgcgttcaaatggtgataaatggagtaacaatacccgttatctgcaacgaggaatttcatcaattaattcagaatttcgcattggtgacagctatacatcaagcgatttattcgactctttccgcttccgaggtatcaatttgaaaaccgatatgcgcatgtaccccgatgcctggcaagggttttcccctatcgttcggggagttgcgcagactaatgctctggtaaaaatcacccaaaataatgttgttatttatcaaggtaatgtaccacccgggccgtttgctattgatactattttacccacaggttcaggtagtgatttgctagttgcagtgacggaagcagacgggcgtactaacagttttaccgttcccttttcatccgttcctaatatgatgaaagaaggtcttggcaaatatgatatcagtgcaggtaaaacacatattgccaacagtcgttataaaccaaacttttttcaagccagctatcaatatggttttaataatgtcctgaccggttatacaggtaccattatcagtaaagattattactcactactgctaggtagtggctttaatctacccattggcgctgtctcaattgacgtttcacagtccagcgccaaatttgataatagcccaaccatgaaagggcaaagctacaaattggcttatagccgttatatcccacaaacaaaaacaaatttctcgctggcggcttatcgttattcaactaaaaattatctcaccctaatcgatgcgattgatctgcatgactggataagcaatggatataaccaacaatattattctcatcaaaaaaatacctttaatatcaatttgaaccagaatcttggtagtcgtgcaggttcactttttctttcgggaacatttcgtaattactggggaacccagaataaaagtagagaatatcaaatggggtattccaatagtctggggaaaatcaattattccctgacagcaagccgtgtccgatacaatatcaatgaaacagaaagtaaagaggaacagcgctattatctgatgctgtctgttccttttgagttgtttggctaccctgcctatttgaccaataatgtctcaatcaatgaaagtcactatgacaacagtaacttaggattaagcggcagcgcaggcccaaacaaccgtttgaattaccacttcaacatttcagatcagaaaagtggttcgacaacaaccagtgcaaatttgacctacaaaacatccgtttccacactgagtagttcttatagccaatccaaggagtaccgccaaatgggacttggcgcaaccggcagtttagttgcttatcgaggcggaattctggcggctaatcaaattggggaaactttcgccatcattgacgcaccgggcacagcaaacgcttctgtgaatggtgataaaagcatggtgacaaacaccagcggtaagttgctgataccttatctttctccttatcgtaaaaatgccatcatgctagataccagtgaagtgccagaaggggccgctgaacttatcggtaacatcagagatgtcgcgccatattccggcgcgattacccatatcggatttaaaacagaccagcggaagacttttatcttctactccgctcaggctgatggtaaacctttacctttcggtactgaaattgtcgattcagaaggtaacagcttaggatacgttggtcagggtagtatggttttcctacgagtagaaaaattaccaccgcaaatttatgtccacatcggtcaactaggtgaaaagagctgcataataaatgatccacagcctgaaatgagctcaaacgccaatatttgccgttaa

SEQ ID NO: 3415 - protein, 824 aa, Photorhabdus luminescens subsp. laumondii TTO1
MIRQKISPLALIISTLLYTDCLCYATTFNTDFLVGESAKADLSRFYSTSELPAGRYGIDIYLNNDWKGRFDINIQNDGKDIYLLNEDLPRLGIKIDKNQLPESNLSKDEILLTKIIHEGTANLDVPKLSLHLVVPQAYIKNELKGYIDPAFWDRGIPGAMLSYNANYYHTQNRNKQNRDREDEDNAYVSLNSGLNLFGWQLRDQSSYHYTRSNGDKWSNNTRYLQRGISSINSEFRIGDSYTSSDLFDSFRFRGINLKTDMRMYPDAWQGFSPIVRGVAQTNALVKITQNNVVIYQGNVPPGPFAIDTILPTGSGSDLLVAVTEADGRTNSFTVPFSSVPNMMKEGLGKYDISAGKTHIANSRYKPNFFQASYQYGFNNVLTGYTGTIISKDYYSLLLGSGFNLPIGAVSIDVSQSSAKFDNSPTMKGQSYKLAYSRYIPQTKTNFSLAAYRYSTKNYLTLIDAIDLHDWISNGYNQQYYSHQKNTFNINLNQNLGSRAGSLFLSGTFRNYWGTQNKSREYQMGYSNSLGKINYSLTASRVRYNINETESKEEQRYYLMLSVPFELFGYPAYLTNNVSINESHYDNSNLGLSGSAGPNNRLNYHFNISDQKSGSTTTSANLTYKTSVSTLSSSYSQSKEYRQMGLGATGSLVAYRGGILAANQIGETFAIIDAPGTANASVNGDKSMVTNTSGKLLIPYLSPYRKNAIMLDTSEVPEGAAELIGNIRDVAPYSGAITHIGFKTDQRKTFIFYSAQADGKPLPFGTEIVDSEGNSLGYVGQGSMVFLRVEKLPPQIYVHIGQLGEKSCIINDPQPEMSSNANICR

SEQ ID NO: 3416 - DNA, 2379 bp, Yersinia pestis biovar Microtus str. 91001
  CDS (1)..(2379): transl_table=11
gtggtcgcccgttgtattaatctccagtgtatcgcattcttattctctttttttcctacgctggctttccctgtcacagaagagggtgaggtggtttttgacatagaaacgctggagagattaggttattcagctgaattggcaaaattcttcagcggtcaggatagatttctacccggccaacatgatgtcactatcattattaatgccagcaagacctaccgtattgcagcgaccttcgatagcgaagggaaactgtgtatggataaagcattactgatggccttgaaattacgaaatacagagagtgacggcagttgtgagaatatggaagcccggtggccgggtatggttgttaaactctttcccggccagttccgggtggaaataacattgccgcaagaggcgtttgatcccgaaatggaaggaagtgagtatcagcaaggagggcatgcactattgcttaattacaatatctttggccaacgggtcgaaagtaacaatagccgctttaatcttgttcaggggcaatttgaaccggggattaattttaaaaattgggtactgataaaccgaggttcctacagttataatcaaggagtgagccaatactataatcaggaaacctctgctttacgcgcggttgaatcattgaaatccgtggttcaactgggtgaatttggtttagtgggtaacaccttttctggtttacccgtaaccggcattcagttgtattccgataacgcacaacgggatgatacacaattgatcgtacccatcgaggggattgccaataccaatgccaccattgaaatccgtcagcgtgggcgggttatttatcgtaccatagtggcaccaggtcctttttcgttatccaatatcagtaacttctcaagtggtgttaacaccgatgtcagtattatcgaagaggatggcactcaacagaattttacggtgacgagcgcccttgatattaacgctgaacaacaggcatccatctaccaactggccgtgggccgttaccgggacatgtttaccggtgaggacaggccgtcaccgctgctgctttccggagaaatgtcattcaatccggcggctaccttttatatgacgtcggctgggttactgtcctctggctatcaaaatatccgtgtgcaaaatctttacagtggatgggatcaggcctggttttcagcggcagcaagttatgctaataccaaagatgcaggacagggataccaatttagcgttcagaatcagatgacgattaacggtaattttggtgtttcatggtcctcggtttatggctcggccaattactggttaccggatgatgccctaagcagtagcaataatctgaatgacctgatgtttggaaaattaaaaaatgcaacgtcggtagccgtgagctgggtgcacccacgttggggggcattctcctatgctttatcaaataatatgtattatcaggcttctggtcgtacttaccatattttctcaattagcgaacaatttggccgggcgactaccatcttgagttctcaattaagttcgcaagggcaaaattcgctctatgttggtatcaatatgccattgggtaatgggacgttaagtggccgggtgcaacgtaacaatggcaatgtggcacttggtagtacttatcaagggcgatggggtgacaacaaagattattcggtagggatcagcggtgacaataggcaacggcgtatcaatggttcgatgaatataaggacggcctattcacaattaaccggtggggtttctcaagcgacaaacaatagccggtctgcatatctgtcatcgcgtggttcagtggcttacgtgaataacacctttgccacatcgtcgtcatcggttggcgatacttttgcggtggtgaacatacccaaccaacccggtttgcgcgtttcatcgccgagcagcggtattgcgattacggattatgctgggatagccttgctgccattagtgaggccttacaccgcttcgaaagtacaaataagcacgcaaacattgccgctgaatattcggcttaataacaccagtgccgatttgctgatgactcgaggctcggtagcaacccatcattttgagacaacagaaacccgccaattgctgctaaccatccgtggtagtgatggtgaaatgctgccgattggtgccaatgtattggatgaaaaaggtaactttctggggacgattatcggtgacggaaactttatgctggaaaataaggcgattggcgtgacattacgtgttaaggcaaataaccgcgatgaatgtcgcgttaactaccgtgaacctgaaaaatttgaccccgatgtattgtatgaagttgccgatgcggtctgtcagtaa

SEQ ID NO: 3417 - protein, 792 aa, Yersinia pestis biovar Microtus str. 91001
MVARCINLQCIAFLFSFFPTLAFPVTEEGEVVFDIETLERLGYSAELAKFFSGQDRFLPGQHDVTIIINASKTYRIAATFDSEGKLCMDKALLMALKLRNTESDGSCENMEARWPGMVVKLFPGQFRVEITLPQEAFDPEMEGSEYQQGGHALLLNYNIFGQRVESNNSRFNLVQGQFEPGINFKNWVLINRGSYSYNQGVSQYYNQETSALRAVESLKSVVQLGEFGLVGNTFSGLPVTGIQLYSDNAQRDDTQLIVPIEGIANTNATIEIRQRGRVIYRTIVAPGPFSLSNISNFSSGVNTDVSIIEEDGTQQNFTVTSALDINAEQQASIYQLAVGRYRDMFTGEDRPSPLLLSGEMSFNPAATFYMTSAGLLSSGYQNIRVQNLYSGWDQAWFSAAASYANTKDAGQGYQFSVQNQMTINGNFGVSWSSVYGSANYWLPDDALSSSNNLNDLMFGKLKNATSVAVSWVHPRWGAFSYALSNNMYYQASGRTYHIFSISEQFGRATTILSSQLSSQGQNSLYVGINMPLGNGTLSGRVQRNNGNVALGSTYQGRWGDNKDYSVGISGDNRQRRINGSMNIRTAYSQLTGGVSQATNNSRSAYLSSRGSVAYVNNTFATSSSSVGDTFAVVNIPNQPGLRVSSPSSGIAITDYAGIALLPLVRPYTASKVQISTQTLPLNIRLNNTSADLLMTRGSVATHHFETTETRQLLLTIRGSDGEMLPIGANVLDEKGNFLGTIIGDGNFMLENKAIGVTLRVKANNRDECRVNYREPEKFDPDVLYEVADAVCQ

SEQ ID NO: 3418 - DNA, 2493 bp, Erwinia carotovora subsp. atroseptica SCRI1043
  CDS (1)..(2493): transl_table=11
atgaagaacattacactcaaagaaaaaatacaacccgcattatttcactatggtatttttattttttctttgagtacaacatcgctcagtgcaacggaatttaacattaatgtactggatgtcgatgaacgtagtgacattgatcttagccatttttccgaccccgaatacgtcacgcctggcacctatcttttatcgataaaagtaaacgcacgtgaaatacagcagcagatgattagctacctgccggaaggtaatcatcgccctcgaccaacggcctgcctctcgactgaactcgtcgataaactggcactgaaaaaagaagcacgcgaccaagttgaattatggaataacggcacgtgtgtcgatctgacgccaattgctggcgtcaaaatatcgaatcaaataggcatgggaacgctaaatattaccattcctcaagcctggctggtgtacagcgatcgcaactggattccgcccgaacaatgggatcacggcatcaacggcgcgctgctagattataacctcgtcgggaacgtacgccgtgataccaatggcagaggcacatcacactatctcagtagctacggcacgaccggatttaatcagggagcctggcgctaccgtgccgattaccgctattttctgcaaaaatcgcgcaactcgaatcgcgatagcttctcgtgggatcagttttacgcttatcgtccgcttcccaccctgtcagccgatctcaagctgggtgaaatgtatttcagcagtaatctgtttgatagctatcgctttaccggcgcgtcattagccaacaacgagaacatgcttcccccttcgttgcgtggctacgcgcccgaagttcgcggcgtcgccaaatcaaacgcaacagtgaccgttacgcaaaatggcaggctgatctatgaaaccaccgttcctgctggcccttttgcgattcaggatatgaaaaacggcgtcagcgggacgttggatgtccgtgtgacggaagaagacggtacggtaacgacgttccagaccgagtcggccaacctgccttacctaacgcgccccggacacgtgcagtacaaactcgccgcaggtaaaccctcgaacaccaaccatcgtctacaaggcccagccttttctgctgccgaagcctcatggggattatccaacgcgtggtcggtgtacggcggcagcattttgtccaatggctaccagtcttggtcggcaggtatagggaaaaacctctacctgctgggcgcactgtccgcagatatcacacagtcgcgcgcgacgcttccgacaacgtcctcgtcgcaaatggggcatgcgttttcgcttaactggtctaaatatttcaattcgatcgatagccagatcagttttgccggctatcgcttttcagagaagacctacatgagcatggcgcagtatctctatgcgctgaatcttgataaccgctatcgcaatgaaaaagagcgctacaccattacgctctcaaaaaacttcgcgacgcaagaatcatcctcgctgctgaacgggctatcgacctacgttacctatacgcgccaaacctactggaatgaagccgagcaggatcgctacggaatttcgctcaacaagtaccttgatatcggcgcatttaaaggaatttctgcgaacttatcggcctaccgcaccgaattcaaccgccgcaccgatgacagcctgtatctgagtttttctattccactcggagaaaaagatcgcctgagctacagcatgggacgctataacgacggcagcaatcaagcgctgacctattccaataacgccgatccgcgtcgtacctggaatctgagcactcggcacgacagcaaagaaaacatctacctgagtggcaactatacccatctggcaccgatgacggatgccaccgtgggcgtcgcctggcagcaagaccgctatacctacctgaacggctcactgcgcggagggattaccgcaacccgccacggcgtcgcggcacatccgaaaggcaatcagggcggcactcgcatcatggtcgatacggaacaagcgggcgtaccgttctctggcagtcaggtcgaaactaaccgctatggcctggccgtgattgctggtagcagtagctactacgatgtgtcgacccgcatcgatatgcagaaattaccgcaaaatattgaagccatgacgacggtggttcagggcacgctgaccgaaggcgcgattggctaccgcaaattcgacgtagttagcggagcaaaagtcatggcacacattgcgctggccgatggcaaatatcctccgttcgccgcccagatcaagaaccagaaaggccgcgatatcgccatggttaccaacggtggacaagcctatatcacgggcgtatcacctgacgaaacgctgtccgtcatctgggaggggagaacccagtgttccatcaccctgcccgccaccttaaatcaccttgatgcgctgctgcttccctgtaaataa

SEQ ID NO: 3419 - protein, 830 aa, Erwinia carotovora subsp. atroseptica SCRI1043
MKNITLKEKIQPALFHYGIFIFSLSTTSLSATEFNINVLDVDERSDIDLSHFSDPEYVTPGTYLLSIKVNAREIQQQMISYLPEGNHRPRPTACLSTELVDKLALKKEARDQVELWNNGTCVDLTPIAGVKISNQIGMGTLNITIPQAWLVYSDRNWIPPEQWDHGINGALLDYNLVGNVRRDTNGRGTSHYLSSYGTTGFNQGAWRYRADYRYFLQKSRNSNRDSFSWDQFYAYRPLPTLSADLKLGEMYFSSNLFDSYRFTGASLANNENMLPPSLRGYAPEVRGVAKSNATVTVTQNGRLIYETTVPAGPFAIQDMKNGVSGTLDVRVTEEDGTVTTFQTESANLPYLTRPGHVQYKLAAGKPSNTNHRLQGPAFSAAEASWGLSNAWSVYGGSILSNGYQSWSAGIGKNLYLLGALSADITQSRATLPTTSSSQMGHAFSLNWSKYFNSIDSQISFAGYRFSEKTYMSMAQYLYALNLDNRYRNEKERYTITLSKNFATQESSSLLNGLSTYVTYTRQTYWNEAEQDRYGISLNKYLDIGAFKGISANLSAYRTEFNRRTDDSLYLSFSIPLGEKDRLSYSMGRYNDGSNQALTYSNNADPRRTWNLSTRHDSKENIYLSGNYTHLAPMTDATVGVAWQQDRYTYLNGSLRGGITATRHGVAAHPKGNQGGTRIMVDTEQAGVPFSGSQVETNRYGLAVIAGSSSYYDVSTRIDMQKLPQNIEAMTTVVQGTLTEGAIGYRKFDVVSGAKVMAHIALADGKYPPFAAQIKNQKGRDIAMVTNGGQAYITGVSPDETLSVIWEGRTQCSITLPATLNHLDALLLPCK

SEQ ID NO: 3420 - DNA, 2379 bp, Yersinia pseudotuberculosis IP 32953
  CDS (1)..(2379): transl_table=11
gtggtcgcccgttgtattaatctccagtgtatcgcattcttattctctttttttcctacgctggctttccctgtcacagaagagggtgaggtggtttttgacatagaaacgctggagagattaggttattcagctgaattggcaaaattcttcagcggtcaggatagatttctacccggccaacatgatgtcactatcattattaatgccagcaagacctaccgtattgcagcgaccttcgatagcgaagggaaactgtgtatggataaagcattactgatggccttgaaattacgaaatacagagagtgacggcagttgtgagaatatggaagcccggtggccgggtatggttgttaaactctttcccggccagttccgggtggaaataacattgccgcaagaggcgtttgatcccgaaatggaaggaagtgagtatcagcaaggagggcatgcactattgcttaattacaatatctttggccaacgggtcgaaagtaacaatagccgctttaatcttgttcaggggcaatttgaaccggggattaattttaaaaattgggtactgagaaaccgaggttcctacagttataatcaaggagtgagccaatactataatcaggaaacctctgctttacgcgcggttgaatcattgaaatccgtggttcaactgggtgaatttggtttagtgggtaacaccttttctggtttacccgtaaccggcattcagttgtattccgatgacgcacaacgggatgatacacaattgatcgtacccatcgaggggattgccaataccaatgccaccattgaaatccgtcagcgtgggcgggttatttatcgtaccatagtggcgccaggtcctttttcgttatccaatatcagtaacttctcaagtggtgttaacaccgatgtcagtattatcgaagaggatggcactcaacagaattttacggtgacgagcgcccttgatattaacgctgaacaacaggcatccatctaccaactggccgtgggccgttaccgggacatgtttaccggtgaggacaggccgtcaccgctgctgctttccggagaaatgtcattcaatccggcggctaccttttatatgacgtcggctgggttactgtcctctggctatcaaaatatccgtgtgcaaaatctttacagtggatgggatcaggcctggttttcagcggcagcaagttatgctaataccaaagatgcaggacagggataccaatttagcgttcagaatcagatgacgattaacggtaattttggtgtttcatggtcctcggtttatggctcggccaattactggtcaccggatgatgccctaagcagtagcaataatctgaatgacctgatgtttggaaaattaaaaaatgcaacgtcggtagccgtgagctgggtgcacccacgttggggggcattctcctatgctttatcaaataatatgtattatcaggcttctggtcgtacttaccatattttctcaattagcgaacaatttggccgggcgactaccatcttgagttctcaattaagttcgcaagggcaaaattcgctctatgttggtatcaatatgccattgggtaatgggacgttaagtggccgggtgcaacgtaacaatggcaatgtggcacttggtagtacttatcaagggcgatggggtgacaacaaagattattcggtagggatcagcggtgacaataggcaacggcgtatcaatggttcgatgaatataaggacggcctattcacaattaaccggtggggtttctcaagcgacaaacaatagccggtctgcatatctgtcatcgcgtggttcagtggcttacgtgaataacacctttgccacatcgtcgtcatcggttggcgatacttttgcggtggtgaacatacccaaccaacccggtttgcgcgtttcatcgccgagcagcggtattgcgattacggattatgctgggatagccttgctgccattagtgaggccttacaccgcttcgaaagtacaaataagcacgcaaacattgccgctgaatattcggcttaataacaccagtgccgatttgctgatgactcgaggctcggtagcaacccatcattttgagacaacagaaacccgccaattgctgctaaccatccgtggtagtgatggtgaaatgctgccgattggtgccaatgtattggatgaaaaaggtaactttctggggacgattatcggtgacggaaactttatgctggaaaataaggcgattggcgtgacattacgtgttaaggcaaataaccgcgatgaatgtcgcgttaactaccgtgaacctgaaaaatttgaccccgatgtattgtatgaagttgccgatgcggtctgtcagtaa

SEQ ID NO: 3421 - protein, 792 aa, Yersinia pseudotuberculosis IP 32953
MVARCINLQCIAFLFSFFPTLAFPVTEEGEVVFDIETLERLGYSAELAKFFSGQDRFLPGQHDVTIIINASKTYRIAATFDSEGKLCMDKALLMALKLRNTESDGSCENMEARWPGMVVKLFPGQFRVEITLPQEAFDPEMEGSEYQQGGHALLLNYNIFGQRVESNNSRFNLVQGQFEPGINFKNWVLRNRGSYSYNQGVSQYYNQETSALRAVESLKSVVQLGEFGLVGNTFSGLPVTGIQLYSDDAQRDDTQLIVPIEGIANTNATIEIRQRGRVIYRTIVAPGPFSLSNISNFSSGVNTDVSIIEEDGTQQNFTVTSALDINAEQQASIYQLAVGRYRDMFTGEDRPSPLLLSGEMSFNPAATFYMTSAGLLSSGYQNIRVQNLYSGWDQAWFSAAASYANTKDAGQGYQFSVQNQMTINGNFGVSWSSVYGSANYWSPDDALSSSNNLNDLMFGKLKNATSVAVSWVHPRWGAFSYALSNNMYYQASGRTYHIFSISEQFGRATTILSSQLSSQGQNSLYVGINMPLGNGTLSGRVQRNNGNVALGSTYQGRWGDNKDYSVGISGDNRQRRINGSMNIRTAYSQLTGGVSQATNNSRSAYLSSRGSVAYVNNTFATSSSSVGDTFAVVNIPNQPGLRVSSPSSGIAITDYAGIALLPLVRPYTASKVQISTQTLPLNIRLNNTSADLLMTRGSVATHHFETTETRQLLLTIRGSDGEMLPIGANVLDEKGNFLGTIIGDGNFMLENKAIGVTLRVKANNRDECRVNYREPEKFDPDVLYEVADAVCQ

SEQ ID NO: 3422 - DNA, 2553 bp, Burkholderia mallei ATCC 23344
  CDS (1)..(2553): transl_table=11
atgattcggcatcgtgtcgccgatgtcggcttctcgcgcatacgagtgaccatgctggccgccgcgctcacggcgctttcggcgaccgctcgcggccaacaggcgctggagttcgatcctgcctttctcgagttgggcggcggccagggcggagccgatctttccgtgtacgcgacatcgaaccgcgtgctgcccggcgtctatccggtatcggtcttcgtcaacggcgaggcgatcgagcggcgcgacatcacgttcgtgtccgaaagcgcgcgcgacgggcgggaagacgcgatcccctgcctgagcgcccggatgttcgacgaatggggcgtcgacatcgccgcgtttgcgaagctcgcgcaagccggcgaagacgcatgcgtcgacattgccgacagcgtgccccacgcgcgaaccgagttcgacagtcatcaactgcggttgaacgtaacggtgccccaggccgcgttgaagcggcgcgcgcgcggcgcggtggacccggcgcgctgggatcagggtatcgacgccgcgctgctcgactatcaactgagcgccgcccagtacgccggcggcaatttcgcgtccgcccgttcgcgcacgacgttgtatgcggggttgcgcggcgccgtcaatctgggcgcatggcggctgtcgcacacgtcgtcgtttctgcgcgggctcgacggccggaatcgctttcagatcgtcaatacgttcgtccagcgcgacatcgccggctggaacagccgcctcaccgccggggaaggcaccacgcccgcgaacattttcgacggatttcagtttctcggcgtgcaactcaataccgacgagaccatgctgcccgacagtctgcagggctacgcgcccaccgtgcacggcgtcgcgcagaccaatgcgcaggtgacgatcaggcagaatggtttcgtcatctacagcacctacgtgccgccggggccgtttacgatcgacgatctttatccgacgtcgtcgtcgggcaatctggaagtgacgattaccgaggccgacgggcacgtcacgacattcacgcaaccgtactccgcggtgccgatgttgctgcgcgacggttcgtggcggtataacgtcacggcgggccaataccgtgacggcatttcaggctcgcatccgagctttgcgatggcgacgctcgcgcgcgggctggcgggcgaattctcgttgtacggcgggttcatcggggccggcatgtatcaatcggtgctcgtcggaatcggcaagaacctgggcagcatcggcgcggtatcgctcgacgtgacgcacgcgcgcagcgcggtcgacctggccgacagcagcacggtgtcggggcatgcctttcgcgtgctttacgcgaaggccgtgggcagttggggcaccgatttccggttgctcgcataccgctactccaccgccggctatcgaagcttcgccgatgcggtgcaactgcgcgacggcagcgagcccgcggcgctgggcgcaaagcgccagcgcctcgagggcacggtgaaccagcgtctcggccgcctcggctcgatgtacgcgaccgtggccgtgcagacctactggggcagcgcggcgcgcagcaccgtgtatcagctcgggcacagcgggaattgggggcgcgccagctacggactctatgcggcctatagcaaaggaagcggcgtgccgtcgagctggaacgtctcgttgtcgctatcgatgccgctggaagtgtttttcggcggcgcgcgcgtgcgtgcgccggcgggcggcagtgcgaatgtctcgtacttcgtcagccggaacaacgagaaccacgtcaatcaacagatgacggccagcggcagcagcagcgagcagcgcctgaactacagcgtgggcgtcgcgcattccagcgagtcggacgtgagcggctcggtgtcggccagctacctcgcgccgttcggccgctacgacgcgtcgatcggcagcggccgcgggtacacgcaggccgcgttcactgccgccggcggcatgctgtggcatggcaccggagtgttgttcacgcaaccgctcggcgagaccgtggcggtcgtggacgtgccgaacgtgcggggcgtgcgtttcgaaatgcacccgggcgtgagcacggatcgggcgggcgaagcggtgattccgcggctgaacccctatcgggtcaaccgcatcgccgtcgaccagcgccggatgccgcaggacgtggagatccgcaacccggtgagcgaagtcgtgcccacccgggcggcggtcgttcaaacgcacttcgattccgtcgtcgggcttcgcgcgctgttcacgttgacgcgcgcggacggctcgtttccgccgcagggcgcgacggccgagaacgacgagggacaggtgctcggcgtcgtcgggatggacggcgagacgttcgtggcgggcttgcccgccgccgaagggcatttcgtcgttcgctggggggcggcgcggcagaatcgctgccgcgtgaattacgcgctgcccggaaaggcggcgatcggcgcgtacttggccgtggaggcgacatgcgattga

SEQ ID NO: 3423 - protein, 850 aa, Burkholderia mallei ATCC 23344
MIRHRVADVGFSRIRVTMLAAALTALSATARGQQALEFDPAFLELGGGQGGADLSVYATSNRVLPGVYPVSVFVNGEAIERRDITFVSESARDGREDAIPCLSARMFDEWGVDIAAFAKLAQAGEDACVDIADSVPHARTEFDSHQLRLNVTVPQAALKRRARGAVDPARWDQGIDAALLDYQLSAAQYAGGNFASARSRTTLYAGLRGAVNLGAWRLSHTSSFLRGLDGRNRFQIVNTFVQRDIAGWNSRLTAGEGTTPANIFDGFQFLGVQLNTDETMLPDSLQGYAPTVHGVAQTNAQVTIRQNGFVIYSTYVPPGPFTIDDLYPTSSSGNLEVTITEADGHVTTFTQPYSAVPMLLRDGSWRYNVTAGQYRDGISGSHPSFAMATLARGLAGEFSLYGGFIGAGMYQSVLVGIGKNLGSIGAVSLDVTHARSAVDLADSSTVSGHAFRVLYAKAVGSWGTDFRLLAYRYSTAGYRSFADAVQLRDGSEPAALGAKRQRLEGTVNQRLGRLGSMYATVAVQTYWGSAARSTVYQLGHSGNWGRASYGLYAAYSKGSGVPSSWNVSLSLSMPLEVFFGGARVRAPAGGSANVSYFVSRNNENHVNQQMTASGSSSEQRLNYSVGVAHSSESDVSGSVSASYLAPFGRYDASIGSGRGYTQAAFTAAGGMLWHGTGVLFTQPLGETVAVVDVPNVRGVRFEMHPGVSTDRAGEAVIPRLNPYRVNRIAVDQRRMPQDVEIRNPVSEVVPTRAAVVQTHFDSVVGLRALFTLTRADGSFPPQGATAENDEGQVLGVVGMDGETFVAGLPAAEGHFVVRWGAARQNRCRVNYALPGKAAIGAYLAVEATCD

SEQ ID NO: 3424 - DNA, 2553 bp, Burkholderia pseudomallei K96243
  CDS (1)..(2553): transl_table=11
atgattcggcatcgtgtcgccgatgtcggcttctcgcgcatacgagtgaccatgctggccgccgcgctcacggcgctttcggcgaccgctcgcggccaacaggcgctggagttcgatcctgcctttctcgagttgggcggcggccagggcggagccgatctttccgtgtacgcgacatcgaaccgcgtgttgcccggcgtctatccgatatcggtcttcgtcaacggcgaggcgatcgagcgacgcgacatcacgttcgtgtccgaaagcgcgcgcgacgggcgggaagacgcgatcccctgcctgagcgcccggatgttcgacgaatggggcgtcgacatcgccgcgtttgcgaagctcgcgcaagccggcgaagacgcatgcgtcgacatcgccgacagcgtgccccacgcgcgaaccgagttcgacagtcatcaactgcggttgaacgtaacggtgccccaggccgcgttgaagcggcgcgcgcgcggcgcggtggacccggcgcgctgggatcagggtatcgacgccgcgctgctcgactatcaactgagcgctgcccagtacgccggcggcaatttcgcgtccgcccgttcgcgcacgacgttgtatgcggggttgcgcggcgccgtcaatctgggcgcatggcggctgtcgcacacgtcgtcgtttctgcgcgggctcgacggccggaatcgctttcagatcgtcaatacgttcgtccagcgcgacatcgccggctggaacagccgcctcaccgccggggaaggcaccacgcccgcgaacattttcgacggatttcagtttctcggcgtgcaactcaataccgacgagaccatgctgcccgacagtctgcagggctacgcgcccaccgtgcacggcgtcgcgcagaccaatgcgcaggtgacgatcaggcagaatggtttcgtcatctacagcacctacgtgccgccggggccgtttacgatcgacgatctttatccgacgtcgtcgtcgggcaatctggaagtgacgattaccgaggccgacgggcacgtcacgacattcacgcaaccgtactccgcggtgccgatgttgctgcgcgacggttcgtggcggtataacgtcacggcgggccaataccgtgacggcatttcaggctcgcatccgagctttgcgatggcgacgctcgcgcgcgggctggcgggcgaattctcgttgtacggcgggttcatcggggccggcatgtatcaatcggtgctcgtcggaatcggcaagaacctgggcagcatcggcgcggtatcgctcgacgtgacgcacgcgcgcagcgcggtcgacttggccgacagcagcacggtgtcggggcatgcctttcgcgtgctttacgcgaaggccgtgggcagttggggcaccgatttccggttgctcgcataccgctactccaccgccggctatcgaagcttcgccgatgcggtgcaactgcgcgacggcagcgagcccgcggcgctgggcgcaaagcgccagcgcctcgagggcacggtgaaccagcgtctcggccgcctcggctcgatgtacgcgaccgtggccgtgcagacctactggggcagcgcggcgcgcagcaccgtgtatcagctcgggcacagcgggaattgggggcgcgccagctacggactctatgcggcctatagcaaaggaagcggcgtgccgtcgagctggaacgtctcgttgtcgctatcgatgccgctggaagtgtttttcggcggcgcgcgcgtgcgtgcgccggcgggcggcagtgcgaatgtctcgtacttcgtcagccggaacaacgagaaccacgtcaatcaacagatgacggccagcggcagcagcagcgagcagcgcctgaactacagcgtgggcgtcgcgcattccagcgagtcggacgtgagcggctcggtgtcggccagctacctcgcgccgttcggccgctacgacgcgtcgatcggcagcggccgcgggtacacgcaggccgcgttcactgccgccggcggcatgctgtggcatggcaccggagtgttgttcacgcaaccgctcggcgagaccgtggcggtcgtggacgtgccgaacgtgcggggcgtgcgtttcgaaatgcacccgggcgtgagcacggatcgggcgggcgaagcggtgattccgcggctgaacccctatcgggtcaaccgcatcgccgtcgaccagcgccggatgccgcaggacgtggagatccgcaacccggtgagcgaagtcgtgcccacccgggcggcggtcgttcaaacgcacttcgattccgtcgtcgggcttcgcgcgctgttcacgttgatgcgcgcggacggctcgtttccgccgcagggcgcgacggccgagaacgacgagggacaggtgctcggcgtcgtcgggatggacggcgagacgttcgtggcgggcttgcccgccgccgaagggcatttcgtcgttcgctggggggcggcgcgacagaatcgctgccgcgtgaattacgcgctgcccggaaaggcggcgatcggcgcgtacttggccgtggaggcgatatgcgattga

SEQ ID NO: 3425 - protein, 850 aa, Burkholderia pseudomallei K96243
MIRHRVADVGFSRIRVTMLAAALTALSATARGQQALEFDPAFLELGGGQGGADLSVYATSNRVLPGVYPISVFVNGEAIERRDITFVSESARDGREDAIPCLSARMFDEWGVDIAAFAKLAQAGEDACVDIADSVPHARTEFDSHQLRLNVTVPQAALKRRARGAVDPARWDQGIDAALLDYQLSAAQYAGGNFASARSRTTLYAGLRGAVNLGAWRLSHTSSFLRGLDGRNRFQIVNTFVQRDIAGWNSRLTAGEGTTPANIFDGFQFLGVQLNTDETMLPDSLQGYAPTVHGVAQTNAQVTIRQNGFVIYSTYVPPGPFTIDDLYPTSSSGNLEVTITEADGHVTTFTQPYSAVPMLLRDGSWRYNVTAGQYRDGISGSHPSFAMATLARGLAGEFSLYGGFIGAGMYQSVLVGIGKNLGSIGAVSLDVTHARSAVDLADSSTVSGHAFRVLYAKAVGSWGTDFRLLAYRYSTAGYRSFADAVQLRDGSEPAALGAKRQRLEGTVNQRLGRLGSMYATVAVQTYWGSAARSTVYQLGHSGNWGRASYGLYAAYSKGSGVPSSWNVSLSLSMPLEVFFGGARVRAPAGGSANVSYFVSRNNENHVNQQMTASGSSSEQRLNYSVGVAHSSESDVSGSVSASYLAPFGRYDASIGSGRGYTQAAFTAAGGMLWHGTGVLFTQPLGETVAVVDVPNVRGVRFEMHPGVSTDRAGEAVIPRLNPYRVNRIAVDQRRMPQDVEIRNPVSEVVPTRAAVVQTHFDSVVGLRALFTLMRADGSFPPQGATAENDEGQVLGVVGMDGETFVAGLPAAEGHFVVRWGAARQNRCRVNYALPGKAAIGAYLAVEAICD

SEQ ID NO: 3426 - DNA, 2385 bp, Burkholderia pseudomallei K96243
  CDS (1)..(2385): transl_table=11
gtgtacgcaagacggttggtcctgtcgtttagcttgctcctcggcatcgcatggggaagcaacgacgcactcgccgtctcgtcgccttcgcccagcgcggcggttgaattcgacacccaaacgctgattgcgcgaggctattccgccgacattgcaaaattcttcagcggcgattcgcgctttctccccggcaagcaggaggtcacgatcgcactcaacgccaaccagacctacacgacgaacgttcaatttgatgacgacggcgatccgtgcttcgacgccgcgctgttggacacgctgcgactgcgcaaaccatccgatctggccggctgcgccgatcccgaacaaatgtggccggaatttcacatgaaactccaccctgggcagtttcgaatcgacatgaccgtgccggaggaagcattcgacccacggcgacgcggcaacggactgcactccggcggcgaggcggtgttactgaattacgatgtcttcgcgcagcgcttcgatacccggttcggcagcagccattacttacaggcacggctcgagcccggcttcaatatcggaaactggtttttccgtaaccgtggagcgctgacccattcaggcaagggattctcgtatcagttgcaagacacctacctcgcgcgtaccgtcgacgcgtggggggccatcacgcagatcggccagttcacgtccacaggcgaaaatctgggcggcctgccgatgctcggcttccagatcagttcggaccgcttgcaaaatagcgggcaactgaccgttcccatccaaggcatcgcggaaagcaacgcgacggtcgaagtgcgtcagcgcggccgtgtcgtctatcgcacgatcgtcccgcccgggcctttcatgctgtccgacatcggcagcgtcgcgcagaacgccgacctccaaatcgaaatcaccgaacaggacggacgaaagcgacgcttcgagatgcccgtcggcatgggctatgccgacgcgaagcagccgacgacttggcaggccgccatcggccgctatcaggatgcaggcaattccgatcgaacgcgtgcacccgcgatattcgccaccggtgaaatctctttctcaccgctcgacaatctacgcgtgtcgaccgccgcgctcgcggcctccggctatcttcatgcgagcgtccaaggaacgctttcggcgaaatccggagcatggcttgcaagcggagtgcgctattcgcggatggctggcgcgggccaaggatatcagttcgagttacaaggctcgtcccgaatcggaggaaacgtgttcgcatccgcctcatggctgtcgcgctcgattcgctataccacgccagatgtcgcgctcggatcgcttggcgatgcaaccggaaccggtcaaaccaagcattcggcgaacgcgtcgatcaactgggcccatccgcgttggggtagctttacgtatggcctgtcgtacaacagtttcgtcggcgcaccgaactccgtatctcacacgctgagcatcggtcgcaagatcggtcgggcaaacgtcagccttgccgcacaaatcagccccaagagcggcagcagcgtctacgccaacgtgtcgattccgctaggcggtggttcgttgagtgcgcgaaccacgcgctcgcagcggggggatctcacgttcggcacgtcctacggcaatcgattgggacgagacggatcgtattccatcggcgcatcgggcagcaagagcggccagaccgcgaacgcgtccgtcagcatgaggacgggcttcgctcaatttggcgccggcgtggctcagagtacgtccaactcacggtctacctacctgtctgcaagcggaggcatcgcctacgccaatggactattcggcacggcatccagccggatcggggaaacgttcgccatcgtgtcggtcccgaaccaaaagggtttgcgcatcagcgcacctggtggaacgtccatcaccaacccattcggcaccgcagtcatctcttccctgacgccctacacgaaagcgcaactcagactcgatacgcaaagccttcccatgaatgtgcgtctcgacacgaccaccgtcgacatcgggctccgacggggcagcgtgctgacgcgcacgatccatgcagccgaaacgcgacagctcatgttgacgatacgagattcgaccggtgccaccgcaccggtcggcaccaccgtgcttgatgagcaaggccagttcctcggcacgatcatcggagatgggaacttcatcctgaatgacgacgacatcggtaggccgatcaggttgtcgggcgtcaatcgtagcgagtgccgcgtgacctacgaggcacccgcacggttcgatccaaatcagccttatgaagaggcagaaggaacatgcgggtga

SEQ ID NO: 3427 - protein, 794 aa, Burkholderia pseudomallei K96243
MYARRLVLSFSLLLGIAWGSNDALAVSSPSPSAAVEFDTQTLIARGYSADIAKFFSGDSRFLPGKQEVTIALNANQTYTTNVQFDDDGDPCFDAALLDTLRLRKPSDLAGCADPEQMWPEFHMKLHPGQFRIDMTVPEEAFDPRRRGNGLHSGGEAVLLNYDVFAQRFDTRFGSSHYLQARLEPGFNIGNWFFRNRGALTHSGKGFSYQLQDTYLARTVDAWGAITQIGQFTSTGENLGGLPMLGFQISSDRLQNSGQLTVPIQGIAESNATVEVRQRGRVVYRTIVPPGPFMLSDIGSVAQNADLQIEITEQDGRKRRFEMPVGMGYADAKQPTTWQAAIGRYQDAGNSDRTRAPAIFATGEISFSPLDNLRVSTAALAASGYLHASVQGTLSAKSGAWLASGVRYSRMAGAGQGYQFELQGSSRIGGNVFASASWLSRSIRYTTPDVALGSLGDATGTGQTKHSANASINWAHPRWGSFTYGLSYNSFVGAPNSVSHTLSIGRKIGRANVSLAAQISPKSGSSVYANVSIPLGGGSLSARTTRSQRGDLTFGTSYGNRLGRDGSYSIGASGSKSGQTANASVSMRTGFAQFGAGVAQSTSNSRSTYLSASGGIAYANGLFGTASSRIGETFAIVSVPNQKGLRISAPGGTSITNPFGTAVISSLTPYTKAQLRLDTQSLPMNVRLDTTTVDIGLRRGSVLTRTIHAAETRQLMLTIRDSTGATAPVGTTVLDEQGQFLGTIIGDGNFILNDDDIGRPIRLSGVNRSECRVTYEAPARFDPNQPYEEAEGTCG

SEQ ID NO: 3428 - DNA, 2535 bp, Pseudomonas syringae pv. syringae B728a
  CDS (1)..(2535): transl_table=11
atggaatggcgcaaagaagttaataagggagttattgcccagtgcgcgctccctcacccccgacgcggtgcgctgggtatcggtttcggattgacgttgatgtgtgcggtcagcgcgtcggccgcctcgtcgggtggcgacggggcagtcaggttcaatacggcgtttatccagggaagcgatcagccggctgaccttcaggagtttctgcgctccaatagtgtattgccgggtatttaccgggttgatatctacgtcaatcgcaagctgagcggcaggcgggatatccgctttttgaaaagtccgctatcaggcctgatcgagccctgcctgtcgctcgagatgctgcagagttttggtctggacttgagccgtctgccgccaggtgaggcatctgcccaggcctgtttcgacctgcccgcgcgtgtcgcatttgcccgcgtcgactatcagcccggtgcgttgcgactgacgatcagtgtgccgcaagcggtgatgtcacgcggtgctcgcggttatgtgtcgccggagctttgggaccagggcgagaccgcaggctttatcaactacaacttcaatggcagccggcggcgtaacaagggcctggaaacggagcagtactacgtggggctgcgaaacgggctgaacgtcggcgcctggcgtttgcgcaacgagtcctctctggtcggcggcagtgacaggccctggcgttatcgcagcaatcgtaccttcgcgcagcgtgacatcaccaccctgaaaagccagctcacgctgggcgagacgttcaccgattcgcaggtattcgacagtgtccgcttcaggggcgcggcgctggcctctgacgatggcatgctgtctgacagcgagcgggcctatgccccggtcatccgcgggattgccgaaaccaatgcgaccgtggaagttcgccagaacggctttctgctctacagcggcagtgtgtcgcccgggccgttcgagattgccgatatctatcccagtggctccaatggcgacttgtcggtgtctgtcatcgaagccgacgggcgtgtaagaaccttcactcaggcctacgcgtcgctgccgatcatggttcccgcaggctcgttgcgctacagcctggccggcgggcaggtcgacaacaacgacgatcagcaggcctctccggcgtttgccagtgtggccctgatctacggtctttccgaacggattaccgggtttgccggggtgcaactggccgaggattaccaggccgcgaacataggcaccgggatcaacaccgggctgggcgccgtgtcgatggaccttacccgctcggtcagcaaggtggatcagcgggcgcgcagtggccagagcctgcgcgtgcgttatgccaatacgctggatgtcaccgacaccacgttggcagtggccggttatcgatattcgaccgagcaataccggaccctgagccagcacgtcagcgacagcggcgcgctgcggcaattgcgggcttctgggctggcgcgggatcggctggaactcagcatcactcagatagtgcctggccagtcggcgtcgctgagcctgacggcgtccgagcagcgctactggaacctgtccggcaagacccggcagctttacctgtcctataacgcggcctggtattcgctcaattacagcctgtccatcgaacgcaacgaggatttcgggcgaagcggtgacgcgagcaccgacaatcgtgttgccctgagcgtgaccctgccgctcggctccagccccggctcgtcgcgactgtctttcaacgcggtgcgcgacagccgcggcgagtacaacgcgcaggccgggctcaacggtcaggtgccgggcgaccgcgacacgttctattcggtacaggctggacgtgacagcagctccggcagtttcggcgcaggcaaggtcagcaccagcacggcattcggccgtttcgaggccggttatagccagggccaggactacgatgcattcagcctgtccgccgcagggtcgctggtggcgcatgccggtggcgtgaacctggggcagaccttgggagaaacctttgctctggttcaggtgcccgacgtcggtggcgcccgcttgaagtcgttcagtaacgtcgagaccgcccgcaacggctatgcggttctgccctatgcgcaggcctaccgcaccaactgggtcagcctggatacccggcaactgggcgctgatgtcgatctggaaaacgctattacccagatcgtgccgcgcaggggcgcaataccggtggtgcgcttcaaggccaatgtgggccgccgggtccagttcgaactggtgcgcgtcgatggcagcaaagtgccgctgggtgccagtgtcgaagatgagcagggcagggcgctggcagtggtcgatcccggcagtcaggcgctggtgctcagcgagcaggatgccggcagcctgtgggtgcgctggtcagatcaacgttgccaggcgacattctcgttaccgcccagagacccgtcgcgagcctacgagcggatcagggtggtatgccgatga

SEQ ID NO: 3429 - protein, 844 aa, Pseudomonas syringae pv. syringae B728a
MEWRKEVNKGVIAQCALPHPRRGALGIGFGLTLMCAVSASAASSGGDGAVRFNTAFIQGSDQPADLQEFLRSNSVLPGIYRVDIYVNRKLSGRRDIRFLKSPLSGLIEPCLSLEMLQSFGLDLSRLPPGEASAQACFDLPARVAFARVDYQPGALRLTISVPQAVMSRGARGYVSPELWDQGETAGFINYNFNGSRRRNKGLETEQYYVGLRNGLNVGAWRLRNESSLVGGSDRPWRYRSNRTFAQRDITTLKSQLTLGETFTDSQVFDSVRFRGAALASDDGMLSDSERAYAPVIRGIAETNATVEVRQNGFLLYSGSVSPGPFEIADIYPSGSNGDLSVSVIEADGRVRTFTQAYASLPIMVPAGSLRYSLAGGQVDNNDDQQASPAFASVALIYGLSERITGFAGVQLAEDYQAANIGTGINTGLGAVSMDLTRSVSKVDQRARSGQSLRVRYANTLDVTDTTLAVAGYRYSTEQYRTLSQHVSDSGALRQLRASGLARDRLELSITQIVPGQSASLSLTASEQRYWNLSGKTRQLYLSYNAAWYSLNYSLSIERNEDFGRSGDASTDNRVALSVTLPLGSSPGSSRLSFNAVRDSRGEYNAQAGLNGQVPGDRDTFYSVQAGRDSSSGSFGAGKVSTSTAFGRFEAGYSQGQDYDAFSLSAAGSLVAHAGGVNLGQTLGETFALVQVPDVGGARLKSFSNVETARNGYAVLPYAQAYRTNWVSLDTRQLGADVDLENAITQIVPRRGAIPVVRFKANVGRRVQFELVRVDGSKVPLGASVEDEQGRALAVVDPGSQALVLSEQDAGSLWVRWSDQRCQATFSLPPRDPSRAYERIRVVCR

SEQ ID NO: 3430 - DNA, 2481 bp, Pseudomonas fluorescens Pf-5
  CDS (1)..(2481): transl_table=11
atgtttttactcaagcgcgacggatgggcgccgttttcgattgccctggttttcagctgcacctgccttgccgatgacgaagaacagttcaatacctcgtttctgcaaggcgcaacgtcttctgtcgatctgcaatcactgctcgccagcagccgcgtgctgcccggtatctatcgggtggacctgtacggcaacgagacgctggtcgggcgccgcgacatcgattttcgtcgcccttccggcacgaacaaggtcgaggcctgcctgactctggagatggtgcagcaattgggggtcgacatcggcaagctgcaggccagcggcaaactgggcagcgatgatcccgacacctgcctggacctgcccgccttgatcgatcacgccagcgtgcgttacgacgtgccccgcctgcgcttgatggtcagtgtcccgcaaagcgccatggcgcgtggccgacgtggttatgtcgacccggccctgtgggacgaaggcgttcccgccgcgttcatcaactatcaattgagcagcagccgcaacggcactcggggtgaaagtaccctgtccaacaacgtcggcctgcgcaacggcatcaacctcggcgcctggcgcttgcgtaacgaatcgaacttcagcagcagcaccggccgccctagtacattcaaaagtaaccgcagctatctgcaacatgacgtgactgccctgaaaggccagttcagcgccggggatatcttttcagatgccgacctgttcgacagcgtgcgctatcgcggcctgaagctggcgtccgacgacggcatgcgtgccgacagcgagcgcggttatgcgccgatcattcgcggcattgcgcagtccagcgccaccgtggagatccgccaggacagctaccttctctacaccgccaatgtgccgccggggccgttcgagatcagcgatatctaccccagcggctccaacggcgacctggaagtgacgattatcgaagccgatggtcgccgccgggtgacggtgcaggcattttccagcctgccgatcatggtccgtgagggccagttgaagtacagcgtctcggccggccagtacaacagcaacagcgatgaccagcagtcaccgcaatttgtcagcagcaccctggcgtacggcatcagcagtaacttgtccgggatcgtcggggtgcaggcctcggaaaacttcaaggcgctgtccgtcggagctggccgcaatacgactatcggtgccgtctcactggacttgacccactccatgagcagcactttcggcgcaaccatcaccggcaacagcctgcgcgccctgtatgcgaagacgtttaccggcaccgacaccaacttcaccctcgccgcctatcgctactcgaccgagggctatcgcaccctcaccgagcacgtcgaggaactgagcaacgacggccagaagcgtatcggcaactcgaaaacccgtaccgacctgaccgtcaaccagagcctgggccgaaaccagcgatacggcagcatctacatcaacgccagcgaccagcgttactggggacgcggtggttcgcaaagcctgtcggcgggttacagcaactattggggcgatgtgagctacaacctcggcgccacctactccaaggatgtcggcaactacgggccggcgaacaatgacacgctggtgaacctgtccgtatcgttcccgctgggctccaagcctcgtgcaccccgcgccttcgtctcggccagcacgcagaagtccggcgacaccacgcaaatgggcatcaacggctatctgtcgcaagacagcgacacctattactcggtgcaagccggcaacagcagcactggcggcagctccggctcggtcaacctcagcacccgcacctcggtaatggatatcagtgccggctacagccaggggcgcggctacaactcgcaaaaccttaacctgtcaggctcgatcgtcggccatggcggcgggatcaacctgggacagaccgtgggcgagacgttcgcgctggcgcaggtcgaaggcgtggaaggggtgaaaatcggcagcttctccggagccaggaccggcagcaacggcttcgccgtggtccccaatgcgcagccctatcgcgtgaactggatcaacctcgacactcgagacctgggcgccgatatcgagatcgacagtgcgacccggcaagtggtgccacgtcgtggtgccgtggtgctggcgcgttacaccagcaagaccggacggcgagtgcagttcgcgctgttcgacgctcgacaccagccgattccgtttggcgcgtcgctcgaagacagcgctggcaaacagttggcgatctctgaccctggtggcaaggctctggcgctggttgaagccgacgccgataccctgaccatcaactggcagggccagcgctgtgaagcgccttatgcgttgcccgaacgcaacaaggcgctgaactatgagcgggcgacactggtgtgccgcccctga

SEQ ID NO: 3431 - protein, 826 aa, Pseudomonas fluorescens Pf-5
MFLLKRDGWAPFSIALVFSCTCLADDEEQFNTSFLQGATSSVDLQSLLASSRVLPGIYRVDLYGNETLVGRRDIDFRRPSGTNKVEACLTLEMVQQLGVDIGKLQASGKLGSDDPDTCLDLPALIDHASVRYDVPRLRLMVSVPQSAMARGRRGYVDPALWDEGVPAAFINYQLSSSRNGTRGESTLSNNVGLRNGINLGAWRLRNESNFSSSTGRPSTFKSNRSYLQHDVTALKGQFSAGDIFSDADLFDSVRYRGLKLASDDGMRADSERGYAPIIRGIAQSSATVEIRQDSYLLYTANVPPGPFEISDIYPSGSNGDLEVTIIEADGRRRVTVQAFSSLPIMVREGQLKYSVSAGQYNSNSDDQQSPQFVSSTLAYGISSNLSGIVGVQASENFKALSVGAGRNTTIGAVSLDLTHSMSSTFGATITGNSLRALYAKTFTGTDTNFTLAAYRYSTEGYRTLTEHVEELSNDGQKRIGNSKTRTDLTVNQSLGRNQRYGSIYINASDQRYWGRGGSQSLSAGYSNYWGDVSYNLGATYSKDVGNYGPANNDTLVNLSVSFPLGSKPRAPRAFVSASTQKSGDTTQMGINGYLSQDSDTYYSVQAGNSSTGGSSGSVNLSTRTSVMDISAGYSQGRGYNSQNLNLSGSIVGHGGGINLGQTVGETFALAQVEGVEGVKIGSFSGARTGSNGFAVVPNAQPYRVNWINLDTRDLGADIEIDSATRQVVPRRGAVVLARYTSKTGRRVQFALFDARHQPIPFGASLEDSAGKQLAISDPGGKALALVEADADTLTINWQGQRCEAPYALPERNKALNYERATLVCRP

SEQ ID NO: 3432 - DNA, 2496 bp, Pseudomonas syringae pv. phaseolicola 1448A
  CDS (1)..(2496): transl_table=11
atgcgtcgccttgcctatgctctgtccttacctgcagcatgtttttttacttccgttcaggcgcagacttaccattttgatccggcgttgctagggagctctgcgaagcataccgatctttcactgttcaaccgagggctacagcagccaggcaggtatcatttagatgtaatgcttaatgacgagcaggtcgacagccaagacattacactgagtttgaaaaaaaatgctgccggcatcagcgtgcttgatccctgcctcagcttagaacaattatcgcgatggggcattaaaacagaagcaattccaggtctgaatcgcacatcaaatgcaggggcttgcgtcatacttgagagtatacccgagtccactgtaaacgcagacattgcgaaccagcagctgcaactgcaagtaccgcaatcattcatgcgtccaaactatagaggtttagcgcctcagggcctatgggatgatgggatcacggcatttttaatgaactacagtgcaggagcatcacgcgtggacagccgagacataggggccaacgacacatcctcttgggcgcaacttcagccgggcttcaatctcggaccatggcgagcaagaagttcgtttagttggaaggatgggggggatttgcagcgctcttatgcctatgttgaacgtggagttaggggattcaaaagccgcctatccttaggtgaacgaacgtcaccgggtgatgtattcgatggcgtccctttcaccggtgtaatgctcgctacggacgatactatgttccctgccagtgagcgtagctttgcacctacggtgagcggtgtagcgcttacacgtgccagaatcgaagtccgtcagaacggctacattatcaagaccctatccgtaccgccaggacctttcgaaattcaagaccttgctgctagcagcggcaatggggatctgcacgtggcggtatatgaggccgacggcagaaatcagttctttatcgtgccttggaacacgcctgccattgctctgcacaaagaccatttaaaatacagcgtgacagctggccgttatcgctcagcagaaagccgcacacctgaggccttgttgatccaagccacagctatctatggcctaccctggaatctgacgggttacggtggtctgcagggagccacacattacggcgccgcatcgttaggcgtaggtgcaatgctgggaggctggggcgcagtctcggtggacgccacgggctcacgaagccaaacgccaggggggaacacgcaaggaggtttgaagtggcggctacgctacagcacccaactgccgttaacgcataccgctgtttcgctcgctagcatgcagtacgcctctgctggataccggtctttaaccgaaacgctaggctcgcgacagcgcgaggaatttgcgatcgacaaagactatagcgggcgccgtcagcgggcgcgcagcacattgtcgttgagtcaaaagctgggcccgctaggcagcttgggaatcagcgcttcgcgcaccgactggcgctacggccaaggacatgacgatggaatggggttcagttggagtaaatcaattcacagcttatcagtgtcgattgaatggcaacaaaaccgctcttttgatggctgtcaggaccgcacgttgagtgtatgggtgagcattcccattggcggtagcacaaacgccagttggacccttacggctcccacccggggccaacaagaacaagaaggcgggctaaatggccgagcatttgaagaccgcttggcatgggatgtcagacaacgctaccgcactgacgtgtcctcggatcagcgcagcggcagcgatctgcatgcaagttggaatggcgcgagtgggcaggttggtgtcgggtatggctacagcgcgactagccgacaagcaaatatggatgtgtcaggcggggtaattgtgcaccacgacggggtaaccctgagccaacagctttcagacacggttgcacttgtgagcgcaccaggtgctgcaggggtgcaagttgagggatggcctggcgtcgaaacagatagacgaggctacacagtaacctcgaatctcgtgggctaccaagagaatacagtgagtttgaatccgataactgttccagacaacgcggaaataccgcagaccgacgtaaagatcgtgccgacagccggggcagtggttgaagcagcctttcgaacgcgcactggtgccaaggccttggttaccctgcactactcagacggatctcccgtcgctttcggctcacaggtgaccgcagaggggcgggaaggaaacgccggcatcaccgatgcaaagggtttggcctatctcaccggcctttcctcaagcggcacgctcagcgtacgttcgggcaacaagatgtgccatgcaaattacgatttgccggggaataaggaaacggcgggactttatcaattagatgccgtgtgtctcgagtccttaaagaaggaaataccccatggctga

SEQ ID NO: 3433 - protein, 831 aa, Pseudomonas syringae pv. phaseolicola 1448A
MRRLAYALSLPAACFFTSVQAQTYHFDPALLGSSAKHTDLSLFNRGLQQPGRYHLDVMLNDEQVDSQDITLSLKKNAAGISVLDPCLSLEQLSRWGIKTEAIPGLNRTSNAGACVILESIPESTVNADIANQQLQLQVPQSFMRPNYRGLAPQGLWDDGITAFLMNYSAGASRVDSRDIGANDTSSWAQLQPGFNLGPWRARSSFSWKDGGDLQRSYAYVERGVRGFKSRLSLGERTSPGDVFDGVPFTGVMLATDDTMFPASERSFAPTVSGVALTRARIEVRQNGYIIKTLSVPPGPFEIQDLAASSGNGDLHVAVYEADGRNQFFIVPWNTPAIALHKDHLKYSVTAGRYRSAESRTPEALLIQATAIYGLPWNLTGYGGLQGATHYGAASLGVGAMLGGWGAVSVDATGSRSQTPGGNTQGGLKWRLRYSTQLPLTHTAVSLASMQYASAGYRSLTETLGSRQREEFAIDKDYSGRRQRARSTLSLSQKLGPLGSLGISASRTDWRYGQGHDDGMGFSWSKSIHSLSVSIEWQQNRSFDGCQDRTLSVWVSIPIGGSTNASWTLTAPTRGQQEQEGGLNGRAFEDRLAWDVRQRYRTDVSSDQRSGSDLHASWNGASGQVGVGYGYSATSRQANMDVSGGVIVHHDGVTLSQQLSDTVALVSAPGAAGVQVEGWPGVETDRRGYTVTSNLVGYQENTVSLNPITVPDNAEIPQTDVKIVPTAGAVVEAAFRTRTGAKALVTLHYSDGSPVAFGSQVTAEGREGNAGITDAKGLAYLTGLSSSGTLSVRSGNKMCHANYDLPGNKETAGLYQLDAVCLESLKKEIPHG

SEQ ID NO: 3434 - DNA, 2556 bp, Pseudomonas syringae pv. phaseolicola 1448A
  CDS (1)..(2556): transl_table=11
gtgaagaccgctatggaatggcgcaaaaaagatcataagggagtcattgcacagttcgctctgcctcacccacgacactgtccgctgggtatcggcctggggttgacgttgatgttttcgctcagcgcgttcgcagcctcgcctggcggtactcgggctgacgggacagtcaaattcaatacggcatttatccagggaagcgatcagccgcctgacctccaggagtttctgcgtaccaacagcgtactgccctgcacttatcgggttgatatttacgtcaatcgcaaactgagcggcaggcgagatatcgccttttcaaaaaatcgggtgtcaggcctgattgaaccctgtctgtcgcttgaaatgctacagagcttcggtctggatctgagtcgcctgctttcagatgaaggcgctgctcagggctgtttcgatttgcctgcgcgtgtcgagtttgcgcgcgtcgactatcagcccggtgcgctgcgactcactatcagtgtgccgcaagccgttatgtcgcggggcgctcgcggttatgtttcaccggagctttgggatcagggtgagacggcaggttttatcaattacaacgccaatggcagcagacgccgtaacaagggtctggaaacggaccagtattatctcgggatgcgaaatggcctgaacctcggggcctggcgattgcgcaatgagtcctcgctggtcggcggcagtgatcggccctggcgttatcgcagcaatcgtactttcgcgcagcgtgacatcactttcctgaaaagccagttcacggtgggggagaccttcagcgactcgcaggttttcgacagtgttcgcttcaagggcgcagcactggcttctgacgatggcatgctgtccgacagcgagcgcgcctacgccccggtcatccgcgggattgccgagaccaacgcgacggtggaagttcgtcagaacggttttctgctgtacagcggcagtgtttcaccagggcctttcgaaattgccgatatctaccccagtggttccaatggtgatttgtcggtgtcggtcattgaggccgatgggcgcgtacggacttttacccaggcctacgcatcgctgccgatcatggtcccctggggatccttgcgctacagcctggccgtcgggcaggtcgataacagtaatgatgttcaagcctctcccgactttgccagcacagccctgatctatgggctttccgagcggattaccgggtttggggggctgcagctggccgaagattatcaggccgcgaatataggtgccgggatcaataccgggctgggcgcagtgtcgctggatatcacccgatctgtcagtcaggttgctcaacagtcgcgcagcggccagagcatacgggtgcgctatgccaacacgctggacgttaccgacaccactctggccgtggcaggttaccgctattccactgaagcgtaccggaccctgagccagcacatcagcgataccgacccgcagagacatgcgctgtccactggcctggctcgggatcggcttgagctaagtgttacccagatagtgtcgagccacgccgcatcgctgagtctgaccgcttccgagcagcgctactggaatctgcccggcaagccccggcaactttatctgtcctataacgctgcctggcagaccgtcaattacagcctgtccattgaacgcaacgaggacttcgggcaaaacggtgaagcgagcaccgacaatcgtgttgccttgagcgtgaccctgccactcggatcgagccctggttcgtcgcgactgtctttcaatgccgtgcgcgacagcaccggtgagtacaacgctcagaccgggctcaacggccaggtgctgggggatcgtgatacgttttattcggtacaggccgggcatgacagcagctccggcagtttcggtgccgggaagatcagtaccaccaccgggttcggtcgcttcgaggcaggttatagccagggccaggactacgatgcattcagcctgtctgcggcgggttcgctggtggctcaccccggaggtgtgaacctggggcaggcgctgggtgaaaccttcgccctggttcaggttccggacgtcagcggggctcggttgaagtccttcagtaacgtcgaaaccgcaggcaacggctatgcggttctgccctatgcgcaggcctaccggaccaattgggtcagcctggatacccgccagttgggtgctgatgtcgacctggaaaatgccatcacccagctcgtaccgcgccggggagcgataccgttggtgcgcttcaaagccgttgtgggccgccgggtccagtttgaactggtccgcgccgacggtagcaaaataccgctgggtgccagtgtcgaggatgaacagggcagggcgctggcggtggtcgacccaggcagtcaggcgttggtgctcagtgagcaggatgtcggcagcttgcgggttcgctggtctgatcaaagttgtcaggcagcattctcgctgccgcccagagatccgacccgtgcctacgagcggatcagggtgacatgccaatga

SEQ ID NO: 3435 - protein, 851 aa, Pseudomonas syringae pv. phaseolicola 1448A
MKTAMEWRKKDHKGVIAQFALPHPRHCPLGIGLGLTLMFSLSAFAASPGGTRADGTVKFNTAFIQGSDQPPDLQEFLRTNSVLPCTYRVDIYVNRKLSGRRDIAFSKNRVSGLIEPCLSLEMLQSFGLDLSRLLSDEGAAQGCFDLPARVEFARVDYQPGALRLTISVPQAVMSRGARGYVSPELWDQGETAGFINYNANGSRRRNKGLETDQYYLGMRNGLNLGAWRLRNESSLVGGSDRPWRYRSNRTFAQRDITFLKSQFTVGETFSDSQVFDSVRFKGAALASDDGMLSDSERAYAPVIRGIAETNATVEVRQNGFLLYSGSVSPGPFEIADIYPSGSNGDLSVSVIEADGRVRTFTQAYASLPIMVPWGSLRYSLAVGQVDNSNDVQASPDFASTALIYGLSERITGFGGLQLAEDYQAANIGAGINTGLGAVSLDITRSVSQVAQQSRSGQSIRVRYANTLDVTDTTLAVAGYRYSTEAYRTLSQHISDTDPQRHALSTGLARDRLELSVTQIVSSHAASLSLTASEQRYWNLPGKPRQLYLSYNAAWQTVNYSLSIERNEDFGQNGEASTDNRVALSVTLPLGSSPGSSRLSFNAVRDSTGEYNAQTGLNGQVLGDRDTFYSVQAGHDSSSGSFGAGKISTTTGFGRFEAGYSQGQDYDAFSLSAAGSLVAHPGGVNLGQALGETFALVQVPDVSGARLKSFSNVETAGNGYAVLPYAQAYRTNWVSLDTRQLGADVDLENAITQLVPRRGAIPLVRFKAVVGRRVQFELVRADGSKIPLGASVEDEQGRALAVVDPGSQALVLSEQDVGSLRVRWSDQSCQAAFSLPPRDPTRAYERIRVTCQ

SEQ ID NO: 3436 - DNA, 2559 bp, Ralstonia eutropha JMP134
  CDS (1)..(2559): transl_table=11
atgcaaaaaagaacagcgcacgctattccgcccagcctgcggccgctcagtgccgtagtcatgatgctcgtcagtgccggcgcgctcggtgcaaaccccgatccacgcccggcgccttcgtccgccgaagtggaattcaatgacctgttcctgcaccagcccggcggaagcgcagtcgatttcagccgcttcaacacgggcaatgtcgtgctgcctggcaactaccgcgcggagctttacgtcaaccaggcatggctcgggcggatggaagtccgcatgggcgagacggcgggcaaggatagtccggtactgccttgcttcgatgagccactgcttgttcggatcggcgcggatgccaacaagctcacgccggaagcgacggcatccgtgcaagatcgcgacgcttgcgtgccgctgcatgccatcatcgctggtgccaccgcgagcttcgacagcagcgaacaacggctcgatgtcagcgtgccacaggccgcgctgacgcggcaggcgcgcgggtatgtggatcctcggtactggagcgacggcgtaaccgcggcgacgctccagtacaacggcagcgtctatcagtcgcgcgcggaagcccgtacggccacgcaaggctatctgggcctcaatgcgggcttcaatgccggcccctggcgcttccgacacaagggcagcctcggcgtcgatcagggcaacgcgcggtaccagagcatacagaccagcttgcagcgctcggtcgttgcgctgcgcagccaactggtgctcggcgatgctttcaccgacggtaccgtcttcgacagcgtcggcttccgtggcgtccagctcgcgagcgacgaccgcatgcaaccggaatcacagcgcggctatgcaccgagcgtgcgcggcatcgccaacagcaacgcgcgcgtacaggtccgccaaaacggcaacctgatctacgaaaccacggtcgcggccggcccgttcgagatcgacgacctctatccgaccggctatggcggcgacctggaagtcgtggtgaccgaagccgacggcagcgtgcatgtttcgcgtgtcccttatgcggccgctgtcaatgccttgcgtcccggcgtcacacgctatggcatcaccgcaggccaataccgcaatgcgggcctgcatgaccgtcctgccatgctccaggccaccgtacagcacggcttcaccaatatggtgaccggctacggtggtgtcgtggtggcagaaggctacctcgccgcagcggctggcgccgcgctcaacacggtctatggtgcgttcggtgctgacctgacccatgcgggcacgcgcctcaccacgcagccggaccgtcatggcttcagcatgcgaatcagctacagcaagctcgtggagcccaccggcaccaacgtatccgtcgcggcctatcgctattcgagcagcggttacctcagctttgccgatgcgatgaccctgcgcgaactcgagcacggcgccatgcaatcgacgatgcgcggcatcccgcgcagccagctccagctcaccctgaatcaacgcctgcagcccggctacgggtccctgtatctgtccgggtcagtacacggctactggaaccgcagaggcaccgacacgcagttccagctcggctacaacaacagctacaagtcgctgaactatggcgttgcggcatcgcgccagttcagcgtgtcgagcggtcgctgggaaagccgcgttatgctcaatatcggcatcccgctgggcaaggcccggcatgcgccgtatgccatgaccggcatcgagcgcgattcgtccggagcggtgagcctgcagcagtcaatgactggctcgctcggcgccgacaacgccttcagctacggcgtgaatgccggctatgccggcggtagcggccgccatgctgcaagcctcgcgggtaatgcgtcttatctgtctcccgtggctacgctgacggcaactgctggcaagggcagcaactattcgcaagtgtccgcgggcatctcgggcggcgtcgtggcctatgccggcggcgtgggcttcacgccgacgatgggcgagacgcttgccatcgtcgaagccgccgacgctggcggagcccggctcgccaacgggagcgggctgcgtatcgatcgctggggccacgcggtggtgcccggactggtgccgttctcgcgcaaccagatcgagatcgatccgaagggcctgccgatgaacgtggagctggactccacgctccagcaggttgccccgaccgcaggcgccgtggtggcggtccggttcgcgaccgcggatcgcggacggcctgcggtcatccgcaccagcacggccgatggcaagtcgattccattcggcgccgaagtacaggatgctcacggcaacaacattggcaccgttggacaaggcagccgcatcgttgcgcgcggcctgcgggccgaacgtggccagttgaccgtgcggtggggcaagacggcgcaagacagctgccgactcgactatgtgctgcccgccgcagcgcggcgcgatacgcgcattgaggtcatcgaggcgcagtgccattga

SEQ ID NO: 3437 - protein, 852 aa, Ralstonia eutropha JMP134
MQKRTAHAIPPSLRPLSAVVMMLVSAGALGANPDPRPAPSSAEVEFNDLFLHQPGGSAVDFSRFNTGNVVLPGNYRAELYVNQAWLGRMEVRMGETAGKDSPVLPCFDEPLLVRIGADANKLTPEATASVQDRDACVPLHAIIAGATASFDSSEQRLDVSVPQAALTRQARGYVDPRYWSDGVTAATLQYNGSVYQSRAEARTATQGYLGLNAGFNAGPWRFRHKGSLGVDQGNARYQSIQTSLQRSVVALRSQLVLGDAFTDGTVFDSVGFRGVQLASDDRMQPESQRGYAPSVRGIANSNARVQVRQNGNLIYETTVAAGPFEIDDLYPTGYGGDLEVVVTEADGSVHVSRVPYAAAVNALRPGVTRYGITAGQYRNAGLHDRPAMLQATVQHGFTNMVTGYGGVVVAEGYLAAAAGAALNTVYGAFGADLTHAGTRLTTQPDRHGFSMRISYSKLVEPTGTNVSVAAYRYSSSGYLSFADAMTLRELEHGAMQSTMRGIPRSQLQLTLNQRLQPGYGSLYLSGSVHGYWNRRGTDTQFQLGYNNSYKSLNYGVAASRQFSVSSGRWESRVMLNIGIPLGKARHAPYAMTGIERDSSGAVSLQQSMTGSLGADNAFSYGVNAGYAGGSGRHAASLAGNASYLSPVATLTATAGKGSNYSQVSAGISGGVVAYAGGVGFTPTMGETLAIVEAADAGGARLANGSGLRIDRWGHAVVPGLVPFSRNQIEIDPKGLPMNVELDSTLQQVAPTAGAVVAVRFATADRGRPAVIRTSTADGKSIPFGAEVQDAHGNNIGTVGQGSRIVARGLRAERGQLTVRWGKTAQDSCRLDYVLPAAARRDTRIEVIEAQCH

SEQ ID NO: 3438 - DNA, 2643 bp, Burkholderia xenovorans LB400
  CDS (1)..(2643): transl_table=11
atgaaggacttcccctgttgccgctcgctcgttcgcgccggtgaacctggcggcgcgtttgggctcaaccccgtcgccgcagttgttgcgctggcgttcgcggtgctgggcggtgtccagccgatagtcgcacaggcgtccgggcaggccgaagcgggcgcggcagtggagttcgactcaacttttctgcgcgtcgatccgaatgcaacggtggacgtctcgcgcttcacgcgtggcaacccgatgtccgaaggcgtttattccgtcgacgtgctggtcaacggtgtgcgtgttgcgcgccatgatgtgcggtttgtggccaccagcggaacggctacggcgcgtccctgtttcagccggcaaatgctggaaacgctcggcgtcgattttgccagggtcgcggcgagcagcgacgcgaagacgccggccgaaaccggcgttaccggtgaatgcgtcgaccttgcggcgaccgtgcccgacgcgatggtcgacttcgacttcgcggaacaaaagatcgccctcagcgtgccgcaaaagtacatgcgaaacgctgcgcgcggttacgtgccgcctgacatgtggcagaccggagtcaacgcggctttcctgagctacaacgcaaacgcgtaccacagcgccggatcgggcgttgaatcgacgcagagctatgtcggcttgaatgccggggtgaacctcggcgcgtggcacttccgccatcagtcgtcggtgacgcagcaagctggcgcagccacacaattcgacaacatcgcgacttaccttcagcgtgacatcaccagaataaagtcgcaattgacggtcggcgacggctacacgaccggcgatgtattcgacagcgtgcagtttcgcggcgcgcagatcgccaccgacgaccgcatgctgccggaatccttgcgaggctacgcgccgatcgtgcgcggcacggctgaatcgaacgcgcgcgtgacggttcgtcagaacggccaggtgatctatgaaaccaccgtttcgccgggtccgttcgaaatcaacgacctttacgcgaccggctatggcggcaacctggatgtcaccgtcaccgaagccaatggccgtaccaaaagcttcactgtgccttacgcctcggttgcccagtcattgcggcccggcaccacacggttttcagtcaccgccggcgagctccgcaattccacgctcgagacaaacccgaatttcgcgcagttcacgctacagcgcgggctgaccaatctggtcacggtctatggtggtgccgtggccgctaatggttacatggccgccgacatgggcgccgcactgaacacgaagttcggcgcgctgtcagccgacgtgacaggcgctcaaacgcagattccggatcacggcacgttgcgcggcacgagcttgcgcatcggttacagcaagttcatcgatccgaccaacacgaacattgcaatcgcagcgtatcgctattcgacggcggggtacatgaacctgtcggatgccgcgtccgtgcgtgacctcgccatgcacggcggcaatccggattcggtgtaccggcagcgcaaccgttttcaggtcacgctcaatcagaacttcaaggaatacggcacggtctttctgaacgcttccgcccagcaatactggaatcgcagcggcagcgacgtgttctaccaggccggctacaccaaccgtttcaagtacggtacgtacagtatcagcgcggggcgcacgcgcaactcgaacgggtcaatgtcggatcagattatgttgagtaccacgttgccgctcggtcgcgaccagcattcgccgctgctgtcggcgaacctcagcagttccggtggaaacgccaacctgcaggccaacgtgagcggctcgttgggcgagcgcaaccagttctcgtacagcgggtatggggcgtacggcgacggtccgggcgccagcacggcgagcgcgggcgcgagcggcacctatcgcacgccgtacgcgcagttgacgggatcggcgagcggcggaaccggctccagccaggtgtcggcgggtatcagcgggtcgatcgtcgcgcatccgggcggtgtcacgttctcgcagacggtgggtgacacgttcggcgtgatcgaagcaccgggcgcagcaggcgcgagcgtgaccagttcgcccggcgtgaaactcaatgggcgcggctttgcggtcgttccgtacctgacaccctatggcatcaacacggtggatatcgatccgaagggcacgtcgaccgatgtcgagtttgaatcgacgtcggagcaggcggtgccgcggctgggctcagtggtgatgatcaggtacaagacggtgaccggacgcgcggcattgattcgtgcgccgcaactcggcgacaaggcgctgccgtttggcgcggacgtggtcgatgcaaccgggcggacggtaggcgtcgttgcgcaggacagtcggattttcgcgcgcgggctcgaggacaaaggctcgctgttcgtgaaatggggcgcgtcggcttccgagcaatgccgcatcgagtacgtgttgccgaggcaaacgggtaaagcaggagcggcctacacgtctgtggaagggcattgtgtgggcgggacaccaaccgaaaacacgaactttgcttctggccgtaccaggtaa

SEQ ID NO: 3439 - protein, 880 aa, Burkholderia xenovorans LB400
MKDFPCCRSLVRAGEPGGAFGLNPVAAVVALAFAVLGGVQPIVAQASGQAEAGAAVEFDSTFLRVDPNATVDVSRFTRGNPMSEGVYSVDVLVNGVRVARHDVRFVATSGTATARPCFSRQMLETLGVDFARVAASSDAKTPAETGVTGECVDLAATVPDAMVDFDFAEQKIALSVPQKYMRNAARGYVPPDMWQTGVNAAFLSYNANAYHSAGSGVESTQSYVGLNAGVNLGAWHFRHQSSVTQQAGAATQFDNIATYLQRDITRIKSQLTVGDGYTTGDVFDSVQFRGAQIATDDRMLPESLRGYAPIVRGTAESNARVTVRQNGQVIYETTVSPGPFEINDLYATGYGGNLDVTVTEANGRTKSFTVPYASVAQSLRPGTTRFSVTAGELRNSTLETNPNFAQFTLQRGLTNLVTVYGGAVAANGYMAADMGAALNTKFGALSADVTGAQTQIPDHGTLRGTSLRIGYSKFIDPTNTNIAIAAYRYSTAGYMNLSDAASVRDLAMHGGNPDSVYRQRNRFQVTLNQNFKEYGTVFLNASAQQYWNRSGSDVFYQAGYTNRFKYGTYSISAGRTRNSNGSMSDQIMLSTTLPLGRDQHSPLLSANLSSSGGNANLQANVSGSLGERNQFSYSGYGAYGDGPGASTASAGASGTYRTPYAQLTGSASGGTGSSQVSAGISGSIVAHPGGVTFSQTVGDTFGVIEAPGAAGASVTSSPGVKLNGRGFAVVPYLTPYGINTVDIDPKGTSTDVEFESTSEQAVPRLGSVVMIRYKTVTGRAALIRAPQLGDKALPFGADVVDATGRTVGVVAQDSRIFARGLEDKGSLFVKWGASASEQCRIEYVLPRQTGKAGAAYTSVEGHCVGGTPTENTNFASGRTR

SEQ ID NO: 3440 - DNA, 2553 bp, Ralstonia metallidurans CH34
  CDS (1)..(2553): transl_table=11
atgcgtcagtcatctccaactctcccagtgcgccgtcagatcagtctggctgcgtgtctgctggtagccagcgcggccgccatggccgccgacggcgggagcctggtggctgaggcgaagttcagcagcatgtttctgcgccagtcacccggcgagcagatcgatctgagccgcttcaaccggggaaacgcggcactggccggcacttaccgcgccgacctgtatgtcaaccagacctggatcggccgcgccgacgtgacgctgcgcgccgtcgacgggaatggcagtaatgtccaaccgtgctttgaccgggcgcttctcgagcgcatgggggtggatctgaccaagctcaagccgcaggccagcgcacgcctggagggcgagggggcttgcgtcgcgttgccggagatcatcgaagatgcaacggcaacctttgataatggcgagcagcgcctggacgtgagcgtgccgcaggcgaacatgtcgcgccaggcccgcggctatgtggatccgaagtactgggacgaaggcatcaacgccgcgcgtttgcagtacaacgccaatgtgtatcacagcgacagccagggcatcgcttcgacccagggttacctgggtctggacgccggcgtgaacatcggcgcctggcgttttcatcatcggggaaacttcacacacgaccagcagactggtaatcactaccagagcgtgcagacgaacttgcaacgctcgatcgtgccgctcaagagtcagctagtgattggcgaggccttcaccgatgggtcgctgttcgacagcgtgggcttccgtggcgtgcagctggccagcgatgaccgcatgtatcccgagtcgcagcgcggttatgcgccgatcgtacgtggcattgcccagagcaacgcgcgggtgcagatccgccagaatggcaacatcctctatgacaccacggtttctgccggtccgttcgagatcaacgatctctatccgactggctacggcggtgacctggaagtcagcgtcaccgaggccgacggcagcgtgcatgtctcgcgtgtgccctacgcggccgccgtcaacgcgctgcgccccggtgtcacgcgctatagcgtcacggcgggccagtaccgcaatccgagcgttcatatctcgccgctcctgctgcagggcacggtacagcacggtttcaccaatctcttcaccggctacggaggcttcgtggcatcgcctcactacatcgccggcctgttgggggcagcgctgaacaccgactatggcgccttcggcgcggacatcacccatgccaccacgtggctggttaatgagcccagccgcagtggccagagcgtgcgcctttcctacagcaagctggtgcagccgaccaacaccaaccttacgctggccgcttaccgttactccagcggaggctatctgggtctggccgacgcgatgaacctgcgggacctggatgaacgcggcatggcctctgccatgagtggcatccagcgcggtaggttccaggtcactgtcaaccagaacctcaggcagggctggggcaacttctatctgtcgggttctgtgcaggactactggaaccgcaatggccgcgatacccagctccaggctgggtacaacaacagctacaagcgtatcaactacggcgtctcggtctcacgccagctcaacgtcacgaccaacaagtgggacaaccgcgtgatgctcaacgtgggcatcccgctgggcaagagtccgcgcgcgccgtattcgatgaccagcctgcagcaggattcctcgggcagcaccagtctgcacgaaacggtgacgggcacgcttggcagggacaacgccgtggcctacggtatcaacgtgggccgcaacagcggcaatggggcggccagcaccagcgtaggtggcaatgtgtcctatgtatcgccggtgacgacgctcagcgcgagtgcgagcaggagcagcaattacacgcagatgagcgcagggctggccggcggcatcgtggcgtacgcggggggcgtggcgttcacaccgagcctgggcgatacggtggcggtcgtggaggccaaggatgcggccggcgcgcggctgaccaacggcagcggcctgcgcgtggatccttggggccatgcggtggtatcgaacctgacgccgtttgcgcgcaatcaggtcgagattgatccacagggactgccgatgaatgtggagttgaagtcgaccatgcagcaggtggcgccgaccgccggggccatcgtgaagctgaagttcgacaccgagaacgccggccgcatggcgatcctcgaggtcaggcgtgctgatggcaagccgttgccgtttggggccgaggtgcgggacgcgggtggccagcctgtgggcacggtgggtcagggcgggcgcatcatcgcgcgcgggctcaagaccgacagcggcaccctcagcgtggcgctgggggaggacgcagccaaatcatgccaactgcgctaccagttgcctcaggagcggaacgaccgccccgcttcggtggccctgatgcaggcgacgtgcgcggaatga

SEQ ID NO: 3441 - protein, 850 aa, Ralstonia metallidurans CH34
MRQSSPTLPVRRQISLAACLLVASAAAMAADGGSLVAEAKFSSMFLRQSPGEQIDLSRFNRGNAALAGTYRADLYVNQTWIGRADVTLRAVDGNGSNVQPCFDRALLERMGVDLTKLKPQASARLEGEGACVALPEIIEDATATFDNGEQRLDVSVPQANMSRQARGYVDPKYWDEGINAARLQYNANVYHSDSQGIASTQGYLGLDAGVNIGAWRFHHRGNFTHDQQTGNHYQSVQTNLQRSIVPLKSQLVIGEAFTDGSLFDSVGFRGVQLASDDRMYPESQRGYAPIVRGIAQSNARVQIRQNGNILYDTTVSAGPFEINDLYPTGYGGDLEVSVTEADGSVHVSRVPYAAAVNALRPGVTRYSVTAGQYRNPSVHISPLLLQGTVQHGFTNLFTGYGGFVASPHYIAGLLGAALNTDYGAFGADITHATTWLVNEPSRSGQSVRLSYSKLVQPTNTNLTLAAYRYSSGGYLGLADAMNLRDLDERGMASAMSGIQRGRFQVTVNQNLRQGWGNFYLSGSVQDYWNRNGRDTQLQAGYNNSYKRINYGVSVSRQLNVTTNKWDNRVMLNVGIPLGKSPRAPYSMTSLQQDSSGSTSLHETVTGTLGRDNAVAYGINVGRNSGNGAASTSVGGNVSYVSPVTTLSASASRSSNYTQMSAGLAGGIVAYAGGVAFTPSLGDTVAVVEAKDAAGARLTNGSGLRVDPWGHAVVSNLTPFARNQVEIDPQGLPMNVELKSTMQQVAPTAGAIVKLKFDTENAGRMAILEVRRADGKPLPFGAEVRDAGGQPVGTVGQGGRIIARGLKTDSGTLSVALGEDAAKSCQLRYQLPQERNDRPASVALMQATCAE

SEQ ID NO: 3442 - DNA, 2604 bp, Ralstonia metallidurans CH34
  CDS (1)..(2604): transl_table=11
atgaagccggtatcaagaatccctcattcgatcccaagtcgcctgtgtcaggtgagcgcagtcgtgctctcgatgttcgcgggggcggtagtcacgcccgccatggccacttccacggacgcgccggtgggcgtgacgatagccgccgtggaatttaacgatacctttcttcatagcccggacgggatgcggctggatatctcccgattcaatcagggcaacttcgcgaccccaggcagctaccgtgccgacctgtatgtcaatgatgcctggctgggccgcgccgaagtcaaccttcgcgcgattggggatgacgcgcacaacgtgcagccttgcttcgatcacgacatgctcgaacgtatgggcgtcgatctcgccaagctgccgccagaggcaatcgcgcggctccaggatgggtctggctgcgaacagattcccgcgctgatccccgcggccaccgcgacgttcgatactggagagcaacgtcttgacgtgagcatcccgcagctctatatgaggcgttctgcgcgcggttatgtcgacccgaaatactgggataacggtattcccgccgcgcggttgcagtacaacgccaatgcctaccattcggatagcgccggggtctcgtacacgcagggcttcgtggggctcgacgcaggtttgaacctgggaccatggaggttccaccacaacggcaatctgtcgtatagcagtggcggagggcagccgggcgccacgcactaccaggcggtgcagaccaacctgcaacggtcgattaatgagatcaagagccagctcacgctgggcgatgccttcaccgatggccggatgttcgacagtttcggctttcgcggtgtccagctggcgaccgatgaccgcatgtatccggactcgcaacgcggatacgcgccgacgatccatggcatcgccaacagcaacgcgcgggtacagattcgccagaacggcaacatcatttacgaaaccacggtcgccccgggcgcgttcgagatcaacgatctgtatccaaccggctacggcggcgacatcgacgtggtggtgaccgaagccgatgggtcgcagcatgtctcccgcgtgccgttcgcgccgatggccaatgcgctgcgcccgggcgtaacgcgctatggcgtgacggccggtcagttccgcaataccagcatctcaagcaagcccggcgtgttccaggccacgatccaacacggcctgtcgaacatgttcaccgcctacggtggcgcgctggtgtccgagggctactggtccgcgctggcgggtctggccatgagcacggactttggcgcgatcggcctcgatgtcacgcaagcgtcgacacacctgacttcggagccggatcgtagcgggcaaagcatccggctgtcgtacagcaagctggttgccccgaccaataccaacctgacgctggcggcctatcgttactcgacgcgcggctatctgggcttttccgacgcggtgatactgcgcgatctcgattcgcgcggactcggcttttccgcggtgggcacggtgcgtggccggttgcaggtgatgctcaatcagatgctttcggcgggatacggcagcttctatctgtcgggatcgacccaggactactggaaccgggatggccgggacacgcagttccaggccggttacagcaatatctacaggggtgtcagctacgggatttcggcggccaggcagctcagcctcaataccggcaagtgggacaaccgcgtgatgctgacgctgacgctgccgctcggcaagtcaccgttcgcgccgtactcgacgaccagcctccagaaggactcgcagggggcaactaccttgcaggagaccctttccgggacgctcggcgccgatcatgcgctgtcgtactcggtctccgccaatcatgccagcggtggcgacgcgcctaccaacaacagcgccagcctcaatgcctcctacatatcgaggatggcgacgctatcgggcaacgtgagtaagggcacgaactacacgcaggcgggcgtgggcatctcaggcggtgtggtggcttaccagggcggtgtcacgttcgccccgcgcttcggcgataccgtcgcggtcatcgaggccaaggatgcggtgggcgcgcaggtgctcaacgatacgggcctgcgtatcgatcgatgggggcacgcggtggtctcgaatctgaccccgttctctcgcaacgagatcaacctcgatccgaagggattaccgctgaacgtcgaactgaagtcgaccatgcagaacgttgccccgacagccggcgccgtggtgaaggtgctgttcgaaaccgataacccgggtcgtgccgtggcgctgcgcatcaagctaccagacggcagcccgttgccgttcggtgcggaagtgctggacgacaatggccggtccttcggcacggtggcccagggtggattggcgatcctacgtggcgtgaaggacgacagcggaacgttgctggccaagtggggcgcgggcccgaaggattcgtgctcgctgtcctatgcattgcccggcgtcgacgcggctcctgccgggttggtacaggcgggtgcggagtgccggccgaacccgtga

SEQ ID NO: 3443 - protein, 867 aa, Ralstonia metallidurans CH34
MKPVSRIPHSIPSRLCQVSAVVLSMFAGAVVTPAMATSTDAPVGVTIAAVEFNDTFLHSPDGMRLDISRFNQGNFATPGSYRADLYVNDAWLGRAEVNLRAIGDDAHNVQPCFDHDMLERMGVDLAKLPPEAIARLQDGSGCEQIPALIPAATATFDTGEQRLDVSIPQLYMRRSARGYVDPKYWDNGIPAARLQYNANAYHSDSAGVSYTQGFVGLDAGLNLGPWRFHHNGNLSYSSGGGQPGATHYQAVQTNLQRSINEIKSQLTLGDAFTDGRMFDSFGFRGVQLATDDRMYPDSQRGYAPTIHGIANSNARVQIRQNGNIIYETTVAPGAFEINDLYPTGYGGDIDVVVTEADGSQHVSRVPFAPMANALRPGVTRYGVTAGQFRNTSISSKPGVFQATIQHGLSNMFTAYGGALVSEGYWSALAGLAMSTDFGAIGLDVTQASTHLTSEPDRSGQSIRLSYSKLVAPTNTNLTLAAYRYSTRGYLGFSDAVILRDLDSRGLGFSAVGTVRGRLQVMLNQMLSAGYGSFYLSGSTQDYWNRDGRDTQFQAGYSNIYRGVSYGISAARQLSLNTGKWDNRVMLTLTLPLGKSPFAPYSTTSLQKDSQGATTLQETLSGTLGADHALSYSVSANHASGGDAPTNNSASLNASYISRMATLSGNVSKGTNYTQAGVGISGGVVAYQGGVTFAPRFGDTVAVIEAKDAVGAQVLNDTGLRIDRWGHAVVSNLTPFSRNEINLDPKGLPLNVELKSTMQNVAPTAGAVVKVLFETDNPGRAVALRIKLPDGSPLPFGAEVLDDNGRSFGTVAQGGLAILRGVKDDSGTLLAKWGAGPKDSCSLSYALPGVDAAPAGLVQAGAECRPNP

SEQ ID NO: 3444 - DNA, 2520 bp, Pseudomonas aeruginosa UCBPP-PA14
  CDS (1)..(2520): transl_table=11
gtggccatatttaggaaaaggttcgacctcaaggtgtccgtctattccaggtcttcctgtctcgtggccttgggattggctttgcctgccgtaacttccgcggtggaattcaacgccgagttcctgaacaacgagggcggggcgcccgttgaactgaagtatttcgagaacggcaactcggtgtcgcccggcacttacagcgtcgacattcatttgaaccagatcatgatccggcgcgaagatgtcgtgttcagtgccgatcccgacaccggaagcgttcgcccgatcattcggatgggcctgctcaaggagattggggtcgatatcgcccggctgactcgggacaagctcattccggccaacctggaaaacaatacgcccctgaatgtcgccgaactcatccccggtgcatccgtagagttcgacgtcaacagcctttccctgctggtcagcattccacagctgtatgtacagcggcactcgcgtggctatgtggatccctctctttgggatgacggcgtcaccgcgttgttttccaactaccaggccaacttcacgcgcaacaccaattttggccagaacagcgattaccgctacctgggtctgcgcaacggcttcaacctgtttggctggcgcctgcgcaacgactcttccctgagcggaggtaccggcatgcgcaacaagttcagtagcaaccgtacctatgtggaacgtgacattcgtgccctgaaggggaccttgtccctcggtgagttgtatacctccgctcagggggatgctttcgagagcgtgcgtatgcgcggcgtgcaactgcaatccgatatcggcatgctgcccgacaacgagatcagctataccccggtggtgcgcggtatcgctgaaaccaatgcgacggtcgaggtgagtcagaatggcttcgtgatctattccaccaacgtaccgcccggtgcgttcgagatcaccgacatctatcccagcggctccaatggcgacctggaggtcaagatcatcgaggcggacggacgccagcggtccttcaagcagtcctattcctacctgccggtcatgacccgcaaggggaacctgcgctatggcctggccgccggtgaataccataatgacggccagccgtcggtcaacctgctccagggatcggctgtgtatggcttgtccgacagggttaccggctttggcggcctgctggctgcggagaagtacaatgccaccaacctgggcctcggcttcaacacgcccctgggcggtctttctgcggacgtgacccatagccagtcccgcacgcgacggggtgggcgcaaccaggggcagagtctgcggcttctctattccaagaccatcaacgccaccgaaaccagctttaccgtggtgggctatcgctattccacggaaggctaccgtactctcagccagcatatcgacgacatgtccgacgagagctacctctatggctcaagttccagtcggcagaagagccgcatagacctgacggtgaaccagacgctgttccgacgcagttcgctctatctcacggcgggcgaaaccacatattggaatcgccccggcagcagccgtcgcgtgcagttcggcttcagcagcggcatcaagcgcgcgagctacagcctggcggtttcccgtacccaggagacggggtcgttcgggcgctccgatacccagttcacggcctccgtcagcatccccttgggcggtagcgcacgctccagtcaggtatatgccaatgccgtgagttcacagcatggtgattcgagtctgaacaccggtatctccggatacctggatgaagccaatgcgttcaactacagcgcacaggccaactacagcaaggacggcggcaactccggcagcgtcggcctgggttgggacacgtccaaggccaagttgtccgccaattacagccaggggcgcgacaacaagcagatcaacctgggagcaagcggttcggtagtggtgcatccggggggagtgaccttcggccagccggtgggggaaacgttcggcctggtggaggttccggaggttggcggcgtcggcctcgacggctactcttcggttcgcaccgacggccgtggctatgccgtgctcccctacatgcaaccctatcgttacaactgggtgaacctggataccaatacccttggaagcgataccgagatcagcgacagcacgcaaatggccgtgccgacccggggcgccgtggttgccaagcgtttctccgcggagtccggtcggcgggtgcagttcgtcctgagcatggagtctggaggaaagattcccttcggtgcacaggcatacgacaaggaagagcgggtcgtgggaatggtcgacaacctgtcccgtttgctggtgttcggtatcgaggaccaggggcgcctgtccattcgctggagcgatggctcctgttcagtcgactatcagttgccgcccaggaacaaggacctgacgtacgaacgagttgcgctcagttgccgtcggtcctcgatctga

SEQ ID NO: 3445 - protein, 839 aa, Pseudomonas aeruginosa UCBPP-PA14
MAIFRKRFDLKVSVYSRSSCLVALGLALPAVTSAVEFNAEFLNNEGGAPVELKYFENGNSVSPGTYSVDIHLNQIMIRREDVVFSADPDTGSVRPIIRMGLLKEIGVDIARLTRDKLIPANLENNTPLNVAELIPGASVEFDVNSLSLLVSIPQLYVQRHSRGYVDPSLWDDGVTALFSNYQANFTRNTNFGQNSDYRYLGLRNGFNLFGWRLRNDSSLSGGTGMRNKFSSNRTYVERDIRALKGTLSLGELYTSAQGDAFESVRMRGVQLQSDIGMLPDNEISYTPVVRGIAETNATVEVSQNGFVIYSTNVPPGAFEITDIYPSGSNGDLEVKIIEADGRQRSFKQSYSYLPVMTRKGNLRYGLAAGEYHNDGQPSVNLLQGSAVYGLSDRVTGFGGLLAAEKYNATNLGLGFNTPLGGLSADVTHSQSRTRRGGRNQGQSLRLLYSKTINATETSFTVVGYRYSTEGYRTLSQHIDDMSDESYLYGSSSSRQKSRIDLTVNQTLFRRSSLYLTAGETTYWNRPGSSRRVQFGFSSGIKRASYSLAVSRTQETGSFGRSDTQFTASVSIPLGGSARSSQVYANAVSSQHGDSSLNTGISGYLDEANAFNYSAQANYSKDGGNSGSVGLGWDTSKAKLSANYSQGRDNKQINLGASGSVVVHPGGVTFGQPVGETFGLVEVPEVGGVGLDGYSSVRTDGRGYAVLPYMQPYRYNWVNLDTNTLGSDTEISDSTQMAVPTRGAVVAKRFSAESGRRVQFVLSMESGGKIPFGAQAYDKEERVVGMVDNLSRLLVFGIEDQGRLSIRWSDGSCSVDYQLPPRNKDLTYERVALSCRRSSI

SEQ ID NO: 3446 - DNA, 2403 bp, Escherichia coli
  CDS (1)..(2403): transl_table=11
gtgctcttctgtcggactgcacttgcgtttgctgtgtcagccgctttcgtcagtgccacaggtgttgcgagtgaaaaactggatatgtcctttatccagggggggggcggagttaatccggatgtctgggcagccctgaacggcagctatgcgccggggcgttatctggttgacctgtccctgaacgggaaggaggtcgggaaacagatactggatgtgacaccacgggagagtaatgaactgtgtctgacagaagcatggctgacgaaggcaggaatttacgtcagtgcagattattttcgtgagggatatgacgccacacgacagtgttatgtgctgacaaaagcgccgtcagtgaaggtggattttgatgtttccacccagagtctggcactgtctgttccccagaaggggctggtgaagatgccggagaacgtggattgggattacgggaccggtgcatttcgcgtgaactataatgcgaacgccaacaccggtcgcaataacacctcagcctttggctcagcagacctgaaagccaatatcggacgctgggtggtgagttcttctgccacagccagcggtggcgacagtgggggtaacactgccacgataaatatgttcacggccacccgggccatccgcgcactgagtgcggacctggcggccgggaaaacatccaccggggatagtctgcttggcagcacaggaacgtatggagtgtcgctgagccggaacaacagcatgaagccgggcaatctggggtatacccctgtgttcagcggcattgcgaacgggccgtcgagggtgacgctgacacagaacgggcggttgctgtattcggagatggtgccgacaggtccgttctccatcaccgatgtgccgttgtataccagtggtgatgtgacgatgaaaatcactggtgaagacggacgagagcagacccaagtcttcccgttatcggtaatggccgggcagttaagcccggggcaacacgagttcagcgtggcagccggtttgcctgacgatgacagtgacctgaaaggcagcgtgctggcggcgtcatatggttacggtctggacgggctgacgctgcgcaccgggggagtttttaaccaggactggcagggtgtcagcgccggagctgttctggggctgagttacctgggggcagtatctgctgacggggcttatgccaaggcaaaataccgtgacggcagccgcagcggaaataaagtgcagttatcctggagtaaacaactggagatgacgaacaccggactgcgggtgagctggtcacggcagagtgaggaatatgaggacatgtcctcctttgacccgacagagctgtggtcacagtcaaatcatggtcgccggacgaaggatgagtggaatgctggtatcagtcagccggtgggtggattgttcagtctgtcggtgtccggctggcagcggagctattaccccgcatccatgaccgggagttaccggtacagcgatgacaacggtaaagacacaggtattaccggcaccatgagcacacagattaagggcgtcagtctgaatctgggctggtccggttcacggaacactcgggggggaaacaactggtctgcatcggcgtcagtatcggtaccgttcacactgtttgaccgccgttacagcagcagtacgtcggtgagcaccagcaaagacggtggtactggtttcagcactggcgtatccggctcgctgaatgaccgtttcagctatggtctgggcggtgggcgtgacagcagcggtggtgtgagcagttatctgaatgtgtcgtacagtggtgaccgggcttatctgagtggagctctgaacaactcgcagtccggcggaaccagcggttctgtatcggccagcggttcggtactggccgttccggcggcgaaagacattatgttcagccgcacgaccggggacaccgtggcggttgtgaacgtgaaggatacacccggagtgaaggtgacgtccggtgacggacagactgacagcgacggcaacctggtggtaccgctgaacagctatgactggaacacggtgacgattgatgcgggtacactcccgctgagcaccgaactgacgaataccagtcagaaggtggtgccgacggacaaagcggtggtctggatgccgtttgactccctgaaagttaagcgttacctgctgcaggtgaagcagcgtgacggtgagtttgtgccagggggaacgtgggcacgtgacagtaagaacacaccgctgggctttgtggccaacaacggtgtgctgatgattaacacggtggatacaccgggtgatattaccttggagcagtgccggatacctgcggccagactgcaggatactgagaaattacaggagattacgtgtgagtaa

SEQ ID NO: 3447 - protein, 800 aa, Escherichia coli
MLFCRTALAFAVSAAFVSATGVASEKLDMSFIQGGGGVNPDVWAALNGSYAPGRYLVDLSLNGKEVGKQILDVTPRESNELCLTEAWLTKAGIYVSADYFREGYDATRQCYVLTKAPSVKVDFDVSTQSLALSVPQKGLVKMPENVDWDYGTGAFRVNYNANANTGRNNTSAFGSADLKANIGRWVVSSSATASGGDSGGNTATINMFTATRAIRALSADLAAGKTSTGDSLLGSTGTYGVSLSRNNSMKPGNLGYTPVFSGIANGPSRVTLTQNGRLLYSEMVPTGPFSITDVPLYTSGDVTMKITGEDGREQTQVFPLSVMAGQLSPGQHEFSVAAGLPDDDSDLKGSVLAASYGYGLDGLTLRTGGVFNQDWQGVSAGAVLGLSYLGAVSADGAYAKAKYRDGSRSGNKVQLSWSKQLEMTNTGLRVSWSRQSEEYEDMSSFDPTELWSQSNHGRRTKDEWNAGISQPVGGLFSLSVSGWQRSYYPASMTGSYRYSDDNGKDTGITGTMSTQIKGVSLNLGWSGSRNTRGGNNWSASASVSVPFTLFDRRYSSSTSVSTSKDGGTGFSTGVSGSLNDRFSYGLGGGRDSSGGVSSYLNVSYSGDRAYLSGALNNSQSGGTSGSVSASGSVLAVPAAKDIMFSRTTGDTVAVVNVKDTPGVKVTSGDGQTDSDGNLVVPLNSYDWNTVTIDAGTLPLSTELTNTSQKVVPTDKAVVWMPFDSLKVKRYLLQVKQRDGEFVPGGTWARDSKNTPLGFVANNGVLMINTVDTPGDITLEQCRIPAARLQDTEKLQEITCE

SEQ ID NO: 3448 - DNA, 2532 bp, Proteus mirabilis
  CDS (1)..(2532): transl_table=11
atggttaataagaatactaataaagatatcgtttattttctctttccaagtgtcattgcattgtcattgacgctgtccttttcatcatatagcgcaaaccgatttaatcctgcatttttggctgactctcctgatgccgtcaccgatttaagttattttgaagcaggcaaccgcattaaacccggtgattatcttcttgatattgtttttaatcatgagtatctgcgtagtgaaaatattcattttattagtcaagataaccatgttattccttgtttaaatcgagattattatcaatcactcgggatcaatattaaactatttgctgattttgagaaattctcggcaaatgaatgtattgatattgaaaaaatcattccagattctgttgttaattatgatattgagaaacaagctttaaatattcaagtccctcaagccgcgttagatttgaaagcacgcggttatattccaccagaaaaatgggataacggtataacagcaggtattttaaactacacctttagtggcgctaatagctggggaaattctcataataatagctactacttaaatctacgtagtgggatcaatattggtgcttggcgattacgcgattattccacttggaattcgtcaaacgggaaaaaccaatggaaccatatcaatacctatctgcaacgcaatattgtgtcattaagaagccaattacaaattggtgatagttatacctcatcaacactttttgacagtgttaattttcgaggtatttcattagaaagtgacgacactatgctacctgatagccaaagaggatttgcacctgtagtcagaggtattgctaaaggcaatgctaaagtggtgatccgccaaaacggttatgtgatttatcaaacctttgtttctccgggtgcttttgaaatccgtgatctctatccaacgtcaaatagtggcgacctctatgtcaccattgaagaaaatgatggtagcaaacacagctatgttgtgccttattctgctgtacctattttacagcgagaaggccaaaaacagtttgtcatccaagccggtgaaatacgccaaaataaccaacataaaaaacctcgctttatacaaggtcatcttatttatggcttaccctatgacaccactgtctatggtggtgcattagcaacaaaagattaccaatcttatgccctaggagcaggtaaaaatatgggtaccctaggtgccttctctaccgatatcacctttgctcatagccaattgccaaataactcaacatcagatggttattctttacgttttctttatgccaagtcgttaaaccaatttggcacaaactttcaattgctcggttatcgttactctacttcgggtttttacacattagatgagacattaaatacgcgtatgtccggttatctgtatgaagataatcaaaaaaaaccgttgagttattttaatttgcataatcgcaagaaagggagcctacaaattaatttatcacaacaactgggggattatggctctatttttatgatgaccaactggcaaaattattggggaactaatgagaaaaatgtcctagtacaaaccggctacaatggcaatattaaagggctctcttataacgtcatttatagttataacagaatgatgaatagtggtcagcgtgaccaaacattgtctgtgggtctttctatcccattacaattgctaatgccgacaagttatcaatccatcaatagcacttatctcacatataattacagccacaataataacggttactcgacacataatgcggggattgctggtacattattggaagacaatacccttaattacagtgttcaacaaggttatagcaatcaaggcggaaactataccggtagtgcggcgttgggttatcaaagtcgctatggcaatttaaatgctagctataactatcatcaagatgctcaacaaattaactatagcctcgctggaggtatgctactccatagtggcggattaaccttaagccaacccttaagcgctaatgccattttagtagatgctcgtaatactgcggatgtaccgattgataatgcgacaggggtttatactgactggcgagggtttgccgttattccctatgctaccgcttatcgacaaaatcgagtggcattagacaccaccgcattacccgataatgttgaaattgagcaaaacattaagcaggtgatcccaacacaaggcgccgtcattaaagttcagtttgatgctaaaaaagggtatcgcttattactgacgctacaacaccaaggtcgcccactcccttttggggcaatagcaactgataaacaaaatcatctgtccggtattgttggcgatgatggcttactctacttatcgggtgtccctgattcaggaaaattagagatccgctgggggcataatgcctctcaatactgtcaagtgaactatcaattacccgcctctcaacttgatgaaccttttgtgaaaatgacacaggagtgccaataa

SEQ ID NO: 3449 - protein, 843 aa, Proteus mirabilis
MVNKNTNKDIVYFLFPSVIALSLTLSFSSYSANRFNPAFLADSPDAVTDLSYFEAGNRIKPGDYLLDIVFNHEYLRSENIHFISQDNHVIPCLNRDYYQSLGINIKLFADFEKFSANECIDIEKIIPDSVVNYDIEKQALNIQVPQAALDLKARGYIPPEKWDNGITAGILNYTFSGANSWGNSHNNSYYLNLRSGINIGAWRLRDYSTWNSSNGKNQWNHINTYLQRNIVSLRSQLQIGDSYTSSTLFDSVNFRGISLESDDTMLPDSQRGFAPVVRGIAKGNAKVVIRQNGYVIYQTFVSPGAFEIRDLYPTSNSGDLYVTIEENDGSKHSYVVPYSAVPILQREGQKQFVIQAGEIRQNNQHKKPRFIQGHLIYGLPYDTTVYGGALATKDYQSYALGAGKNMGTLGAFSTDITFAHSQLPNNSTSDGYSLRFLYAKSLNQFGTNFQLLGYRYSTSGFYTLDETLNTRMSGYLYEDNQKKPLSYFNLHNRKKGSLQINLSQQLGDYGSIFMMTNWQNYWGTNEKNVLVQTGYNGNIKGLSYNVIYSYNRMMNSGQRDQTLSVGLSIPLQLLMPTSYQSINSTYLTYNYSHNNNGYSTHNAGIAGTLLEDNTLNYSVQQGYSNQGGNYTGSAALGYQSRYGNLNASYNYHQDAQQINYSLAGGMLLHSGGLTLSQPLSANAILVDARNTADVPIDNATGVYTDWRGFAVIPYATAYRQNRVALDTTALPDNVEIEQNIKQVIPTQGAVIKVQFDAKKGYRLLLTLQHQGRPLPFGAIATDKQNHLSGIVGDDGLLYLSGVPDSGKLEIRWGHNASQYCQVNYQLPASQLDEPFVKMTQECQ

SEQ ID NO: 3450 - DNA, 2613 bp, Pseudomonas aeruginosa
  CDS (1)..(2613): transl_table=11
atgttctgccacgttgaggcacggcgcaccggcaaactgccgctggctctgggcggcctagcgctggccttcgcgggcctggccaatggagaggcgcagtatcgtttcgacgacagcctgttgatgggctcgggcctcgccggcgggaccctagaacgcttcaaccgggccaaccaggtggaccccggaacctaccatgtcgatgtctatctcaacggcagctacgccagtcgcaccaggatcgagttccgcccccgggccggcggcgtcaaaccctgcttcggcgaacgcttcttgcgccggacgctgggcgtccgccccgcctctgaggccggcgtgcaagcgcctggagattgcctggggctggaagaacgcctgccaggctcgaccttcaatctcgacaccgcccttctgcgcctcgatctctcggtgccccaggccctgctggatatcaagccacgcggctacgtgggtcccgacgagtgggacgctggcagtagcatgggcttcgtcaactacgacgccagcttctatcgctcgagcttcgacggagtaggcggcaacggcgactcggactatggctacctggggctgagcgggggcatcaatttcggcctgtggcgcctgcgccaccagtccaactacagctactccagctatgcgggaaacacccgcagcgactggaacagcatccgcacctatgcccagcgcgcggtgccaggcctgcgcagcgaactgaccctgggcgagagcttcaccgagggcaatctgttcggcagcctgggttatcgcggcgtgcgcctggccagcgacgaccgcatgctggcagactcgcaacgccgctatgctccacaggtacgcggtacagcgaacagcaacgcacgggtggtcatcagccagaacggcaagaaggtccacgaatccgccgtcgctcccggtcccttcgtcatcaacgacctctatggcaccgcctacgacggcgatctggatgtccaagtgattgaggccgacggcagcgtctcgcgcttttccgtgcccttttccgcggttcccgaatccatgcgcccgggcatctcgcgctacagcgccaccctcggccaagcgcgccagtatggcgacggcaacgacctgttcggcgacttcacctatcagcgcggcctgaccaactcgctaaccgccaacctcggctcgcgcctggccgaggactatctggcgctgctcggcggaggcgtgctcgccacgccctacggagccttcggcttcaacagcatcttttcccatgccacggtggagaacggccagcgcaagcagggctggcgtgtcggtctgaactacagccggaccttccagccgacccagaccactctcaccctggctggctaccgctattccaccgagggctatcgcgacctcggcgacgcgctttcggcgcgccacgccgatgagcacaacgactcctggaactccagcagctacaagcaacgcaaccagttcaccctgctggtcaaccagggcctggggggctacggcaacctgtatctgtccggagccaccagcgactactacgacggcaagagccgcgacacccagttgcagttcggctacagcaacacttggcgccagctcagctacaacctcgcctattcgcgccagcagaccacctggtaccgcgatctgaacgacgactacgacccgtcactgccgccgcaatacaacctgcggcacggcagcgaacgtagcaacaccttaaccctgacactttccatgccgctggggtcctccagccaggccccgaatctcagcgcgatggcctcccggcgttccggcgacagccgcggcagcagctaccagacgggcctcaacggcaccctcgacgaagaccgcagcctgagctacgcgattgccgccgggcgcgacagcgacaaccacggcagcgatttcaacggcagtctgcagaaacagacctcggtggcgacgctgaacgccggctatgccgagaacagcagctaccggcagctcaacaccggcctgcgcggcgccgccgtgctgcatcgcggcggcctgaccctcggcccctacgtcggcgacactttcgccctggtcgaggccaagggcgccagcggagctggcgtacgcggtggtcagggcgcgcgcgtcaacggcaatggctacgccgtggtgccatcactctcgccctaccgctacaacccggtcagcctcgatccgcagggcatgggcgaagaggccgagctgctggagaccgagcgcaagatcgcgccatacgccggcgccgccgtgcatgtgaagttccgcacactgaccggtcacccattgctaatccaggcccaactcgccgacggcagcgcgctaccgctaggggccaatgtgctcgacagccagggtgtgaacatcggcatggtcggtcaaggcggccaggtctatgcccgcgccgagggcgacaagggccgcctgcgcgtgcaatggagcgaacgcccaggggacgcctgtctgctggattacgacctcgacactggccctcgccaggctatcgaacccggacaggcggtgatccgcctgcagggcacctgcacgcccgtctcggaggcaccatga

SEQ ID NO: 3451 - protein, 870 aa, Pseudomonas aeruginosa
MFCHVEARRTGKLPLALGGLALAFAGLANGEAQYRFDDSLLMGSGLAGGTLERFNRANQVDPGTYHVDVYLNGSYASRTRIEFRPRAGGVKPCFGERFLRRTLGVRPASEAGVQAPGDCLGLEERLPGSTFNLDTALLRLDLSVPQALLDIKPRGYVGPDEWDAGSSMGFVNYDASFYRSSFDGVGGNGDSDYGYLGLSGGINFGLWRLRHQSNYSYSSYAGNTRSDWNSIRTYAQRAVPGLRSELTLGESFTEGNLFGSLGYRGVRLASDDRMLADSQRRYAPQVRGTANSNARVVISQNGKKVHESAVAPGPFVINDLYGTAYDGDLDVQVIEADGSVSRFSVPFSAVPESMRPGISRYSATLGQARQYGDGNDLFGDFTYQRGLTNSLTANLGSRLAEDYLALLGGGVLATPYGAFGFNSIFSHATVENGQRKQGWRVGLNYSRTFQPTQTTLTLAGYRYSTEGYRDLGDALSARHADEHNDSWNSSSYKQRNQFTLLVNQGLGGYGNLYLSGATSDYYDGKSRDTQLQFGYSNTWRQLSYNLAYSRQQTTWYRDLNDDYDPSLPPQYNLRHGSERSNTLTLTLSMPLGSSSQAPNLSAMASRRSGDSRGSSYQTGLNGTLDEDRSLSYAIAAGRDSDNHGSDFNGSLQKQTSVATLNAGYAENSSYRQLNTGLRGAAVLHRGGLTLGPYVGDTFALVEAKGASGAGVRGGQGARVNGNGYAVVPSLSPYRYNPVSLDPQGMGEEAELLETERKIAPYAGAAVHVKFRTLTGHPLLIQAQLADGSALPLGANVLDSQGVNIGMVGQGGQVYARAEGDKGRLRVQWSERPGDACLLDYDLDTGPRQAIEPGQAVIRLQGTCTPVSEAP

SEQ ID NO: 3452 - DNA, 2547 bp, Escherichia coli
  CDS (1)..(2547): transl_table=11
atgcttcatataaatagcatggtaaaagtgtgttttttcgtaataatcgcattttcacttttccatacgagaaattcagatggaaagacatattcattcgatgcatctttgctaaagagaagaggggagggagtagacctaactctttttgaaaatggagggcagcttcccggcatttatccagtcgatatttttctaaatggaactattgtgggttcagaggatatatttttccatgccgaacatagtaatggaaaaccttatttaaaggcttgtttaagtgaggagttgttaatgcgttatggggtgaagacagagaaataccctaaacttttcctctcgcattatggaaaaaaagatgaaagacaatgtgcagatttatctgtaattcctcaagcaaccgaagagtttctgtttgaagcgcagaaattagtgcttagtatccctcaagtagcaattcgttcaccattgagaggagttgcttccgacctgatatgggaagacggaatatcaacttttttgctaaattggcaggtagaggcaggacattcagaatttcaacattatgagaaaacaacgtcagataatttctgggtcagtttggaaccgggaattaacattgggccgtggcgtatcagaaacttgacaactttgaataagtcttctggtcaagtgggaaaatgggaaagctcatacatccgtgcagaacgtgggttgaataatataaaaagtcgtttaacactgggggaagactatacccctgcagatatttttgccagtgtcccttttaggggggtgatgcttggaactgatgagaatatgataccttatgatcagcgtggatttgctcctgtaattagaggtattgcacgtactcaagcccggattgaaatacgtcaaaatggttatctaatacagagtcaaactgtagcagcgggaccttttgctttaacagatctacctataacgggatccggtggtgagtttcaggtgaccatatttgagtcggatggagccatacagtcttttaatgtaccatttactacaccagccatagctctgcgtgaggggtatctaaagtataatataagtgctggacagtatcgttcatcggatgaatctgtagaaaaagcatatctatggcaagcaacagctatgtatggcttaccacgggcattgacagtctttggtggagttcagactgctgaacattatcaggctgcagcactaggggttggtttgtcgctaggaaatatgggtgcagcatcattggatacgatttattcccgaggccagcaaaaaggatatgattttgatacgggaaacagttggcgcatccgttatgacaaatcctttgaactgacagacactagtttttcagctgcgagttatcagtattcaaatgaaggatatcatgaactatcagatattttggatacttatcgcagtggagctaactttgtatttaatgatactgatagaaaaaggcgcaggattacaataaatataaaccagtctcttggtccatggggatttataggactaagcggggggagggatgaatataaggggggggacagacaggattatattggagcatcatatagtatgtcatggaaagatatatctttctcagttaactggacacgcaatcgcaatgttggggactactttagtaatcgaacctttaatgaagacactgttggtatgtggatgagtatcccattgaagcattggctgggaaaaaatgataatgatgtaaatgccactgcacaaatacagcattccacgagacaaaacactcgttatgaaatgggactaaacggacgtgcctttgaccagaagctatactgggacatccgtgaacagatagtgcctggtagcttgttgatgcagatcagccgattgaatatgcgttggtcaggaagctatggagaactagtggggatgtatagttacaatagtcatactcgccagatgaatgcagggatgtcaggaagcatagctatgcatagtgaaggtataacatttggtcagaggttcggtgatacgatggctttgattgcagcaccaggtgtacggggggcttctgttggaggctggccgggcgtttcgactgattctcgtggatatgcattagtgagttatataaccccatatcaggaaaatattattacactggacccgacaactttccctgaaaatgcagaggtgcttcaaactgatactcgtgtcgttccgacgaaaggagccgttgtacgggctaaattcaagacccgagtgggtaatcgtgcagtcgtgaggctggctcgtgcggatggaacacctttaccatttggtacagtcgttaccttagaaggaaaaacggaagtatcaaattctacaggggtagtggatgacaaggggatggtgtatctgagtggattgtcagaagctggcaaactgaaggcacagtggggaatgaatagccattgctatgcaaactaccgccttcctgtaaaaaaaggaccagcagggctctatcttactagtgcagtatgcatatag

SEQ ID NO: 3453 - protein, 848 aa, Escherichia coli
MLHINSMVKVCFFVIIAFSLFHTRNSDGKTYSFDASLLKRRGEGVDLTLFENGGQLPGIYPVDIFLNGTIVGSEDIFFHAEHSNGKPYLKACLSEELLMRYGVKTEKYPKLFLSHYGKKDERQCADLSVIPQATEEFLFEAQKLVLSIPQVAIRSPLRGVASDLIWEDGISTFLLNWQVEAGHSEFQHYEKTTSDNFWVSLEPGINIGPWRIRNLTTLNKSSGQVGKWESSYIRAERGLNNIKSRLTLGEDYTPADIFASVPFRGVMLGTDENMIPYDQRGFAPVIRGIARTQARIEIRQNGYLIQSQTVAAGPFALTDLPITGSGGEFQVTIFESDGAIQSFNVPFTTPAIALREGYLKYNISAGQYRSSDESVEKAYLWQATAMYGLPRALTVFGGVQTAEHYQAAALGVGLSLGNMGAASLDTIYSRGQQKGYDFDTGNSWRIRYDKSFELTDTSFSAASYQYSNEGYHELSDILDTYRSGANFVFNDTDRKRRRITININQSLGPWGFIGLSGGRDEYKGGDRQDYIGASYSMSWKDISFSVNWTRNRNVGDYFSNRTFNEDTVGMWMSIPLKHWLGKNDNDVNATAQIQHSTRQNTRYEMGLNGRAFDQKLYWDIREQIVPGSLLMQISRLNMRWSGSYGELVGMYSYNSHTRQMNAGMSGSIAMHSEGITFGQRFGDTMALIAAPGVRGASVGGWPGVSTDSRGYALVSYITPYQENIITLDPTTFPENAEVLQTDTRVVPTKGAVVRAKFKTRVGNRAVVRLARADGTPLPFGTVVTLEGKTEVSNSTGVVDDKGMVYLSGLSEAGKLKAQWGMNSHCYANYRLPVKKGPAGLYLTSAVCI

SEQ ID NO: 3454 - DNA, 2517 bp, Escherichia coli
  CDS (1)..(2517): transl_table=11
atgcgaatattaacttgtgttccgaaatatacaaaaaccagagtggcacttgctgtcatacttgcctgcgcttttatttacagcagtacaggagaagcccggagatattcgtttgatgcctcgcagctgaatggcggaggaaagggtgttgacctttccctctttgaggaaggtgcacagcttccgggtgtatatccggtagatattatcctgaacgggtcccgtgtggattcgcgggagatggcgttttacggggtgaaagtggaggattatccggggctgttccgtcagggtgacggggacagtggtaaggatgcagatgcctgcgcagacctgtcagtcattccgggtgccacggaaacacaccagtttgcggctcaacagttactgctgggcattcctcaggtggcattacgccctcagtttacgggaattgcacctgaagctctgtgggatgatggtataccggcatttctgctgaactggcaggcaaatgcgtatcgttcggagtaccggggttacgggaaaagtgtttcggattcatttcaggccacgctggagccgggtattaacgtggggccatggcgtgtgcggaatctgaccacctggaacaaatcatcgggtcagcccggggaatgggaaagttcatacacccgtgctgaacgcgggctgaacgggataaaaagccgtctgacgttgggagagagttacacgccgtcagacatttttgatagtgtgccgttccggggagtgatgctgggctcggatgagaacatggtgccgtacagtcagcgtgagtttgcgccggtggtacggggtattgcccgtactcaggcgaggattgaggtgcgtcagaatggttaccttattcgcagtctgacggtggcgccgggggcatttgcactgacggacctgcctgttacaggctccggtggtgacctgcaggtgacagtactggagtctgacgggacgacacaggtgtttactgtgccgttcaccacaccggccattgcgctgcgtgaggggtacatgaagtacaacgtgaccggcgggcagtaccgctcttatgatgatgctgttgagcatacgtcgctgggacaggccacacttatgtatggtctgccgtgggggctgacagtattcggtggtgttcagggagctaagcattaccagtctgctgcgctggggctgggatgggcgctgggcagtctgggggcggtgtctgtggacggtattcattcccgcggtcagaaaaaggggcgtgtgcaggaaagcggggatacctggcgtgtccgttataacaaatcctttgagacaaccgggaccagttttactgcggcgagttatcagtattcttcagacggttattacacgctctctgatgtactggacacataccgtcatcatggcagcggatattcatacaaaagcagtgagcaccggagtcgccgaaccacactgaacctgagccagtccatggggagtctggggtatgtgagtctgtggggcagtcgcgatgagtaccgtgacggcagggagaaccgtgactccatgggcgcatcttacagcacaacctggaaggatatctccctgtcagttaactggtcgcgaaaccgcaacgcgggtggctattacggctggcggcagggaaaaacagaggacagtgtcagcgtgtggatgagtgttccgctggggcgctggctgggtaatacggataacgatatccgggccacggcacgggtgcagcgcagcaccgggcaggacacccgttatgaagccgggatgaatggccgggcgtttgaccgtcgtctgtcctgggatatccgtaaacaggtgacgccgggaagtgagacgaacagtgacagcagtcgtctgaatctgacctggtacggtacatacggcgaagcgacggggatgtacagttacagcagtcattcaagacagatgagtgcaggcctgtccggtggactggttgcccaccgtcatggtgtgacgctgggtcagaagaccggtgagacagtggcactggttgaggcaccgggggtgagtggtgcttccgtgagtggctggcctggtgtcaggacggatttccgcggatataccctgttgggctggataagcccgtaccaggagaatgtggtcacactggacccgacgacgttcccggcggatgcggaggtgccacagacggacagccgggttgttccgacgaaaggggcggtggtcagtgcgggttttgttacccgcgtgggcggcagggcactggtgacgctgacccggggtgatggtacgccgctaccgtttggtgcggtggtgacggtggatggtgaagcgggacgtatatcaggtgctgccggtgtggtgggtgataacggtgaggtgtatatgagcggtctgtctgaaaccgggaaactgaaggcgcagtggggtcagaacagtcagtgtcatgcggattaccgtctgccggaagagaaaggcccggcggggatattcctgacccgcagtgtgtgcatgtga

SEQ ID NO: 3455 - protein, 838 aa, Escherichia coli
MRILTCVPKYTKTRVALAVILACAFIYSSTGEARRYSFDASQLNGGGKGVDLSLFEEGAQLPGVYPVDIILNGSRVDSREMAFYGVKVEDYPGLFRQGDGDSGKDADACADLSVIPGATETHQFAAQQLLLGIPQVALRPQFTGIAPEALWDDGIPAFLLNWQANAYRSEYRGYGKSVSDSFQATLEPGINVGPWRVRNLTTWNKSSGQPGEWESSYTRAERGLNGIKSRLTLGESYTPSDIFDSVPFRGVMLGSDENMVPYSQREFAPVVRGIARTQARIEVRQNGYLIRSLTVAPGAFALTDLPVTGSGGDLQVTVLESDGTTQVFTVPFTTPAIALREGYMKYNVTGGQYRSYDDAVEHTSLGQATLMYGLPWGLTVFGGVQGAKHYQSAALGLGWALGSLGAVSVDGIHSRGQKKGRVQESGDTWRVRYNKSFETTGTSFTAASYQYSSDGYYTLSDVLDTYRHHGSGYSYKSSEHRSRRTTLNLSQSMGSLGYVSLWGSRDEYRDGRENRDSMGASYSTTWKDISLSVNWSRNRNAGGYYGWRQGKTEDSVSVWMSVPLGRWLGNTDNDIRATARVQRSTGQDTRYEAGMNGRAFDRRLSWDIRKQVTPGSETNSDSSRLNLTWYGTYGEATGMYSYSSHSRQMSAGLSGGLVAHRHGVTLGQKTGETVALVEAPGVSGASVSGWPGVRTDFRGYTLLGWISPYQENVVTLDPTTFPADAEVPQTDSRVVPTKGAVVSAGFVTRVGGRALVTLTRGDGTPLPFGAVVTVDGEAGRISGAAGVVGDNGEVYMSGLSETGKLKAQWGQNSQCHADYRLPEEKGPAGIFLTRSVCM

SEQ ID NO: 3456 - DNA, 2586 bp, Escherichia coli
  CDS (1)..(2586): transl_table=11
atgcacaggaataagtcatcttcaggtttatctttatattgcgtaaaaacaaaaattacagcggttgctctctctgtgatggcggcctgtacccttctttacaccgggaatactgaggcccgcacatactcctttgatgcttccatgcttaaaggtggcggaaagggggtggacctgacgttgtttgaagaaggtgcccaactgcccggtatctatccggttgatattatcctgaacggttcgcgggtggattcgcgggacatggcgttccgtacggagaaagatgcggagggtaagacttatttgaaaacctgtctgacccgggaaatgctggcccgctatggtgtcatgacggaggaatatccggagttgtttcacggggatgacggaaaggaagctgaagcctgtgctgagttatccgttattccacaggccacggaaacataccagtttgcgtcacagcagttgctgctgagtattcctcaggtggccctgcgcccgcccctgagggggatagcgccggaggccttatgggatgatggtattcctgcttttctgctgaactggcaggcaaataccagtcgttcagaatatcgtggatacgggaaatcggttactgacaattactgggtcactcttgagccgggcattaatcttggtccctggcgggtgcgtaacctgacaacctggaacaggtcatccggtcagccggggcagtgggagagtgcctatattcgtgcggagcgggggattaacagtctcagaagtcgtctgacgctgggtgaggattacacgccttcagacatttttgacagtgtgccgttccgtggggtgatgctgggggcagatgagagcatggtgccttataaccagcgtgaatttgcgccggtggtcagaggtattgcccggacccaggccaggattgaggtgcgccagaatggttatctgattgacagccggacggtggccccgggcgcatttgccctgacggacctgccgctgacggggtcaggtggagaccttcaggtaacggtacaggaatctgatggtactgctcaggtgtttacggtgccttacaccacaccggccattgcgcttcgtgagggatatatgaagtacagcattgccgggggggagtaccgttcttcagatgatgctgttgagcattcaccgctggggcagatgagtgtcatgtatggtctgccatgggggctgacggccttcgggggagcacagatgtcatcgcattatcagtcagcggctctggggctgggatggtcaatgggcagactgggggcggtgtcggttgacggcattcattcccgcggtcagcagaagggacgggatacggagacgggagagacatggcgtctgcgttacaacaagtcatttgaacttacgaatacagatttgacagcggcgagatatcagtatacgtcctcaggattccacacattgtccgatgtgctgagtacatttagaaatgataattttcgtgcatatagttatagtggggacaggagtcgccggacaacattacgccttaatcagtctgtgggatctctggggtatatgagcttttacggtagccgtgatgagttccgtcataaccgacagaagcaggattctttcggcatgtcatatggaacgtcatggaagaatatttcgtggtacgttaattggtccggtaactatagtacaaatgcatattatcagagagggcatatagaggatagtatcaatctgtggatgaatattcctctggggcagtggattgggggtagagataacgatattaatgttacaactcaaacgcaaagaactacggggcagaatacttggtacgaaaccggtttgaatggtcgcgcatttgaccgtaggttgtattgggatgtgagtgagcggatagctcccggaagtgaaaataatgtagacagtagccgactgaatttgaggtggtttggtacctatggtgagttggcggggatgtacagttacagcagttatattcgccagatgagtgctggtatatcaggaggtatggtgctccacaatgaaggtatcactcttggtcagaaaggagaggatacggttgctctggttgtagcacctggagttaatggcgcttcagttgggagtttgcctggcgttaggaccgataccagaggttacactcttgtgaatcatgtatctccataccaagaaaatcttattacactggatccgacaactttcccggaaaatgtggaagtatcacagacagatactcgtgttgttcctacaaagggagccgtggttcgggcgaagtttatcactcgagtagggggaagagcactgataactctgtcacgtagtggctctcgcctgccttttggagctgtggtgacagaggaaggaaagaaaggtcaaatgcctggtggggcaggggttgtgggggataatggagaagtgtatttgagcggactggatgaaaccggacagttgaaggttcaatgggggcgtaacagttcttgccgtgcaaattatcgacttccagaggagaaagaagcaactggtatttttctggtgcgcactgtgtgtatgtga

SEQ ID NO: 3457 - protein, 861 aa, Escherichia coli
MHRNKSSSGLSLYCVKTKITAVALSVMAACTLLYTGNTEARTYSFDASMLKGGGKGVDLTLFEEGAQLPGIYPVDIILNGSRVDSRDMAFRTEKDAEGKTYLKTCLTREMLARYGVMTEEYPELFHGDDGKEAEACAELSVIPQATETYQFASQQLLLSIPQVALRPPLRGIAPEALWDDGIPAFLLNWQANTSRSEYRGYGKSVTDNYWVTLEPGINLGPWRVRNLTTWNRSSGQPGQWESAYIRAERGINSLRSRLTLGEDYTPSDIFDSVPFRGVMLGADESMVPYNQREFAPVVRGIARTQARIEVRQNGYLIDSRTVAPGAFALTDLPLTGSGGDLQVTVQESDGTAQVFTVPYTTPAIALREGYMKYSIAGGEYRSSDDAVEHSPLGQMSVMYGLPWGLTAFGGAQMSSHYQSAALGLGWSMGRLGAVSVDGIHSRGQQKGRDTETGETWRLRYNKSFELTNTDLTAARYQYTSSGFHTLSDVLSTFRNDNFRAYSYSGDRSRRTTLRLNQSVGSLGYMSFYGSRDEFRHNRQKQDSFGMSYGTSWKNISWYVNWSGNYSTNAYYQRGHIEDSINLWMNIPLGQWIGGRDNDINVTTQTQRTTGQNTWYETGLNGRAFDRRLYWDVSERIAPGSENNVDSSRLNLRWFGTYGELAGMYSYSSYIRQMSAGISGGMVLHNEGITLGQKGEDTVALVVAPGVNGASVGSLPGVRTDTRGYTLVNHVSPYQENLITLDPTTFPENVEVSQTDTRVVPTKGAVVRAKFITRVGGRALITLSRSGSRLPFGAVVTEEGKKGQMPGGAGVVGDNGEVYLSGLDETGQLKVQWGRNSSCRANYRLPEEKEATGIFLVRTVCM

SEQ ID NO: 3458 - DNA, 2571 bp, Escherichia coli
  CDS (1)..(2571): transl_table=11
ctgtggcagataaagacaagtcttactgctgtggcatattcagtgatgatgacatgtacattacttcatgttgaagatgttatagctcgcacatattcttttaattcatcgctgcttagtggtggagtaaaaggtgttgatttgaccgtatttgaagagggagggcaactgccgggcatttatcaaactgacataatcctgaatggttctcgtgttgattcactggagatgccctttcatacagaaaaggatgagaatggcaggccttatctgaagacttgtctgacccaagagatgctggcgcgttacggggtgaagacagaggaatatccggccctattccgttctttgggtggtgggagtgatacgtctggtgaaaggggagtatgtgctgacctgtcggcgataccgcaagccacggagaactatcagtttgctgcacagcaactggtgctgggtattccacaggtggcacttcgccccctgctgagggggattgcgccagaggttctatgggacgacggtataccagcatttctgctgaattggcaagcgaacgcgggccgttcggaataccggggatacataaaggatgtcgaggattatttctggagcagtttggaaccgggtatcaacattggttcttggcgcatcagaaacctgacgacctggaacaaatcgtccgggcaatcggggaaatgggagagtttatacattcgtgccgaacgagggctaaacagtctaaaaagccgtctgacgctgggtgagaactacacgccgtcagacatctttgacagcgttccttttcgaggggggatgttgagttctgatgagagcatggtgccctataaccagcgtgaatttgcacctgtggtgagaggaattgcccgcacccaggcccgaatcgaagtgcgacagaacgggtatctgatacagagtcagacggtggctccgggggcatttgccctgacggacttgccggtaacgggttccggcagtgacctgcaggtgacagtgcgggaatcagacgggacagtccaggttttcactgtaccattcaccacacctgctattgcactgcgtgaggggtatctgaagtataacgtcatggcagggcagtatcgttcatcagatgatgctgttgaagatagtactctgggacaggtgatgggcatgtatgggttgccatgggggctgacggtatttggcgggcttcagggtgctgagcattatcagtctgcagcactggggctgggctggtcactgggaaaactcggggcggtatcactggacacgattcattcccgtggtcagcagaagggatataattatgagacagggaacacttggcgtatccgttataacaagtcctttgagcttacgggtacgagttttacggcagcaagttaccagtattcatcatcaggctaccacacactgtcggatgtgttggaaacataccgtgatgacggcaggttcgcatacagaagtactgacagccgaactagtcgtaccacggtaaatctgagccagtcacttggacggtggggatatctggggctgaacggcagtcgggatgagtatcgtgataggccacaccaagattatattggtgcgtcatatggtgcatcgtggaaccgcatgtccctgtcagtcaactggtcgcgcaaccatagcactaggggatattacggtagcaagtcacgtacggaagatagtatcagtatatggatgagtattccgctggagagctggctgggcaggtcggataacaacatcagtgctacggcacagatgcagcgttccacggaacagaatacacgttatgaattgggcctgaacggacgtgcttttgaccgcaggctgttctgggaagttcatgagcagatggtgtcgggcagtgaatataatacaggcaccagtcgtctgaacctgcgctggtcggggacttatggtgagctggcagggatgtatagttacagcagtaacatgcggcagattaacgccggaatgtcaggaagcatggttgctcacggtgagggggtcacatttggtcagagagccggagacacagtgactctgattgccgcacctggcgtgagcggggcctctgtgggagactggccaggtgtcagaaccgatttccgcggatatgccctagccggttatgcatcaccgtaccaggagaacgttatcacactggacccgacgacgttcccggaagatgcggaagtgccacagacggacagccgagttgtgccgacgaagggggcagtggtccgggccgggttcaggacccgcgtgggtggtcgtgcactggtgagcctgacccgtcaggacggatcctccctgccatttggtgcgatagtgaccttggaaggaaagccgggggagacatccggctctgccggtgtggtagatgacaaggggagggtgtatctgagcggactgtctgaaactggaaaactgaaggctcagtggggagagaacagtctatgtcatgcggactaccgtcttccggaagagaaagggcctgcgggtattttcctgacccgcacggtatgtatgtga

SEQ ID NO: 3459 - protein, 856 aa, Escherichia coli
MWQIKTSLTAVAYSVMMTCTLLHVEDVIARTYSFNSSLLSGGVKGVDLTVFEEGGQLPGIYQTDIILNGSRVDSLEMPFHTEKDENGRPYLKTCLTQEMLARYGVKTEEYPALFRSLGGGSDTSGERGVCADLSAIPQATENYQFAAQQLVLGIPQVALRPLLRGIAPEVLWDDGIPAFLLNWQANAGRSEYRGYIKDVEDYFWSSLEPGINIGSWRIRNLTTWNKSSGQSGKWESLYIRAERGLNSLKSRLTLGENYTPSDIFDSVPFRGGMLSSDESMVPYNQREFAPVVRGIARTQARIEVRQNGYLIQSQTVAPGAFALTDLPVTGSGSDLQVTVRESDGTVQVFTVPFTTPAIALREGYLKYNVMAGQYRSSDDAVEDSTLGQVMGMYGLPWGLTVFGGLQGAEHYQSAALGLGWSLGKLGAVSLDTIHSRGQQKGYNYETGNTWRIRYNKSFELTGTSFTAASYQYSSSGYHTLSDVLETYRDDGRFAYRSTDSRTSRTTVNLSQSLGRWGYLGLNGSRDEYRDRPHQDYIGASYGASWNRMSLSVNWSRNHSTRGYYGSKSRTEDSISIWMSIPLESWLGRSDNNISATAQMQRSTEQNTRYELGLNGRAFDRRLFWEVHEQMVSGSEYNTGTSRLNLRWSGTYGELAGMYSYSSNMRQINAGMSGSMVAHGEGVTFGQRAGDTVTLIAAPGVSGASVGDWPGVRTDFRGYALAGYASPYQENVITLDPTTFPEDAEVPQTDSRVVPTKGAVVRAGFRTRVGGRALVSLTRQDGSSLPFGAIVTLEGKPGETSGSAGVVDDKGRVYLSGLSETGKLKAQWGENSLCHADYRLPEEKGPAGIFLTRTVCM

SEQ ID NO: 3460 - DNA, 2502 bp, Yersinia pestis
  CDS (1)..(2502): transl_table=11
atgaggtattcaaagctgttcctgtgtgcagggttaactttggcaacattgccttgttggggacgcgcatatacttttgactctactatgcttgatacgaatagtggagagagtatagatgtatctctttttaatcaaggacttcaacttccaggtaattattttgttaatgtttttgtaaatggtcgaaaggtagactctggaaatatcgacttccgtctagaaaaacataatggaaaagaacttctttggccatgcctatcatccttacaattgacaaagtatggcattgatatagataaatatcctgatttaataaaatctggtacagagcaatgtgttgatttattagcaataccacattcagatgtgcagttttattttaatcagcagaaattatcgttaattgtgccaccacaggcacttttacctagatttgatggcattatgccaatgcaattgtgggatgacggcattcctgctctgttcatgaattataatacgaacatgcagacaagaaaattcagagaaggaggcaagtctctggactcttattatgctcagttgcaaccgggattaaacataggggcttggcgctttcgtagttcaacctcatggtggaaacaacaaggatggcagcgttcgtatatttatgccgagcgaggattgaatacaattaagagccgtttgacattgggggaaacctattctgatagcagtatctttgacagtatcccgattaaggggataaaaattgcttcagatgaatcgatggttccttattaccaatggaattttgctccagttgttcgcggtatcgcacgtacacaagccagggtagaggttttaagagatggctacactgtaagtaatgagttggtgccctcgggaccatttgagttagcaaatcttcctctgggtggggggagtggtgagctgaaagtcatcattcatgaaagtgatggaacaaagcaagtttttacagttccatatgacacaccagcagtggcattacggaagggctatttcgaatattcaatgatggggggagaatatcgtccagctaatgatcttacacaaacatcgtatgttggcgctcttgggatgaaatatggtttgccaaggaatcttacgttatatggtggactacaagggtcccaaaattatcatgccgcagctctgggtatcggtgctatgttgggtgattttggtgccatatctacagatgttactcaagcagacagccagaaaaataaacaaaaaaaagaaagcggccaacgttggcgcgttcgatataataagtacttgcagagtggaacatcgttaaacattgctagcgaggaatacgccacagaaggatttaacaaactcgctgacacgttaaatacttattgtaaacctaatactagaaacgattgccgttttgattatgctaaacccaaaaacaaagtgcaattcaatttaagtcaaagcatacctggttcggggacgcttaatttcagtggctacagaaaaaactattggcgtgacagtaggagcacaacttctttttctgtaggctataaccatttttttaggaatggtatgtcattgactttaaatttatcgaagacacagaatatcaataagtatggagaaaaaactagtgagctattatctaatatctggttgagttttcctctcagtcgctggctaggtaataactcaataaattcaaattaccaaatgacatcagattctcatggtaacactacccatgaggtaggtgtgtacggtgaagcctttgatcgccaattatactgggacgttcgcgaacgttttaatgaaaagggcagaaaatatacctccaatgcactgaatttgaattatcgaggaacttatggggagatcagtggtaactacagctacgatcaaacccaaagccaacttggtataggtgtaaatggcaatatggtaataactcagtacggtataacggctggccaaaaaactggagatactattgcattagtacaagcccctgatataagcggtgcttcagtgggatactggccaggcatgaaaacagactttagggggtacaccaattatggttacttaaccccttacagagagaataaggtagaaattaacccagttactttacccaatgatgcagagataacaaataatattgttagcgtgatcccgacaaagggagctgtagtattagcaaaatttaacgcaaggattggtggacgattgtttttacatttaaaacgctctgacaataaacctgttccatttggttctatagttaccattgaagggcaatcatccagctctggcattgtcggagataatagcggtgtctatttgactggactacctaaaaaatcaaaaatacttgttaagtgggggagagataaaaatcaatcatgttcatctaatgtagttctaccagaaaaaacggatatttctggtgcttataggttatccacaacctgcatcttaaataactga

SEQ ID NO: 3461 - protein, 833 aa, Yersinia pestis
MRYSKLFLCAGLTLATLPCWGRAYTFDSTMLDTNSGESIDVSLFNQGLQLPGNYFVNVFVNGRKVDSGNIDFRLEKHNGKELLWPCLSSLQLTKYGIDIDKYPDLIKSGTEQCVDLLAIPHSDVQFYFNQQKLSLIVPPQALLPRFDGIMPMQLWDDGIPALFMNYNTNMQTRKFREGGKSLDSYYAQLQPGLNIGAWRFRSSTSWWKQQGWQRSYIYAERGLNTIKSRLTLGETYSDSSIFDSIPIKGIKIASDESMVPYYQWNFAPVVRGIARTQARVEVLRDGYTVSNELVPSGPFELANLPLGGGSGELKVIIHESDGTKQVFTVPYDTPAVALRKGYFEYSMMGGEYRPANDLTQTSYVGALGMKYGLPRNLTLYGGLQGSQNYHAAALGIGAMLGDFGAISTDVTQADSQKNKQKKESGQRWRVRYNKYLQSGTSLNIASEEYATEGFNKLADTLNTYCKPNTRNDCRFDYAKPKNKVQFNLSQSIPGSGTLNFSGYRKNYWRDSRSTTSFSVGYNHFFRNGMSLTLNLSKTQNINKYGEKTSELLSNIWLSFPLSRWLGNNSINSNYQMTSDSHGNTTHEVGVYGEAFDRQLYWDVRERFNEKGRKYTSNALNLNYRGTYGEISGNYSYDQTQSQLGIGVNGNMVITQYGITAGQKTGDTIALVQAPDISGASVGYWPGMKTDFRGYTNYGYLTPYRENKVEINPVTLPNDAEITNNIVSVIPTKGAVVLAKFNARIGGRLFLHLKRSDNKPVPFGSIVTIEGQSSSSGIVGDNSGVYLTGLPKKSKILVKWGRDKNQSCSSNVVLPEKTDISGAYRLSTTCILNN

SEQ ID NO: 3462 - DNA, 2514 bp, Haemophilus influenzae
  CDS (1)..(2514): transl_table=11
gtgaaaacaaaaaattttcccttaaataaaattgcgtttgcttgcaccttgctactggcaaatcctgtggcgtgggcagaagaccaatttgatgcctctctttggggaggcggctcggtgttgggcattgattttgctcgatttaatgtaaaaaatgccgtgttaccagggcgttatgaagcgcaaatttatgtaaataatgaagaaaaaggcgaaagtgacattatttttgccgataatcctgccacagggcgggctgaattatgctttacgcctaaacttcaagaaatgctggatttgatggatgaagccattgtgaaatcgcccaattcagaagatgacacttgtgtctttgcttctgatgccattcctaaaggcacctttgattatcaaggtggcgacatgaaattgaaacttgaaatccctcaagcattaaccattcgccgcccaagaggctatattgcaccgtctcgctggcaaactggcaccaatgccgcttttgcaaattacgacatcaactattatcgttctggtaatcctgaagtgaaatccgaaagtttgtatgtgggcttgcggggtggtgtgaatttcggtaactgggctttgcgtcataatggcagttttagccgttttgaaaaccaaagtagttcaggttttacggataagggtaaaaatcattacgaacgtggcgatacctatttacaacgagattttgccctgcttcgtggcaatgtcactgttggggattttttcagcaccgcccgtattggcgaaaattttggtctgcgtggtttgcgtattgcctctgatgatagaatgcttgccccatcacaacgaggctttgcccccgtggtgcgtggcgtggcaaatacaaacgccaaagtcagcatcaaacaaaatggctataccatttatcaaattaccgttcccgcagggcctttcgtgattaacgatttgtatgccagtggttacagcggcgatttaacggtggaaatccaagaaagtgatggtaaagtgcggtcatttattgtgccgttttctaaccttgccccgttaatgcgtgtgggacacttgcgttatcaattagctggcggacgttatcgcatcgacagccgcacctttgatgaacgggtgttacaaggcgtgttgcaatatggtttaactaatcatctcacgctgaattcaagcctgctttacactcgccattatcgtgcagggctgttcggttttggattaaacacgccgattggggcgttttctgccgatgccacttggtcgcatgcagaatttccgttgaaaaaagtcagtaaaaacggttacagtctacacggcagttatagtattaacttcaatgaaattggcaccaatctcacgttggcagcttatcgttattcttcccgtgatttttacaccttaagcgacaccattggtcttaaccgcactttcagacaatttagcggtgcgtatttgcctgaaatttaccgcccaaaaaatcagtttcaagtgagtttaagccaaagtctggggaattggggaaatctctatctttcaggacaaacctataattattgggaaaaacgtggcacgaatacgcaatatcaagttgcctattcaaacagcttccatattctcaattactctgtaaacctttcacagagtattgataaagaaacgggcaaacgtgacaacagcatttatttgagtctcagcctgccattaggcgataaccattctgcagatagtagttattctcgcagtggtaacgatattaaccaacgacttggcgtaaatggctcttttggtgaacgtcatcaatggagttatggtattaacgcttcacgcaataatcaaggctatcgcagttatgacggtaatctttcgcataacaatagcattggtagctatcgtgcttcttattcccgtgacagcctcaaaaatcgctctacttcattaggcgtaagtggtgctgtcgtggcacacaaatacggtattaccttaagccaacctgttggcgaaagctttgccattattcacgctaaagatgctgcaggggcaaaagtggaatcaggtgccaatgtcagccttgattatttcggcaatgcggttgtgccttacaccagcccatatgaaatcaattatattggtatcaatccatctgatgcagaggcgaatgtggaatttgaagccactgaacgccaaattattcctcgtgcaaattcaattagcttagtggatttccgcacgggcaaaaatacaatggtgttatttaacctcactttgccaaatggcgagccagtgccaatggcatccaccgcacaagatagcgaaggggcatttgtgggcgatgtggtgcaagggggcgtgcttttcgctaataaacttacccagccaaaaggcgagttaatcgtcaaatggggcgagcgagaaagcgaacaatgccgcttccactatcaagttgatttggataatgcacaaatacaaaaccacgatattcaatgcaaaaccgcagaataa

SEQ ID NO: 3463 - protein, 837 aa, Haemophilus influenzae
MKTKNFPLNKIAFACTLLLANPVAWAEDQFDASLWGGGSVLGIDFARFNVKNAVLPGRYEAQIYVNNEEKGESDIIFADNPATGRAELCFTPKLQEMLDLMDEAIVKSPNSEDDTCVFASDAIPKGTFDYQGGDMKLKLEIPQALTIRRPRGYIAPSRWQTGTNAAFANYDINYYRSGNPEVKSESLYVGLRGGVNFGNWALRHNGSFSRFENQSSSGFTDKGKNHYERGDTYLQRDFALLRGNVTVGDFFSTARIGENFGLRGLRIASDDRMLAPSQRGFAPVVRGVANTNAKVSIKQNGYTIYQITVPAGPFVINDLYASGYSGDLTVEIQESDGKVRSFIVPFSNLAPLMRVGHLRYQLAGGRYRIDSRTFDERVLQGVLQYGLTNHLTLNSSLLYTRHYRAGLFGFGLNTPIGAFSADATWSHAEFPLKKVSKNGYSLHGSYSINFNEIGTNLTLAAYRYSSRDFYTLSDTIGLNRTFRQFSGAYLPEIYRPKNQFQVSLSQSLGNWGNLYLSGQTYNYWEKRGTNTQYQVAYSNSFHILNYSVNLSQSIDKETGKRDNSIYLSLSLPLGDNHSADSSYSRSGNDINQRLGVNGSFGERHQWSYGINASRNNQGYRSYDGNLSHNNSIGSYRASYSRDSLKNRSTSLGVSGAVVAHKYGITLSQPVGESFAIIHAKDAAGAKVESGANVSLDYFGNAVVPYTSPYEINYIGINPSDAEANVEFEATERQIIPRANSISLVDFRTGKNTMVLFNLTLPNGEPVPMASTAQDSEGAFVGDVVQGGVLFANKLTQPKGELIVKWGERESEQCRFHYQVDLDNAQIQNHDIQCKTAE

SEQ ID NO: 3464 - DNA, 2517 bp, Escherichia coli
  CDS (1)..(2517): transl_table=11
atgccacaacgacaccaccagggacataaacgcacaccgaaacagttggcgctcatcatcaaacgttgtttgccgatggtgctcactggcagcggcatgctttgcactaccgctaacgccgaagagtattatttcgaccccattatgctggaaaccacaaaaagtggtatgcaaacaaccgatctgtcgcgtttttcaaaaaaatatgcacaactaccaggaacttatcaggttgatatctggctgaataaaaagaaggtttcacagaaaaaaattacatttaccgccaatgcagagcaacttctgcagccacagtttacggtagaacaactacgtgagctgggtattaaggtggatgaaatcccggcgctggctgaaaaagatgacgatagcgtgatcaactcgcttgaacaaatcattcccggtacagctgctgaatttgatttcaatcatcagcaacttaatttgagcattccccaaattgcactgtaccgtgatgcaagaggttacgtctccccttctcgttgggacgatggtataccaacgctgtttaccaactactcgtttacaggttctgataaccgttaccgccagggcaatcgtagccaacgacagtacctgaatatgcaaaatggtgctaattttggcccctggcgattacgcaactattccacatggacacgcaacgatcagacatcaagctggaataccatcagtagttatttacaacgtgatatcaaggcgttgaagtctcagttgcttctgggagaaagcgccaccagcggcagtattttttccagctacacctttactggcgtgcaactcgcttccgacgataatatgttgccaaacagccagcgcggatttgccccaacggtacgcggtatcgcaaacagtagtgcaatcgtgactatcaggcaaaatggttatgtgatctatcaaagcaacgtgtcagcgggtgcctttgaaattaacgatctctacccctcttccaacagcggcgatttagaagtcacgattgaagaaagtgacggtacacaacgtcgctttatccagccttattcttcattacccatgatgcagcgacctgggcatctaaagtatagcgcgaccgctggacgctatcgcgctgatgcaaacagtgatagcaaggaacccgaatttgctgaagccacggcaatatatggtttgaataatacttttacgctgtatggcggcctgctcggttctgaagattattatgcgctggggatcggtatcggcggcacacttggcgcactgggcgcgttgtcgatggatatcaacagagctgacacccaattcgataaccagcactcttttcatggctatcaatggcgtacgcagtacatcaaagatatcccggaaaccaacaccaatatcgctgtcagctactatcgctataccaacgatggctattttagttttaatgaagccaatacccgcaattgggactataacagtcgccaaaaaagtgaaattcaattcaacatcagccagacaatatttgatggggtaagtctgtatgcctccggttcgcagcaagactattggggcaataacgataaaaacaggaatatctctgttggggtttccggccagcaatggggagttggttacagcctgaattatcaatacagccgctacactgatcaaaataatgaccgcgcactctctttgaatctcagtattccgttagaacgctggttaccgcgtagccgggtttcctatcagatgaccagccagaaagatcgcccaacccaacatgaaatgcgtcttgatggctcactgctggatgatggtcgcctgagctatagcctggaacaaagtctggatgacgataacaaccataacagtagcctgaacgccagttaccgttcaccttatggcaccttcagtgccggatacagctacggtaatgacagcagccaatacaattacggcgttaccggcggcgtggttatccatcctcatggcgtgacgctctcgcaatatctgggcaacgcttttgcgcttatcgatgctaacggagcatctggcgtgaggatacaaaactatccggggattgctaccgatccttttggctatgcagtggttccttatctcacaacttatcaggaaaaccgtctctcggtagatactacgcagctgcccgataacgtcgatcttgaacaaacaacacagtttgtggtgcccaacagaggtgcaatggtagcggcgcgtttcaacgccaatatcggttatcgcgtacttgttacagtcagcgatcgcaacggtaaaccgttgccctttggcgctcttgccagcaacgatgatacggggcaacaaagtatcgtcgatgagggcggcatactatatctctctgggatatcgagtaaatcacaaagctggactgtacgctggggaaatcaggcagatcaacaatgtcagtttgctttcagtacaccggattcagaacctacaacctctgtattacaaggcacagcgcagtgccattaa

SEQ ID NO: 3465 - protein, 838 aa, Escherichia coli
MPQRHHQGHKRTPKQLALIIKRCLPMVLTGSGMLCTTANAEEYYFDPIMLETTKSGMQTTDLSRFSKKYAQLPGTYQVDIWLNKKKVSQKKITFTANAEQLLQPQFTVEQLRELGIKVDEIPALAEKDDDSVINSLEQIIPGTAAEFDFNHQQLNLSIPQIALYRDARGYVSPSRWDDGIPTLFTNYSFTGSDNRYRQGNRSQRQYLNMQNGANFGPWRLRNYSTWTRNDQTSSWNTISSYLQRDIKALKSQLLLGESATSGSIFSSYTFTGVQLASDDNMLPNSQRGFAPTVRGIANSSAIVTIRQNGYVIYQSNVSAGAFEINDLYPSSNSGDLEVTIEESDGTQRRFIQPYSSLPMMQRPGHLKYSATAGRYRADANSDSKEPEFAEATAIYGLNNTFTLYGGLLGSEDYYALGIGIGGTLGALGALSMDINRADTQFDNQHSFHGYQWRTQYIKDIPETNTNIAVSYYRYTNDGYFSFNEANTRNWDYNSRQKSEIQFNISQTIFDGVSLYASGSQQDYWGNNDKNRNISVGVSGQQWGVGYSLNYQYSRYTDQNNDRALSLNLSIPLERWLPRSRVSYQMTSQKDRPTQHEMRLDGSLLDDGRLSYSLEQSLDDDNNHNSSLNASYRSPYGTFSAGYSYGNDSSQYNYGVTGGVVIHPHGVTLSQYLGNAFALIDANGASGVRIQNYPGIATDPFGYAVVPYLTTYQENRLSVDTTQLPDNVDLEQTTQFVVPNRGAMVAARFNANIGYRVLVTVSDRNGKPLPFGALASNDDTGQQSIVDEGGILYLSGISSKSQSWTVRWGNQADQQCQFAFSTPDSEPTTSVLQGTAQCH

SEQ ID NO: 3466 - DNA, 26 bp, Artificial sequence
  primer
atgttaaaaaaaacgttactggccta

SEQ ID NO: 3467 - DNA, 25 bp, Artificial sequence
  primer
ttattggcactctcctgttgctgtc

SEQ ID NO: 3468 - protein, 850 aa, Artificial sequence
  consensus sequence
  Variant (2)..(7): Xaa in position 2 to 7 is any amino acid
  Variant (8)..(8): Xaa in position 8 is any or no amino acid
  Variant (11)..(11): Xaa in position 11 is any amino acid
  Variant (13)..(18): Xaa in position 13 to 18 is any amino acid
  Variant (20)..(29): Xaa in position 20 to 29 is any amino acid
  Variant (31)..(75): Xaa in position 31 to 75 is any amino acid
  Variant (76)..(100): Xaa in position 76 to 100 is any or no amino acid
  Variant (102)..(105): Xaa in position 102 to 105 is any amino acid
  Variant (108)..(118): Xaa in position 108 to 118 is any amino acid
  Variant (119)..(122): Xaa in position 119 to 122 is any or no amino acid
  Variant (124)..(125): Xaa in position 124 to 125 is any amino acid
  Variant (127)..(128): Xaa in position 127 to 128 is any amino acid
  Variant (130)..(133): Xaa in position 130 to 133 is any amino acid
  Variant (135)..(153): Xaa in position 135 to 153 is any amino acid
  Variant (154)..(163): Xaa in position 154 to 163 is any or no amino acid
  Variant (165)..(165): Xaa in position 165 is any amino acid
  Variant (167)..(169): Xaa in position 167 to 169 is any amino acid
  Variant (171)..(172): Xaa in position 171 to 172 is any amino acid
  Variant (174)..(192): Xaa in position 174 to 192 is any amino acid
  Variant (193)..(205): Xaa in position 193 to 205 is any or no amino acid
  Variant (207)..(217): Xaa in position 207 to 217 is any amino acid
  Variant (219)..(226): Xaa in position 219 to 226 is any amino acid
  Variant (227)..(228): Xaa in position 227 to 228 is any or no amino acid
  Variant (230)..(235): Xaa in position 230 to 235 is any amino acid
  Variant (237)..(238): Xaa in position 237 to 238 is any amino acid
  Variant (240)..(241): Xaa in position 240 to 241 is any amino acid
  Variant (243)..(244): Xaa in position 243 to 244 is any amino acid
  Variant (246)..(251): Xaa in position 246 to 251 is any amino acid
  Variant (252)..(254): Xaa in position 252 to 254 is any or no amino acid
  Variant (256)..(258): Xaa in position 256 to 258 is any amino acid
  Variant (260)..(260): Xaa in position 260 is any amino acid
  Variant (262)..(264): Xaa in position 262 to 264 is any amino acid
  Variant (266)..(270): Xaa in position 266 to 270 is any amino acid
  Variant (272)..(272): Xaa in position 272 is any amino acid
  Variant (274)..(280): Xaa in position 274 to 280 is any amino acid
  Variant (282)..(283): Xaa in position 282 to 283 is any amino acid
  Variant (285)..(285): Xaa in position 285 is any amino acid
  Variant (287)..(289): Xaa in position 287 to 289 is any amino acid
  Variant (291)..(298): Xaa in position 291 to 298 is any amino acid
  Variant (299)..(299): Xaa in position 299 is any or no amino acid
  Variant (301)..(301): Xaa in position 301 is any amino acid
  Variant (303)..(305): Xaa in position 303 to 305 is any amino acid
  Variant (307)..(307): Xaa in position 307 is any amino acid
  Variant (310)..(313): Xaa in position 310 to 313 is any amino acid
  Variant (315)..(326): Xaa in position 315 to 326 is any amino acid
  Variant (327)..(327): Xaa in position 327 is any or no amino acid
  Variant (329)..(331): Xaa in position 329 to 331 is any amino acid
  Variant (333)..(336): Xaa in position 333 to 336 is any amino acid
  Variant (338)..(356): Xaa in position 338 to 356 is any amino acid
  Variant (357)..(361): Xaa in position 357 to 361 is any or no amino acid
  Variant (363)..(371): Xaa in position 363 to 371 is any amino acid
  Variant (373)..(377): Xaa in position 373 to 377 is any amino acid
  Variant (378)..(379): Xaa in position 378 to 379 is any or no amino acid
  Variant (381)..(385): Xaa in position 381 to 385 is any amino acid
  Variant (387)..(393): Xaa in position 387 to 393 is any amino acid
  Variant (394)..(394): Xaa in position 394 is any or no amino acid
  Variant (396)..(398): Xaa in position 396 to 398 is any amino acid
  Variant (399)..(399): Xaa in position 399 is any or no amino acid
  Variant (401)..(414): Xaa in position 401 to 414 is any amino acid
  Variant (415)..(417): Xaa in position 415 to 417 is any or no amino acid
  Variant (419)..(431): Xaa in position 419 to 431 is any amino acid
  Variant (432)..(433): Xaa in position 432 to 433 is any or no amino acid
  Variant (435)..(442): Xaa in position 435 to 442 is any amino acid
  Variant (444)..(447): Xaa in position 444 to 447 is any amino acid
  Variant (449)..(488): Xaa in position 449 to 488 is any amino acid
  Variant (489)..(509): Xaa in position 489 to 509 is any or no amino acid
  Variant (511)..(552): Xaa in position 511 to 552 is any amino acid
  Variant (553)..(578): Xaa in position 553 to 578 is any or no amino acid
  Variant (581)..(657): Xaa in position 581 to 657 is any amino acid
  Variant (658)..(675): Xaa in position 658 to 675 is any or no amino acid
  Variant (677)..(683): Xaa in position 677 to 683 is any amino acid
  Variant (685)..(693): Xaa in position 685 to 693 is any amino acid
  Variant (694)..(696): Xaa in position 694 to 696 is any or no amino acid
  Variant (698)..(707): Xaa in position 698 to 707 is any amino acid
  Variant (709)..(720): Xaa in position 709 to 720 is any amino acid
  Variant (721)..(724): Xaa in position 721 to 724 is any or no amino acid
  Variant (726)..(726): Xaa in position 726 is any amino acid
  Variant (728)..(733): Xaa in position 728 to 733 is any amino acid
  Variant (734)..(734): Xaa in position 734 is any or no amino acid
  Variant (736)..(761): Xaa in position 736 to 761 is any amino acid
  Variant (762)..(762): Xaa in position 762 is any or no amino acid
  Variant (764)..(765): Xaa in position 764 to 765 is any amino acid
  Variant (767)..(772): Xaa in position 767 to 772 is any amino acid
  Variant (774)..(788): Xaa in position 774 to 788 is any amino acid
  Variant (789)..(790): Xaa in position 789 to 790 is any or no amino acid
  Variant (792)..(794): Xaa in position 792 to 794 is any amino acid
  Variant (796)..(796): Xaa in position 796 is any amino acid
  Variant (798)..(834): Xaa in position 798 to 834 is any amino acid
  Variant (835)..(842): Xaa in position 835 to 842 is any or no amino acid
  Variant (844)..(844): Xaa in position 844 is any amino acid
  Variant (845)..(849): Xaa in position 845 to 849 is any or no amino acid
FXXXXXXXPGXYXXXXXXNXXXXXXXXXXFXXXXXXXXXXXXXXXXXXXXXXXXXXXXXXXXXXXXXXXXXXXXXXXXXXXXXXXXXXXXXXXXXXXXXXLXXXXPQXXXXXXXXXXXXXXXWXXGXXAXXXXYXXXXXXXXXXXXXXXXXXXXXXXXXXXXXGXNXXXWXXRXXXXXXXXXXXXXXXXXXXXXXXXXXXXXXXXRXXXXXXXXXXXGXXXXXXXXXXFXXXXXXGXXLXXDXXMXXXXXXXXXPXXXGXAXXXAXXXXXQXGXXXXXXXVXXGXFXXXDXXXXXXXXXLXVXXXEXDGXXXXFXXXXXXXXXXXXXGXXXYXXXXGXXXXXXXXXXXXXXXXXXXXXXXXGXXXXXXXXXGXXXXXXXYXXXXXGXXXXXXXXGXXXXDXXXXXXXXXXXXXXXXXGXXXXXXXXXXXXXXXTXXXXXXXXYXXXXYXXXXXXXXXXXXXXXXXXXXXXXXXXXXXXXXXXXXXXXXXXXXXXXXXXXXXXXXXXXXXYXXXXXXXXXXXXXXXXXXXXXXXXXXXXXXXXXXXXXXXXXXXXXXXXXXXXXXXXXXXXXXXXXXXXPLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXGXXXXXXXXXXXXTXXXXXXXXXXGXXXXXXXXXXXXXXXXGXAXXXXXXXYXXXXXXXXXXXXXXXXXXXXXXXXXXXPXXGXXXXXXFXXXXXXXXXXXXXXXXXGXXXPXGXXXXXXXXXXXXXXXXXXXXXXXXXXXXXXXXXXXXXXXXXXXXXCXXXXXXP

SEQ ID NO: 3469 - protein, 29 aa, Artificial sequence
  protein pattern
  Variant (2)..(2): Xaa in position 2 is any amino acid
  Variant (3)..(4): Xaa in position 3 to 4 is any or no amino acid
  Variant (6)..(6): Xaa in position 6 is any amino acid
  Variant (7)..(8): Xaa in position 7 to 8 is any or no amino acid
  Variant (10)..(10): Xaa in position 10 is Asp, Asn, Gln, Arg or Ser
  Variant (11)..(11): Xaa in position 11 is Gly, Asn or Ser
  Variant (12)..(13): Xaa in position 12 to 13 is any amino acid
  Variant (14)..(14): Xaa in position 14 is Ala, Ile, Leu or Val
  Variant (15)..(18): Xaa in position 15 to 18 is any amino acid
  Variant (20)..(20): Xaa in position 20 is Ala, Asn, Pro or Ser
  Variant (21)..(21): Xaa in position 21 is Ala or Pro
  Variant (23)..(23): Xaa in position 23 is any amino acid
  Variant (25)..(25): Xaa in position 25 is any amino acid
  Variant (26)..(26): Xaa in position 26 is Ile or Leu
  Variant (27)..(27): Xaa in position 27 is any amino acid
  Variant (28)..(28): Xaa in position 28 is Asp, Asn or Thr
  Variant (29)..(29): Xaa in position 29 is Ile, Leu, Met or Val
AXXXVXXXQXXXXXXXXXVXXGXFXXXXX

SEQ ID NO: 3470 - DNA, 846 bp, Escherichia coli K12
  CDS (1)..(846): transl_table=11
atgattgagaaccgtccgtggctgacgatattcagccataccatgctgatcctcgggatcgcggtgatcctcttcccgctgtacgtggcgtttgtcgcggcgacgctggataaacaggccgtctatgccgcgccgatgacgctcatccccggcacacatctgctggaaaacatccacaacatctgggtgaacggggtaggcacgaatagcgcgccgttctggcggatgttgcttaacagctttgtgatggcgttcagcattacgctcggcaaaattaccgtctcgatgctctcggcatttgccattgtctggtttcgttttccgctacgtaacctcttcttctggatgatttttatcaccctgatgctgccggttgaagtacgtatcttcccgacggtggaagtcatcgccaacctgcagatgctcgacagctacgccggtttaacgctgccgctgatggcctcggcgaccgctactttcctgttccgccagttctttatgacgctgccggatgagctggtggaagccgcgcggatcgacggcgcatcgccaatgcgcttcttttgcgacatcgtttttccgctctccaaaactaatctggcggcgctgtttgtgatcacctttatctacggctggaatcagtatttgtggccgttgttgattattaccgatgtggatctcggcaccaccgtggcagggatcaaagggatgatcgctacaggcgaaggcaccacggaatggaactcagtgatggtggcgatgttgttaacgcttatccctccggtggtgattgttttagtgatgcagcgtgccttcgtgcgcggcctggtcgatagtgagaaataa

SEQ ID NO: 3471 - protein, 281 aa, Escherichia coli K12
MIENRPWLTIFSHTMLILGIAVILFPLYVAFVAATLDKQAVYAAPMTLIPGTHLLENIHNIWVNGVGTNSAPFWRMLLNSFVMAFSITLGKITVSMLSAFAIVWFRFPLRNLFFWMIFITLMLPVEVRIFPTVEVIANLQMLDSYAGLTLPLMASATATFLFRQFFMTLPDELVEAARIDGASPMRFFCDIVFPLSKTNLAALFVITFIYGWNQYLWPLLIITDVDLGTTVAGIKGMIATGEGTTEWNSVMVAMLLTLIPPVVIVLVMQRAFVRGLVDSEK

SEQ ID NO: 3472 - DNA, 915 bp, Mesorhizobium loti MAFF303099
  CDS (1)..(915): transl_table=11
atggttgagcgcaccccgttcctcaatttcttcacgcatctgatcctgttcatcggcttcgtcttttgcatcgcgccgttcgtggtcgtggcgatcgcggcgtcgcacaacctcaaggatgtcaacgatgtgccgatgtcgctgctgccgggcagcgacttctgggtcaacatcaagaccgcctggacgaccgccgatctcggtcccaagctgctcaacagcttcatcatggcgacaggcgtcgccgccggcaaagtgatcatctcggcgctcaccgccttctcgatcgtctacttccgctatcccggccgcatgctgatcttctggctgatcttcatcacgctgatgctgccgctcgaagtgcgtatcgtgccgacctacgccgtggtcgccaacgtgctcgagccctatcaggcgatcctggacctgaccgggctttcctggctgatcgagaaagtctcgggcgtgcaggtccagctcagcctcggactgctcaattcctatagcggactgatcctgccgctggtcgccaccgcgaccggcacgttcctctaccggcagttcttcctgaccgtgccggacgaactgaccgaggccgcccgcatggacggcgcaggggcgctgcggttcttcatcgatatcctgctgccgctgtcgcgcaacaacatggcggcgctcggcaccatcatgttcctgtgggcctggaaccagtatctgtggccactgctcatcaccacggaccagtcgcatacgatggcggtgaccgagctcaaacaattgatccccaatgtcggcggcgttccggaatggcacatcgccatggccggcacgctgatcgtcatgctgccgccgctgatcgtcgtggtgctgatgcagcgctggttcgtgcgcggcctgatcgccaccgagaagtaa

SEQ ID NO: 3473 - protein, 304 aa, Mesorhizobium loti MAFF303099
MVERTPFLNFFTHLILFIGFVFCIAPFVVVAIAASHNLKDVNDVPMSLLPGSDFWVNIKTAWTTADLGPKLLNSFIMATGVAAGKVIISALTAFSIVYFRYPGRMLIFWLIFITLMLPLEVRIVPTYAVVANVLEPYQAILDLTGLSWLIEKVSGVQVQLSLGLLNSYSGLILPLVATATGTFLYRQFFLTVPDELTEAARMDGAGALRFFIDILLPLSRNNMAALGTIMFLWAWNQYLWPLLITTDQSHTMAVTELKQLIPNVGGVPEWHIAMAGTLIVMLPPLIVVVLMQRWFVRGLIATEK

SEQ ID NO: 3474 - DNA, 843 bp, Vibrio cholerae O1 biovar eltor str. N16961
  CDS (1)..(843): transl_table=11
atgaaaagtaatcgactctccgatcatttgatccttatcgctggcgcactgtttatgctagtgccgctgtggctgattttcgcaagctcaacccatcagccaaacaccattgtctcggaaggtttgcaatggactcttggcgataatctcagcgcagtttatcgcgaagcatggaataaaagcctcggttttgccggtaatgtcaccgcgcaaaccatgatcgttaactcgatgatcatgggcttgggttttgcgattggcaaaatcgtaatttcgatgatggccgcttacgctttggtctactttcgtttgccttatgccagcgcgtggttttggctgattttcattaccctactgctgccgcttgaagtgcggattattccctcttatgaagtggtgtccaatttaggcatgctcaatagctacaccggcttagtgctacccctgattgcctccgctaccgcgacgtttttcttccgtcagttttttaaaaccataccggatgaactgttggaagcggctcagcttgataacgcaggccctatacgtttttttatcgatattttatttcccctctcgaaaaccatgatggccgcgattttcatcatcatgtttgtggtgggttggaaccaatacctgtggccgatcatgatgaccacggatgagcagtacaacaccatagtgatgggcataaaacagattctcaataacatcaatgaaaccagcttgccgcgttatgactacgcgtttgccatggtgatcctcgccatgctgccaccggttttggtggtggtgattttccaacgttggtttgtaaaaggattagtcgaaagtgaaaaataa

SEQ ID NO: 3475 - protein, 280 aa, Vibrio cholerae O1 biovar eltor str. N16961
MKSNRLSDHLILIAGALFMLVPLWLIFASSTHQPNTIVSEGLQWTLGDNLSAVYREAWNKSLGFAGNVTAQTMIVNSMIMGLGFAIGKIVISMMAAYALVYFRLPYASAWFWLIFITLLLPLEVRIIPSYEVVSNLGMLNSYTGLVLPLIASATATFFFRQFFKTIPDELLEAAQLDNAGPIRFFIDILFPLSKTMMAAIFIIMFVVGWNQYLWPIMMTTDEQYNTIVMGIKQILNNINETSLPRYDYAFAMVILAMLPPVLVVVIFQRWFVKGLVESEK

SEQ ID NO: 3476 - DNA, 858 bp, Agrobacterium tumefaciens str. C58
  CDS (1)..(858): transl_table=11
ttgagggagaagaccatgtacaagacgagacctctcgatcatctggtattgatcctcggcgcactgtttctgatattgcctgtcgtcgtggccttcatgacatccacccacacggcggcggaaatccaccgtagcggtctgacgatagtcccgggcgataatttcgtggagacctacgaaaaggtcctgacgcagaagggtggcttcaccgggcaggtcaccggtctcaacatggtgatcaactcgctggtcctcggcatcggttttgccgtcggcaagatcgtcctgtcgatgacggcggcctatgcgatcgtctatttccgcttccggtttgcgacgcttgccttctggatcattttcaccacgctgctcttgccgctcgaagtgcgcatcatgccgtcctatgaggtgatgagcaaactcggcctcctgaattcctataccggcctcatcgtgccgcttctcgcctcggccaccggcaccttttatttccggcaattcttcaagtccgttccggaggagttgctggaagccgcgcgcatcgatggcgcgggtcctgtgaaattcttcatcgatatattaatccccctgtcccgcacgatgatgtcggcgatcttcatcatcatgttcgtgtacggctggaaccagtacctctggcccatgctgatgacgacggacgagaggttcttcacgctgatgcgtggcatcaagtcgatcctgcaggtctgggtcggttcgcaaattcccgattacaacgaagctttcgcgcttgccgtcctggccatgctgccgccggtgctgatcgtcgtcattttccagcgctggttcatcaagggcctgaccgaaagcgataaataa

SEQ ID NO: 3477 - protein, 285 aa, Agrobacterium tumefaciens str. C58
MREKTMYKTRPLDHLVLILGALFLILPVVVAFMTSTHTAAEIHRSGLTIVPGDNFVETYEKVLTQKGGFTGQVTGLNMVINSLVLGIGFAVGKIVLSMTAAYAIVYFRFRFATLAFWIIFTTLLLPLEVRIMPSYEVMSKLGLLNSYTGLIVPLLASATGTFYFRQFFKSVPEELLEAARIDGAGPVKFFIDILIPLSRTMMSAIFIIMFVYGWNQYLWPMLMTTDERFFTLMRGIKSILQVWVGSQIPDYNEAFALAVLAMLPPVLIVVIFQRWFIKGLTESDK

SEQ ID NO: 3478 - DNA, 849 bp, Agrobacterium tumefaciens str. C58
  CDS (1)..(849): transl_table=11
atgattgaaaatcgccccatcgcccgcgtgattgcccatctgatgctggttctcggcatcatcatcgtggccttcccgatctattacaccttcatcgcgtcctccatgacatcgaatgatatcatccgcccgcccatgtcgctgctgcccggcgatcatctcagtgcgaattacaccgaggccatggtcggcggtgtcgaaagagtggttggcgtcagcctcgagcggctactgttcaacagcttcgtcgttgcgctcgccatcgccatcggcaaaatcgtcatctcgttcctgtcggcattcgccatcgtgtttttccgctttcccttccgcatgggctttttctggatgatcttcatcaccctcatgctgccggtggaagtgcgcatcctgccgacctacaaggtcatcgtcgatctcgggctgatcgacacctatgcgggactgacgctgccgctgatggcatcggcaacggcgactttcctgttccggcagtttttcctcaccattcccggtgagctggtcgaggcggcgcgtatcgacaatgccggcccattccgcttcatgcgcgatattctgctgccgctgtcgagaaccaatatcgccgctcttttcgtgattctgttcatctatggctggacccagtatctctggccgctgctcgtcaccaacgatgccaagatgaacacgatcatcatcggcctcaagcgcatggtggatttcaccgacgcttcgacaccctggaattatgtgatggtgacggcgatcctcgccatcatcccccctgttatggttgtggtgctgatgcagcgctggttcgtcaaaggtttggtggagaccgagaagtaa

SEQ ID NO: 3479 - protein, 282 aa, Agrobacterium tumefaciens str. C58
MIENRPIARVIAHLMLVLGIIIVAFPIYYTFIASSMTSNDIIRPPMSLLPGDHLSANYTEAMVGGVERVVGVSLERLLFNSFVVALAIAIGKIVISFLSAFAIVFFRFPFRMGFFWMIFITLMLPVEVRILPTYKVIVDLGLIDTYAGLTLPLMASATATFLFRQFFLTIPGELVEAARIDNAGPFRFMRDILLPLSRTNIAALFVILFIYGWTQYLWPLLVTNDAKMNTIIIGLKRMVDFTDASTPWNYVMVTAILAIIPPVMVVVLMQRWFVKGLVETEK

SEQ ID NO: 3480 - DNA, 885 bp, Agrobacterium tumefaciens str. C58
  CDS (1)..(885): transl_table=11
atgatccagcgcacaccctatgccgacgccctgacctacgcgatcatggtggcgggctttctcctgctcatcggccccttcctcgtcgtcatttccggcgcgagccagtctgttcagcaggtcaacagcgtgccgttcagcttcatgccgcaaggcgaattcctcgccaatgcgcagaccgcctgggcacgcgcgaatcttggcaacgccctctggaacagcctgatcatggcgacgctggtgaccatcggcaaggtggcgctttccgccttcaccgccttcgccatcgtcttcttccgctcgccgctgaagcatctgttcttctggacggtcttcatcaccctgatgctgccgctcgaagtgcgcgtggtcccgacctattcggtcgccgccgatcttttccagccgctccgctccattctcggcctgttcggcatcgagatgacgctggaatggaacctcctgaactcctatgccggcctgaccctgccgcttgtcgccacagccaccggcacctttctctaccggcagttcttcatgacgatcccggacgagctggccgaagcggcccgcatggatggttcgggcgccgcacgtttcttcgtcgacatgctgctgccgctctcgcgcaccaacatgctggcactcaccaccatcatgttcgtttatgcctggaaccagtatctgtggccgctgctgatggtcacggacccttcctacaagacggtgatgatgtcgctcagggcgctgttgcccgccgatgacggcaccccggactggaacgtgacgctggccggttccctcatcatcatcctgccgccgcttttcgtcgtggccttcctgcaacgctggttcgtccgtggcctcgtctcgtccgacaagtga

SEQ ID NO: 3481 - protein, 294 aa, Agrobacterium tumefaciens str. C58
MIQRTPYADALTYAIMVAGFLLLIGPFLVVISGASQSVQQVNSVPFSFMPQGEFLANAQTAWARANLGNALWNSLIMATLVTIGKVALSAFTAFAIVFFRSPLKHLFFWTVFITLMLPLEVRVVPTYSVAADLFQPLRSILGLFGIEMTLEWNLLNSYAGLTLPLVATATGTFLYRQFFMTIPDELAEAARMDGSGAARFFVDMLLPLSRTNMLALTTIMFVYAWNQYLWPLLMVTDPSYKTVMMSLRALLPADDGTPDWNVTLAGSLIIILPPLFVVAFLQRWFVRGLVSSDK

SEQ ID NO: 3482 - DNA, 849 bp, Sinorhizobium meliloti 1021
  CDS (1)..(849): transl_table=11
atgattgaaaagcgccccatctccaacctaatcgggcacctgatgctgatcatcggcatcatcatcgtggttttcccgatctattataccttcgtcgcctcaagcatgagctcggtcgagatcatcaggccgcctatgccgcttgttcccggcacgcggcttgccgagaattatagcgaagcgctttccggtggcgtcgagcgtgtggtcggcgtcagcctggaacgcttgctgttcaacacattcgtggtggcgatcgcgatcgccgtcggcaagatcgtcatttccttcctctcggccttcgccatcgtgttcttccgtttccctctgcgcatggccttcttctggatgatcttcatcacgctgatgctcccggtggaggtgcggatcctgccgacctacaaggtgatcgtcgatctcggactgatcgacacctatgcgggactgacgcttcccctgatggcgtcggcgacggcgaccttcctgttccggcagttctttctcaccatcccgggcgaactcgtggaagcggcgcgcatcgacaatgccgggccgttccgcttcatgcgggatattctgctgccgctttcaaagaccaatatcgcggcgcttttcgtgatcctcttcatctacggctggacccagtatctctggccgctgctggtcacgaatgacagccggatgaacacgatcatcatcggcctcaggaagatggtcgatttcactgacgcatcgaccccgtggaactacgtcatggtgaccgccatcctcgcgatcatcccgcctgtcgcagtggtcgtcctgatgcagcgctggttcgtcaagggcctcgtcgaaacggagaagtaa

SEQ ID NO: 3483 - protein, 282 aa, Sinorhizobium meliloti 1021
MIEKRPISNLIGHLMLIIGIIIVVFPIYYTFVASSMSSVEIIRPPMPLVPGTRLAENYSEALSGGVERVVGVSLERLLFNTFVVAIAIAVGKIVISFLSAFAIVFFRFPLRMAFFWMIFITLMLPVEVRILPTYKVIVDLGLIDTYAGLTLPLMASATATFLFRQFFLTIPGELVEAARIDNAGPFRFMRDILLPLSKTNIAALFVILFIYGWTQYLWPLLVTNDSRMNTIIIGLRKMVDFTDASTPWNYVMVTAILAIIPPVAVVVLMQRWFVKGLVETEK

SEQ ID NO: 3484 - DNA, 849 bp, Ralstonia solanacearum GMI1000
  CDS (1)..(849): transl_table=11
atgatcgaacgccgcccgttcctggatgtcctgacccacctcgtgctgatcctgggcgtggtggtggtcgcctttccggtctacgtggtcttcgtcgcgtcctcgctgacggccgaggacgtgctgcaggcgccgatgacgctgatccccggcccgcacctgatcgacaactaccgcgaggtgctcgcgcacggcatgggcaacgccgccacgccggtcggcaccatgctgatgaacagcctgatcatggcgctgggcatctcgctgggcaagatcgcgatctccatcatctcggccttcgccatcgtctatttccgctttccgctgcgcaagaccttcttctggctgatcttcgtcacgctgatgctgccggtggaggtgcgcatcctgccgacctacaaggtggtgtcggacctcggcatgctcaacagctacttcggcctgaccatcccgatcatcgcctcggccaccgccacgttcctgttccgccagttcttcctgaccattcccgacgagctcgccgaggccgcgcgcatcgacggcgccgggccgctcaagttcttctgggacgtggtgctgccgctgtcgcgcaccagcatcgcggcgctgttcgtgatccagttcatctacggctggaaccagtacctgtggccgctgctggtcaccaccgagcgggacatgacgccgatcgtgctgggcgtcacgcagatgatctcgcgttcgggcgattccgccaccgactggaacctgctgatggccaccgtgatgctggccatggtgccgcccgtgctggtggtgatcggcatgcagcggtggttcgtgaagggcctggtggaaaccgaaaaatag

SEQ ID NO: 3485 - protein, 282 aa, Ralstonia solanacearum GMI1000
MIERRPFLDVLTHLVLILGVVVVAFPVYVVFVASSLTAEDVLQAPMTLIPGPHLIDNYREVLAHGMGNAATPVGTMLMNSLIMALGISLGKIAISIISAFAIVYFRFPLRKTFFWLIFVTLMLPVEVRILPTYKVVSDLGMLNSYFGLTIPIIASATATFLFRQFFLTIPDELAEAARIDGAGPLKFFWDVVLPLSRTSIAALFVIQFIYGWNQYLWPLLVTTERDMTPIVLGVTQMISRSGDSATDWNLLMATVMLAMVPPVLVVIGMQRWFVKGLVETEK

SEQ ID NO: 3486 - DNA, 843 bp, Agrobacterium tumefaciens str. C58
  CDS (1)..(843): transl_table=11
atgtacaagacgagacctctcgatcatctggtattgatcctcggcgcactgtttctgatattgcctgtcgtcgtggccttcatgacatccacccacacggcggcggaaatccaccgtagcggtctgacgatagtcccgggcgataatttcgtggagacctacgaaaaggtcctgacgcagaagggtggcttcaccgggcaggtcaccggtctcaacatggtgatcaactcgctggtcctcggcatcggttttgccgtcggcaagatcgtcctgtcgatgacggcggcctatgcgatcgtctatttccgcttccggtttgcgacgcttgccttctggatcattttcaccacgctgctcttgccgctcgaagtgcgcatcatgccgtcctatgaggtgatgagcaaactcggcctcctgaattcctataccggcctcatcgtgccgcttctcgcctcggccaccggcaccttttatttccggcaattcttcaagtccgttccggaggagttgctggaagccgcgcgcatcgatggcgcgggtcctgtgaaattcttcatcgatatattaatccccctgtcccgcacgatgatgtcggcgatcttcatcatcatgttcgtgtacggctggaaccagtacctctggcccatgctgatgacgacggacgagaggttcttcacgctgatgcgtggcatcaagtcgatcctgcaggtctgggtcggttcgcaaattcccgattacaacgaagctttcgcgcttgccgtcctggccatgctgccgccggtgctgatcgtcgtcattttccagcgctggttcatcaagggcctgaccgaaagcgataaataa

SEQ ID NO: 3487 - protein, 280 aa, Agrobacterium tumefaciens str. C58
MYKTRPLDHLVLILGALFLILPVVVAFMTSTHTAAEIHRSGLTIVPGDNFVETYEKVLTQKGGFTGQVTGLNMVINSLVLGIGFAVGKIVLSMTAAYAIVYFRFRFATLAFWIIFTTLLLPLEVRIMPSYEVMSKLGLLNSYTGLIVPLLASATGTFYFRQFFKSVPEELLEAARIDGAGPVKFFIDILIPLSRTMMSAIFIIMFVYGWNQYLWPMLMTTDERFFTLMRGIKSILQVWVGSQIPDYNEAFALAVLAMLPPVLIVVIFQRWFIKGLTESDK

SEQ ID NO: 3488 - DNA, 849 bp, Brucella suis 1330
  CDS (1)..(849): transl_table=11
atgatagaacaacgcccagtctcaaatctgatcggccatctgatcctgatcctcgggatcatcattgtcgcctttccgatctattacacctttgtcgcctcgttgatgacctcgacgcagatcatccgccccccgatctcgctcctgccgggcgatcatctggttgaaaactaccgcgaagccattttcggcggcgtggaacgggtggtcggcgtcagcctcgaacggctgctctggaactccttcgtcgtcgccatggcaattgccgtcggcaagatcatcatttccttcatgtcggcctttgcgatcgtgttctttcgctttccgatgcgcatgttcttcttctggatgattttcatcacgctgatgctgcccgtggaagtgcgtatcctgccgacctacaaggtgatcgtcgatctcggcatgatcgacacctatgcggggctgaccctgcccttgatggcatcggcaacggcaactttcctgttccgccagtttttcctcaccattccgggcgaactggtggaggcggcgcgcatcgacaatgcggggcctttccggttcatgcgcgatatcctgctgccgctttccaagaccaatatcgcagcactcttcgtcattctctccatctatggatggacccagtatctttggccgctccttgtcaccaatgacgccaagatgaatacgatcatcatcggcctgcgccgcatggttgattgggccgatgcgtccacatcctggaactacgtcatggtcacggccatcctggccatcatccccccgattctcgtggtggtgctgatgcagcgctggttcgtcaaaggtctcgttgaaacggaaaagtaa

SEQ ID NO: 3489 - protein, 282 aa, Brucella suis 1330
MIEQRPVSNLIGHLILILGIIIVAFPIYYTFVASLMTSTQIIRPPISLLPGDHLVENYREAIFGGVERVVGVSLERLLWNSFVVAMAIAVGKIIISFMSAFAIVFFRFPMRMFFFWMIFITLMLPVEVRILPTYKVIVDLGMIDTYAGLTLPLMASATATFLFRQFFLTIPGELVEAARIDNAGPFRFMRDILLPLSKTNIAALFVILSIYGWTQYLWPLLVTNDAKMNTIIIGLRRMVDWADASTSWNYVMVTAILAIIPPILVVVLMQRWFVKGLVETEK

SEQ ID NO: 3490 - DNA, 843 bp, Vibrio vulnificus CMCP6
  CDS (1)..(843): transl_table=11
atgaaaagtaatcgactctctgatcacttaattttgatcgctggcgcactctttatgttgctgccactttggctgatcttcgccagctctacccacaacccaaacaccatcgtctcggaaggattgcaatggacgctaggagacaatctgcaagcggtttacagcgaggcatggaacaaaagtttgggctttgctagtaatgtgaccgctcataccatgatcgtgaactctctcatcatggggctaggttttgcgattggtaaaatcattatctcgatgatggcagcgtacgcactggtttattttcgcctaccctattccaccgcgtggttttggctgatcttcatcacactgctgctgccgctggaagtgcgtatcatcccttcgtatgaagtggtttctcgcttaggtatgctcaatagctacactggtttagtgctgcctcttatcgcctccgccactgccacgtttttctttcgtcaattttttaaaaccattcctgatgaactgctcgaggcagcacaacttgacaatgcagggccgatacgattttttatcgatattttgttccctctgtccaaaaccatgatggccgccatcttcatcatcatgtttatcgtgggttggaatcaatatctctggccgatcatgatgaccaccgatgagcagtacaacaccatcgtcatgggcatcaaacagattctcaataacatcaatgaaaccagcttacctcgttatgactacgcctttgccatggtgatcctcgccatgttgccacctgttttggtggtggtcatcttccagcgttggtttgttaaaggattagtagaaagtgaaaaataa

SEQ ID NO: 3491 - protein, 280 aa, Vibrio vulnificus CMCP6
MKSNRLSDHLILIAGALFMLLPLWLIFASSTHNPNTIVSEGLQWTLGDNLQAVYSEAWNKSLGFASNVTAHTMIVNSLIMGLGFAIGKIIISMMAAYALVYFRLPYSTAWFWLIFITLLLPLEVRIIPSYEVVSRLGMLNSYTGLVLPLIASATATFFFRQFFKTIPDELLEAAQLDNAGPIRFFIDILFPLSKTMMAAIFIIMFIVGWNQYLWPIMMTTDEQYNTIVMGIKQILNNINETSLPRYDYAFAMVILAMLPPVLVVVIFQRWFVKGLVESEK

SEQ ID NO: 3492 - DNA, 849 bp, Bradyrhizobium japonicum USDA 110
  CDS (1)..(849): transl_table=11
atggtcgaggacgagggcatcaggcgctacgtcgcccatttcattctctggatcgggatcgcgatcgtcgcattcccggtctacatcgcgatcgtcgcctcgacccaggacaacgcactgatcgcgaacgggcagatgtcgctgctgccgggcgggcacttcttcgaggtctactaccagaccatcttcgtcggcacgagcggctcgacccgcgagcccgtcggcaacatgatgctcaattcgctggtgatggcgctggcgatcgcgatcggcaagatcgcgatctcgatcatctcggcctatgcgatcgtgtatttccgctttccgttccggatgccgatcttctggatcatcttcatcaccctgatgctgccggtcgaggtccgcatctatccgacctacaagatcgttgccgatttgcacatgctcgacagctatgcgggcctgtcgctgccgctaatcgcgtccgccaccgcgacgctgctgttccgccagttcttcatgaccgtgccggacgaattgctggaggcctcgcgcatcgacggcgccggtcccttgcgcttcttctgggacacgctgctgccgctgtcgcgcaccaacatggcggcgctgttcgtgatcctgttcatcctcggctggaatcaatatctctggccgctgctcatcaccacccgcgacgacatgcagaccatccaggtcggcatccgcaagatgatcaccaccaccgacgcgctgaccgaatggccgatcgtgatggcgaccgccgtgctggccatgctgccgccggtgttcgtcgtcgtcgccatgcagagactgttcgtgcgcggcctggtcgagacggaaaagtag

SEQ ID NO: 3493 - protein, 282 aa, Bradyrhizobium japonicum USDA 110
MVEDEGIRRYVAHFILWIGIAIVAFPVYIAIVASTQDNALIANGQMSLLPGGHFFEVYYQTIFVGTSGSTREPVGNMMLNSLVMALAIAIGKIAISIISAYAIVYFRFPFRMPIFWIIFITLMLPVEVRIYPTYKIVADLHMLDSYAGLSLPLIASATATLLFRQFFMTVPDELLEASRIDGAGPLRFFWDTLLPLSRTNMAALFVILFILGWNQYLWPLLITTRDDMQTIQVGIRKMITTTDALTEWPIVMATAVLAMLPPVFVVVAMQRLFVRGLVETEK

SEQ ID NO: 3494 - DNA, 894 bp, Pseudomonas syringae pv. tomato str. DC3000
  CDS (1)..(894): transl_table=11
atgatcaggcacagtcggctgctcgatgcagttgcctacttactgctgacgctgggtctggtgttcgcgttggggccgctgtatatggcggtctgctcggcgaccgtcagtaactcgcagctgttcacttacggccttgcggtcgtgcccggcgaccagttgctggagaacctgcagcaggttacccggcgtctggacttgctgcgtttgctgggcaacagcctattggtcgccacgctggtggtgatcggcaaactggcgctctcggccttgaccgcctttgcggtggtgtactttcgcagccgttacacgtcagtgattttcttcgctgtactgggcgcgctgttgctgccgctggaggtgcgcatcatccccacgtatgccgtggccagtgatctcctcgggccgctgcgcacggtattgcgatggctgggcatccagtggctgccggtgccgaccattaatctgctcgacagctacaccggcctcgccctgcccctgatcgcttcggccaccggtacttttctgtttcggcagttctaccagaccctgcccgccgaactggtcgaggccgcgcgaatggatggcgccgggccgtggcgctttttcatcgacattctgctgccgctgtcgaagaccaacttcgctgcgctgggcacgctggtgtttatcggcgcctggaaagactacctgtggccgctggtggcgaccaaccgcgaggacatgcgcacgctggtgctgggcgtcgccagctttctgccgaccgatgcaagtcaaatccctgaatggaacctgctgatggccgctgcagtggtcagcatgctgccccctatcctcgtcattgcgctcatgcagcgatggttcgtcaaaggcctgatcggagtcggtaaatga

SEQ ID NO: 3495 - protein, 297 aa, Pseudomonas syringae pv. tomato str. DC3000
MIRHSRLLDAVAYLLLTLGLVFALGPLYMAVCSATVSNSQLFTYGLAVVPGDQLLENLQQVTRRLDLLRLLGNSLLVATLVVIGKLALSALTAFAVVYFRSRYTSVIFFAVLGALLLPLEVRIIPTYAVASDLLGPLRTVLRWLGIQWLPVPTINLLDSYTGLALPLIASATGTFLFRQFYQTLPAELVEAARMDGAGPWRFFIDILLPLSKTNFAALGTLVFIGAWKDYLWPLVATNREDMRTLVLGVASFLPTDASQIPEWNLLMAAAVVSMLPPILVIALMQRWFVKGLIGVGK

SEQ ID NO: 3496 - DNA, 846 bp, Salmonella enterica subsp. enterica serovar Typhi Ty2
  CDS (1)..(846): transl_table=11
atgatagagaatcgtcgcgggctgacaatattcagccataccatgctgattctggggatcgcggtcattttgtttccgctgtatgtcgcgtttgtcgcggcgacgctggacgaccgcgcggtgtttgagacgccgatgacgctgcttcccggcacgcagttactggagaatatcaaaactatttgggtcaacggcgtcggtgttaatagcgcgccattctggctgatgatgcttaacagtttcattatggcgttcagcattacggtaggcaaaatcacggtatctatgctttccgcattcgccatcgtctggtttcgttttcccctgcgtaacctgttcttctggatgatttttatcaccctgatgttgccggttgaagtgcgtatcttcccgacggtggaagtgatcgccaacctgaaaatgctcaacagctatgccggtctgacgttaccgctgatggcgtccgctaccgccactttcctgtttcgtcaattcttcatgacgcttccggatgaactggtggaggcggcccgtattgacggcgcgtcgccgatgcgctttttccgcgacatcgtgttgccgctgtcaaaaaccaacctggcggcgttattcgtcatcacctttatctacggctggaaccagtatctgtggccgctgttgattatcaccgacgtgaatcttggcactgccgtagcgggtatcaaagggatgatcgccactggcgaaggtaccacgcaatggaaccaggtgatggcggcaatgctgctgactctgattcccccggtcgtaattgtgttagccatgcaacgggcgtttgtgcgtggtttagtggacagtgagaaataa

SEQ ID NO: 3497 - protein, 281 aa, Salmonella enterica subsp. enterica serovar Typhi Ty2
MIENRRGLTIFSHTMLILGIAVILFPLYVAFVAATLDDRAVFETPMTLLPGTQLLENIKTIWVNGVGVNSAPFWLMMLNSFIMAFSITVGKITVSMLSAFAIVWFRFPLRNLFFWMIFITLMLPVEVRIFPTVEVIANLKMLNSYAGLTLPLMASATATFLFRQFFMTLPDELVEAARIDGASPMRFFRDIVLPLSKTNLAALFVITFIYGWNQYLWPLLIITDVNLGTAVAGIKGMIATGEGTTQWNQVMAAMLLTLIPPVVIVLAMQRAFVRGLVDSEK

SEQ ID NO: 3498 - DNA, 852 bp, Bordetella bronchiseptica RB50
  CDS (1)..(852): transl_table=11
atggtagaacgtcgtccctggctggacatcctggcccacttcatcctgctgtgcggggtggcgctggtggccttcccgatatacgtcaccttcgtggcttccacgcagacggcgcaggaagtcgcctcggcgcccatgtcgctgattcccggcaagcatttcgtcgacaactacatgcaggcgctgttcgccggttcgggcggcggctcgtacggcgcgccggtgggccgcatgatgtatgtaagcctgatcatggcgctggcgatctcgctgggcaagatcgccatctcgctgctgtcggcgttcgcggtggtgtatttccgcttccccggccgcatgttcttcttctggatgatcttcgtcacgctgatgctgcccgtggaggtgcgcatcgcgcccacctacaaggtggtggccgacctgggcctgctcaacagctacgccggcctgacgctgccgctgatcgcctcggccacggccaccttcctgttccgccagttcttcctgaccgtgcccgacgaactggtcgaggccgcgcgcatcgacggcgccggcccgatgcggttcttccgcgacgtgctgctgccgctgtcgcgcaccagcatcgcggccctgttcgtgatccagttcatctatggctggaaccagtacctgtggccgctgctgatcaccacccaggaagacatgtatcccgtggtcatcggcatcaagcgcatgatcagcgggggcgacagcgtcaccgaatggaatatcaccatggccaccgcgatcctggccatgatcccgcccgcgctggtggtcatcctgatgcagaaatggttcgtcaagggtctggtcgacaccgagaagtaa

SEQ ID NO: 3499 - protein, 283 aa, Bordetella bronchiseptica RB50
MVERRPWLDILAHFILLCGVALVAFPIYVTFVASTQTAQEVASAPMSLIPGKHFVDNYMQALFAGSGGGSYGAPVGRMMYVSLIMALAISLGKIAISLLSAFAVVYFRFPGRMFFFWMIFVTLMLPVEVRIAPTYKVVADLGLLNSYAGLTLPLIASATATFLFRQFFLTVPDELVEAARIDGAGPMRFFRDVLLPLSRTSIAALFVIQFIYGWNQYLWPLLITTQEDMYPVVIGIKRMISGGDSVTEWNITMATAILAMIPPALVVILMQKWFVKGLVDTEK

SEQ ID NO: 3500 - DNA, 840 bp, Chromobacterium violaceum ATCC 12472
  CDS (1)..(840): transl_table=11
atggtggagaaccgtaaagggctggacctgttctgccacgcgatgctgatcgcgggcatgctggtggtggcctttcccttgtatctgatgctggtcgccgccagtcaggacgccgatcaggtgacgcgggtgccgctgtcgctgctgcccggcagccagctgtggaccaacctttccaccgtgctgtggaacggcagcggcgggttggcggtgccgctggcgcgcacgctgtggaacagcttcgtgatggcgatgctgatcgccgtcggcaagatcgtcatttccttcctgtcggcctacgccatcgtctatttccgcttcccgctgcgcaagaccggcttcgcgctgatcttcgtcacactgatgctgccggtggaggtgcgcatcttcccgacggtggaagtggtgaccaagatggggctgatcaacagctataccggcctgacgctgcccttgatcgcgtccgccaccgccaccttcctgctgcggcagttcttcatgacgctgcccaaggaattgatggaggcgtcgcgggtggacggcgcggggccgatccgcttcatggtggacgtggtgctgcccttgtcgcgcaccaatatcgcggccttgttcgtgattaccttcatctacggctggaaccagtatctgtggccgctcttggtcacccatgatccggcgatgtccacctcggtgatcgcgatcaagggcatgctgggcgagggcgcggtgcagtggcacctggtgatggcgtccgcgctcttgaccctgctgccgccgctggcggtggtgatcggcatgcagcgctggttcgtcaagggcctggtggacaacgagaaatga

SEQ ID NO: 3501 - protein, 279 aa, Chromobacterium violaceum ATCC 12472
MVENRKGLDLFCHAMLIAGMLVVAFPLYLMLVAASQDADQVTRVPLSLLPGSQLWTNLSTVLWNGSGGLAVPLARTLWNSFVMAMLIAVGKIVISFLSAYAIVYFRFPLRKTGFALIFVTLMLPVEVRIFPTVEVVTKMGLINSYTGLTLPLIASATATFLLRQFFMTLPKELMEASRVDGAGPIRFMVDVVLPLSRTNIAALFVITFIYGWNQYLWPLLVTHDPAMSTSVIAIKGMLGEGAVQWHLVMASALLTLLPPLAVVIGMQRWFVKGLVDNEK

SEQ ID NO: 3502 - DNA, 843 bp, Vibrio vulnificus YJ016
  CDS (1)..(843): transl_table=11
atgaaaagtaatcgactctctgaccacttgattttgatcgctggcgcactctttatgttgctgccactttggctgatcttcgccagctctacccacaacccaaacaccatcgtctcagaaggattgcaatggacgctaggagacaatctgcaagcggtttacgccgaggcatggaacaaaagtttgggctttgctggtaatgtgaccgctcataccatgatcgtcaattccatgatcatggggctgggtttcgcgattgggaaaattattatctcgatgatggcagcgtatgcactggtttactttcgcctgccctattcgaccgcgtggttttggctgatcttcatcacactgctgctgccgctggaagtacgtatcatcccttcttatgaagtggtttctcgcttgggcatgctcaatagctacacgggtttagtgctgcctcttatcgcctccgccactgccacgtttttctttcgtcagttttttaaaaccattcctgatgaactgcttgaagcggcacaactcgacaacgcagggccgatacgattctttatcgatattttgttccctctgtccaaaaccatgatggccgccatcttcatcatcatgtttatcgtgggttggaatcaatatctctggccaatcatgatgaccaccgatgagcagtacaacaccatcgtcatgggcatcaaacagattctcaataacatcaatgaaaccagcttacctcgctatgactacgcctttgccatggtgatcctcgccatgttgccgcctgttttggtggtggtcatcttccagcgttggtttgttaaaggattagtagaaagtgaaaaataa

SEQ ID NO: 3503 - protein, 280 aa, Vibrio vulnificus YJ016
MKSNRLSDHLILIAGALFMLLPLWLIFASSTHNPNTIVSEGLQWTLGDNLQAVYAEAWNKSLGFAGNVTAHTMIVNSMIMGLGFAIGKIIISMMAAYALVYFRLPYSTAWFWLIFITLLLPLEVRIIPSYEVVSRLGMLNSYTGLVLPLIASATATFFFRQFFKTIPDELLEAAQLDNAGPIRFFIDILFPLSKTMMAAIFIIMFIVGWNQYLWPIMMTTDEQYNTIVMGIKQILNNINETSLPRYDYAFAMVILAMLPPVLVVVIFQRWFVKGLVESEK

SEQ ID NO: 3504 - DNA, 849 bp, Rhodopseudomonas palustris CGA009
  CDS (1)..(849): transl_table=11
atggtcgagcgccggaagttcggaaacctggtgccgcacctgatcctgtggatcggcgtcgcgatcgttgccttcccggtctatctggcgttcgtcgcctcgacccaggacaacgccaccatcgccaatggccagatgtcgctgctacccggcagccatttcctggaaacctactacaagaccatcttcgtcggctcctccggcaccacgcgggagccggtcgccagcatgctgttcaactcgttcgtgatggcgatgtcgatcgcgctaggcaagatcgcgatctcgatcatctccgcctacgcgatcgtgtacttccggtttccgttccggatgacgatcttctggatcatcttcatcacgctgatgctgccggtcgaggtccggatctatccgacctacaagatcgccgccgacctcaatctgctggacagctacgccgggctggcgctgccgctgatcgcgtcggcaaccgcaacgctgctgttccggcagttcttcatgacggtgccggacgagctgttggaagcgtcgcggatcgacggcgccgggccgctgcggttcttctgggatacgctgctgccgctgtcgcgcaccaatatggcggcgctgttcgtgatcctcttcatcctcggctggaatcaatatctctggccgctgctgatcaccacgcgtgacgacatgcagaccatccagatcggcatccgcaaaatgattgtcacctcggatgcgttgaccgaatggccgatcgtgatggcgaccgcggtgctggcgatgctgccgccggtcgccgtggtggtgctgatgcagaagctgttcgtgcgcggactggtcgagacggagaagtaa

SEQ ID NO: 3505 - protein, 282 aa, Rhodopseudomonas palustris CGA009
MVERRKFGNLVPHLILWIGVAIVAFPVYLAFVASTQDNATIANGQMSLLPGSHFLETYYKTIFVGSSGTTREPVASMLFNSFVMAMSIALGKIAISIISAYAIVYFRFPFRMTIFWIIFITLMLPVEVRIYPTYKIAADLNLLDSYAGLALPLIASATATLLFRQFFMTVPDELLEASRIDGAGPLRFFWDTLLPLSRTNMAALFVILFILGWNQYLWPLLITTRDDMQTIQIGIRKMIVTSDALTEWPIVMATAVLAMLPPVAVVVLMQKLFVRGLVETEK

SEQ ID NO: 3506 - DNA, 852 bp, Bartonella quintana str. Toulouse
  CDS (1)..(852): transl_table=11
atggttgaaaatcgccctattttgaaatttctaacccatatcacccttattattggcatttttattatctgttttccagtttatgttgctattattgcatcaacccatagttcagcggcatttaactcaggaacacttccccttttaccgggaaagtatgcgttggaaaactataaaacaatctttggtgatgatcttgtgcagcttggtctgcccaatctctggccactcttaatgaattcgctcattatggcacttggcattagtattggaaaaattattatttcactcttgtctgcttacgcaattgtctacatgcgcttcccttttcgcaaaactgcttttgccctcatttttatcacactgatgctgcctatcgaagttcgtattattccaacgtatgcagtggtcgcacaattaggcatgataaacacctatggcgggatgattattccacttattgcatccgcaactgctacatttttatttcgccagttttttttgactgttcctgatgaactcttagaagctgctcgcgttgatggtgcaggatcatttaaattttttaaagatattcttctccctcttagcaaaagcaatattgcggctttatttatcattatgttcatttatggatggatacaatatctctggcccctcatagttacaactgatcaaaatcatcaaactattcttattattctcaaacaacttatcgtagaatcacttcaacatgatcctaaatggaatatactcatggcagtatcagtcgtcgccatggtgccgcctgttcttgttgtcatctgcatgcagcggctttttatcaaaggtcttattgaaacggagaaatga

SEQ ID NO: 3507 - protein, 283 aa, Bartonella quintana str. Toulouse
MVENRPILKFLTHITLIIGIFIICFPVYVAIIASTHSSAAFNSGTLPLLPGKYALENYKTIFGDDLVQLGLPNLWPLLMNSLIMALGISIGKIIISLLSAYAIVYMRFPFRKTAFALIFITLMLPIEVRIIPTYAVVAQLGMINTYGGMIIPLIASATATFLFRQFFLTVPDELLEAARVDGAGSFKFFKDILLPLSKSNIAALFIIMFIYGWIQYLWPLIVTTDQNHQTILIILKQLIVESLQHDPKWNILMAVSVVAMVPPVLVVICMQRLFIKGLIETEK

SEQ ID NO: 3508 - DNA, 852 bp, Bartonella henselae str. Houston-1
  CDS (1)..(852): transl_table=11
atggttgaaaatcgccctgttttaaaatttctaacccatataacccttattattggcattttcattatttgctttccagtttatgttgctatcattgcctcaacccataactcggcggcatttagttcaggaacacttcctcttttaccaggaaaatatgccctggaaaactataagacaatctttggtgatggacttatgcagcttggtttgcctaatctctggccactcttaatgaactccctcattatggctgttggtattagtattggaaaaattattatttcactcttttctgcttatgcaattgtctacatgcgcttcccttttcgcaaaactgcgtttgcccttatattcattacattaatgctacctgtcgaagttcgtattatcccaacatatgcagtcgtcgcacaattaggcatgataaacacctatggtggaatgattattccactcattgcatctgcaactgctacatttttatttcgtcagttttttttgactgttcctgacgaactcttagaagctgctcgtgttgatggtgcaggaccatttaaattttttaaagatattcttcttcctcttagcaaaagtaatattgctgctttatttatcattatgttcatttatggatgggtacaatatctttggcctcttatagtcacaactgaccaaaatcatcaaactattcttattattctcaaacagctcatcgtagaatcacttcaacataaccctcaatggaatatactcatggcagtatcggttgtggccatggtgccacctgttctagtcgttattttcatgcagcgactttttatcaaaggccttattgaaacggagaaataa

SEQ ID NO: 3509 - protein, 283 aa, Bartonella henselae str. Houston-1
MVENRPVLKFLTHITLIIGIFIICFPVYVAIIASTHNSAAFSSGTLPLLPGKYALENYKTIFGDGLMQLGLPNLWPLLMNSLIMAVGISIGKIIISLFSAYAIVYMRFPFRKTAFALIFITLMLPVEVRIIPTYAVVAQLGMINTYGGMIIPLIASATATFLFRQFFLTVPDELLEAARVDGAGPFKFFKDILLPLSKSNIAALFIIMFIYGWVQYLWPLIVTTDQNHQTILIILKQLIVESLQHNPQWNILMAVSVVAMVPPVLVVIFMQRLFIKGLIETEK

SEQ ID NO: 3510 - DNA, 852 bp, Erwinia carotovora subsp. atroseptica SCRI1043
  CDS (1)..(852): transl_table=11
atggcaatgattgagaatcgtcgcgggttagatattttcagccacgtcatgctgatcgtcggcattctcgccgtattgttccctctgtacgtggggtttgtcgccgccacgctggataatcaggaagtctttcaggctccgatgacgctcatccccggttcgcacctgtggggaaacctgcgtgatatctggttgcacggtgcgggcaataacaccacgccgttcgggctaatgctgctcaatagcttcgtcatggcgctggcgatcacggtaggcaaaattaccgtatcgatcctatccgcttacgccatcgtttattttcgttttccactgcgcaacctgttcttctggatgattttcctgacgctgatgctgccggtagaagtgcgtattttcccgacggtggaagtgatcgcgcggctggacatgatggacagctacaccggtttaacgctgccgctgatggcgtcggcgaccgcaactttcctgtttcgccagttctttatgacgctgccggatgaactgatggaagcggcgcgtatcgacggtgccagcccgatgcgtttcttcttcgacatggtgttgccgctgtcgaagaccaatctggcggcgctgttcgtgatcacgttcatttacggctggaaccagtatctgtggccgctgctgatagttagcgatgccaatctgggcaccgcggttgcggggattaaaagcatgattgcctccggtgatggtgcaacccagtggaatcaggtgatggccgcgatgctgttgaccatgctgccgccgctgctggtggtgctactgatgcagcgctggttcgttcgcggtctggtcgacagcgaaaaataa

SEQ ID NO: 3511 - protein, 283 aa, Erwinia carotovora subsp. atroseptica SCRI1043
MAMIENRRGLDIFSHVMLIVGILAVLFPLYVGFVAATLDNQEVFQAPMTLIPGSHLWGNLRDIWLHGAGNNTTPFGLMLLNSFVMALAITVGKITVSILSAYAIVYFRFPLRNLFFWMIFLTLMLPVEVRIFPTVEVIARLDMMDSYTGLTLPLMASATATFLFRQFFMTLPDELMEAARIDGASPMRFFFDMVLPLSKTNLAALFVITFIYGWNQYLWPLLIVSDANLGTAVAGIKSMIASGDGATQWNQVMAAMLLTMLPPLLVVLLMQRWFVRGLVDSEK

SEQ ID NO: 3512 - DNA, 846 bp, Yersinia pseudotuberculosis IP 32953
  CDS (1)..(846): transl_table=11
atgatcgagaatcgtcgtggattggatatcttttgtcacatcatgctgattatcggggtgctattgatcctgttcccactgtatgtggcgttcgttgcggcttcattagatgacagccaggtttttcaggcgcccatgacgctgatccctggcccgcatttgtggcaaaacatcagccatatctggcatgccggcgtgggcaataacagcacacctttcgggttgatgctgttgaacagttttgttatggcttttgccattactgtcggcaaaatcactgtctcaatattgtctgcttatgccatcgtttacttccgtttcccactgcggaatctgtttttctggctaatcttcctcacgctgatgctaccggtggaagtgcgtattttccctaccattgaggtgattgccaacctgaacctgctagacagctataccggtttaacattgccgctgatggcctctgccacggcgacgttcttattccgccagttctttatgacgttgccggatgagctattggaagccgcccgtattgacggcgccggtgccatgcgtttcttctgggacattgtattaccgctgtcaaaaaccaatctcgcagcattatttgttattacctttatttatggctggaaccaatacctttggccgatcttaatcaccagtgatgcctcaatgggcacggcagtggcggggataagaagcatgatttcaacctcgggcgcaccaacccaatggaatcaggttatggcggcgatgattttgactttaattccaccggtcgtggtggttcttttgatgcagcgttggtttgtacgcggcttggtagacagtgagaagtaa

SEQ ID NO: 3513 - protein, 281 aa, Yersinia pseudotuberculosis IP 32953
MIENRRGLDIFCHIMLIIGVLLILFPLYVAFVAASLDDSQVFQAPMTLIPGPHLWQNISHIWHAGVGNNSTPFGLMLLNSFVMAFAITVGKITVSILSAYAIVYFRFPLRNLFFWLIFLTLMLPVEVRIFPTIEVIANLNLLDSYTGLTLPLMASATATFLFRQFFMTLPDELLEAARIDGAGAMRFFWDIVLPLSKTNLAALFVITFIYGWNQYLWPILITSDASMGTAVAGIRSMISTSGAPTQWNQVMAAMILTLIPPVVVVLLMQRWFVRGLVDSEK

SEQ ID NO: 3514 - DNA, 771 bp, Legionella pneumophila subsp. pneumophila str. Philadelphia 1
  CDS (1)..(771): transl_table=11
atgatggctcctttgtatttggctgtagttgctgcaagtcatgaaggaacggtcatgatgcattctcagttgccattgattccagggacctcatttttcaaaaatattaaaagtgtgctgactgaaggtttagctgtcactggaggtgagcctatcacttccatgcttgtaaatagcttattcatggcatttatcattgcagtgggtaagatcattttggctctgggatctgcttttgcattggtatattttgatttttcttttaaaaagtcttgttttgccctgatatttgcaacgatgatgttaccagtggaagtaagaatagtccctacttttcaagtggttgcttcatttggcctattgaactcattttctggtttaaccttgccattattggcatcagctactggaacatttttatttcgtcagttttttaaaaccatatctaaagaactggttgatgctgctaaattagatggcgcaggtccattaagattttttattgatatcgtgttacccttgtcaagaactcaaatttccgccttgtttgtaatcttgtttgtctatgggtggaatcaatacttatggcctttggtcatcacgacagaaactaaaatgacaactattgtgatgggaattcggtatttggcaggcgtagcggatcaagtaccggagtggcactatattatggccgtcgcattgatagctcttgtgccgccttgtatggtggttatggtgatgcaacgttggttcgaaaagggattgaaataa

SEQ ID NO: 3515 - protein, 256 aa, Legionella pneumophila subsp. pneumophila str. Philadelphia 1
MMAPLYLAVVAASHEGTVMMHSQLPLIPGTSFFKNIKSVLTEGLAVTGGEPITSMLVNSLFMAFIIAVGKIILALGSAFALVYFDFSFKKSCFALIFATMMLPVEVRIVPTFQVVASFGLLNSFSGLTLPLLASATGTFLFRQFFKTISKELVDAAKLDGAGPLRFFIDIVLPLSRTQISALFVILFVYGWNQYLWPLVITTETKMTTIVMGIRYLAGVADQVPEWHYIMAVALIALVPPCMVVMVMQRWFEKGLK

SEQ ID NO: 3516 - DNA, 846 bp, Burkholderia pseudomallei K96243
  CDS (1)..(846): transl_table=11
atgatcgagaatcgcaagggcttcgacctgttctgccacgcggtgctgatcgcgggcatcgcggtcatcgtgttcccggtgtacgtcgggttctgcgcggcgacgatgaacgcgcgcgaagtgttcacggtgccgctgtcgctcgtgccgagcacgcatctgttcgagaacgtcaccgcgatctggcggcgcggcagcggcggcatgacgacgccgttcggcacgctgctcgtcaacagcgtcgtgatggcgctcgtgatcgcggcgggcaagatctcggcgtcgatcctgtccgcttacgcaatcgtgtacttccgctttccgctgcgcaatacggcgttctggctgatcttcgtcacgctgatgctgcccgtcgaagtgcggatctttccgaccgtgcaggtggtgtcgacgctgcatctgacgaacagctacgcggggctcacgctgccgctcatcgcgtcggcgacggcgaccttcctgttccggcagttcttcatgacgctgcccgacgagctcgtcgacgcggcgcgcatcgacggcgcggggccgctgcgtttcttctgggacgtcgtgctgccgctgtcgaagacgagcatcgccgcgctgttcgtgatcacgttcatctacggctggaaccagtatctgtggccgatcctgatcacgaccgacgcgtcgctgacgacggccgtggtcggcatcaaatcgatgatcgcgagcggcgacgccgcgaccgaatggcatctcgtgatggcggcgacgctcgtcgcgatgctgccgccgctcgtcgtcgtgctcgcgatgcagcgctggttcgtgcgcggcctcgtcgattcggaaaagtga

SEQ ID NO: 3517 - protein, 281 aa, Burkholderia pseudomallei K96243
MIENRKGFDLFCHAVLIAGIAVIVFPVYVGFCAATMNAREVFTVPLSLVPSTHLFENVTAIWRRGSGGMTTPFGTLLVNSVVMALVIAAGKISASILSAYAIVYFRFPLRNTAFWLIFVTLMLPVEVRIFPTVQVVSTLHLTNSYAGLTLPLIASATATFLFRQFFMTLPDELVDAARIDGAGPLRFFWDVVLPLSKTSIAALFVITFIYGWNQYLWPILITTDASLTTAVVGIKSMIASGDAATEWHLVMAATLVAMLPPLVVVLAMQRWFVRGLVDSEK

SEQ ID NO: 3518 - DNA, 852 bp, Silicibacter pomeroyi DSS-3
  CDS (1)..(852): transl_table=11
atggtcgaaaatcgccccatcctgaatgtcatcacccatctggttctgatccttggcatcgtcatcgtcgcgctgccgatctggatcacctttgtcgccgccacccatgacgcggtgcgcatgacacaggcgccgatcccgatgctgccgggcacccatttctgggagaatttcactcagaccctgtttggctctggcctgagcgggaccgagaccgcaccggtctggcggatgctgctcaacagcctggccatggcgatgatgatcgccttgggcaagatcgcgatctcgctgatttcggcctttgccatcgtctatttcaagtttcccttccgcatgttctttttctggctgatcttcgtcaccctgatgctgccggtcgaggtgcgcatcctgcccacgttcgaagtggtggccgatctgggcatgctcaacagctattggggcctgtcgatcccgctgattgcctcggccacggcaacgttcatgttccgccaggtgtttctgaccatccccgacgagatgctggaaagcgcgcgcatcgacggggccgggccgctgcgctttttctgggatatcctgatcccgctgtcgcgcaccaatatcgcggcgctgttcgtgatcctcttcatctatggctggaaccagtatctgtggccgctgctgattaccactgacaccgacatgaccaccatcgtgatgagcatcaagcaaatgcttgaggcggcggaacagtccccgcaatggaacatcatcatgatgaccgcgctgctggcgatgctgccgccggtcttcgtggtggtcgcaatgcaaaagctctttgttcagggcctgacagagaccgacaaatag

SEQ ID NO: 3519 - protein, 283 aa, Silicibacter pomeroyi DSS-3
MVENRPILNVITHLVLILGIVIVALPIWITFVAATHDAVRMTQAPIPMLPGTHFWENFTQTLFGSGLSGTETAPVWRMLLNSLAMAMMIALGKIAISLISAFAIVYFKFPFRMFFFWLIFVTLMLPVEVRILPTFEVVADLGMLNSYWGLSIPLIASATATFMFRQVFLTIPDEMLESARIDGAGPLRFFWDILIPLSRTNIAALFVILFIYGWNQYLWPLLITTDTDMTTIVMSIKQMLEAAEQSPQWNIIMMTALLAMLPPVFVVVAMQKLFVQGLTETDK

SEQ ID NO: 3520 - DNA, 894 bp, Pseudomonas syringae pv. syringae B728a
  CDS (1)..(894): transl_table=11
atgatcgagcataaccggctgttcaacgcaggcgcttacctgctgctgacccttggcctggtgttcgcgttggggccgctgtacatagcggtctgctcggcgaccgtcagtaacccgcaattgttcgcccacggtcttgcggtgatccctggcgaccaactgttggagaatctgcagcgggtcagtcggcgtctggatctgctgcgcctgctgggcaacagcctgctggtcgccacgctggtggtgatcggcaagctggcgctctcggcgctgacggcctttgccgtggtgtactttcgcagccgctacagttcggtgatgttcttcgccgtgctgggggcgctgctgctgccgctggaagtacggatcatccccacgtatgccgtggccagcgatctgctcggccccgtgcgcagcctgttgcactggctgggcattcagtggctgccactgccgaccatcaatttgctcgacagctaccccggcctcgccctgccgctgattgcctcggcgaccggcacctttctgtttcggcagttctaccagacgctgcctgccgagctggtcgaggccgcacgcatggacggtgcagggccctggcggtttttcatcgacatcctgctgccactgtcgaagaccaactttgctgcgctcggcacgctggtgttcatcggcgcctggaaggactacctgtggccgctggtggcaaccaatcgcgaggacatgcgcacgctggtactgggcgtggccagctttctgccgaccgatgcaacccaggtccccgagtggaacctgctgatggccgctgctgtggtcagcatgctgccgcccatcctcgtcattgcgctcatgcagcgctggtttgtcaaaggcctgatcggagtcggtaaatga

SEQ ID NO: 3521 - protein, 297 aa, Pseudomonas syringae pv. syringae B728a
MIEHNRLFNAGAYLLLTLGLVFALGPLYIAVCSATVSNPQLFAHGLAVIPGDQLLENLQRVSRRLDLLRLLGNSLLVATLVVIGKLALSALTAFAVVYFRSRYSSVMFFAVLGALLLPLEVRIIPTYAVASDLLGPVRSLLHWLGIQWLPLPTINLLDSYPGLALPLIASATGTFLFRQFYQTLPAELVEAARMDGAGPWRFFIDILLPLSKTNFAALGTLVFIGAWKDYLWPLVATNREDMRTLVLGVASFLPTDATQVPEWNLLMAAAVVSMLPPILVIALMQRWFVKGLIGVGK

SEQ ID NO: 3522 - DNA, 894 bp, Pseudomonas syringae pv. phaseolicola 1448A
  CDS (1)..(894): transl_table=11
atgatcgagcgtcaccggctgatcgacgcgggcgcttacctgctgctgacgctcgggctggtgttcgcgacgggaccgctgtacgtcgcagtctgctcggcaactgtgagcaacccacaactgttcgcccacggccttgcgctgatacccggcgaccaactgctggagaacctgcaacaagtcacccgacgcctcgacctgctgcgcttgctgggcaatagcctgctggtcgccacgctggtggtaatcggcaagctgacactttcggcgctgacagcatttgccgtggtgtactttcgcagccgctacacctcggtgatcttctttgccgtgctgggcgctctgctgctgccgctggaggtacgcatcatccccacgtatgcggtggccagcgacctgctcggaccgctacgcaacctgttgcaatggctgggcatccagtggctgccggtgccgaccatcaacctgctcgacagctacaccgggctcgccttgccgctgattgcctcagccaccggcacctttctgttccggcagttttaccagacgctgcccgccgaactggtcgaggccgcacgtatggacggtgccgggccctggcgtttttttgtcgacattctgctgccgctgtcgaagaccaacttcgcagcgctcggcacgctggtgttcatcggcgcgtggaaagactacctgtggccgctggtcgcgaccaatcgcgaggacatgcgcacgctggtgctgggcgtcgccagctttctgccgaccgatgcaacccaggtccccgaatggaacctgctgatggccgccgccgtggtcagcatgctaccccccatcctcgtcattgcgctcatgcagcgatggtttgtcaaaggcctgatcggagtcggtaaatga

SEQ ID NO: 3523 - protein, 297 aa, Pseudomonas syringae pv. phaseolicola 1448A
MIERHRLIDAGAYLLLTLGLVFATGPLYVAVCSATVSNPQLFAHGLALIPGDQLLENLQQVTRRLDLLRLLGNSLLVATLVVIGKLTLSALTAFAVVYFRSRYTSVIFFAVLGALLLPLEVRIIPTYAVASDLLGPLRNLLQWLGIQWLPVPTINLLDSYTGLALPLIASATGTFLFRQFYQTLPAELVEAARMDGAGPWRFFVDILLPLSKTNFAALGTLVFIGAWKDYLWPLVATNREDMRTLVLGVASFLPTDATQVPEWNLLMAAAVVSMLPPILVIALMQRWFVKGLIGVGK

SEQ ID NO: 3524 - DNA, 849 bp, Ralstonia eutropha JMP134
  CDS (1)..(849): transl_table=11
atggtagaacgacgacctttgctcgatgtactttctcatttgatgctgctccttggcgtgggcatcgtggcctttccggtctatgtgaccttcgtcgcgtcgacactaaccgcggacgaggtactacaggcgcccatgacgttggtgccaggcagccacttgctggaaaactacaggacggtcctggtggacggtgttggcaatgccgcgtcgcccgtttccacgatgatgatgaacagcctgatcatggcgctcgggattgcgctgggcaagatcgcgatctccatcatctcggccttcgcgatcgtctatttccgcttcccgctgcgcaagaccttcttctggctgatcttcatcacgctgatgctgccggtggaagtccgcattctgccaacctacaaggtcgtgtccgacctcggcatgctcgacagctattttggcctgacgattccgatcatcgcctcggccacggccacgttcctgttccggcagttcttcctgacgattcccgacgagcttgccgaagcggcgcgcatcgatggcgcagggccgctgcgcttcttctgggacgtggtgctgccactgtcgcgcacgagcatcgcggccctgttcgtgatccagttcatctacggctggaaccagtacctgtggccgctgctgatcaccacgcagaagtcgatgacgccgatcgtggtcggtgtgacgcagatgatttcgcgctcgggcgatgcggcaacggactggaacctcgtaatggccaccgtgatgctggccatgattccgccagctgtcgtcgtggtgctgatgcagaagtggttcgtcaagggactggtcgaaaccgagaagtga

SEQ ID NO: 3525 - protein, 282 aa, Ralstonia eutropha JMP134
MVERRPLLDVLSHLMLLLGVGIVAFPVYVTFVASTLTADEVLQAPMTLVPGSHLLENYRTVLVDGVGNAASPVSTMMMNSLIMALGIALGKIAISIISAFAIVYFRFPLRKTFFWLIFITLMLPVEVRILPTYKVVSDLGMLDSYFGLTIPIIASATATFLFRQFFLTIPDELAEAARIDGAGPLRFFWDVVLPLSRTSIAALFVIQFIYGWNQYLWPLLITTQKSMTPIVVGVTQMISRSGDAATDWNLVMATVMLAMIPPAVVVVLMQKWFVKGLVETEK

SEQ ID NO: 3526 - DNA, 864 bp, Rhodobacter sphaeroides 2.4.1
  CDS (1)..(864): transl_table=11
atggctgagcacgagatgatcggcacctcgcgccagagccggatcatggcgcatttcctgctggtgatcggggtcatcgtggtggccttcccgatctggtatgtcttcgtggcctcgacccacccgctccagcagatcctgcgcccgccgctgccgctgctgcccggcgccgaggggccctcgaactacgcccgcgcgctcggcggcgggatcggacagatcggccgcgtgggggtggaccggcttcttctcaacacggccgtcgtggctttcggcatcgccatcggaaagatcctgatctcgatggcctcggcctacgccatcgtcttcttccgcttcccgctgcgcatggtctgcttctggatgatcttcatcaccctgatgctgccggtcgaggtgcggatcctgcccacctacaaggtgatggtggacctgcgcctgatcgacacctacgcgggtctgatcctgccgctggtggcctcggccacggggacgctgctcttccggcagttcttcatgacgatcccgaacgagctgatggaagccgctcgcgtcgatggcgcaggcccctggcgcttcttcaaggacatcctgctgccgctctcggccaccaacatcgcggcgctgttcgtgatcctcttcatctacggatggacgcagtatctctggccgctcctcgtgaccaactcgaactcgatgaacaccatcgtgatcgccctgagaaagatgatctccttcgccgatgccgacacgccgtgggacctcgtgatggtcacctgcgtgctggccatcctgccgccgatcctcgtggtcgtgctgatgcagcggtggttcgtgaagggacttgtggagacggagaagtaa

SEQ ID NO: 3527 - protein, 287 aa, Rhodobacter sphaeroides 2.4.1
MAEHEMIGTSRQSRIMAHFLLVIGVIVVAFPIWYVFVASTHPLQQILRPPLPLLPGAEGPSNYARALGGGIGQIGRVGVDRLLLNTAVVAFGIAIGKILISMASAYAIVFFRFPLRMVCFWMIFITLMLPVEVRILPTYKVMVDLRLIDTYAGLILPLVASATGTLLFRQFFMTIPNELMEAARVDGAGPWRFFKDILLPLSATNIAALFVILFIYGWTQYLWPLLVTNSNSMNTIVIALRKMISFADADTPWDLVMVTCVLAILPPILVVVLMQRWFVKGLVETEK

SEQ ID NO: 3528 - DNA, 846 bp, Burkholderia sp. 383
  CDS (1)..(846): transl_table=11
atgatcgaaaatcgcaagggcttcgacctgttctgtcacgcggtgctgatcgcgggtgtggtgctggtcgtgtttcccgtctacgtcgcgttctgcgcggcgacgatgaacgcgcaggaagtgttcacggtgccgctgtcgctcgtgccgagcacgcacctgttcgagaacgtcgcgtacatctgggggcatggcagcgccggcacgaccgcgccgttcggccgcctgctcctgaacagcttcgcaatggcgttcggcatctccgtgggcaagatcgcggtgtcgatcctgtctgcgtacgcgatcgtctatttccgcttcccgttccgcaacacggcgttctggctgatcttcgtcacgctgatgctgccggtggaggtgcggatcttcccgaccgtgcaggtcgtgtcgacgttgcacatgacgaacacctatgcggggctcacgctgccgctgatcgcatcggcgaccgcgacgttcctgttccgccagttcttcatgacgttgcccgacgagctgatggatgccgcgcgcatcgacggcgcggggccgctgcggttcttctgggacgtcgtgctgccgctgtcgaagacgagcatcgcggcgctgttcgtgatcacgttcatctacggctggaaccagtatctgtggccgatcctgatcacgacggaggcgtcgctgtcgacggcggtggtgggcatcaagacgatgatcgcgagcggcgacgccgcgaccgaatggcaatacgtgatggcggcgacgctgctgggaatgatcccgccgctcgtcgtcgtgctggcgatgcagcgctggttcgtgcgcggcctcgtcgattccgagaaataa

SEQ ID NO: 3529 - protein, 281 aa, Burkholderia sp. 383
MIENRKGFDLFCHAVLIAGVVLVVFPVYVAFCAATMNAQEVFTVPLSLVPSTHLFENVAYIWGHGSAGTTAPFGRLLLNSFAMAFGISVGKIAVSILSAYAIVYFRFPFRNTAFWLIFVTLMLPVEVRIFPTVQVVSTLHMTNTYAGLTLPLIASATATFLFRQFFMTLPDELMDAARIDGAGPLRFFWDVVLPLSKTSIAALFVITFIYGWNQYLWPILITTEASLSTAVVGIKTMIASGDAATEWQYVMAATLLGMIPPLVVVLAMQRWFVRGLVDSEK

SEQ ID NO: 3530 - DNA, 846 bp, Burkholderia thailandensis E264
  CDS (1)..(846): transl_table=11
atgatcgagaatcgcaagggcttcgacctgttctgccacgcggtgctgatcgcgggcatcgcggtcatcgtgtttcccgtgtacgtcggcttctgcgcggcgacgatgaacgcgcgcgaagtgttcacggtgccgctgtcgctcgtgccgagcacgcatctgttcgagaacgtcgccgagatctggcggcgcggcagcggcggcatgacgacgccgttcggcacgctgctcgtcaacagcgtcgtgatggcgctcgtgatcgcggcgggcaagatttcggtgtcgatcctgtccgcgtacgcgatcgtctatttccgctttccgctgcgcaacgccgcgttctggctgatcttcgtcacgctgatgctgcccgtcgaggtgcggatctttccgaccgtgcaggtggtgtcgacgctgcatctgacgaacagctacgcgggcctcacgctgcccctcatcgcgtcggcgacggcgaccttcctgttccggcagttcttcatgacgctgcccgacgagctcgtcgacgcggcgcgcatcgacggcgcgggcccgctgcgcttcttctgggacgtcgtgctgccgctgtcgaagacgagcatcgccgcgctgttcgtgatcacgttcatctatggctggaaccagtatctgtggccgatcctgatcacgaccgacgcatcgctctcgacggccgtcgtcggcatcaagtcgatgatcgcgagcggcgacgccgcgaccgaatggcatctcgtgatggcggcgacgctcgtcgcgatgctgccgccgctcgtcgtcgtgctcgcgatgcagcgctggttcgtgcgcggtctcgtcgattcggaaaaataa

SEQ ID NO: 3531 - protein, 281 aa, Burkholderia thailandensis E264
MIENRKGFDLFCHAVLIAGIAVIVFPVYVGFCAATMNAREVFTVPLSLVPSTHLFENVAEIWRRGSGGMTTPFGTLLVNSVVMALVIAAGKISVSILSAYAIVYFRFPLRNAAFWLIFVTLMLPVEVRIFPTVQVVSTLHLTNSYAGLTLPLIASATATFLFRQFFMTLPDELVDAARIDGAGPLRFFWDVVLPLSKTSIAALFVITFIYGWNQYLWPILITTDASLSTAVVGIKSMIASGDAATEWHLVMAATLVAMLPPLVVVLAMQRWFVRGLVDSEK

SEQ ID NO: 3532 - DNA, 846 bp, Burkholderia xenovorans LB400
  CDS (1)..(846): transl_table=11
atgatcgagaaccgccgcggtttcgacctcttctgccacgcggtgctgatgctcggcgtcgtgctggtggtgtttccggtgtacgtcgcgttctgcgcggcgaccatgagcgagcacgaagtgttcagcgtgccgctctcgctggtgccgagcacgcatctgttcgagaacatcgcgaccgtctggtcgcaaggcagcggcaacgcggcggcgccgttcggccgcatgctgttcaacagcctcgtcatggcgctggtgatttcgatcggcaagatcgcggtctcgatgatctccgcgtacgcgatcgtgttcttccgttttccgttccgcaacctcgcgttctggctgattttcatcacgctgatgctgccggtcgaagtgcggatctttccgaccgtgcaggtcgtgtcgtcgatgcatctgagcaatacgtacagcggtttgacgttgccgctgatcgcctcggccaccgcgacattcctgttccgccagttcttcatgacgctgccggacgaactcatggaagccgcgcggatcgacggcgcgggcgccatgcggtttttctgggacgtcgtgttgccgctgtcgaaaacgaacatggcggccctcttcgtcatcacgttcatttacggctggaatcagtacctgtggccgattctgatcacgagccagcaatcgctgaccacggccgtggtcggcatcaaaagcatgatcgcctcgggcgacaccgcgaccgaatggcacctggtgatgaccgcgacactgctcgcaatgctgccgccgctcgccgtcgtgctgacgatgcagcgctggttcgtgcgcggactcgtggacgcggagaagtga

SEQ ID NO: 3533 - protein, 281 aa, Burkholderia xenovorans LB400
MIENRRGFDLFCHAVLMLGVVLVVFPVYVAFCAATMSEHEVFSVPLSLVPSTHLFENIATVWSQGSGNAAAPFGRMLFNSLVMALVISIGKIAVSMISAYAIVFFRFPFRNLAFWLIFITLMLPVEVRIFPTVQVVSSMHLSNTYSGLTLPLIASATATFLFRQFFMTLPDELMEAARIDGAGAMRFFWDVVLPLSKTNMAALFVITFIYGWNQYLWPILITSQQSLTTAVVGIKSMIASGDTATEWHLVMTATLLAMLPPLAVVLTMQRWFVRGLVDAEK

SEQ ID NO: 3534 - DNA, 849 bp, Ralstonia metallidurans CH34
  CDS (1)..(849): transl_table=11
atggtagaacgacgtcccgtactcgactttattactcacctcgtgctgatcgtcggtatcgcgatcgtggcatttccggtgtacctgaccttcgtcgcgtcgacgctgacggccgagcaggtactcgatgcaccgatgacgctgatcccgggcagccatctgatcgaaaactatcgcaccgtgctgtttcaaggcgtgggcgaggccgcttcgccggtctcgaccatgatgaagaacagcctgatcatggcgttgggcattgcgctggggaagatcgcgatttcgatcatttccgccttcgcgatcgtctatttccgctttccgctgcgcaagacgttcttctggatgatcttcatcacgctgatgctgccggtggaagtgcgtatcctgccgacctacaaggtggtatctgacctcggcatgctggatagctacttcggcctgacgattcccatcatcgcgtcggccaccgccacgttcctgtttcggcaattctttctgacgatcccggatgaactggccgaagccgcccgcatcgacggggccggaccgctgcgattcttctgggatgtggtgctgccgctgtcgcgcaccagcatcgccgcgctgttcgtgatccagttcatctatggctggaaccagtacctctggccattgctgatcaccacgcagaagtcgatgacgcccgtggtggtgggcgtgacgcagatgatttcccgctcgggcgatgccgctaccgactggaacctcgtgatggccaccgtgatgctggcgatgatcccgccggcagtggtggtggtgctgatgcaacgctggttcgtcaagggcctcgtggaaacggaaaaataa

SEQ ID NO: 3535 - protein, 282 aa, Ralstonia metallidurans CH34
MVERRPVLDFITHLVLIVGIAIVAFPVYLTFVASTLTAEQVLDAPMTLIPGSHLIENYRTVLFQGVGEAASPVSTMMKNSLIMALGIALGKIAISIISAFAIVYFRFPLRKTFFWMIFITLMLPVEVRILPTYKVVSDLGMLDSYFGLTIPIIASATATFLFRQFFLTIPDELAEAARIDGAGPLRFFWDVVLPLSRTSIAALFVIQFIYGWNQYLWPLLITTQKSMTPVVVGVTQMISRSGDAATDWNLVMATVMLAMIPPAVVVVLMQRWFVKGLVETEK

SEQ ID NO: 3536 - DNA, 852 bp, Silicibacter sp. TM1040
  CDS (1)..(852): transl_table=11
atggttgaaaatagacccatcctgaacatcgtcagccacattatcctgatcctcggcatcgcgatcgtggcgctgcccatctggattacctttgtggccgccacccatgatgcggtgcgcatgacacaggcacctattccgcttttgccgggcagctacttctgggaaaacttcaagcagacgctgtttggctcggggctttcgggcaccgagatcgccccggtctggcggatgttgttgaactctctggcgatggcgatgctgatctctctgggcaagatcgcgatctcgctcatctcggcctttgccatcgtctacttcaagttccccttccgcatggggttcttctggctgatcttcatcacgctgatgctgccggtcgaggtgcgtatcctgccaacattcgaggtggtcgcggatcttggcatgctcaacagctactggggtctttcgatcccgctgattgcctccgccacggcgaccttcatgttccggcaggtgttcctgacgatccctgatgaaatgctcgagagcgcgcgcattgatggcgctgggccgatgcggttcttctgggacatcgtgatcccactcagccgcaccaatatcgcggcgctcttcgtgatcttgttcatctacggctggaaccagtatctctggcccttgctgatcaccaccgacactgacatgaccaccatcgtcatgagcatcaaacagatgctggaggccgcagagcaatctccgcaatggaacatcatcatgatgacggctcttttggcgatgatcccgccggtcttcgtcgtgatcgcaatgcagaagctctttgttcagggcctcaccgagacagataaatag

SEQ ID NO: 3537 - protein, 283 aa, Silicibacter sp. TM1040
MVENRPILNIVSHIILILGIAIVALPIWITFVAATHDAVRMTQAPIPLLPGSYFWENFKQTLFGSGLSGTEIAPVWRMLLNSLAMAMLISLGKIAISLISAFAIVYFKFPFRMGFFWLIFITLMLPVEVRILPTFEVVADLGMLNSYWGLSIPLIASATATFMFRQVFLTIPDEMLESARIDGAGPMRFFWDIVIPLSRTNIAALFVILFIYGWNQYLWPLLITTDTDMTTIVMSIKQMLEAAEQSPQWNIIMMTALLAMIPPVFVVIAMQKLFVQGLTETDK

SEQ ID NO: 3538 - DNA, 849 bp, Rhizobium leguminosarum bv. viciae 3841
  CDS (1)..(849): transl_table=11
atggttgaaaatcgccctttcctgaatttcctggcgcaccttgtcctcatcattggcgtcacgatcgtcgtatttccggtctacgtggctttcatcgcatcgagccacggtccaaacgacttcctgtcaggcgtcgtgccgctgacaccgggaagccatatcatcgagaactattcgacgatgctgtcgtcgggaatgacaagctccggggcgccgccgatcgggccgatgatgatcaactcgctgatcatggcggttggcgtcgccgtcgggaagatcgctatttcgatcctttcggcctttgccatcgtctatttccggtttccgttccggaccttggcattctggatgatcttcatcacgctgatgctgccggtcgaggtacgcatcgtgccgacctataaagtcgtcgccgatcttggaatgctgaacaattacggcggcctcatcattccgctgatcgcatcggcaacggcaaccttcctgtttcgccagttctttctgacagtccccgacgaactcatggaggctgcccgtgtcgatggggcagggccgatgaagttcttccgcgatatcctgctgccgctgtcgatcaccaacatcgcagcattgttcatcatcctgtttgtgctcggctggaaccagtatctgtggccgctcatcataacgaccgaccagagcttctataccgtcgtgatgggaatccagcgcatggcagcggttgccgatgccgagcctcgctggaacctagtgatggcagccgtcattctggccgcactaccacccgtcctcgtcatcgtcgccatgcaacgcctttttgtcaaaggcctggtcgaaacggagaaatga

SEQ ID NO: 3539 - protein, 282 aa, Rhizobium leguminosarum bv. viciae 3841
MVENRPFLNFLAHLVLIIGVTIVVFPVYVAFIASSHGPNDFLSGVVPLTPGSHIIENYSTMLSSGMTSSGAPPIGPMMINSLIMAVGVAVGKIAISILSAFAIVYFRFPFRTLAFWMIFITLMLPVEVRIVPTYKVVADLGMLNNYGGLIIPLIASATATFLFRQFFLTVPDELMEAARVDGAGPMKFFRDILLPLSITNIAALFIILFVLGWNQYLWPLIITTDQSFYTVVMGIQRMAAVADAEPRWNLVMAAVILAALPPVLVIVAMQRLFVKGLVETEK

SEQ ID NO: 3540 - DNA, 921 bp, Rhizobium leguminosarum bv. viciae 3841
  CDS (1)..(921): transl_table=11
atgcccgaacgtcatctcggtctttcgatcttctgccacgccatactgctgattggcgcgatctttgtctgccttcccctctacttcgctttcgtcgccggatcattgacgttgcagcaggttcagcaggcgccgttcccggtcatcccaggctcccattttctcgaaaaccttgccgccgcctggcagcagggcgagttctcccggttgtttttgaattcgatcatcgtcaccgccggcatcgttatcggaaagctggcgatctcattgattgcagcatttggcgtgacctattttcgcttcccgtttcgcatgacggcattctggctcattttcgtgtcgctgatgcttccggtcgaggtccgcatcatcccgacctatgaagcggtcgccgatgctgccgggccgctgcgctggttggccgggtcgatcggtctttccggtgtcgttgaagggctcaccggatacagtatcgaagcatccttgaagtggaacatggtcaacagctacgccggcctgatcctgcctctcatcgcctctgcctccgcgaccttccttttccggcagttcttcctgaccgttcccgatgaactctgcgaggccgccaagctcgatggagccggcccgctgaaattcttcaaggacattctccttccactctcgagcgccaatatcgcggccctgtcgatcatcctgtttctctatggctggaaccagtatttgtggccgctgctcttcacgacggacaaggagatgggaactgcggtccttgggctgaagcagctcgttcccgtctcggactcagcacctgcctggaacatcgcgatgagtgcggcacttctcgtcatgcttccgcctgcggccgtcattctcttcatgcagcgctggttcaccaagggactggtggactccggaaagtaa

SEQ ID NO: 3541 - protein, 306 aa, Rhizobium leguminosarum bv. viciae 3841
MPERHLGLSIFCHAILLIGAIFVCLPLYFAFVAGSLTLQQVQQAPFPVIPGSHFLENLAAAWQQGEFSRLFLNSIIVTAGIVIGKLAISLIAAFGVTYFRFPFRMTAFWLIFVSLMLPVEVRIIPTYEAVADAAGPLRWLAGSIGLSGVVEGLTGYSIEASLKWNMVNSYAGLILPLIASASATFLFRQFFLTVPDELCEAAKLDGAGPLKFFKDILLPLSSANIAALSIILFLYGWNQYLWPLLFTTDKEMGTAVLGLKQLVPVSDSAPAWNIAMSAALLVMLPPAAVILFMQRWFTKGLVDSGK

SEQ ID NO: 3542 - DNA, 915 bp, Rhizobium leguminosarum bv. viciae 3841
  CDS (1)..(915): transl_table=11
atgatcgaacgcacgccgatattcaacttcatctgctatacgcttctcgcgctcggcatggtgatcgcgcttctgcctttcgccatcgtcatcatcgcctcgacgcttgatctggagacggtcaatcgtgtgccgctgccgctggttccaggctcgcatttctgggaaaacgcgcagaccgcctgggttcgcgccgatctcggcaacaagctgtttcacagcgtcatcttcgccgcaaccgtcggcgccggcaaggtgatgctgtcttccatggcagccttctcgatcgtctacttccgctttcgcggccggtatgtgattttctggatcatcttcatcacgctgatgctgccgctggaagtccgcatcgtgccgacctattcgattgcggccaacgcgctgcagcctttccagacgatcctcgacgtcaccggcataagctggctcgtcgcgcagatcaccggcgttcagatcaagctcgaatggggcctgctgaattcctatcccggtctcgttctgccgctggtcgcgaccgcgaccggcaccttcctctaccggcagttctacctgacggttccggacgagcttgccgaggcctcgaagatggacggatcaggcccggtccggttcttctgggacattctgctgccgctctcccgcccaaatatgatcgcgctcttcaccatcatgttcgtctgggcctggaaccagtatctctggccgctgctgatcaccaccgatccgaatttcggcatcgccgtgacgcagctcaagaccctcatcccgtccgaattcggcctgcccgactggaacgtcgcaatggccggaaccctgatcatcatgtcgccgccattgatcctcgtcattctgatgcagcgctggttcgtacgcggccttatctccaccgagaagtga

SEQ ID NO: 3543 - protein, 304 aa, Rhizobium leguminosarum bv. viciae 3841
MIERTPIFNFICYTLLALGMVIALLPFAIVIIASTLDLETVNRVPLPLVPGSHFWENAQTAWVRADLGNKLFHSVIFAATVGAGKVMLSSMAAFSIVYFRFRGRYVIFWIIFITLMLPLEVRIVPTYSIAANALQPFQTILDVTGISWLVAQITGVQIKLEWGLLNSYPGLVLPLVATATGTFLYRQFYLTVPDELAEASKMDGSGPVRFFWDILLPLSRPNMIALFTIMFVWAWNQYLWPLLITTDPNFGIAVTQLKTLIPSEFGLPDWNVAMAGTLIIMSPPLILVILMQRWFVRGLISTEK

SEQ ID NO: 3544 - DNA, 846 bp, Burkholderia vietnamiensis G4
  CDS (1)..(846): transl_table=11
atgatcgaaaatcgcaagggcttcgacctgttctgccacgcggtgctgctcgcgggcgtcgtcgtgatcgtgttcccggtgtacgtcgcgttctgcgcggcgacgatgaatgcgcaggaagtgttcacgatcccgctgtcgctggtgccgagcacgcatctgctggagaacgtcgcgtacatctggagccacggcagcggcggcacgaccgcgccgttcggccggctgctggtgaacagcttcgtgatggcgctcgggatcgcggtcggcaagatcgcggtgtcgatcctgtccgcgtacgccatcgtctatttccgcttcccgctgcgcaacaccgcgttctggctgatcttcgtcacgctgatgctgccggtcgaggtgcggatcttcccgaccgtgcaggtcgtgtcgacgctgcacctgaccaacacctacgcggggctgtcgctgccgctgatcgcgtcggcgaccgcgacgttcctgttccgccagttcttcatgacgctgcccgacgagctgatggacgccgcgcgcatcgacggcgcggggccgctgcggtttttctgggacgtcgtgctgccgctgtcgaagacgagcatcgccgcgctgttcgtgatcacgttcatctacggctggaaccagtatctgtggccgatcctgatcacgacggaggcgtcgctgtcgacggcggtggtcggcatcaagacgatgatcgcgagcggcgacgccgcgaccgaatggcaatacgtgatggcggcgacgctgctggcgatgattccgccgctcgtcgtcgtgctggcgatgcagcgctggttcgtgcgcggcctcgtcgattccgaaaaatga

SEQ ID NO: 3545 - protein, 281 aa, Burkholderia vietnamiensis G4
MIENRKGFDLFCHAVLLAGVVVIVFPVYVAFCAATMNAQEVFTIPLSLVPSTHLLENVAYIWSHGSGGTTAPFGRLLVNSFVMALGIAVGKIAVSILSAYAIVYFRFPLRNTAFWLIFVTLMLPVEVRIFPTVQVVSTLHLTNTYAGLSLPLIASATATFLFRQFFMTLPDELMDAARIDGAGPLRFFWDVVLPLSKTSIAALFVITFIYGWNQYLWPILITTEASLSTAVVGIKTMIASGDAATEWQYVMAATLLAMIPPLVVVLAMQRWFVRGLVDSEK

SEQ ID NO: 3546 - DNA, 879 bp, Roseovarius nubinhibens ISM
  CDS (1)..(879): transl_table=11
atgaccgatatcccctatacccccgccgcgcgccgcatccgctggtcggtactggccgatcacgcggtgctcatcgccgggtcgctcttcctgctgatcccgctgctggtgatgctgcaaaccaccaccaccaccgatctcgaaacgatcaaatacggcccgcaactggccatcggcgatcagctcgacgacaatttccgcgccgccatgttcaaggcctcgggcttttccggtcagaacaccgggctgtcgatgctgatcaactcgaccatcctcggcctcggctttgcgctgggcaagatcgtcatcggcatgatggccgcctatgcgctggtctatttccggatgcgctttgcgacgctggccttctggctcatcttcaccacgcttctgctgccgctcgaggtgcgcatcctgccctcctacgagatcgcgcaaaagctcaacctcctgaacagctacaccggtctcatcctgccgctcatcgcctccgcgacggccaccttcttcttccgccagttctttcgcgcggtcccggaagagctggtcgaggcggcgcgcatcgacggggccgggccggtgcgcttcttcatcgacgtgctcgtgccgctgagccggacgatgatcgccgcgatgttcatcatcatgtttgtctttggctggaaccaatacctctggcccacgatgatcaccaccgaggaaggcatgtacacgctggtgcgcggcatcaagcagctgacccaggatctcgaaggcaccaacatccccgaatatggccgcgccaacatgctggcgctgattgcgatcctgccgccggtggcggtggtgatctttttccaaagctggttcgtcaagggcctcacggaatcggacaaataa

SEQ ID NO: 3547 - protein, 292 aa, Roseovarius nubinhibens ISM
MTDIPYTPAARRIRWSVLADHAVLIAGSLFLLIPLLVMLQTTTTTDLETIKYGPQLAIGDQLDDNFRAAMFKASGFSGQNTGLSMLINSTILGLGFALGKIVIGMMAAYALVYFRMRFATLAFWLIFTTLLLPLEVRILPSYEIAQKLNLLNSYTGLILPLIASATATFFFRQFFRAVPEELVEAARIDGAGPVRFFIDVLVPLSRTMIAAMFIIMFVFGWNQYLWPTMITTEEGMYTLVRGIKQLTQDLEGTNIPEYGRANMLALIAILPPVAVVIFFQSWFVKGLTESDK

SEQ ID NO: 3548 - DNA, 846 bp, Oceanicola batsensis HTCC2597
  CDS (1)..(846): transl_table=11
atgatcgagaaccgccccgtcctgaacatcgtccagcatgtcatcctgatcctcggggtgacggtcttcgtctttccgatctggctggccttcgtcgcctcgacccataccgcccgggacgtgaattccggcatccccctgctgcccggcgaccagatgtgggagaactacgcccaggtgctgggcgagggtctgtcgaccatcggtgcgccgccgatcgggctcatgctgttcaattcgctgatcatggcgctggcgatcacaatcgggaagatcgtgatctctctgctgtcctccttcgccatcgtctatttccggtttcccttccgggtgctcgcgttctggacgatcttcgtgacgctgatgctgccggtcgaagtccggatccttccgacctacgaggtggtggcgcagctggggatgctgaactcctatgccgggttgtcgatcccgctgatcgcctcggccacggcgacctttctcttccggcagttcttcatgaccgtgccggacgaactgaccgaggcggcgcgggtggacggcgcggggccgatgaagttcttccgcgacatcctggtgccgctgtcgcgcaccaatctggccgcgctcttcgtgatcctgttcatctacggctggaaccagtacctatggccgctgctcgtgaccacggacgagagctattacaccgtcgtcatggggatccagcgcatggcgaatgccggcgaggaacaaccgctgtggaatcttatcatggccaccgccatcctggcgatgctgccgccggtggccgtcatcatcgggatgcagcggctgttcgtccgcggcctggtcgaaaccgagaagtaa

SEQ ID NO: 3549 - protein, 281 aa, Oceanicola batsensis HTCC2597
MIENRPVLNIVQHVILILGVTVFVFPIWLAFVASTHTARDVNSGIPLLPGDQMWENYAQVLGEGLSTIGAPPIGLMLFNSLIMALAITIGKIVISLLSSFAIVYFRFPFRVLAFWTIFVTLMLPVEVRILPTYEVVAQLGMLNSYAGLSIPLIASATATFLFRQFFMTVPDELTEAARVDGAGPMKFFRDILVPLSRTNLAALFVILFIYGWNQYLWPLLVTTDESYYTVVMGIQRMANAGEEQPLWNLIMATAILAMLPPVAVIIGMQRLFVRGLVETEK

SEQ ID NO: 3550 - DNA, 849 bp, Photobacterium sp. SKA34
  CDS (1)..(849): transl_table=11
atggtagaaagaagacctctttttaatttttgttgtcatctattgttgatacttggcgtgatctctatcgcgttaccagtatggttagccattgtggcaacgacacacgaaaatcatgatttcgcgacaagtactcctctgtggtttggtgatcttgggttcagtatttttaaagatttactcagtgggcataccgcttttagtgataagtcattatccataaatggactattacttaactcgtttattatggcgatatgtatcactgtgggtaaattatcaatctctattatgtcagcttatgcggtggttttcttccgttttcgtggccgtatgattgctttttggttgatcttttttaccctgatgttacctgttgaagtgcgtattatgccgacttttgaggtgatcagtaatttggggatgttgaattcattttcaggcttaaccattccattgattgctagtgcaacagccacgttcttatttaggcagttctttttaacgattcccaatgaacttgttgaagccgcacgtattgatggtgcaggtccaataaaattctttttcgatattttattgccattatcacgcaccaatatcgcagccttatttgtgatcacttttatctacggttggaaccaatatttatggccgttattgatcacgacggatacccattatttcactatcgtcatggcgatcaagcaaatgacgggagtggttgatggcgtcattgaatggaacaaaattatggcaaccacgattatcgcaatgttaccaccagtcattgttgttatagcaatgcaaaaagcctttgttaaaggcctagttgattcggagaaataa

SEQ ID NO: 3551 - protein, 282 aa, Photobacterium sp. SKA34
MVERRPLFNFCCHLLLILGVISIALPVWLAIVATTHENHDFATSTPLWFGDLGFSIFKDLLSGHTAFSDKSLSINGLLLNSFIMAICITVGKLSISIMSAYAVVFFRFRGRMIAFWLIFFTLMLPVEVRIMPTFEVISNLGMLNSFSGLTIPLIASATATFLFRQFFLTIPNELVEAARIDGAGPIKFFFDILLPLSRTNIAALFVITFIYGWNQYLWPLLITTDTHYFTIVMAIKQMTGVVDGVIEWNKIMATTIIAMLPPVIVVIAMQKAFVKGLVDSEK

SEQ ID NO: 3552 - DNA, 852 bp, Xanthobacter autotrophicus Py2
  CDS (1)..(852): transl_table=11
atggccggcacctcgcgcctgtccctgctcttcgcccacctcgtgctcatcgccggcgcggcggtgatgatgctgccgctctatgtggcgttcgtcgcctccacttatgcgggcgcggatttcctctccggccgcgtgggcctcctgcccggcccgcatctggtggaaaattaccgtctcgcgctcaccaccggatcgtccacggcgggcattccgccggtgggccccatgctgtggaactcgctggtggtcgcggtggtgatcgcggcggggaagatctccatctccatcctgtccgccttcgccatctgctatttccgctttccgctgcgggtgccggccttctggctcatcttcatgacgctgatgctgccggtggaggtgcgcatattgcccaccttcgaggtggcagcgcggctggatctcctcaattcctacgccggcctcaccgtgccgctgatcgccagcgccacggccaccttcctgttccggcaggtgttcatgaccattccggacgagctgacggaagctgccatcatcgacggcgcgggcccgctgcgcttcttctggtcgatccttttgccgctctcgcgcaccaatatcgcggccctgttcgtgatcctgttcctctatggctggaaccagtatctgtggccgctgctggtgacgacggacgccagctacttcaccgtggtcatgggcatccgccgcctcgtgggcgcggcggcggaggcggacccggtgtggcacctggtgatggccaccgccatcctggcgctggtgccgcctgtgctggtgatcgcggcgctgcagcggctgttcgtgcgcgggctgaccgagacggagaagtga

SEQ ID NO: 3553 - protein, 283 aa, Xanthobacter autotrophicus Py2
MAGTSRLSLLFAHLVLIAGAAVMMLPLYVAFVASTYAGADFLSGRVGLLPGPHLVENYRLALTTGSSTAGIPPVGPMLWNSLVVAVVIAAGKISISILSAFAICYFRFPLRVPAFWLIFMTLMLPVEVRILPTFEVAARLDLLNSYAGLTVPLIASATATFLFRQVFMTIPDELTEAAIIDGAGPLRFFWSILLPLSRTNIAALFVILFLYGWNQYLWPLLVTTDASYFTVVMGIRRLVGAAAEADPVWHLVMATAILALVPPVLVIAALQRLFVRGLTETEK

SEQ ID NO: 3554 - DNA, 849 bp, Acidovorax sp. JS42
  CDS (1)..(849): transl_table=11
atgatcgaccgtaacccctggctcaatttcatttcgcacgccgtgctggtcctcggcgtggccatcgtggccttcccgctgtacctggcgctggtggcctccacccacacggcggacgccatcgtgcagtcgcccatgccgctgctgccgggcagccatctgtgggagaactaccaggccgcgctgttcggctcgggcaagctgggctccaacaccaacgtggtgcacatgatgtgggtgagcttcgtggtggccatggtcatcaccgtgggcaagatcgccatctcgctgctgtcggcgttcgccatcgtgtacttccgcttcccgttcaagatgctgtgcttctgggccatcttcgtgacgctgatgctgccggtggaagtgcgcatcctgcccacctacaaggtggtggcagacctgggcctgctcaacagctacgccggcctcacgctgccgctgatcgcctcggccaccgccacgttcctgttccgccagttcttcctgacggtgcccgacgagctggtggaggccgcgcgcatcgacggcgccgggcccatgcgctttttcaaggacgtgctggtgccgctgtcgcgcacctcgatcgctgcgctgttcgtgatccagttcatctacggctggaaccagtacctgtggccgctgctgatgaccacctccgaagacatgtacccggtggtgatcggcatcaagcgcatgctggccggcggcgaggccgccgtggactggaacatcgtgatggccaccgccatcgtcgccatgctgccgcccacggccgtggtgatcctgatgcagaagtggttcgtcaagggcctggtcgacaccgagaaataa

SEQ ID NO: 3555 - protein, 282 aa, Acidovorax sp. JS42
MIDRNPWLNFISHAVLVLGVAIVAFPLYLALVASTHTADAIVQSPMPLLPGSHLWENYQAALFGSGKLGSNTNVVHMMWVSFVVAMVITVGKIAISLLSAFAIVYFRFPFKMLCFWAIFVTLMLPVEVRILPTYKVVADLGLLNSYAGLTLPLIASATATFLFRQFFLTVPDELVEAARIDGAGPMRFFKDVLVPLSRTSIAALFVIQFIYGWNQYLWPLLMTTSEDMYPVVIGIKRMLAGGEAAVDWNIVMATAIVAMLPPTAVVILMQKWFVKGLVDTEK

SEQ ID NO: 3556 - DNA, 22 bp, Artificial sequence
  primer
atgattgagaaccgtccgtggc

SEQ ID NO: 3557 - DNA, 24 bp, Artificial sequence
  primer
ttatttctcactatcgaccaggcc

SEQ ID NO: 3558 - protein, 316 aa, Artificial sequence
  consensus sequence
  Variant (2)..(12): Xaa in position 2 to 12 is any amino acid
  Variant (14)..(15): Xaa in position 14 to 15 is any amino acid
  Variant (17)..(18): Xaa in position 17 to 18 is any amino acid
  Variant (20)..(22): Xaa in position 20 to 22 is any amino acid
  Variant (23)..(25): Xaa in position 23 to 25 is any or no amino acid
  Variant (27)..(48): Xaa in position 27 to 48 is any amino acid
  Variant (49)..(49): Xaa in position 49 is any or no amino acid
  Variant (52)..(56): Xaa in position 52 to 56 is any amino acid
  Variant (58)..(72): Xaa in position 58 to 72 is any amino acid
  Variant (73)..(80): Xaa in position 73 to 80 is any or no amino acid
  Variant (83)..(85): Xaa in position 83 to 85 is any amino acid
  Variant (87)..(91): Xaa in position 87 to 91 is any amino acid
  Variant (95)..(96): Xaa in position 95 to 96 is any amino acid
  Variant (98)..(100): Xaa in position 98 to 100 is any amino acid
  Variant (102)..(102): Xaa in position 102 is any amino acid
  Variant (104)..(104): Xaa in position 104 is any amino acid
  Variant (106)..(106): Xaa in position 106 is any amino acid
  Variant (109)..(115): Xaa in position 109 to 115 is any amino acid
  Variant (118)..(118): Xaa in position 118 is any amino acid
  Variant (121)..(121): Xaa in position 121 is any amino acid
  Variant (124)..(124): Xaa in position 124 is any amino acid
  Variant (127)..(127): Xaa in position 127 is any amino acid
  Variant (132)..(132): Xaa in position 132 is any amino acid
  Variant (135)..(136): Xaa in position 135 to 136 is any amino acid
  Variant (138)..(140): Xaa in position 138 to 140 is any amino acid
  Variant (142)..(146): Xaa in position 142 to 146 is any amino acid
  Variant (147)..(177): Xaa in position 147 to 177 is any or no amino acid
  Variant (179)..(179): Xaa in position 179 is any amino acid
  Variant (182)..(183): Xaa in position 182 to 183 is any amino acid
  Variant (186)..(186): Xaa in position 186 is any amino acid
  Variant (191)..(191): Xaa in position 191 is any amino acid
  Variant (200)..(200): Xaa in position 200 is any amino acid
  Variant (202)..(202): Xaa in position 202 is any amino acid
  Variant (204)..(204): Xaa in position 204 is any amino acid
  Variant (207)..(207): Xaa in position 207 is any amino acid
  Variant (212)..(212): Xaa in position 212 is any amino acid
  Variant (218)..(219): Xaa in position 218 to 219 is any amino acid
  Variant (222)..(222): Xaa in position 222 is any amino acid
  Variant (224)..(226): Xaa in position 224 to 226 is any amino acid
  Variant (230)..(230): Xaa in position 230 is any amino acid
  Variant (232)..(233): Xaa in position 232 to 233 is any amino acid
  Variant (238)..(238): Xaa in position 238 is any amino acid
  Variant (240)..(240): Xaa in position 240 is any amino acid
  Variant (242)..(243): Xaa in position 242 to 243 is any amino acid
  Variant (246)..(246): Xaa in position 246 is any amino acid
  Variant (252)..(254): Xaa in position 252 to 254 is any amino acid
  Variant (256)..(261): Xaa in position 256 to 261 is any amino acid
  Variant (263)..(277): Xaa in position 263 to 277 is any amino acid
  Variant (278)..(281): Xaa in position 278 to 281 is any or no amino acid
  Variant (283)..(285): Xaa in position 283 to 285 is any amino acid
  Variant (287)..(294): Xaa in position 287 to 294 is any amino acid
  Variant (297)..(298): Xaa in position 297 to 298 is any amino acid
  Variant (301)..(302): Xaa in position 301 to 302 is any amino acid
  Variant (306)..(306): Xaa in position 306 is any amino acid
  Variant (309)..(309): Xaa in position 309 is any amino acid
  Variant (312)..(315): Xaa in position 312 to 315 is any amino acid
MXXXXXXXXXXXHXXLXXGXXXXXXPXXXXXXXXXXXXXXXXXXXXXXXPGXXXXXNXXXXXXXXXXXXXXXXXXXXXXXNSXXXAXXXXXGKIXXSXXXAXAXVXFRXXXXXXXFWXIFXTLXLPXEVRIXPTXXVXXXLXXXXXXXXXXXXXXXXXXXXXXXXXXXXXXXXXXXXYXGLXXPLXASATXTFLFRQFFXTXPXELXEAARXDGAGPXXFFXDXXXPLSXTXXAALFXIXFXXGWXQYLWPXXXTXXXXXXTXXXXXXXXXXXXXXXXXXXWXXXMXXXXXXXXPPXXVVXXMQRXFVXGLXXXXK

SEQ ID NO: 3559 - protein, 59 aa, Artificial sequence
  protein pattern
  Variant (2)..(3): Xaa in position 2 to 3 is any amino acid
  Variant (7)..(7): Xaa in position 7 is Phe or Tyr
  Variant (8)..(8): Xaa in position 8 is any amino acid
  Variant (9)..(9): Xaa in position 9 is Ala, Ser or Thr
  Variant (10)..(10): Xaa in position 10 is Ile, Leu or Val
  Variant (12)..(12): Xaa in position 12 is any amino acid
  Variant (15)..(15): Xaa in position 15 is any amino acid
  Variant (16)..(16): Xaa in position 16 is Asp or Glu
  Variant (18)..(18): Xaa in position 18 is Ala or Ser
  Variant (19)..(19): Xaa in position 19 is any amino acid
  Variant (20)..(20): Xaa in position 20 is Ile, Leu, Met or Val
  Variant (22)..(22): Xaa in position 22 is Gly or Asn
  Variant (23)..(23): Xaa in position 23 is Ala or Ser
  Variant (24)..(24): Xaa in position 24 is Gly or Ser
  Variant (25)..(25): Xaa in position 25 is Ala, Pro or Ser
  Variant (26)..(26): Xaa in position 26 is any amino acid
  Variant (27)..(27): Xaa in position 27 is Lys or Arg
  Variant (29)..(29): Xaa in position 29 is Phe or Met
  Variant (30)..(30): Xaa in position 30 is any amino acid
  Variant (32)..(32): Xaa in position 32 is Ile, Met or Val
  Variant (33)..(33): Xaa in position 33 is Leu or Val
  Variant (34)..(34): Xaa in position 34 is Phe, Ile, Leu or Val
  Variant (38)..(38): Xaa in position 38 is any amino acid
  Variant (39)..(39): Xaa in position 39 is Ala, Asn, Pro, Ser or Thr
  Variant (40)..(40): Xaa in position 40 is any amino acid
  Variant (41)..(41): Xaa in position 41 is Phe, Ile, Leu or Met
  Variant (42)..(42): Xaa in position 42 is any amino acid
  Variant (44)..(44): Xaa in position 44 is Ile, Leu or Met
  Variant (45)..(46): Xaa in position 45 to 46 is any amino acid
  Variant (47)..(47): Xaa in position 47 is Ile or Leu
  Variant (48)..(48): Xaa in position 48 is any amino acid
  Variant (50)..(50): Xaa in position 50 is Ile, Leu or Val
  Variant (51)..(51): Xaa in position 51 is any amino acid
  Variant (52)..(52): Xaa in position 52 is Ala or Gly
  Variant (54)..(54): Xaa in position 54 is any amino acid
  Variant (55)..(55): Xaa in position 55 is Asp or Gln
FXXRQFXXXXPXELXXAXXXDXXXXXXFXXDXXXPLSXXXXXAXXXXXFXXXWXXYLWP

SEQ ID NO: 3560 - protein, 51 aa, Artificial sequence
  protein pattern
  Variant (2)..(3): Xaa in position 2 to 3 is any amino acid
  Variant (4)..(6): Xaa in position 4 to 6 is any or no amino acid
  Variant (8)..(9): Xaa in position 8 to 9 is any amino acid
  Variant (10)..(10): Xaa in position 10 is Ala, Ser or Thr
  Variant (12)..(12): Xaa in position 12 is Phe or Tyr
  Variant (14)..(14): Xaa in position 14 is Ile, Leu or Val
  Variant (16)..(16): Xaa in position 16 is Phe, Trp or Tyr
  Variant (17)..(17): Xaa in position 17 is Phe or Met
  Variant (18)..(18): Xaa in position 18 is Lys or Arg
  Variant (19)..(25): Xaa in position 19 to 25 is any amino acid
  Variant (27)..(28): Xaa in position 27 to 28 is any amino acid
  Variant (29)..(29): Xaa in position 29 is Ile or Val
  Variant (30)..(30): Xaa in position 30 is Phe or Leu
  Variant (31)..(31): Xaa in position 31 is any amino acid
  Variant (32)..(32): Xaa in position 32 is Ala or Thr
  Variant (34)..(34): Xaa in position 34 is Leu or Met
  Variant (37)..(37): Xaa in position 37 is Ile, Leu or Val
  Variant (41)..(41): Xaa in position 41 is Ile or Val
  Variant (42)..(42): Xaa in position 42 is any amino acid
  Variant (44)..(44): Xaa in position 44 is Ser or Thr
  Variant (45)..(46): Xaa in position 45 to 46 is any amino acid
  Variant (47)..(47): Xaa in position 47 is Ile or Val
  Variant (48)..(48): Xaa in position 48 is any amino acid
  Variant (49)..(49): Xaa in position 49 is Ala, Ser, Thr or Val
  Variant (50)..(50): Xaa in position 50 is any amino acid
  Variant (51)..(51): Xaa in position 51 is Leu or Met
IXXXXXSXXXAXAXVXXXXXXXXXXFXXXXXXLXLPXEVRXXPXXXXXXXX

SEQ ID NO: 3561 - protein, 36 aa, Artificial sequence
  protein pattern
  Variant (2)..(4): Xaa in position 2 to 4 is any amino acid
  Variant (5)..(5): Xaa in position 5 is Leu or Met
  Variant (6)..(6): Xaa in position 6 is any amino acid
  Variant (7)..(7): Xaa in position 7 is Ala, Gly, Ser, Thr or Val
  Variant (8)..(8): Xaa in position 8 is any amino acid
  Variant (9)..(9): Xaa in position 9 is Ile, Leu, Met or Val
  Variant (10)..(10): Xaa in position 10 is Ile, Leu or Val
  Variant (11)..(12): Xaa in position 11 to 12 is any amino acid
  Variant (13)..(13): Xaa in position 13 is Ile, Leu or Val
  Variant (16)..(16): Xaa in position 16 is any amino acid
  Variant (17)..(17): Xaa in position 17 is any or no amino acid
  Variant (19)..(22): Xaa in position 19 to 22 is any amino acid
  Variant (23)..(23): Xaa in position 23 is any or no amino acid
  Variant (25)..(25): Xaa in position 25 is Lys or Arg
  Variant (26)..(26): Xaa in position 26 is any amino acid
  Variant (28)..(29): Xaa in position 28 to 29 is any amino acid
  Variant (32)..(32): Xaa in position 32 is any amino acid
  Variant (33)..(33): Xaa in position 33 is Ala, Asp, Glu, Gly or Ser
  Variant (34)..(34): Xaa in position 34 is Ala, Asn, Ser, Thr or Val
  Variant (35)..(35): Xaa in position 35 is Asp, Glu or Gly
WXXXXXXXXXXXXPPXXVXXXXXQXXFXXGLXXXXK

SEQ ID NO: 3562 - protein, 13 aa, Artificial sequence
  protein pattern
  Variant (2)..(2): Xaa in position 2 is any amino acid
  Variant (4)..(4): Xaa in position 4 is Leu or Met
  Variant (5)..(5): Xaa in position 5 is any amino acid
  Variant (6)..(6): Xaa in position 6 is Ile, Leu or Val
  Variant (9)..(9): Xaa in position 9 is Ile, Leu, Met or Val
  Variant (13)..(13): Xaa in position 13 is Ser or Thr
YXGXXXPLXASAX

SEQ ID NO: 3563 - DNA, 1131 bp, Escherichia coli
  CDS (1)..(1131)
atgattccatttaacgcaccgccggtggtgggaaccgaactcgactatatgcagtcggcaatgggtagcggcaaactgtgtggcgatggcggttttacccgtcgctgccagcagtggctggagcaacgttttggcagcgccaaagtgttactgacgccgtcctgcaccgcttcgctggagatggcggcgctgctgctcgatatccagcctggcgatgaagtgatcatgccgagctacacctttgtctccaccgccaatgcctttgtgctgcgtggcgcaaaaatcgtttttgtggatgttcgcccggacaccatgaacatcgacgaaacgctgattgaagcggcgatcaccgacaaaacgcgcgttatcgtgccggtccattacgcgggtgtggcctgcgaaatggacaccattatggcgttggcgaaaaagcataatttgtttgtggtagaagatgccgctcagggcgtgatgtccacttacaaagggcgtgcactgggaaccattggtcatattggctgctttagcttccatgaaaccaaaaactacacggcgggcggtgaaggcggcgcgacgctgattaacgataaagcgttaatcgaacgagccgagatcatccgtgaaaagggcactaaccgcagccagttcttccgtggtcaggtcgataaatatacctggcgcgatattggctccagctatttgatgtccgatctgcaagctgcatacctgtgggcgcaactggaagcagcggatcgtatcaaccagcaacgtctggcgctgtggcaaaactactacgatgcgttagcgcctctggcgaaagccgggcgtatcgagctgccgtcgattcccgatggctgcgtgcagaacgcgcatatgttctacattaaactgcgggatattgatgaccggagcgcgttgattaactttctgaaagaagcggaaatcatggcggtgtttcattacattccgctgcacggttgccctgcgggggaacactttggtgagttccacggtgaagatcgctacaccaccaaagagagcgagcgcctgctgcgcctgccgctgttctacaacctgtcgcccgtcaatcagcgtacggtaattgcgactttgttgaactacttttcctaa

SEQ ID NO: 3564 - protein, 376 aa, Escherichia coli
MIPFNAPPVVGTELDYMQSAMGSGKLCGDGGFTRRCQQWLEQRFGSAKVLLTPSCTASLEMAALLLDIQPGDEVIMPSYTFVSTANAFVLRGAKIVFVDVRPDTMNIDETLIEAAITDKTRVIVPVHYAGVACEMDTIMALAKKHNLFVVEDAAQGVMSTYKGRALGTIGHIGCFSFHETKNYTAGGEGGATLINDKALIERAEIIREKGTNRSQFFRGQVDKYTWRDIGSSYLMSDLQAAYLWAQLEAADRINQQRLALWQNYYDALAPLAKAGRIELPSIPDGCVQNAHMFYIKLRDIDDRSALINFLKEAEIMAVFHYIPLHGCPAGEHFGEFHGEDRYTTKESERLLRLPLFYNLSPVNQRTVIATLLNYFS

SEQ ID NO: 3565 - DNA, 1149 bp, Pseudomonas aeruginosa PAO1
  CDS (1)..(1149): transl_table=11
atgtcactggactttctgccattctcccggccaagcatcggcgaggacgaaatcgccgccgtggagcaggtcctgcgttccggctggatcaccaccgggccgaagaaccaggagctcgaacagcgcttcgccgaacgcctcggctgccgccacgcggtggcgctatcctcggccaccggcgccctgcacgtcaccctgctggcgctgggcatcggccccggcgacgaagtgatcacgccgtcgctgacctgggtctccaccgccaacgtcatcaccctgctcggcgccaccccggtgttcgtcgacgtcgaccgcgacaccctgatgtgttcggcgcaggcagtggaagccgccatcggcccgcgcacccgcgccatcgtgccggtgcactacgccggctccaccctggatctcgaaggcctgcgcacggtcgccgggcgccacggcatcgccctggtcgaggacgccgcccacgcggtcggcagcgaataccgcgggcgcccggtaggctcccgcggcacggcgatcttttccttccacgcgatcaagaacctgacctgcgccgaaggcgcgatgttcgtcagcgacgacagtgccctcgccgaacgggtccgccgcctcaagttccacggcctcggggtcgatgcctacgaccgcctgagccatggacgcaagccgcaggcggaagttatcgagcccggtttcaaatacaacctggccgacctcaacgccgccctcgcgctggtccagctcaagcgcctggacgcgctcaacgcgcgccgccaggccctcgccgaacgctacctggagcgcctcgccggcctgccgctggcgccgctcggcctgcccgcgcacaagcagcgccacgcctggcacctgttcatcctgcgcatcgacgccgaggtctgcggcctgggccgcgacgccttcatggaagccctgaaggcgcgcggcatcggtagcggcatccatttcatcgccagtcacctgcaccactactaccgccagcgccagccgcgcctgagcctgcccaacagcgagtggaactcggcccgcctgtgctccatcccgctgttccccgacatgcgcgacgacgacatcgagcgcgtcgcccgcgccatcgaggagatcctggagaaacgtcgatga

SEQ ID NO: 3566 - protein, 382 aa, Pseudomonas aeruginosa PAO1
MSLDFLPFSRPSIGEDEIAAVEQVLRSGWITTGPKNQELEQRFAERLGCRHAVALSSATGALHVTLLALGIGPGDEVITPSLTWVSTANVITLLGATPVFVDVDRDTLMCSAQAVEAAIGPRTRAIVPVHYAGSTLDLEGLRTVAGRHGIALVEDAAHAVGSEYRGRPVGSRGTAIFSFHAIKNLTCAEGAMFVSDDSALAERVRRLKFHGLGVDAYDRLSHGRKPQAEVIEPGFKYNLADLNAALALVQLKRLDALNARRQALAERYLERLAGLPLAPLGLPAHKQRHAWHLFILRIDAEVCGLGRDAFMEALKARGIGSGIHFIASHLHHYYRQRQPRLSLPNSEWNSARLCSIPLFPDMRDDDIERVARAIEEILEKRR

SEQ ID NO: 3567 - DNA, 1092 bp, Methanothermobacter thermautotrophicus str. Delta H
  CDS (1)..(1092): transl_table=11
atgatacctattctagaaccatctattggaaatgaagagttagaaaatgtcctggaagctctaaagagcggatggataagttcgaggggagaatttataactaaattcgaggaaaaatttgcaagatatcatggcatgggctttgggataagcacatcaaatgggacaacagcacttcaccttgcccttaaatcagttgggataaaaaaaggagatgaggttattgtaccatctttaacctttgcagccacagcaaatgcagtcatatactgtaatgcaaaacctgtacttgtagattcacatcctgattactggtgcattgatccatcaaggattgaggaaaaaataaataagaacacacgtgcgataatacctgtccatctttatggtcatccatgtgatatgggctggattggggatattgccgatgaacatggattgattattatagaggatgctgcggaggcccacggagcagaatacagagggaaaaagatcggcaccttcggggacgtgtcttgtttttcattttatggtaacaaaataataaccactggtgaaggtggaatgtgtcttactaatgatgaggagcttgctgagagaatggcagtgttaagggatcatggtatgagaccggaaaagagatactggcacgaggaggttggattcaattataggatgactaatttacaggctgcggtgggtgttgctcaattagaaaaaattgatggttttattaatagaaaacgggaaatagctgagatatacaatagaggtcttgctgaattacatgaaaatgaagaattaatgttgcacccagagatgttatgggccagatctgtatactgggtttattcgattgtccttaaaaaaaggaagaacatggatttaataaggtaccttaattcttgtggggtggatacaagaccatttttttatcctcttaatttaatgcctccctataaagatgattccagctatcctgtggcagaaaacctctcttatggtggtctgagtcttccatcaagtgttgaaattggagatgaagccatagaatacgttgttgatagagtaagggagttttttgaatga

SEQ ID NO: 3568 - protein, 363 aa, Methanothermobacter thermautotrophicus str. Delta H
MIPILEPSIGNEELENVLEALKSGWISSRGEFITKFEEKFARYHGMGFGISTSNGTTALHLALKSVGIKKGDEVIVPSLTFAATANAVIYCNAKPVLVDSHPDYWCIDPSRIEEKINKNTRAIIPVHLYGHPCDMGWIGDIADEHGLIIIEDAAEAHGAEYRGKKIGTFGDVSCFSFYGNKIITTGEGGMCLTNDEELAERMAVLRDHGMRPEKRYWHEEVGFNYRMTNLQAAVGVAQLEKIDGFINRKREIAEIYNRGLAELHENEELMLHPEMLWARSVYWVYSIVLKKRKNMDLIRYLNSCGVDTRPFFYPLNLMPPYKDDSSYPVAENLSYGGLSLPSSVEIGDEAIEYVVDRVREFFE

SEQ ID NO: 3569 - DNA, 1083 bp, Methanothermobacter thermautotrophicus str. Delta H
  CDS (1)..(1083): transl_table=11
atgataccggttgctactccaataatcgatgaagaggaaattcaggaagtcataaaggtacttaaatcgggttttatcgcgcagggacccagggtggctgaattcgaggagaaatttgcggcctatgtgggaacagagcatgcagttgcaacgagttcagggacaacagcccttcatctggccctcctcgccgctggagttggaaagggggatgaggtaataacaacccccttcagtttcgctgcaacagcaaacgcagccctctacgtcggagccacaccagtattcgcagatatagaccccctgacatataatatagatcctgagaggatagaggaactcataacacccagcacaagggcgataataccggtccacctctatggccagcccgcagacatggaccccataatggaccttgcagctgaccatgacatcctggtcattgaggatgctgcacaggcccacggagcagagtatcatggaaggaaagtcggttccatgggcgatgccgcctgtttcagcttctaccccacaaagaacatcacaacaggtgagggcggaatcataacaactgatgacgatgagatagctgagatggcacgtatactcagggcccatggggagacagaacgctacaggcacacatacctgggatacaacttccgcatgactgacatctcagccgccatcgggatagcccagctcggaaaactcgaggagttcaacagcaggcgaattgaaaatgcagcttacctcacatcccagctgggggaccttgagggagtatcaacaccccacattgcagctggggtcaggcacgtctttcaccagtacaccctgcgggttccaggctcaagggatgaactcatgggcttcctcaatgagaggggtgtgggtacaggcatccactatcccagaccaatctacaggcaggaactgtaccagagactgggctttgatgccagatgcccggtgagtgaggcggctgcagcggaggtcctctcaataccggtacaccctgccctaaccggtgaggagcttgagagggtcgcaggcacggtcagggaattttttgagtaa

SEQ ID NO: 3570 - protein, 360 aa, Methanothermobacter thermautotrophicus str. Delta H
MIPVATPIIDEEEIQEVIKVLKSGFIAQGPRVAEFEEKFAAYVGTEHAVATSSGTTALHLALLAAGVGKGDEVITTPFSFAATANAALYVGATPVFADIDPLTYNIDPERIEELITPSTRAIIPVHLYGQPADMDPIMDLAADHDILVIEDAAQAHGAEYHGRKVGSMGDAACFSFYPTKNITTGEGGIITTDDDEIAEMARILRAHGETERYRHTYLGYNFRMTDISAAIGIAQLGKLEEFNSRRIENAAYLTSQLGDLEGVSTPHIAAGVRHVFHQYTLRVPGSRDELMGFLNERGVGTGIHYPRPIYRQELYQRLGFDARCPVSEAAAAEVLSIPVHPALTGEELERVAGTVREFFE

SEQ ID NO: 3571 - DNA, 1131 bp, Yersinia pestis CO92
  CDS (1)..(1131)
atgattccatttaacactccaccgatagtgggcactgaactgggttatatgcaggctgcgatgagcagtggcaagttatgcggtgatggtggttttacccgtcgctgccagcagtggatggagaaacgttttaactgcccaaaagtgttactgacgccatcttgtaccgcctcgttggaaatggccgcgttattgctggatatcaagcccggtgatgaagtgatcatgccaagttttacctttgtttctaccgccaatgcctttgtgctgcgcggggccaaaatggtgtttgtcgatatccgtccagacaccatgaatatcgatgaaaccaagattgaagcggcgatcaccgataaaacccgggttattgtgccagtccactacgcaggggttgcctgtgagatggataccatcatggcactggcgaaaaagcataatttgtttgtggtagaagatgcggctcaaggcgtgatgtcaacctacaaaggtaaagctctgggtaccattggccatattggctgcttcagcttccatgaaaccaaaaattacactgcgggcggtgaaggtggggcgacgttgatcaatgatccttcattgattgatcgtgcagaaattatccgtgaaaagggcaccaaccgtagccaattcttccgtggtcaggtggataaatacacctggcgtgacatcggctccagctacttgatgtctgatttacaggccgcttacctgtggggccagttagaggcagcagagcagatcaacgaacgccgtctggcgctatggcatggttattataatgctttcaaaccgttggccgatgctgggcgcattgatttaccggtgatcccaggcaacgtggtgcaaaatgcccacatgttttatattaaactgcgtgatattgaggagcgctctgcatttatcagctatttaaaagaagcggatattatggcggtattccactacatcccattacatgcgtgtccagcaggtgaggcgtttggccgtatggctggcgaagaccgctttacctccaaggagagtgagcgtctggtgcgcttacctattttctacaacctgactgatgttaatcagagcacggttattaatactgtgctgagtttcttcgtctga

SEQ ID NO: 3572 - protein, 376 aa, Yersinia pestis CO92
MIPFNTPPIVGTELGYMQAAMSSGKLCGDGGFTRRCQQWMEKRFNCPKVLLTPSCTASLEMAALLLDIKPGDEVIMPSFTFVSTANAFVLRGAKMVFVDIRPDTMNIDETKIEAAITDKTRVIVPVHYAGVACEMDTIMALAKKHNLFVVEDAAQGVMSTYKGKALGTIGHIGCFSFHETKNYTAGGEGGATLINDPSLIDRAEIIREKGTNRSQFFRGQVDKYTWRDIGSSYLMSDLQAAYLWGQLEAAEQINERRLALWHGYYNAFKPLADAGRIDLPVIPGNVVQNAHMFYIKLRDIEERSAFISYLKEADIMAVFHYIPLHACPAGEAFGRMAGEDRFTSKESERLVRLPIFYNLTDVNQSTVINTVLSFFV

SEQ ID NO: 3573 - DNA, 1116 bp, Caulobacter crescentus CB15
  CDS (1)..(1116): transl_table=11
gtgagtgacctgccgcgcatttccgtcgccgcgccgcgcctcgacggcaacgaacgtgactatgtactcgaatgcatggacacgacctggatctcgtcggtcggacgcttcatcgttgagttcgaaaaggccttcgccgactactgtggcgtcaagcacgcgatcgcctgcaacaacggtacgaccgccttgcacctggccctggtggcgatggggatcggacccggcgacgaggtgatcgttccgagcctgacctatatcgcctcggccaattcagtcacctattgcggcgcgacgcctgtgctggtcgacaacgatccgcggaccttcaacctggacgccgcgaagttggaggcgctgataacgccgcgcacgaaggcgatcatgcccgtgcacctctacggtcagatttgcgacatggatccgatcctcgaagttgctcgcaggcataacctgctcgtgatcgaggatgcggccgaggcggtgggcgcgacctaccggggcaagaagtcaggctcgctgggcgactgcgccaccttcagcttcttcggcaacaagatcatcaccaccggcgagggcgggatgatcaccaccaatgatgatgacctggcggccaagatgcgcttgctgcgaggccagggcatggatcccaaccgccgctactggtttccgatcgtcggcttcaattaccggatgaccaacatccaggccgcgatcggtctggcgcagctggagcgggtcgacgaacacctggccgcgcgcgaaagggtcgtgggctggtacgagcagaagctggcgcgcctgggcaatcgggtcaccaagccccatgtcgcgctgaccggtcgccacgtgttctggatgtacactgtgcgcctgggcgagggcctttccaccacgcgcgatcaggtgatcaaggatctcgacgcgttgggcattgagagccgtccggtgttccacccgatgcacatcatgccgccctatgcgcatctggccacggatgatctgaagatcgccgaggcctgcggggtcgacggcttgaacctgccgacccacgcggggctgactgaagccgatatcgaccgtgtcatcgcggcgctcgatcaggtgttggtctag

SEQ ID NO: 3574 - protein, 371 aa, Caulobacter crescentus CB15
MSDLPRISVAAPRLDGNERDYVLECMDTTWISSVGRFIVEFEKAFADYCGVKHAIACNNGTTALHLALVAMGIGPGDEVIVPSLTYIASANSVTYCGATPVLVDNDPRTFNLDAAKLEALITPRTKAIMPVHLYGQICDMDPILEVARRHNLLVIEDAAEAVGATYRGKKSGSLGDCATFSFFGNKIITTGEGGMITTNDDDLAAKMRLLRGQGMDPNRRYWFPIVGFNYRMTNIQAAIGLAQLERVDEHLAARERVVGWYEQKLARLGNRVTKPHVALTGRHVFWMYTVRLGEGLSTTRDQVIKDLDALGIESRPVFHPMHIMPPYAHLATDDLKIAEACGVDGLNLPTHAGLTEADIDRVIAALDQVLV

SEQ ID NO: 3575 - DNA, 1038 bp, Synechocystis sp. PCC 6803
  CDS (1)..(1038): transl_table=11
atgaaattatccgttcttactgtggcgtttagcgtctcagctttatttgaaactactatatttgctgaattttgcggaacaaaatatgcagtagcagttagcagtggtactgccgcgttgcatttggctctcctcgccttaaatattggtgccggtgatgaggtaattgttccaacgttaagttttatcgctacggctaatgcagttacttacacaggagctaaacccatttttgtggatagtgaatgggaaacatggaatattaaccctgatttaattgaagctgccattactcctcgcaccaaagccatcatgcccgttcatctctatggacatcctgcgaaaatggacaaaattctcgatattgctcaacgctatcatttagctgtgattgaagatgcagcagaagctcacggcgcaacttatcagggaaaaaccgttggaagcttaggagatttggggatttttagcttttatggtaataaaattgtaaccacaggggaaggcggcatgatagttactgatgacgaagaattagcacaaaaaattcgtattctcaaagaccatggaatgtcgaaaaaacaaagatactggcatcctattttaggatataactaccgcataactaatattcaggcagctttaggagttgctcaaatggagcgaattaataaaatacctgaggctaaacgacgcattgcccaactgtatgaacaagaattgttacaaattcaaggcttaactttacctccgcgtcaaccctgggcagaaagcgtcttttggttatacacgattttaattaatcaggacaaactggaattaaatcgagatcaattaatgtcgaggttgcaagaaaaaggaattgaaaccagacctttgtttattcctattcatcgtcagcccatttataacactcatcagtcattacctgtagctgaatcattaagcaagaatgggttaagtttacctagttttgttaccttgtctaatgaaaatctttatcaaattatagactcgattaaaaaagttatcagttaa

SEQ ID NO: 3576 - protein, 345 aa, Synechocystis sp. PCC 6803
MKLSVLTVAFSVSALFETTIFAEFCGTKYAVAVSSGTAALHLALLALNIGAGDEVIVPTLSFIATANAVTYTGAKPIFVDSEWETWNINPDLIEAAITPRTKAIMPVHLYGHPAKMDKILDIAQRYHLAVIEDAAEAHGATYQGKTVGSLGDLGIFSFYGNKIVTTGEGGMIVTDDEELAQKIRILKDHGMSKKQRYWHPILGYNYRITNIQAALGVAQMERINKIPEAKRRIAQLYEQELLQIQGLTLPPRQPWAESVFWLYTILINQDKLELNRDQLMSRLQEKGIETRPLFIPIHRQPIYNTHQSLPVAESLSKNGLSLPSFVTLSNENLYQIIDSIKKVIS

SEQ ID NO: 3577 - DNA, 1131 bp, Salmonella typhimurium LT2
  CDS (1)..(1131): transl_table=11
atgattccttttaatgcgccgccggtggtgggaaccgaactcgaatacatgcagtctgcaatgagcagcggcaaactgtgcggcgacggcggctttacgcgtcgttgccagcagtggctggagcaacatttcggcagcgcgaaggtgttgctaacgccttcctgtaccgcatcgctggagatggcggctctgttgttggatattcagcccggcgatgaagtgatcatgccgagctttacgtttgtctccaccgctaacgcttttgtcctgcgcggcgcgaaaattgtgtttgtcgatattcgtccggatacgatgaatattgacgaaacgctgattgaggcggcgattactgataaaacccgcgctatcgtgccggtacactacgctggcgtcgcttgtgaaatggacgtcatcatggcgctggcggataagtataatctgttcgttgtcgaggatgccgcccagggtgtgatgtccacgtacaaagggcgcgcattagggacgatcggtcacatcggctgttttagcttccatgaaaccaaaaattacaccgctggcggcgaaggcggcgcgacgctgatcaacgatcgtacgctaattgaacgcgcggagatcatccgcgaaaaaggcaccaaccgtagccagttcttccgtggtcaggtggataaatacacctggcgggatatcggctccagttatttgatgtccgatctgcaggctgcctatctgtgggcgcaactggaggccgccgatcgtatcaatcaacagcgtctgtcgctgtggcagacttactacgatgcgttaacgccgctggcgcgcgccgggcgtttcgagctgccttctattccggaaaactgcgggcataatgcccatatgttttacatcaaactgcgggatatcgccgatcgcagcgcgctgattaatttcctgaaagaggcggaaatcatggcggtattccattacattccgctgcatgattgtccggcgggcgataaattcggcgagtttatcggggacgatgtctacaccacaaaagagagcgaacgtttgttgcgtctgccgctgttttataaccttgcgcccgtcgatcaacgaacggtgattactaccttgctaaattatttctcctga

SEQ ID NO: 3578 - protein, 376 aa, Salmonella typhimurium LT2
MIPFNAPPVVGTELEYMQSAMSSGKLCGDGGFTRRCQQWLEQHFGSAKVLLTPSCTASLEMAALLLDIQPGDEVIMPSFTFVSTANAFVLRGAKIVFVDIRPDTMNIDETLIEAAITDKTRAIVPVHYAGVACEMDVIMALADKYNLFVVEDAAQGVMSTYKGRALGTIGHIGCFSFHETKNYTAGGEGGATLINDRTLIERAEIIREKGTNRSQFFRGQVDKYTWRDIGSSYLMSDLQAAYLWAQLEAADRINQQRLSLWQTYYDALTPLARAGRFELPSIPENCGHNAHMFYIKLRDIADRSALINFLKEAEIMAVFHYIPLHDCPAGDKFGEFIGDDVYTTKESERLLRLPLFYNLAPVDQRTVITTLLNYFS

SEQ ID NO: 3579 - DNA, 1149 bp, Nostoc sp. PCC 7120
  CDS (1)..(1149): transl_table=11
atgatccaaagcctaagttcgattcccgcctttgatatcaagcagcaatatgcttccatagaagccgaagtcagcagagccgttgtcgatgcgctggcttccgggcgttatattggtggccctccagtcgaaagttttgagcaacagtttgctgcttatcatggcgttactgattgtgtagcttgtaattctggtacagatgccctatttctagctttacgcgccttaggaatcggtgcaggcgatgaagtaattactacacccttcacctttgtcgctacggctgaagtgatcagcgctgtaggtgcaaagccggtatttgttgacatcgatgagataagttttaacctcgatttacaacaagtagcggcggcgattacacccaaaaccaaagcgattatcccagtgcatttatttggacagcctgtggatatgacaaagctcatggcgatcgctcaagctcacaatgtcgcagtaattgaagattgcgctcaatctacaggcgcaagttgggacggcaaaaaggtcggtagtattggacatattggttgttttagcttctaccccaccaagaatttaggtgcttgcggcgatggtggcgcgattacaaccaatgatccagaaattgctgccaaggtgcggatcatcaaggaacatggacagagacatcgttatcaatatgaagaaataggtgttaatagccgcttagatgccattcaagcagtaattttgcagattaaactaccatatcttgatatgtggaatcggcaaagacaagcgatcgctgcctattatcaaaaattcctcagtcaaattcccggtatcattcccccgcaagaactagctggtggcgtgagtgtgtggaatcaatatactattcgcgtcatcaccgcaggacggaatggcaatagcgccacacatcgggagacggtaaaaaatagcttgcaagaaaagaaagtaggctcaatggtttactacccctaccctttacatttgcagccagtttatcaatatctcggttatcaaccaggacaattaccagttgcagaacaagcgtgcaatgaagtcttatccttacccatgtttcccgaattaacaaccgaacagcaagatcaagtgatttatgctctgaaggatattcttttgtag

SEQ ID NO: 3580 - protein, 382 aa, Nostoc sp. PCC 7120
MIQSLSSIPAFDIKQQYASIEAEVSRAVVDALASGRYIGGPPVESFEQQFAAYHGVTDCVACNSGTDALFLALRALGIGAGDEVITTPFTFVATAEVISAVGAKPVFVDIDEISFNLDLQQVAAAITPKTKAIIPVHLFGQPVDMTKLMAIAQAHNVAVIEDCAQSTGASWDGKKVGSIGHIGCFSFYPTKNLGACGDGGAITTNDPEIAAKVRIIKEHGQRHRYQYEEIGVNSRLDAIQAVILQIKLPYLDMWNRQRQAIAAYYQKFLSQIPGIIPPQELAGGVSVWNQYTIRVITAGRNGNSATHRETVKNSLQEKKVGSMVYYPYPLHLQPVYQYLGYQPGQLPVAEQACNEVLSLPMFPELTTEQQDQVIYALKDILL

SEQ ID NO: 3581 - DNA, 1161 bp, Ralstonia solanacearum GMI1000
  CDS (1)..(1161): transl_table=11
atgacccaaaccaacgccgtcgccgaacaaccgttcctgcccttcgtgcgccccaccatcgacgaggcgaccatcgccgccgtggccgatgtgctgcgctcgggctggatcacctcgggccccaaggtcgccgcgttcgaagccgcgctgtcggaatacttcggcggccgcccggtgcgcaccttcgccaacggcaccgccacgatggaagtggcgctgcgcgtcgcgggcatcggccccggcgacgaggtcatcaccacgcccatctcgtgggtggccacctccaacgtggtgctgacggtcggcgccaggcccgtcttcgtcgacatcgacccagtcacccgcaacatcgacctggacaagatcgaggccgccatcacgccgcgcacgcgcgcgatcatcccggtctacctgtcgggcctgccggtggacatggaccgcctgtacgacatcgcccgccgccacaagctgcgcgtggtggaagacgccgcgcaggccatcggctcgcgctggggcgaccagcgcatcggccagctcggcgacctggtcagcttcagcttccaggccaacaagaacatcaccaccatcgagggcggcgcgctcgtgctgaacacgcccgaagaagccgtgctggccgagaaataccgcctgcagggcgtggtccgcaccggcttcgacggcatggaagtcgacgtggtgggcggcaagttcaacctgaccgacgtcaacgccgccatcggcctcggccagttcgcccagctggaggccatcaccgcgcgccgcgccgcgctggcccgccgctacttcgccgccatgcgcgcggccaacatcgaatcgttcggcatcgagctgccggtcgaagatttcgcgcacaccaactggcacatgttccagatcgtgctgccgctcgatcgcctcaaggtcgatcgcgccggcttcatggccgggctgaaggccatgggcatcggcaccggcgtgcactatccgcccatccacctgttcaagctgtaccgcgagctcggctggggcccgggcatgttcccggtggccgagcgcatcgggcgcgccatcgtgacgctgccgatgttcgccgccatggaagattccgacgtggaccgcgtagtcaatgcggtccgccaactctgcatccaacaccaataa

SEQ ID NO: 3582 - protein, 386 aa, Ralstonia solanacearum GMI1000
MTQTNAVAEQPFLPFVRPTIDEATIAAVADVLRSGWITSGPKVAAFEAALSEYFGGRPVRTFANGTATMEVALRVAGIGPGDEVITTPISWVATSNVVLTVGARPVFVDIDPVTRNIDLDKIEAAITPRTRAIIPVYLSGLPVDMDRLYDIARRHKLRVVEDAAQAIGSRWGDQRIGQLGDLVSFSFQANKNITTIEGGALVLNTPEEAVLAEKYRLQGVVRTGFDGMEVDVVGGKFNLTDVNAAIGLGQFAQLEAITARRAALARRYFAAMRAANIESFGIELPVEDFAHTNWHMFQIVLPLDRLKVDRAGFMAGLKAMGIGTGVHYPPIHLFKLYRELGWGPGMFPVAERIGRAIVTLPMFAAMEDSDVDRVVNAVRQLCIQHQ

SEQ ID NO: 3583 - DNA, 1095 bp, Pyrococcus furiosus DSM 3638
  CDS (1)..(1095): transl_table=11
atgattccaattgcaaagcccttaatcggagaagaggagattaatgccgtaattgaagtcctaaagagcgggatgctcgcccatggaaaggaagtagaagccttcgaaagggaatttgccagctacataggagtaaaacacggaattgcggtggtgaatggaacggcagctttggatatagctttaaaagcactgaagataaagccaggagatgaaattataacaactcccttcacgttcatagcttcagcaaatgctattcttttccagggagccaaaccggtttttgcagatatagatcccaagacgtacaacctcgatccggacgaggttctcgaaaagataaacgagaagacaaaagctataatcgttgttcacctctacggacaacctgcagacatgaaggcctttaaggaaatagctgaggactacaaactatatctcatcgaggactgcgcacaagctcacggagctgagtttgaaggtcagaaggttggaaccttcggagacatagccgccttcagcttttatccaacgaagaacatgacaaccggagagggtggaatggttctaactaacgacgatgaactcgctcgtagagctaggctcataaggaaccatgggcagacagagaaataccttcatgaggagctcggctacaaccttagaatgaccaatatcgccgcagcgctcggaagagtccagctcagaaagcttgacaaatggaacgagattagaattgaaaacgcggaactattaacaaagggaataaagaggattaaggggttgacgccgccttacgttgataagagggttaagcacgtctttcaccagtatgttataagggttgaagacgattttccattaacgagagatgagctcagggaaaagttaatggaaaaaggaataggaactgccgtgcactatcccatgccagttcaccaccagcccctctaccaaaggctcggctactccaaggattgctgtcccaatgcgatagaggccagcaagagagttctaagcttgccagtgcatccagctgtcagtaaggaggacataaattacataattaggacgcttgaagagcttgggtga

SEQ ID NO: 3584 - protein, 364 aa, Pyrococcus furiosus DSM 3638
MIPIAKPLIGEEEINAVIEVLKSGMLAHGKEVEAFEREFASYIGVKHGIAVVNGTAALDIALKALKIKPGDEIITTPFTFIASANAILFQGAKPVFADIDPKTYNLDPDEVLEKINEKTKAIIVVHLYGQPADMKAFKEIAEDYKLYLIEDCAQAHGAEFEGQKVGTFGDIAAFSFYPTKNMTTGEGGMVLTNDDELARRARLIRNHGQTEKYLHEELGYNLRMTNIAAALGRVQLRKLDKWNEIRIENAELLTKGIKRIKGLTPPYVDKRVKHVFHQYVIRVEDDFPLTRDELREKLMEKGIGTAVHYPMPVHHQPLYQRLGYSKDCCPNAIEASKRVLSLPVHPAVSKEDINYIIRTLEELG

SEQ ID NO: 3585 - DNA, 1116 bp, Thermoanaerobacter tengcongensis MB4
  CDS (1)..(1116): transl_table=11
atggagatagaattaattaatttaaaacgccagtataaaaatttaagggacgaaataaataaggcaatagaaaaagttttagaaaatggacaatatatcctaggtccagaagtaaaagcttttgaaaaagaaatagcagaatatttgggtataagatacgcaataggtgtagcaaatgggactgatgctttggtgctttcattaagagctctcaatataggaccaggagatgaagttataacaactccttttaccttttttgcaacagcagaagcagtttctcaggtaggtgctacaccagtttttgtcgacatagacccagatacgtacaatataaatccggatttgatagaagaaaaaattactaaaaaaacaaaagctattataccagtacatatttttggacaaccctgtgatatggacaaaatcatggaaattgccaagaaacacaatttatacgtaatcgaggatgcatgtcaagcaataggatcagagtataaaggccaaaaagtaggtacttttggagatgtcgcctgcttctcattctttcccacaaaaaacttaggcggttatggcgatggaggaatggtggtaactaataatccagagatagctgaaaaagtagacatactcagaaaacatggcagtaaaaagaaatattataatgaagaaattggatataacagtagactcgatgaattgcaggctgcaattttaagagtaaaattaaaatatcttgatgtgtggaatagtcaaaggattagtgcagctaataaatataacgaactattaaaagatttatcagatgttataaaaagtccatataaattaccagaagttaaacacatatatcatttgtactgcatacaaagtgaaaaaagagaatttttaatggaaaaattaaaagaaaatggcattgcaacagggatatactatcctgtgccattacatcttcaaaaggcgtatgctaatttaggctacaaagaaggcgacttgccagttgctgaagaagtatgtagaaaaatttttgctataccgatgtatcctgaaattactgatgaagagattagctatatcagtaaggtactgcacaaaattgtaaacgaaggagattga

SEQ ID NO: 3586 - protein, 371 aa, Thermoanaerobacter tengcongensis MB4
MEIELINLKRQYKNLRDEINKAIEKVLENGQYILGPEVKAFEKEIAEYLGIRYAIGVANGTDALVLSLRALNIGPGDEVITTPFTFFATAEAVSQVGATPVFVDIDPDTYNINPDLIEEKITKKTKAIIPVHIFGQPCDMDKIMEIAKKHNLYVIEDACQAIGSEYKGQKVGTFGDVACFSFFPTKNLGGYGDGGMVVTNNPEIAEKVDILRKHGSKKKYYNEEIGYNSRLDELQAAILRVKLKYLDVWNSQRISAANKYNELLKDLSDVIKSPYKLPEVKHIYHLYCIQSEKREFLMEKLKENGIATGIYYPVPLHLQKAYANLGYKEGDLPVAEEVCRKIFAIPMYPEITDEEISYISKVLHKIVNEGD

SEQ ID NO: 3587 - DNA, 1083 bp, Methanosarcina mazei Go1
  CDS (1)..(1083): transl_table=11
atgatcccaatcgccaggcccctgctgggcaaggaagagattgatgcagtaacagaggtcctgagttcaggaatgatcgcacagggaccaaaagtagaagaatttgagcttgctttttccgagtacacaggctgcgaatatgcagcggccgtaaattccggcactgcagctcttcatattgcacttcttgcccacgatatcggaaaagaagatgaagtaatcacaagtcccttcacatttattgccactgcaaacagcatcctctataccggagcaaaacctgtttttgcagacattgagcctgatacatacaatatagacccggaaaaaataaaggaaaagataaattcaaaaacgaaagccattatgcccgtccacctttacgggcagtctgctgacatgaaagccataatggaaatcgctgaagactacaaacttgttgtgatagaagatgcctgccaggcacatggtgcagagtgcctggggaagaaagcaggcagtttcgggacaggagcattcagcttttacccgaccaaaaacatgacaacaagcgaaggcggaataattacaaccagcgaccgggaaattgcagaaaaatcaaaaatgatcagggctcacggctccagagtacgctacctgcatgaaatgctgggctttaacttgcgcatgactgacattgcagccgcaataggacttgctcagcttgaaaaactggacgggtttaatgcctccaggcagaaaaatgcagccatgctttcagaagggcttaaaagcatttcaggaattgtacccgcaactacaaggaaaggttatacccacgtttttcaccagtacacaataagggcacaaaacagagataaactggcagattttttgaaggaaaaaggcataggcacaggagttcactacccgatacctatccataaacagccttattatatggagcttggatacaaagactctctgcctatctcagataaagcagcagaagaggttctttcccttcctgtacatcctgccctgtccagagacgatgttctgaaagtaataaaggaagtcaaagaattttatgcaagtgcctga

SEQ ID NO: 3588 - protein, 360 aa, Methanosarcina mazei Go1
MIPIARPLLGKEEIDAVTEVLSSGMIAQGPKVEEFELAFSEYTGCEYAAAVNSGTAALHIALLAHDIGKEDEVITSPFTFIATANSILYTGAKPVFADIEPDTYNIDPEKIKEKINSKTKAIMPVHLYGQSADMKAIMEIAEDYKLVVIEDACQAHGAECLGKKAGSFGTGAFSFYPTKNMTTSEGGIITTSDREIAEKSKMIRAHGSRVRYLHEMLGFNLRMTDIAAAIGLAQLEKLDGFNASRQKNAAMLSEGLKSISGIVPATTRKGYTHVFHQYTIRAQNRDKLADFLKEKGIGTGVHYPIPIHKQPYYMELGYKDSLPISDKAAEEVLSLPVHPALSRDDVLKVIKEVKEFYASA

SEQ ID NO: 3589 - DNA, 1206 bp, Yersinia pestis KIM
  CDS (1)..(1206): transl_table=11
ttgctgctttacgtctctatattcgtagtggtgcctccattgagagtaccgcgtattggttatgcaggggatgagatgattccatttaacactccaccgatagtgggcactgaactgggttatatgcaggctgcgatgagcagtggcaagttatgcggtgatggtggttttacccgtcgctgccagcagtggatggagaaacgttttaactgcccaaaagtgttactgacgccatcttgtaccgcctcgttggaaatggccgcgttattgctggatatcaagcccggtgatgaagtgatcatgccaagttttacctttgtttctaccgccaatgcctttgtgctgcgcggggccaaaatggtgtttgtcgatatccgtccagacaccatgaatatcgatgaaaccaagattgaagcggcgatcaccgataaaacccgggttattgtgccagtccactacgcaggggttgcctgtgagatggataccatcatggcactggcgaaaaagcataatttgtttgtggtagaagatgcggctcaaggcgtgatgtcaacctacaaaggtaaagctctgggtaccattggccatattggctgcttcagcttccatgaaaccaaaaattacactgcgggcggtgaaggtggggcgacgttgatcaatgatccttcattgattgatcgtgcagaaattatccgtgaaaagggcaccaaccgtagccaattcttccgtggtcaggtggataaatacacctggcgtgacatcggctccagctacttgatgtctgatttacaggccgcttacctgtggggccagttagaggcagcagagcagatcaacgaacgccgtctggcgctatggcatggttattataatgctttcaaaccgttggccgatgctgggcgcattgatttaccggtgatcccaggcaacgtggtgcaaaatgcccacatgttttatattaaactgcgtgatattgaggagcgctctgcatttatcagctatttaaaagaagcggatattatggcggtattccactacatcccattacatgcgtgtccagcaggtgaggcgtttggccgtatggctggcgaagaccgctttacctccaaggagagtgagcgtctggtgcgcttacctattttctacaacctgactgatgttaatcagagcacggttattaatactgtgctgagtttcttcgtctga

SEQ ID NO: 3590 - protein, 401 aa, Yersinia pestis KIM
MLLYVSIFVVVPPLRVPRIGYAGDEMIPFNTPPIVGTELGYMQAAMSSGKLCGDGGFTRRCQQWMEKRFNCPKVLLTPSCTASLEMAALLLDIKPGDEVIMPSFTFVSTANAFVLRGAKMVFVDIRPDTMNIDETKIEAAITDKTRVIVPVHYAGVACEMDTIMALAKKHNLFVVEDAAQGVMSTYKGKALGTIGHIGCFSFHETKNYTAGGEGGATLINDPSLIDRAEIIREKGTNRSQFFRGQVDKYTWRDIGSSYLMSDLQAAYLWGQLEAAEQINERRLALWHGYYNAFKPLADAGRIDLPVIPGNVVQNAHMFYIKLRDIEERSAFISYLKEADIMAVFHYIPLHACPAGEAFGRMAGEDRFTSKESERLVRLPIFYNLTDVNQSTVINTVLSFFV

SEQ ID NO: 3591 - DNA, 1155 bp, Yersinia pestis KIM
  CDS (1)..(1155): transl_table=11
atgcagagttttttgcctttttctaggccagcaataggtagtgaagaaattaatgctgttgctaatgtattaggctctggttggattactaccggtccccagaatcatcaattggaaactgatttctgtcaaatttttggttgcaaacatgcgatcgctgtatgttctgcaacagcaggaatgcacattacattgctggcgttgggcattggccctggtgatgaggttattacgccatcacagacgtgggtttctacgattaacatgatcgtgttgctgggtgcagaacccgtaatggtcgatgttgatcgcgatacattgatggtaaatgcggctgctattgaagcggcgattacacccaacaccaaagccattattcccgtccactatgctggcgcgccctgcgaccttgacgcattgcgtcagatctcccaacggcatggtatcccactgattgaagatgctgcacatgccgttggcactcgttatcgagatcaatggattggtgagcaggggaccgctattttctctttccatgccatcaagaatatcacttgtgctgagggggggttagttgccaccgatgatgatgaattggcggccagagtccgtcggcttaagttccatggcctgggtgtggatgcctttgaccgacaaatacaggggcgtagcccacaggctgaagttgtggaaccggggtataaatataacttatctgatatccacgccgctattgcggtggtgcagcttagacgtttgcccgaaattaacgcccgtcggcaggcgctggttgcttcctatcataaggcattagcgcatttgcctttgcagccgttggccttgcctcactattctcatcaacatgcctggcaccttttcatggtgcgtgttgatgaagaacgctgtggtattagccgggatcaactgatggcgtgtttgaaagatatgggtattggcagtgggctacattttcgtgcggtacatagccaaaaatattatcgcgaacgttatccgcatttgtgtttgcccaacacggaatggaactcagccagattgtgcacgttaccgcttttccccgatatgctagacagtgatattgaacgagtggctaatgcattaacaacaattatagggtcacaccgtgtcactaaatga

SEQ ID NO: 3592 - protein, 384 aa, Yersinia pestis KIM
MQSFLPFSRPAIGSEEINAVANVLGSGWITTGPQNHQLETDFCQIFGCKHAIAVCSATAGMHITLLALGIGPGDEVITPSQTWVSTINMIVLLGAEPVMVDVDRDTLMVNAAAIEAAITPNTKAIIPVHYAGAPCDLDALRQISQRHGIPLIEDAAHAVGTRYRDQWIGEQGTAIFSFHAIKNITCAEGGLVATDDDELAARVRRLKFHGLGVDAFDRQIQGRSPQAEVVEPGYKYNLSDIHAAIAVVQLRRLPEINARRQALVASYHKALAHLPLQPLALPHYSHQHAWHLFMVRVDEERCGISRDQLMACLKDMGIGSGLHFRAVHSQKYYRERYPHLCLPNTEWNSARLCTLPLFPDMLDSDIERVANALTTIIGSHRVTK

SEQ ID NO: 3593 - DNA, 1098 bp, Thermosynechococcus elongatus BP-1
  CDS (1)..(1098): transl_table=11
atgagcgtagttccttttcttgatttgcgtgctgcttatcttgagctcaaagcggagatcgatgctgctgtggcccgcgtgctggatagcggctggtatatcctcgggcaagagctcgaagcgtttgaggctgaatatgcagcctattgtggcgcgcagcattgcgtcggggttgccaatggtttggatgcacttcacctggctttgctggcgatggaggtcgggcctggagatgaagtcatcgttccctccaacacctacatcgccacatggctggcggtgagtcagtgtggtgcagtgccagtgccggtggagccagatctggctacctacaatatcgacccgcagcggatcgaagccgcgattactccgcgtaccaaggtcattttgccggtgcatttatacgggcagccggtagacctcgaccccattcttgcgatcgcgcaacgccacgggttgcgtgtgctggaggatgctgcacaggcgcatggggcgcgctacaagggccagcgtattggtgcgcatggcgatgcagtagcctggagtttctaccctggcaagaatctcggtgctatgggcgatgcgggtgcggtcacgacgaacgacccagagcttgcggatcgcatacgtgtgctgcgtaactacggctcccgcgtgaaatacgtcaacgaactacaaggctggaacagccggttggacccacttcaagccgctattctgcgcgttaagctcacccatctggacgaatggaacgagcggcgtagaaaactcgctgcgttatacctgcgggagttgagcaattccggcttggggttaccccacgtgccagattgggcggagcccgtttggcacttgttcgtggtgcggcatccgcgccgcgatgacttccagcagcggcttgcgcaggcgggtatccagacgttgatccactatcctatcccgccgcacgggcaggcagcctatgccggtcttgggattgcgccggggacgcttcccatcgccgagcgcctggctgctgaagtgttgagcttgccaatcgggccgcatttgtcagattcggatgcgctgactatcgtcggggctgtcaagaaatgttga

SEQ ID NO: 3594 - protein, 365 aa, Thermosynechococcus elongatus BP-1
MSVVPFLDLRAAYLELKAEIDAAVARVLDSGWYILGQELEAFEAEYAAYCGAQHCVGVANGLDALHLALLAMEVGPGDEVIVPSNTYIATWLAVSQCGAVPVPVEPDLATYNIDPQRIEAAITPRTKVILPVHLYGQPVDLDPILAIAQRHGLRVLEDAAQAHGARYKGQRIGAHGDAVAWSFYPGKNLGAMGDAGAVTTNDPELADRIRVLRNYGSRVKYVNELQGWNSRLDPLQAAILRVKLTHLDEWNERRRKLAALYLRELSNSGLGLPHVPDWAEPVWHLFVVRHPRRDDFQQRLAQAGIQTLIHYPIPPHGQAAYAGLGIAPGTLPIAERLAAEVLSLPIGPHLSDSDALTIVGAVKKC

SEQ ID NO: 3595 - DNA, 1131 bp, Oceanobacillus iheyensis HTE831
  CDS (1)..(1131): transl_table=11
ttgataccatttaatataccttgtcatttaggtcaagaagaagaagcaatcgctgaagcaattaaagagcaaaagttatctgggaatggccgttttagtcgatattgtacgacatggttggagaatcagttagacgcaaaaaaagcaatattaactccgtcctgtacggccgctttggaaatgtctgccattttgacagatgtgtcagaaggagacgaagttattatgccatcctatacatttgtgtctaccgctaatgcatttgcattgcgaggagcacatattcggtttgtagatgtggaaccaacgacaatgaatattgatccgaaggctattgaagcagcaattaatcatcgaactaaagcaatcgtagtggttcactatgggggtgtggcttgtgatatgattcctatcatgaacttggcaaacgaacatcaattatgggtaattgaagatgcggcacaaggattaaagagtcagtataatggacgtccattaggaactattggtcatcttgggacatttagttttcatgaaacaaaaaattatacatgtggagaaggcggagctcttataataaatgacgatgcttttatcgaacgtgcagagatcatacaggaaaaaggcacagaccgttctaaatttgttcgcggggaagtagacaaatatacatggcgagatatcggatcttcttatttaacgagtgaattaaatgcagcctatttatctgttcaattggatcaagcagaagtcattaaccaagatcgtcttgctacttggtatttgtatcaaaaaggattaaagccattagaagaaaaaggaattttagatttaccaaccataccaaatggatataagcataatgcacatatgttttacattaaaacaaaaacagaagaagacagaaatgaacttattaaatacttaaaggaacaagaaattatggctgtaacccattatgttccattacaccaatctgaagctggtagatattatggatccttctcaggagaagacatgtatacaacatctcatagtaacaggattctacgcttaccactttattacggaataacaaaaagggatgtcgcatatgtcatacaaacaattcagcaatattattcaacataa

SEQ ID NO: 3596 - protein, 376 aa, Oceanobacillus iheyensis HTE831
MIPFNIPCHLGQEEEAIAEAIKEQKLSGNGRFSRYCTTWLENQLDAKKAILTPSCTAALEMSAILTDVSEGDEVIMPSYTFVSTANAFALRGAHIRFVDVEPTTMNIDPKAIEAAINHRTKAIVVVHYGGVACDMIPIMNLANEHQLWVIEDAAQGLKSQYNGRPLGTIGHLGTFSFHETKNYTCGEGGALIINDDAFIERAEIIQEKGTDRSKFVRGEVDKYTWRDIGSSYLTSELNAAYLSVQLDQAEVINQDRLATWYLYQKGLKPLEEKGILDLPTIPNGYKHNAHMFYIKTKTEEDRNELIKYLKEQEIMAVTHYVPLHQSEAGRYYGSFSGEDMYTTSHSNRILRLPLYYGITKRDVAYVIQTIQQYYST

SEQ ID NO: 3597 - DNA, 1107 bp, Shigella flexneri 2a str. 301
  CDS (1)..(1107): transl_table=11
atgggcgtggaggaactcgctgcagttaaagaggttctcgaatccggttggatcacaaccggtccgaagaatcaggcgcttgagcaagccttttgccagttgacgggaaatcagcatgccatcgcggtcagttcagccaccgccggaatgcatatcacgctaatggcgttggaaattggcaagggcgatgaagtgattacgccttccctgacctgggtttcaaccctcaatatgatttccttgctgggtgcaacgccggtaatggtggatgtcgaccgcgatacgctgatggtcacgcctgaagcgatcgaatcagccattacgccacgcactaaagccatcattccggtgcattatgccggtgcgccagcagatattgacgccattcgcgccattggcgaacgttacggcatcgcagttatcgaagatgctgcccatgccgtcggtacgtattacaaagggcgacatattggcgcaaaaggtaccgctattttttcatttcatgccattaaaaatattacctgtgctgaaggtggcctgattgtaactgataatgaaaaccttgcccgccagctacggatgctgaaatttcacggtctgggtgtcgatgcctatgacagacaaacctggggccgtgcaccgcaggctgaagtcttaacaccgggctataagtacaatctgaccgatattaacgccgcgattgccctgacacagttagtcaaattagagcacctcaacacccgtcggcgcgaaattgcccagcaatatcagcaagcactggcagctctcccctttcagccattaagccttcccgcctggccgcacgttcacgcctggcatctgtttattattcgtgtcgatgaacaacgttgtggtatcagtcgcgatgcgttgatggaagcgttaaaagaaagaggcattggtaccgggttacatttccgcgccgctcacacacaaaaatattatcgcgagcgttttcccacgctgtcgttaccgaataccgaatggaatagcgaacgcatctgttcgttgccgctgttcccggatatgactaccgccgatgccgaccgcgtcatcacagcccttcagcaactcgcaggacaataa

SEQ ID NO: 3598 - protein, 368 aa, Shigella flexneri 2a str. 301
MGVEELAAVKEVLESGWITTGPKNQALEQAFCQLTGNQHAIAVSSATAGMHITLMALEIGKGDEVITPSLTWVSTLNMISLLGATPVMVDVDRDTLMVTPEAIESAITPRTKAIIPVHYAGAPADIDAIRAIGERYGIAVIEDAAHAVGTYYKGRHIGAKGTAIFSFHAIKNITCAEGGLIVTDNENLARQLRMLKFHGLGVDAYDRQTWGRAPQAEVLTPGYKYNLTDINAAIALTQLVKLEHLNTRRREIAQQYQQALAALPFQPLSLPAWPHVHAWHLFIIRVDEQRCGISRDALMEALKERGIGTGLHFRAAHTQKYYRERFPTLSLPNTEWNSERICSLPLFPDMTTADADRVITALQQLAGQ

SEQ ID NO: 3599 - DNA, 1146 bp, Shewanella oneidensis MR-1
  CDS (1)..(1146): transl_table=11
atgatcccctatggccgacaagacatcaatcaggcagatgttgatgctgtgattgaagtgcttaattctgattatttgactcaagggcctaaggttccggcatttgagtcagcagttgcttcctattgttcagctcgctatggcgtagcagtaaatagtgcgacttctgccttgcatattgcatgtctcgctcttggggttgggccaaacgatatagtatggacttctccaattacctttgtcgcctcggcaaactgcgcgctttactgtggagctgagattgattttgtcgatgtggatcctctaacgggtaatctttgtccacatgcattggcaatgaaattagaacaagcggctcggatagggaagctccctaaggttgttatccctgtacatttatgtggtcatagttgtgatatggcagcgatcgctgctcttgctgaacaatatagctttcacatcattgaagatgcctcacatgggattggcgggagctatcatggataccctttgggtagctgccaatactctgatattaccgtttttagctttcaccccgtcaaaattatcaccagcgccgaaggcggtatggccatgacaaacagctcagaattagctgaaaaaatggccctttaccgcagccacggtatcactaaagcccccgataaaatgttaagacctgatgaaggggactggtattacgaacaacacgccttgggatttaactataggatgacggagttgcaggcagcgcttggtttgtcgcaaattagcaggcttaatgcctttgttttgaaacgcaatgaactagccgctatatatcgtaaagaactcattggattacccttttgctgggttgagcctttgtcaaatactcaaagtgctagacatttacaaattatccgcctaaatgacgcatcaagaagaaaacagctattcaacgatatgagagctgcaaatgtacaagtgcatgttcattatttccccgtacatcttcaaccttactatttaaaacaaggatttaaagaaggtgatttcccacaagcagaggcattttatcaacagatattgaccttgccactctatcctttgatgactgataaggaacaagcttgcgttattaacaccttgttagctgtactgtaa

SEQ ID NO: 3600 - protein, 381 aa, Shewanella oneidensis MR-1
MIPYGRQDINQADVDAVIEVLNSDYLTQGPKVPAFESAVASYCSARYGVAVNSATSALHIACLALGVGPNDIVWTSPITFVASANCALYCGAEIDFVDVDPLTGNLCPHALAMKLEQAARIGKLPKVVIPVHLCGHSCDMAAIAALAEQYSFHIIEDASHGIGGSYHGYPLGSCQYSDITVFSFHPVKIITSAEGGMAMTNSSELAEKMALYRSHGITKAPDKMLRPDEGDWYYEQHALGFNYRMTELQAALGLSQISRLNAFVLKRNELAAIYRKELIGLPFCWVEPLSNTQSARHLQIIRLNDASRRKQLFNDMRAANVQVHVHYFPVHLQPYYLKQGFKEGDFPQAEAFYQQILTLPLYPLMTDKEQACVINTLLAVL

SEQ ID NO: 3601 - DNA, 1119 bp, Bradyrhizobium japonicum USDA 110
  CDS (1)..(1119)
atggacgctgacaccggccgtcggcgcatcggttacgtcaaccttccggcgcaattcgaggaagagcgcgccgagatcatgcaggcggtcgagggcgtgttccagcgcggcgatttcatcggcggtgcggcggtcggaaagctcgaagaggaattgtccgcctatctcggctcgccgcatgtcgtgacgctgaattccggcaccgatgcgctgatcctcgcgatgagggcgctcgacatcggtcccggcgacgaggtcatcaccccgccgaattcgttcgtggcatcgaccgccgcgatcatcgcagtcggcgcctcgccggtctttgcggacgtgctgccggaccagaacatcgatccggccgcggtcgaggccgccgtcacgccgcggaccaaggcgatcatgccggtgcacctgactgggcgcatggccgacatgaacccgctgatggcgatcgcaagcaagcacgccctcgccgtgatcgaggatagcgcgcaggccgtcggctcgacctatgacgggcgaatgagcggcaccatcggaaccttcggctgcttctccgcgcatccgctgaagaacctcaatgccgcgggcgatgccggcttcctcgtcaccgccgacgccgagcttgccgcacgaattcgccgcctgcgtaatcacggtctgatcaaccgcagcgacgtccaggaatggggcatcgtatcgcggctcgacacgctgcaggccgagctgcttcgcattcgcctgcgcaacctgccctcggtgatcgagcgccggcggcgcaacgccgcgcaataccgcgccgagctcgcaggcctgccgctgttcattccgccctgccgcaacatcgagttcaacacgttccacaccttcgtggtgcagaccgaccgccgcaacgacttccagaaatatcttgccgacaacggcatcgagaccgcgatccattatccggtcccgatccacctgcagccggcggcagcgcatctgggtcatggtcgcggcgcatttccggtgaccgagcagcaggccgaccagatcctcacccttcccatcaaccagttcctctcggccgccgatatcagctatatctgcgcgaccgcccgggagtacttcgcatga

SEQ ID NO: 3602 - protein, 372 aa, Bradyrhizobium japonicum USDA 110
MDADTGRRRIGYVNLPAQFEEERAEIMQAVEGVFQRGDFIGGAAVGKLEEELSAYLGSPHVVTLNSGTDALILAMRALDIGPGDEVITPPNSFVASTAAIIAVGASPVFADVLPDQNIDPAAVEAAVTPRTKAIMPVHLTGRMADMNPLMAIASKHALAVIEDSAQAVGSTYDGRMSGTIGTFGCFSAHPLKNLNAAGDAGFLVTADAELAARIRRLRNHGLINRSDVQEWGIVSRLDTLQAELLRIRLRNLPSVIERRRRNAAQYRAELAGLPLFIPPCRNIEFNTFHTFVVQTDRRNDFQKYLADNGIETAIHYPVPIHLQPAAAHLGHGRGAFPVTEQQADQILTLPINQFLSAADISYICATAREYFA

SEQ ID NO: 3603 - DNA, 1158 bp, Salmonella enterica subsp. enterica serovar Typhi Ty2
  CDS (1)..(1158): transl_table=11
atggctgaaggaaaaatgatgtcggactttttgcctttctcccgtccggcgatgggcgcggaagagctcgctgccgttaagaccgtactggactcaggttggataacaaccggcccgaaaaatcaggaactggaagcggcgttttgtcggctaacaggcaatcaatatgccgttgccgtcagttcagccactgccggtatgcacatcgcgttgatggcgctgggtattggtgaaggcgacgaggtcattacaccgtcaatgacgtgggtttctacgctaaatatgatcgttttactcggcgcgacccccgtcatggtcgatgtcgatcgcgatacgctgatggtcacgcctgaacatatcgaagccgcgattacgccacaaaccaaagcaattatccccgtccactacgctggcgcgcccgccgatctggacgctatttacgctcttggcgcgcgttatggcattccggtgattgaagacgcggcgcacgcgacaggaaccagctacaaaggtcgccacattggcgcccggggcaccgcgattttctccttccacgccattaagaacattacctgcgctgaaggcggtatcgtcgtcacggataacccgcaattcgccgataaactgcgcagtctcaagtttcacgggcttggcgttgatgcctgggatcgacagagcggaggacgcgcgccacaagcggaagtcctggcgccgggctacaaatataatttgcccgacttcaacgccgctatcgcgcttgcccagttacagaaactggatgcgcttaacgctcgccgcgccgccatcgcagcgcagtaccatcaggcaatggcagaccttccttttcagcctctgagccttccgccgtgggagcatattcacgcctggcatttattcattatccgggtcgatgaagcccgctgcggtattacccgggatgctctgatggcatcgctgaaaacgaaaggcatcggcacagggctgcatttccgcgccgcgcatacgcaaaaatattatcgcgaacgtttcccaacgctcacgctgcctgacaccgagtggaacagcgagcggatctgctcactgccgctcttcccggacatgaccgagagtgactttgatcgggtcattaccgcccttcatcagatagcaggacaataa

SEQ ID NO: 3604 - protein, 385 aa, Salmonella enterica subsp. enterica serovar Typhi Ty2
MAEGKMMSDFLPFSRPAMGAEELAAVKTVLDSGWITTGPKNQELEAAFCRLTGNQYAVAVSSATAGMHIALMALGIGEGDEVITPSMTWVSTLNMIVLLGATPVMVDVDRDTLMVTPEHIEAAITPQTKAIIPVHYAGAPADLDAIYALGARYGIPVIEDAAHATGTSYKGRHIGARGTAIFSFHAIKNITCAEGGIVVTDNPQFADKLRSLKFHGLGVDAWDRQSGGRAPQAEVLAPGYKYNLPDFNAAIALAQLQKLDALNARRAAIAAQYHQAMADLPFQPLSLPPWEHIHAWHLFIIRVDEARCGITRDALMASLKTKGIGTGLHFRAAHTQKYYRERFPTLTLPDTEWNSERICSLPLFPDMTESDFDRVITALHQIAGQ

SEQ ID NO: 3605 - DNA, 1131 bp, Salmonella enterica subsp. enterica serovar Typhi Ty2
  CDS (1)..(1131): transl_table=11
atgattccttttaatgcgccgccggtggtgggaaccgaactcgaatacatgcagtctgcaatgagcagcggcaaactgtgcggcgacggcggctttacgcgtcgttgccagcagtggctggagcaacatttcggcagcgcgaaggtgttgctgacgccttcctgtaccgcgtctttggagatggcggccctgttgttggatattcagcccggcgatgaagtgatcatgccgagctttacgtttgtctccactgctaacgcttttgtcctgcgcggcgcgaaaattgtgtttgtcgatattcgtccggatacgatgaatattgacgaaacgctgattgaggcggcgattactgataaaacccgcgctatcgtgccggtacactacgctggcgtcgcttgtgaaatggacgtcatcatggcgctggcggataagtataatctgttcgttgtcgaggacgccgcccagggcgtaatgtccacgtacaaagggcgcgcgttagggacgatcggtcacatcggctgttttagcttccatgaaaccaaaaattacaccgctggcggcgaaggcggcgcgacgctgatcaacgatcgtacgctgattgaacgcgcggagatcatccgcgaaaaaggcaccaaccgtagccagttcttccgtggtcaggtggacaaatacacctggcgggatatcggctccagttacttgatgtccgatctgcaggctgcctacctgtgggcgcaactggaggccgccgatcgtatcaatcaacagcgtctgtcgctgtggcagacttactacgatgcgttaacgccgctggcgcgcgccgggcgtattgagctgccttctattccggaaaactgcgggcataatgcccacatgttttacatcaaactgcgggatatcgccgatcgcagcgcgctgattaatttcctgaaagaggcggaaatcatggcggtattccattacattccgctacatgattgcccggcgggcgataaattcggcgagtttatcggggacgatgtctacaccacaaaagagagcgaacgtttgttgcgtctgccgctgttttataaccttgcgcccgtcgatcaacgaacggtgattactaccttgctaaattatttctcctga

SEQ ID NO: 3606 - protein, 376 aa, Salmonella enterica subsp. enterica serovar Typhi Ty2
MIPFNAPPVVGTELEYMQSAMSSGKLCGDGGFTRRCQQWLEQHFGSAKVLLTPSCTASLEMAALLLDIQPGDEVIMPSFTFVSTANAFVLRGAKIVFVDIRPDTMNIDETLIEAAITDKTRAIVPVHYAGVACEMDVIMALADKYNLFVVEDAAQGVMSTYKGRALGTIGHIGCFSFHETKNYTAGGEGGATLINDRTLIERAEIIREKGTNRSQFFRGQVDKYTWRDIGSSYLMSDLQAAYLWAQLEAADRINQQRLSLWQTYYDALTPLARAGRIELPSIPENCGHNAHMFYIKLRDIADRSALINFLKEAEIMAVFHYIPLHDCPAGDKFGEFIGDDVYTTKESERLLRLPLFYNLAPVDQRTVITTLLNYFS

SEQ ID NO: 3607 - DNA, 1110 bp, Coxiella burnetii RSA 493
  CDS (1)..(1110): transl_table=11
atgaaatttatcgacttaaatgagcaatacctgaagataaaacaagcggttgatggaaggatgcaagccgtgctggatcacggccaattcattatgggcccggaagtgaaagaattggaggcccggttggcggagtgggtaggggtccgccactgtatcacagtttctagtgggacgatggctttgttgatcgccttgatggccttaggcgtaggcccgggggatgaggtaatcacctcttcctttagtttttttgcaacggctgaaacgattgtttttttgggtgctacacccgttttcgttgatatcgaccctaaaacgtacaatatagacgtttcacgtatcgaagcagcgattactaatcgaacaaaggcgattgtgccagtgagtttgtatggccagtgtgccgatttagtggcgattaatgccattgctgaacgacatggtttaccggtgattgaagatggggctcagagcttaggtgcgacccatcatggccgccagtcttgtggcttcaccaccatcggctgcacgagcttttttccttccaagccgttaggttgctatggggacgggggggcttgttttacgaatgataacgaactggcgcaaacgatgcgtttgattcgtaaccacggccaagaaaagcgctatcatcatgttcgggtcggcttgaacgcgcggttcaatactttacaagcggctgttttgttggcaaaactggaattatttgctgatgagttagagcagcgacagcgggtggctgagtggtattctgaaattttaggggcagattttgttaccccttatattgctccgaataacatgagcgcttttgcccaatacaccctccgtgttgaacaaagagagcgcgttcaagttgctttgacggaagctggcattccaacagccattcattatccgaagtcgttgcatgaacagcctgcgatccaagcttatttgaaaaccgatgaccattacccgcaagcgcaagcagccagtcagcaagtgttgagtttaccttttcatccctatttgacaaaagagacagtaagaaacgtttgtgacgaattattaagcattgtgagctgtaagagtgtcaacggatag

SEQ ID NO: 3608 - protein, 369 aa, Coxiella burnetii RSA 493
MKFIDLNEQYLKIKQAVDGRMQAVLDHGQFIMGPEVKELEARLAEWVGVRHCITVSSGTMALLIALMALGVGPGDEVITSSFSFFATAETIVFLGATPVFVDIDPKTYNIDVSRIEAAITNRTKAIVPVSLYGQCADLVAINAIAERHGLPVIEDGAQSLGATHHGRQSCGFTTIGCTSFFPSKPLGCYGDGGACFTNDNELAQTMRLIRNHGQEKRYHHVRVGLNARFNTLQAAVLLAKLELFADELEQRQRVAEWYSEILGADFVTPYIAPNNMSAFAQYTLRVEQRERVQVALTEAGIPTAIHYPKSLHEQPAIQAYLKTDDHYPQAQAASQQVLSLPFHPYLTKETVRNVCDELLSIVSCKSVNG

SEQ ID NO: 3609 - DNA, 1155 bp, Coxiella burnetii RSA 493
  CDS (1)..(1155): transl_table=11
atgacgatgataaaacaaaaacgaaaaatccctattgcgataccttccataggcgatgaagaatggcaagcgctgaaagtgccattggactcaggatggttaacccaaggcccaaaagttgccgaatttgaacgcctttttgctgttcgacaccaagcgcaaaaggcgctagcaaccacttcgtgtaccactgcattgcatttggcgctggcagctatgggggtaggacccggtgatgaagtgattgtgcctgcatttacatggattgccacagccaatgcggtcttatattgtggggcaacgccggtatttgcggacgttgatagagacacttttaatattaacgtggaagacatctctcggaaaatcaccgataaaacgaaagcaattattcccgtgcatttatttggtgcttgtgcggatatagacgccatacgcaaagttattcccaatcaggtaatgattttggaggacgcggcgtgcgctgcaggagctgcttataaaggaaaacccgcaggtattttaggcgatatgggtgctttttcttttcatccgcgtaaatcgattactaccggcgaaggagggatgttaacgacgaacaacaccgagcttgcacatcgagctgaaattatgcgtaatcacggcgctgaaattcctgaagaagtgcggcatttgagtgataaaccttatcttctgcctgattttaaattgttaggttttaattatcgtatgacggatttacaggctgctgttggcattgtgcaattagctaaattggatgcttttattaatgaacgtgatcaatgggctaattattattacacccatttaaaagatctcacttggttgcgtgcgcagcgattattagctgattgcaaacatgcttggcaagcttgtgttttttacgtagatccggagcgcgcgccaatgcctcgcaatacattgatggaatacttaaaagaagctggtattgccacgcggccgggcactcatgctgtgcatctgttaagtttctaccaagaaaaatatggaatttattcggatgatttccctggtgcgcgtgattgtgatcacaacacgatggcgattcctcttcataatcgtatgactaaagatgattacgattacgtcattgaaactttaagaagtatttaa

SEQ ID NO: 3610 - protein, 384 aa, Coxiella burnetii RSA 493
MTMIKQKRKIPIAIPSIGDEEWQALKVPLDSGWLTQGPKVAEFERLFAVRHQAQKALATTSCTTALHLALAAMGVGPGDEVIVPAFTWIATANAVLYCGATPVFADVDRDTFNINVEDISRKITDKTKAIIPVHLFGACADIDAIRKVIPNQVMILEDAACAAGAAYKGKPAGILGDMGAFSFHPRKSITTGEGGMLTTNNTELAHRAEIMRNHGAEIPEEVRHLSDKPYLLPDFKLLGFNYRMTDLQAAVGIVQLAKLDAFINERDQWANYYYTHLKDLTWLRAQRLLADCKHAWQACVFYVDPERAPMPRNTLMEYLKEAGIATRPGTHAVHLLSFYQEKYGIYSDDFPGARDCDHNTMAIPLHNRMTKDDYDYVIETLRSI

SEQ ID NO: 3611 - DNA, 1146 bp, Nitrosomonas europaea ATCC 19718
  CDS (1)..(1146): transl_table=11
gtgaaaaatacaaatcaccgcatcccgttcaactggcctcacatgacaggcaaggagttgtactacatcgctgaagcgcacttcaatggtagcttggcaggcgatgggcctttcaccaagcgctgtcatgcatggctggaggagcggactggatgtaataagggtctgcttactcactcttgcacggcggcactcgagatggctgctttattgctggatattcagcccggtgacgaggtcatcatgccgtcgtacacctttgtatctaccgccaatgcctttgtgctacgtggtggggttcctgtgtttgtcgatatcagagaagacactctgaatttggacgaacggctgattgagtccgccattacgccgcgtacccgtgccattgctcccgtgcattacgcgggagtggcgtgcgagatggatacgattatggccatcgcccagaagcatgaattgaaggtcgttgaggatgcagcgcagggggtgatgtcaacctacaaagggcgggccctcggcagcattggtgatcttggagcctacagtttccacgaaacaaaaaatgtgatctcgggagaaggcggtgcgctactcgttaatacacctgatctgagccttcgtgcagagatcatccgcgaaaaagggaccgatcgcagtcagttcttcaggggcgaagtggacaagtacacctggcaggaggtgggctcgtcattcttaccgggtgagctgatcgctgccttcctgtgggcgcagcttgaagaagcagaccgtataactaacgagcggctggcaagctggcaacgatatcatgagttgcttgggccacttgaagctaaagagattctgcgtcgtccaatcgttccggaagagtgtcagcataatgcccacatgtattatgtattattggcatcaaaaattgataggcaagaagtacttgacgaatttaagagaaacgatatttggtctgtgttccattatgtgccccttcattcctccccggctggtttacggtacggacgtatacatggcaacctgaaaattactactcaacaatctgagagattggttcggttacccctctgggttggtttatcagtagagcagcaagaccgggtcgttgaggttttgtgtaaagctgttagctga

SEQ ID NO: 3612 - protein, 381 aa, Nitrosomonas europaea ATCC 19718
MKNTNHRIPFNWPHMTGKELYYIAEAHFNGSLAGDGPFTKRCHAWLEERTGCNKGLLTHSCTAALEMAALLLDIQPGDEVIMPSYTFVSTANAFVLRGGVPVFVDIREDTLNLDERLIESAITPRTRAIAPVHYAGVACEMDTIMAIAQKHELKVVEDAAQGVMSTYKGRALGSIGDLGAYSFHETKNVISGEGGALLVNTPDLSLRAEIIREKGTDRSQFFRGEVDKYTWQEVGSSFLPGELIAAFLWAQLEEADRITNERLASWQRYHELLGPLEAKEILRRPIVPEECQHNAHMYYVLLASKIDRQEVLDEFKRNDIWSVFHYVPLHSSPAGLRYGRIHGNLKITTQQSERLVRLPLWVGLSVEQQDRVVEVLCKAVS

SEQ ID NO: 3613 - DNA, 1149 bp, Mycobacterium bovis AF2122/97
  CDS (1)..(1149): transl_table=11
gtgtcagatcacaaagttccattcaatcggccgtacatgaccggccgggagctcgcgtacatcgccgaagcgcattcttgcggccacctggccggcgatggtcccttcacccggcgtagccatgcatggctcgaacagcagaccggttgtcgcaaggcactactcaccccctcatgcaccgccgcgctggaaatgatggcgctgcttctggacatagaggagggggacgaagtcatactgccgtcatacacctttgtctctaccgccaacgccttcgtgttgcgcggtggtgtgccagtctttgtcgatattcggcccgacacgctcaacattgatgaaactcgcatcgtagacgccatcaccccgcgaaccaaggccatcgtccccgttcactatgccggcgtggcctgcgagatggacgcgatcatgaagatcgccacgcaccacaacctggcggtggtcgaagacgcggcccaaggcgcgatggcgtcgtatcgtgggcgggcgctcggcagcatcggcgacctgggagcgctctcatttcacgagaccaagaatgtgatttccggcgaaggcggcgccctgcttgtcaactcagaagacttcctgctccgggcagagattctcagggaaaagggcaccaatcgcagccgcttccttcgcaacgaggtcgacaaatatacgtggcaggacaaagggtcttcctatttgcccagcgaattagtcgctgcctttctatgggctcagttcgaggaagccgagcggatcacgcgtatccgattggacctatggaaccggtatcatgaaagcttcgaatcattggaacagcgggggctcctgcgccgtccgatcatcccacagggctgctctcacaacgcccacatgtactacgtgttactagcgcccagcgccgatcgggaggaggtgctggcgcgtctgacgagcaaaggtataggcgcggtctttcattacgtgccgcttcacgattcgccggccgggcgtcgctacggccgcaccaatggcaacctgaccgtcaccaacgacgtggcttcccgcctaatccgtctgccgatgtgggttggacttcaggaggtagatcagagccgcgttgtcgaggcgctcacgcgcatcctgacgttgcgcgcatga

SEQ ID NO: 3614 - protein, 382 aa, Mycobacterium bovis AF2122/97
MSDHKVPFNRPYMTGRELAYIAEAHSCGHLAGDGPFTRRSHAWLEQQTGCRKALLTPSCTAALEMMALLLDIEEGDEVILPSYTFVSTANAFVLRGGVPVFVDIRPDTLNIDETRIVDAITPRTKAIVPVHYAGVACEMDAIMKIATHHNLAVVEDAAQGAMASYRGRALGSIGDLGALSFHETKNVISGEGGALLVNSEDFLLRAEILREKGTNRSRFLRNEVDKYTWQDKGSSYLPSELVAAFLWAQFEEAERITRIRLDLWNRYHESFESLEQRGLLRRPIIPQGCSHNAHMYYVLLAPSADREEVLARLTSKGIGAVFHYVPLHDSPAGRRYGRTNGNLTVTNDVASRLIRLPMWVGLQEVDQSRVVEALTRILTLRA

SEQ ID NO: 3615 - DNA, 1149 bp, Wigglesworthia glossinidia endosymbiont of Glossina brevipalpis
  CDS (1)..(1149): transl_table=11
atgaaaaaaaaaaataaaattattccttttaatttacctgtttattcaggaaaagaattaaaatatatagattttgcaataagaaataaaaccttttcaggagaagggtatttttcaaatttatgcacgttatggatagaaaataaattaaatattaaaaaagtttttttgacaccttcttgtacttcctctttagaaatggctgctttattattaaaaataaataaagacgacgaaattatcatgccaagttatacttttgtgtcaactgctaatccttttgtattacgtggagcaaaaatagtattcgttgacattagatcggataatttaaatattaatgaaaatttaattgaatctgcaatcacaaaaaagacaaaagcaatagtagttatgcactatgctggaatttcttgtgaaatggattttataaaaaatatttctaataagtataaattatggctaatagaagatagtgctcaaagtatgatgtctaaatataaaaatttatatttaggaagcttaggtcatataggatgttttagttttcatgaaacaaaaaattatacctctggaggagagggaggagcaattcttataaatgatgagtctttaatcaaaagagcaagcataattaaagaaaaaggaacaaatcgttccctttttattaaaggaaaaacaaataaatatgtttggaaagacataggatctagttatactatatcagatattcaagcagcatatttatggtctcagttaaaaatatcagaaaagattcaaaaaaaaagagaaatgttgtggaaaaattattttttgtctttagaaaatataaaattgttcaggataccgtttttcaacaaaaattgcaagcataatgcaaatacattttatttaatttttaatgataaaaaaacttgtaatttgtttattgaatacatgaaaaataataaaattacaactttaagacactatgttcctttgcacattagtccagcaggaaaaaaatttggaaaatttcatggaaatgatataaatactattaaaacaagtaataatcttgttcgtcttccattattttttaatttaaaaaataaagaccaaaaatatattataagtaatatttataatttcatagataaatattcttaa

SEQ ID NO: 3616 - protein, 382 aa, Wigglesworthia glossinidia endosymbiont of Glossina brevipalpis
MKKKNKIIPFNLPVYSGKELKYIDFAIRNKTFSGEGYFSNLCTLWIENKLNIKKVFLTPSCTSSLEMAALLLKINKDDEIIMPSYTFVSTANPFVLRGAKIVFVDIRSDNLNINENLIESAITKKTKAIVVMHYAGISCEMDFIKNISNKYKLWLIEDSAQSMMSKYKNLYLGSLGHIGCFSFHETKNYTSGGEGGAILINDESLIKRASIIKEKGTNRSLFIKGKTNKYVWKDIGSSYTISDIQAAYLWSQLKISEKIQKKREMLWKNYFLSLENIKLFRIPFFNKNCKHNANTFYLIFNDKKTCNLFIEYMKNNKITTLRHYVPLHISPAGKKFGKFHGNDINTIKTSNNLVRLPLFFNLKNKDQKYIISNIYNFIDKYS

SEQ ID NO: 3617 - DNA, 1131 bp, Haemophilus ducreyi 35000HP
  CDS (1)..(1131): transl_table=11
atgattccttttaataaaccaccattggtgggcaatgaattagcctatattcaacaggcgttacagcaagataaattatcaggtgatggttattataaccagcaagcggaacaatggttagaaaagcaattttcgacagtgaaagcgttattaacaccatcttgtactgccgcattagaaatggcggcgattctgttagatattcaagctggcgatgaagtgattatgcctagctatacttttgtgtcgactgcaaatgcatttgtgttgcgtggcgctaaaattgtgtttgttgatattcgcccggatactatgaatattgatgaacagaaaattgaagcgacaattacggatagaactaaagtgattgttccagtgcattacgcgggcgtagcttgtgagatggatacaattatggcattagcggctaaatatcagctatatgtggttgaagatgctgcacaggcaatgatagcaagctataaaaatcgcccattaggcacgattggacatttggggtgttatagttttcacgaaactaaaaattatagttcggcaggtgaaggtggagcgctgttaattaatgatgcgacattagttagtcgcgcagaaattattcgcgagaaaggcactgatcgaagtcagttttttcgaggacaagttgataaatatacgtggcgagatattggatcaagttatctcatgtcggagttacaagcggcttatttatatgcacaatttacggtggcagaacagattaatcaaacacgtttagcaatgtggcaacgttattatcaagcgttattgccttttgctaatagcgggcggatagcattagcccaattaccgcccgaatgccaacataatgcgcatttattttatttaaaattaacagattcagccgatcggaacgcgttattaacttggcttaaacaacacgatattttagcggtgtttcattatattccattgcattccagcccagcaggtaaacaatttgggcgctttgtcggtgaagatcaatttacaacacaagaaagtgagcgcttgctaaggttacccttgttttataatttgcatctaacagagcaacaacgtgtgattgaggttgtgacggattattttcagtaa

SEQ ID NO: 3618 - protein, 376 aa, Haemophilus ducreyi 35000HP
MIPFNKPPLVGNELAYIQQALQQDKLSGDGYYNQQAEQWLEKQFSTVKALLTPSCTAALEMAAILLDIQAGDEVIMPSYTFVSTANAFVLRGAKIVFVDIRPDTMNIDEQKIEATITDRTKVIVPVHYAGVACEMDTIMALAAKYQLYVVEDAAQAMIASYKNRPLGTIGHLGCYSFHETKNYSSAGEGGALLINDATLVSRAEIIREKGTDRSQFFRGQVDKYTWRDIGSSYLMSELQAAYLYAQFTVAEQINQTRLAMWQRYYQALLPFANSGRIALAQLPPECQHNAHLFYLKLTDSADRNALLTWLKQHDILAVFHYIPLHSSPAGKQFGRFVGEDQFTTQESERLLRLPLFYNLHLTEQQRVIEVVTDYFQ

SEQ ID NO: 3619 - DNA, 1188 bp, Prochlorococcus marinus subsp. marinus str. CCMP1375
  CDS (1)..(1188): transl_table=11
atgcaagtccccccttttactcttgaaaaacaactgtctgaaatagggcaggatctggatgaagctgtttcgagggttgttaagagtggaatttatataggaggttcagaagtacttaaatttgaacaatctttcgcagatgctgttggggttagctttgccattggttgcaatagtggaacagatgcattggtgcttgctttacgagcattgaatattggaccaatggatgaagtaattactccctcttttagtttttttgctacagctgaggcaataagtaatgttggtgctacacctgtgtttgtggatgttgatccaactaattatttattagatattgaattaattgaagcagctataacccctttgacaaaagccattttgcctgtgcatctttttggctgtcctgtaaatatgacgaaaatagtctctttggctaagaaaaatgggataaaagtgattgaagattgcgcacaagctgttgggactcaatgggatgggaagccagtgggaagtattggcgatataggctgttttagctttttccctacaaagaacttaggggcagctggagacgctggtgctgtaactactaatgatcctgagttggcagaacgtattagagaacttgctatacatggaatgccgcgtagatattttcatactgaactgggatataacagtcgattggatgcagttcaagcagccattctaaatgtgaagttgccgatacttgataaatggataacccaaaggaaagaaattgctaaacgttatataaacttattaaaggggttgtctgacttagctttgccaagcttttgcgaaaaaaataatgacattcattcatggaatcaatttgtaattagagttaaagactgctctaaagaagaaaaagttaagggaataaaaaaaatagaaaatatctgcaaagacttacctgaaagtgatgctagagataccctgaaggatcgacttctacatgatggcgttaatacaataatctattatccaatccctatacatttgcaacctgcatataaaaaacttggttacaaagtaaataatttgccaaatacagaaagcctttgtagccaagttcttagtcttcctattttccctgagttgacattagaagagcaagaatatgtcgtaaattcaattaagaagtctttgaaagattga

SEQ ID NO: 3620 - protein, 395 aa, Prochlorococcus marinus subsp. marinus str. CCMP1375
MQVPPFTLEKQLSEIGQDLDEAVSRVVKSGIYIGGSEVLKFEQSFADAVGVSFAIGCNSGTDALVLALRALNIGPMDEVITPSFSFFATAEAISNVGATPVFVDVDPTNYLLDIELIEAAITPLTKAILPVHLFGCPVNMTKIVSLAKKNGIKVIEDCAQAVGTQWDGKPVGSIGDIGCFSFFPTKNLGAAGDAGAVTTNDPELAERIRELAIHGMPRRYFHTELGYNSRLDAVQAAILNVKLPILDKWITQRKEIAKRYINLLKGLSDLALPSFCEKNNDIHSWNQFVIRVKDCSKEEKVKGIKKIENICKDLPESDARDTLKDRLLHDGVNTIIYYPIPIHLQPAYKKLGYKVNNLPNTESLCSQVLSLPIFPELTLEEQEYVVNSIKKSLKD

SEQ ID NO: 3621 - DNA, 1101 bp, Bordetella bronchiseptica RB50
  CDS (1)..(1101): transl_table=11
atgcaattcattgacctgaaaacccaataccaagcgctgcgcgacaccatcaacccgcgcatccaggccgtgctggaccacggccagttcatcatgggcccggaagtcaaggaactggaggccgccctgtgcgcctacaccggcgccaagcactgcatcaccgtggcctcgggcaccgaggcgctgctgatctcgctgatggcgctgggcgtgaaggccggcgacgaagtcatcaccacctcgttcaccttcgtggccaccgctgaagtcatcgcgctgctgggcgccaagcccgtgttcgtcgacgtcgaaccggatacctgcaacatcaaggtgtccgagatcgaagcgaagatcaccccgcgcaccaaggccatcatcccggtgtcgctgtacggccaatgcggcgacatggacgaagtcaacgccgtcgcggccaggcacggcctgccggtcatcgaagacgccgcgcagagcttcggcgccacctacaagggccgcaagagctgcaacctgtcgaccatcggctgcaccagcttcttcccgagcaagccgctgggctgctacggcgacggcggcgcgctgttcaccaacgacgacgagctggcgcaagccatgcgcgaaatccgcgtgcacggccaatcgggccgctactaccacacccgcatcggcgtgggcggccgcatggacacgctgcaatgcgccgtggtgctgggcaagctggagcgtttcgattgggaaatcgcccaacgcatcaagatcggcgcgcgctaccagcaactgctggccgatttgcccggcggcgcatgtaccgtaaccgtgcgccccgaccgcgacagcgtctgggcccagttcaccgtcatggtgcccaaccgcgaagccgtcatcgcccagctgaaggaggccggcattcccaccgccgtgcactatccgcgccccatccacgcgcagccggcctatgagcaatacgccgagggcgccggcgccacgccggtttccgacgacctggccgcgcgcgtcatgagcctgccgatgcacccggatctggacgaagccacccaggacaagatcgtcgccgcgttgcgccaggccctgaactga

SEQ ID NO: 3622 - protein, 366 aa, Bordetella bronchiseptica RB50
MQFIDLKTQYQALRDTINPRIQAVLDHGQFIMGPEVKELEAALCAYTGAKHCITVASGTEALLISLMALGVKAGDEVITTSFTFVATAEVIALLGAKPVFVDVEPDTCNIKVSEIEAKITPRTKAIIPVSLYGQCGDMDEVNAVAARHGLPVIEDAAQSFGATYKGRKSCNLSTIGCTSFFPSKPLGCYGDGGALFTNDDELAQAMREIRVHGQSGRYYHTRIGVGGRMDTLQCAVVLGKLERFDWEIAQRIKIGARYQQLLADLPGGACTVTVRPDRDSVWAQFTVMVPNREAVIAQLKEAGIPTAVHYPRPIHAQPAYEQYAEGAGATPVSDDLAARVMSLPMHPDLDEATQDKIVAALRQALN

SEQ ID NO: 3623 - DNA, 1227 bp, Prochlorococcus marinus str. MIT 9313
  CDS (1)..(1227): transl_table=11
atgcaggtgcccccttttagccttactcaacagctagccgaactggggcctgaccttgatgaggcggtcttgcgcgtgctgcgcagtggccaatacatcggcggcaccgaaattgaatcttttgaacaagcctttgctaactcccttggcgtgccttttgtcgttggttgcaacagcggcaccgatgctttggtcctggccctgagggcactggatatcggagcaggagatgaggtgatcagctgttctttcagcttttttgccactgccgaggcaatcagttcggtaggcgccacacctgtcttcgtggacgtcgaagcggacacttatctcatcaacctggaacaaatcgaagcagcaataaccccagacacccgtgctcttttaccagttcaccttttcggccgccccgtcaacatggagcagctgatggccatcgccaacaaacatgggctgaaagtgatcgaagattgtgcccaagccagtggtgcagcgtggaacggacggtccgtaggcagttggggcgatgtgggctgcttcagcttctttcccaccaaaaaccttggcggcgctggcgatggtggagccgtcagcacacatgacgcaaagcttgctcagcgaatgcgagaactcgctgttcacggaatgccgcgtcgatatttgcatacagaacttggctacaacagccgactggatgccctgcaagccgccgttttaaacgtgaaactaccaaggctttcttgctgggttgaaaagcgacaagccatcgcgacccgttatcaaacgttgctcacaaaccttccttgcctcgagcttccagatcaaacaaaagcaagccatctgcaacatgcatggaaccaattcgtggtgcgggtaacgagctgcccaatgaaccaaagcaactctgagagccttggcaaaccgtcaaaaaacaatggcagcaataccctgccggatagcagttgccgtgattggctcaaacaaagtcttttagaacatggcattaacaccatcatttactacccaatcccgatccatctccaaccggcctatgaaggcctaagccaaggcccaggcagcctgccggtcactgaacagctttgcagtcaagtgctgagcttgccgatcttcccagaattgcgcgaagagcagcagcaacaggttgtctctatgttgcagaagctgctgagtccagcaaccacaactcacatgagcaaggttgcttaa

SEQ ID NO: 3624 - protein, 408 aa, Prochlorococcus marinus str. MIT 9313
MQVPPFSLTQQLAELGPDLDEAVLRVLRSGQYIGGTEIESFEQAFANSLGVPFVVGCNSGTDALVLALRALDIGAGDEVISCSFSFFATAEAISSVGATPVFVDVEADTYLINLEQIEAAITPDTRALLPVHLFGRPVNMEQLMAIANKHGLKVIEDCAQASGAAWNGRSVGSWGDVGCFSFFPTKNLGGAGDGGAVSTHDAKLAQRMRELAVHGMPRRYLHTELGYNSRLDALQAAVLNVKLPRLSCWVEKRQAIATRYQTLLTNLPCLELPDQTKASHLQHAWNQFVVRVTSCPMNQSNSESLGKPSKNNGSNTLPDSSCRDWLKQSLLEHGINTIIYYPIPIHLQPAYEGLSQGPGSLPVTEQLCSQVLSLPIFPELREEQQQQVVSMLQKLLSPATTTHMSKVA

SEQ ID NO: 3625 - DNA, 1125 bp, Chromobacterium violaceum ATCC 12472
  CDS (1)..(1125): transl_table=11
atggattttctgccgtttacccgtccgtccatcgacgaggacaccatcgccgccgtcggcgaagtgctgcgctccggctggatcaccaccggcccgcgctgccagcagctggaggccgaattgtccgccttctgcggcggccgcccggtccgcttggtctcctccgccaccgccgcgctggagatggcgctgcagatcgccggcgtcggtcccggcgacgaagtgatcacctgcccgctgagctggatcgccaccgccaacgtcatcatgaaggtgggcgcgacgccggtgttcgtcgacgccgatccggccacccgcaacatcgacctggacaagatcgaagccgcgatcacgccgcgcacccgcgccatcattccggtggacctggccggcctgccggtggaccgcgaccgactgtacgacatcgcgggccgccaccggctgcgcgtggtcgaggatgccgcccaatccatgggcgccagttggaacggccagtccatcggcagcttcggcgacctggtgtcgttcagcttccacgccaacaagaacatgaccagcggcgaaggcggctgcctggtgctgaacgacgcggaagaggccaggctgttcgagaaactgcgcctgcaaggcgtcacccgcttcccggacggcaccatggatgtagacgtgctgggcggcaaggccaacctcaccgacatcgccgccgccatcggcctgggccagttgaagcggctggacggcttcaacgcccgccgccgcgagctggcccggctgtacttccagcatttcgagcgcgcgctcggctgcgaactgccgccggccgacttccagcacggcaactggcacatgttccagccgctgctgccgctggaccgcatgcgcgtcacccgcggcgaattcatcgcccggatgaaggcggagaacatcggcgtcggcatccactatccggccatgcacctgttcacgctgttccgcgacaaaggctacgccgaaggccgcttcccggtggccgaggacatcggcgcgcgcaccgtcaccctgccgctgttccccggcatgcgcgacgaggacgtgctccgcgtctgccaaaccttcagcgccgtcctgcgcgccgttttacactga

SEQ ID NO: 3626 - protein, 374 aa, Chromobacterium violaceum ATCC 12472
MDFLPFTRPSIDEDTIAAVGEVLRSGWITTGPRCQQLEAELSAFCGGRPVRLVSSATAALEMALQIAGVGPGDEVITCPLSWIATANVIMKVGATPVFVDADPATRNIDLDKIEAAITPRTRAIIPVDLAGLPVDRDRLYDIAGRHRLRVVEDAAQSMGASWNGQSIGSFGDLVSFSFHANKNMTSGEGGCLVLNDAEEARLFEKLRLQGVTRFPDGTMDVDVLGGKANLTDIAAAIGLGQLKRLDGFNARRRELARLYFQHFERALGCELPPADFQHGNWHMFQPLLPLDRMRVTRGEFIARMKAENIGVGIHYPAMHLFTLFRDKGYAEGRFPVAEDIGARTVTLPLFPGMRDEDVLRVCQTFSAVLRAVLH

SEQ ID NO: 3627 - DNA, 1215 bp, Chromobacterium violaceum ATCC 12472
  CDS (1)..(1215): transl_table=11
atggacatggaggcggccgagcgcggccgcgcaaagacgagagaccgagaaatgagcgaaacaaagttcctgccgttcgccttgccggatatcggcgaggaagagatcaacgaagtggtcgatgctttgaggtcgggctgggtgaccaccggtcccaagaccaagcagttcgaggccgatttcgccgccttcctcggcggcgaggtcgaggcgatcgcggtcaactccgccaccgccggcctgcatttggcgctggaggcgatcggcatccgtgagggggacgaagtgatcgtgccgtcctacaccttcaccgccaccgccgaggtggtgcgctatctgggcgcgcacccggtgtgcgtggacgtggacggcgccaccttcaacatccgcccggatgcgatccgcgccgcgatcactgataagacccgcgccatcatcccggtgcatttcgccggcctggcctgcgacatggacgagatcatcgccatcgcccgcgagcatgggctgaagatcgtcgaggacgccgcccacgccatgcccacctactacaagggcaagctggtgggcacgctggattcagacgtcaccgtgttcagcttctacgccaacaagaccatgaccaccggcgagggcggcatggtggtgtccaggaacaaggacatcatcgcccgctgcaaggtgatgcgcctgcatggcatcagccgcgacgccttcgaccgctacgtgtccaagaccccggcctggttctacgaagtggtcgcgcctggctacaagtacaatatgccggacaccgccgcggcgatgggcatccaccagttgaagaagatccgtggcttctatgaaaagcgcgaagtcatggcccagcgcttcgaccgcgagctggccgatctgccgctgatcctgccggcgcgcgccaaggacgagggcagcaaccacgcctggcacctgtacccggtgcggatcaagccggaagccggcatcagccgcgacgacttcatcgccaggatggcggaaaagggcatcggctgctcggtgcatttcatcccgctgcaccgccagccggtatggcgcgacggctaccagctggcgcgcgagcaattcccggtggccgacgccgctttcgaggccgaagtgacgctgccgctctacacccggatgacggacgacgaccagacccgcgtcatcgccgcggtgcgcgagattctgggcgcatga

SEQ ID NO: 3628 - protein, 404 aa, Chromobacterium violaceum ATCC 12472
MDMEAAERGRAKTRDREMSETKFLPFALPDIGEEEINEVVDALRSGWVTTGPKTKQFEADFAAFLGGEVEAIAVNSATAGLHLALEAIGIREGDEVIVPSYTFTATAEVVRYLGAHPVCVDVDGATFNIRPDAIRAAITDKTRAIIPVHFAGLACDMDEIIAIAREHGLKIVEDAAHAMPTYYKGKLVGTLDSDVTVFSFYANKTMTTGEGGMVVSRNKDIIARCKVMRLHGISRDAFDRYVSKTPAWFYEVVAPGYKYNMPDTAAAMGIHQLKKIRGFYEKREVMAQRFDRELADLPLILPARAKDEGSNHAWHLYPVRIKPEAGISRDDFIARMAEKGIGCSVHFIPLHRQPVWRDGYQLAREQFPVADAAFEAEVTLPLYTRMTDDDQTRVIAAVREILGA

SEQ ID NO: 3629 - DNA, 1089 bp, Wolinella succinogenes DSM 1740
  CDS (1)..(1089): transl_table=11
atgaaaatagactttgccaatttagctctgcagcaccagctctacaaagaggagatcgaatcggccatccatgaggtgatctcaaagtgcaatttcatcatgggagaggaggtcgaactcctagagagggagctagaagccttcacgggtgcaaagcatgccatcacctgcgctagcggaacagatgccctccttttggctctcatggccttaggaatcaaagcaggagatgaggtgattaccactcccttcaccttcattgccaccgcagagatgattgctcttttaggagccaagcctctgtttgtggatattgaagaggagagctacaatcttgatgtcactcaattagagaagaagatcacccctaagaccaaagcgattcttcctgtccatctctatggtcagccaagcgacttaaaagagatcatggaggtcgctaaagcgcatgatcttagggtggttattgatggagcccaaagctttgggagcacctatgagggggtgagcgatagtgctttgggagatatctcctgcacgagctttttccccgccaaaccccttggatgttatggagatgggggggcgctcttcacctccaatgaagagcttgccgccaaaatcaagagcctaagaatccatggtcaaacccaaaggtatcatcaccaatatattggaattggggggaggctagatacgattcaagccgccgtgctaagggtgaaattgcgtcactactctaaagatcttgcccaaagggtggaggtggccaaacgctactctttggctctctcttctaaagagggaatcatcctcccccaaattaagccaaatcgcacctcagcctttgcccaatactccataagggttaaagagcgccctagagtgcaggctagactcaaggaggcgggagtccccacggcagtgcactatcctatgcccttgcatcttcaagggtgctttgcctatttggggcatcaaaagggggatttccctgtggcggagcaagtgagtgaggagatattgagtctgcccatgaatccctatgtgagcgaggaagagatggagtatataggggggtgtttttag

SEQ ID NO: 3630 - protein, 362 aa, Wolinella succinogenes DSM 1740
MKIDFANLALQHQLYKEEIESAIHEVISKCNFIMGEEVELLERELEAFTGAKHAITCASGTDALLLALMALGIKAGDEVITTPFTFIATAEMIALLGAKPLFVDIEEESYNLDVTQLEKKITPKTKAILPVHLYGQPSDLKEIMEVAKAHDLRVVIDGAQSFGSTYEGVSDSALGDISCTSFFPAKPLGCYGDGGALFTSNEELAAKIKSLRIHGQTQRYHHQYIGIGGRLDTIQAAVLRVKLRHYSKDLAQRVEVAKRYSLALSSKEGIILPQIKPNRTSAFAQYSIRVKERPRVQARLKEAGVPTAVHYPMPLHLQGCFAYLGHQKGDFPVAEQVSEEILSLPMNPYVSEEEMEYIGGCF

SEQ ID NO: 3631 - DNA, 1131 bp, Photorhabdus luminescens subsp. laumondii TTO1
  CDS (1)..(1131): transl_table=11
atgattccatttaacaaaccaccagtagttggcactgaattagattacatgaagcaagccatggaaagcggtaagctttgcggggatggtggtttcaccaagcgttgtgaagagtggatggaacaacatttcaattgcccgaaagttctattgacaccatcctgtaccgctgcactggaaatggcggctattttgctgaatatccaacccggtgatgaagttattatgccgagtttcactttcgtttccagttctaacgcgtttgtactgcgtggagcaactgttgtatttgtggatatccgtccagataccatgaatattgatgaaaccaaaatcgaagcagcaattacagctaaaacacgcgtgattgttccagtgcattatgccggtgtagcctgtgaaatggataccattatggccttggcagagaaatataatctgtttgtcgtggaagatgctgcacagggagtaatgtctacttataaagggcgtgcattgggaactatcggacacattggttgctacagtttccacgaaaccaaaaactactcctctggtggtgaaggtggtgcagcacttatcaatgatcaatcattgatttctcgtgcggaaattgtccgtgaaaaagggactaatcgtagtcagtttttccgtggtcaagttgataaatatacttggcgcgatatcggttcgagttatcttatgtcggaacttcaggctgcttatttgtgggcacaattggaagaggctgagaaaatcaatgagcgtcgtcttgccttgtggaatacctattatcaagcattaaaaccgctggttgatgctggtctcctgacattgccggtcataccggaagagctggagcataatgctcacatgttctatatcaagctgaaagatgttgaagaacgctcagcattcaatagctatatgaaggacgcaggtgtactaacagtattccattatgtttctctgcacaccagccccggtggtgaaaaatttggccgttttcatggggaagattgttttactacttgtgaaagtgatcgtctagtgcgcttgccgatgttttacaacataacagacgctgaacagcagattgtcatcaaacatattcgggaatacttcgcctga

SEQ ID NO: 3632 - protein, 376 aa, Photorhabdus luminescens subsp. laumondii TTO1
MIPFNKPPVVGTELDYMKQAMESGKLCGDGGFTKRCEEWMEQHFNCPKVLLTPSCTAALEMAAILLNIQPGDEVIMPSFTFVSSSNAFVLRGATVVFVDIRPDTMNIDETKIEAAITAKTRVIVPVHYAGVACEMDTIMALAEKYNLFVVEDAAQGVMSTYKGRALGTIGHIGCYSFHETKNYSSGGEGGAALINDQSLISRAEIVREKGTNRSQFFRGQVDKYTWRDIGSSYLMSELQAAYLWAQLEEAEKINERRLALWNTYYQALKPLVDAGLLTLPVIPEELEHNAHMFYIKLKDVEERSAFNSYMKDAGVLTVFHYVSLHTSPGGEKFGRFHGEDCFTTCESDRLVRLPMFYNITDAEQQIVIKHIREYFA

SEQ ID NO: 3633 - DNA, 1071 bp, Photorhabdus luminescens subsp. laumondii TTO1
  CDS (1)..(1071): transl_table=11
atgcaatttaccgatctggcagcacagcaacttaaaattaaagataaaattgacgcgaatatccagaaagtcctcgcacatggaaaatatattttagggcctgaagtcgacgaattagaagcaaagctgattgcctacaccggcgcgccatattgcattacctgcgccaatggcaccgatgccttgcaaattgccttaatggcgattggcattaaacccggcgacgaagtgattaccgccggctttacctacattgccaccgctgaaaccgttgcgctactgggcggggttccagtttatgttgacgtcaaacccaccacgtataacttagatccaacgcaactcgaagcggcgattaccccaaaaaccaaagcgatcattccggtttccttatttggtcaatgtgccgattttgacgaaattaatgccatcgcagcaaaacataacctgatcgtaatagaagacgcggcccaaagttttggcgcgacttataaaggcaaacgttcctgtaacttaacgaccatctcatgtaccagtttcttccctagcaaaccgttgggatgttacggcgatggcggcgctattttcacccgtgatgaagaactggcgaaaattattcgtcaaattgcccgtcatggacaagaccgacgataccaccatatccggatcggaattaatagccgcttagataccctgcaagcagctatcctgttacccaaactggagatattcgatgaagaaatggcattacgtcagcaggtggcagaaaactacaataacgcattgaacggcatcggtatcacgaccacgccctatattgagccacacaatctttcggcctatgcgcaatatactctccgcattaaaaaccgtgatgaattacaacgcagattaaaagaacagggtattcccaccgccattcattacccgatcccgctaaataaacaacccgcggtggccagcaatattgctctgcctataggagacgaaatcgcacaagaagtcattagcttgccgatgcatccttatttatccatagatataattaataaaattgccagttcaatttaa

SEQ ID NO: 3634 - protein, 356 aa, Photorhabdus luminescens subsp. laumondii TTO1
MQFTDLAAQQLKIKDKIDANIQKVLAHGKYILGPEVDELEAKLIAYTGAPYCITCANGTDALQIALMAIGIKPGDEVITAGFTYIATAETVALLGGVPVYVDVKPTTYNLDPTQLEAAITPKTKAIIPVSLFGQCADFDEINAIAAKHNLIVIEDAAQSFGATYKGKRSCNLTTISCTSFFPSKPLGCYGDGGAIFTRDEELAKIIRQIARHGQDRRYHHIRIGINSRLDTLQAAILLPKLEIFDEEMALRQQVAENYNNALNGIGITTTPYIEPHNLSAYAQYTLRIKNRDELQRRLKEQGIPTAIHYPIPLNKQPAVASNIALPIGDEIAQEVISLPMHPYLSIDIINKIASSI

SEQ ID NO: 3635 - DNA, 1158 bp, Photorhabdus luminescens subsp. laumondii TTO1
  CDS (1)..(1158): transl_table=11
atgaactcttcttttctccctttcgcactcccagaaatcagccaagaagaaattgatgaagtcattgactcacttaaaacaggctggataaccaccggacctaaaaccagaagatttgaacaagattttgcgcaatatttaggttccgatgttgaagccatagcggtaaattcagccacggcagggttgcatttagcattagaagccattggtattcagccgggtgatgaagtcatcgttccgacctatacctttacggcaaccgcagaagttgtccgttatttgggagctcaccctatttttgttgattctttacctgacagcctgaatattgacccaatagcaatagaaaaagccataaccgccaaaactaaagcaattatgccggtacactttgcaggtttatcctgtgatatggatgccattattgcaatagctaaaaaattcaatctacgaatcattgaagatgccgcccattcatttccgactttatataagggaaagaaaattggcacgctagataccgatgtcaccgtattcagcttttacgcgaataaaaccatgacgacagcggaaggtggcatgctagtctccagacatccagatatcataaaaagagcaaaaataatgcgcctccacggcattagcaaagacgcctttgatcgatatcaatctaaaatacctgcctggtattatgaagtgattgaaccaggctataaatataacatgcccgatatttgtgcatctatcggcatccatcaattacagaaaatagacactttccacaagaaaagagaggcaatggctaaactctatgatgatgaattaaaagatctaccgattatcttacccactaaacctcaagaatctaatagccaacacgcctggcatctatataccattagattaaatgatcaagtcaaaatatccagagatgactttattataaaaatggcagaaaaaaatatcggctgctctgtccattttattccactacacaaacaacccatctggaaaaatacctattctcttaacgaaaacaacttcccagtcgcagaagaaaactttaaaagaattgtatccatccctttatatacaaaaatgaccaaagaagaccaaatatacgttatcaaaacaattaaagagatcttggcataa

SEQ ID NO: 3636 - protein, 385 aa, Photorhabdus luminescens subsp. laumondii TTO1
MNSSFLPFALPEISQEEIDEVIDSLKTGWITTGPKTRRFEQDFAQYLGSDVEAIAVNSATAGLHLALEAIGIQPGDEVIVPTYTFTATAEVVRYLGAHPIFVDSLPDSLNIDPIAIEKAITAKTKAIMPVHFAGLSCDMDAIIAIAKKFNLRIIEDAAHSFPTLYKGKKIGTLDTDVTVFSFYANKTMTTAEGGMLVSRHPDIIKRAKIMRLHGISKDAFDRYQSKIPAWYYEVIEPGYKYNMPDICASIGIHQLQKIDTFHKKREAMAKLYDDELKDLPIILPTKPQESNSQHAWHLYTIRLNDQVKISRDDFIIKMAEKNIGCSVHFIPLHKQPIWKNTYSLNENNFPVAEENFKRIVSIPLYTKMTKEDQIYVIKTIKEILA

SEQ ID NO: 3637 - DNA, 1152 bp, Vibrio vulnificus YJ016
  CDS (1)..(1152): transl_table=11
atgtttgagacaaattatatgattccattcaataaacctccagttactggtgaagaacttcaatttattcaggaagctatttcttgtgggaagctttcgggagatggagaattctcaagaaagtgcgaaaattggtttgtatcacatactggtacgactaaagctcttcttactccttcatgtactcatgcgctagaaatggctgcgatgctcatcgatatccagcctggtgatgaagtaataatgccaagttatacattcgttagtacagccaacgcttttgtattaagaggggccaaagtagtatttgtggacattcgagctgatacgatgaatatcgacgaatccaagatagaggtagctatcaccgagcgcactaaggcgatcgtgcccgtacattatgcaggggtggcttgtgatatggacactataatgggtttatctgacaaatatggtttgtatgttattgaagatgcagcccaagggatgatgtcaacttataaaggtcgagcgttaggtagtattggtcatatagggacctatagttttcatgaaaccaaaaattatacgagtggtggtgaaggtggtttactgttggttaatgatcagagtttttctcaacgagcagaaataattagagaaaaaggcactaatcgcaatcagttttttagaggtatggttgataaatatacatgggtagatgttggtagtagtatgttacctagtgaaattcaatctgcttatttatgggcccagttgattaatgctaaaagaattaatgagaagagaattaatgattggaattactattttgatagtttgttacccttgaaggaaaaaggattaattgagttgcccaacattccaattgaatgtacacacaatgctcatatgttctacattaaactaccggacttaacccaaagaacaaggtttattgaagccatgtttaaacaaggtgttctttctgtttttcattatataccattacattcttcgcctgcaggaaaaagttttggtcgattcaatggtaaggatatctatacaaccatggaaagtgaaaaattagttcgcttacctatgttttatggattggctctctcagagagaaataagatcatatctactatttttgatattttggagtcttaa

SEQ ID NO: 3638 - protein, 383 aa, Vibrio vulnificus YJ016
MFETNYMIPFNKPPVTGEELQFIQEAISCGKLSGDGEFSRKCENWFVSHTGTTKALLTPSCTHALEMAAMLIDIQPGDEVIMPSYTFVSTANAFVLRGAKVVFVDIRADTMNIDESKIEVAITERTKAIVPVHYAGVACDMDTIMGLSDKYGLYVIEDAAQGMMSTYKGRALGSIGHIGTYSFHETKNYTSGGEGGLLLVNDQSFSQRAEIIREKGTNRNQFFRGMVDKYTWVDVGSSMLPSEIQSAYLWAQLINAKRINEKRINDWNYYFDSLLPLKEKGLIELPNIPIECTHNAHMFYIKLPDLTQRTRFIEAMFKQGVLSVFHYIPLHSSPAGKSFGRFNGKDIYTTMESEKLVRLPMFYGLALSERNKIISTIFDILES

SEQ ID NO: 3639 - DNA, 1137 bp, Bdellovibrio bacteriovorus HD100
  CDS (1)..(1137): transl_table=11
atgaaaattccattcaatctaccgcctaaaagctcgaacgaagagaagtacatttctcaagccatctccaacaaaaaactcagtggagaaggtcagttcaataaaaaatgcacggaatggttcaacaagaaccttccaaccttgatgaccgtcatcaccccgtcttgcacctcggctctggaaatggccatggttttggccgatatcggtccgggcgatgaagtcatcctgccatctttcactttcacttccactgccaacgttgtcgccctgtatggcgccatcccggtttttgtcgacgtggaccccaagaccatgaacatcgatgtcgatgccattgccaaagccatcaccgcccgcacacgcgtgatcatgccggttcactatgccggcgtgggctgcgagatggacaaaatcatggaccttgcgaacaagaacaacatctgggtggttgaagacgcggctcagggcatctttgcttcctacaagggcaaagccttgggagcttggggccatatggccgctttcagcttccatgaaaccaaaaatatcgtctgcggcgaaggcggtgccttgaccatcaacgatccccgtctggtggcgcgcgctgaaatcgtgcgcgacaaggggaccaatcgccagcaattcctgaacggccaagtcgacaaatacacctggcaggacaaagggtcttcctatctgctgtccgagctttcagctgcttttcttttgtcccaactggaagagggcgaaaaaatcacggcccgccgtatggcgatctggaagcagtactatgccggcatggcggatctggaagctgctggcaaagtccagcgcatgaccgtgcctgcggaggccaaagccaacgcgcatatcttctatttcctgctacctactatgcagacgcgcattgagctatggacccacctgaaagaagccggaatccagtccacattccattatgtgcctttgcattctgctccggcgggtttgaaatacggcaaagtcagcggcagcatggctgtcactgatgatcactcagcccgtttgctgcgactgcctttgtgggcggacatgacagcggcggatgctcagttcgtcctggacgaagttaataaattttttaaggggaaataa

SEQ ID NO: 3640 - protein, 378 aa, Bdellovibrio bacteriovorus HD100
MKIPFNLPPKSSNEEKYISQAISNKKLSGEGQFNKKCTEWFNKNLPTLMTVITPSCTSALEMAMVLADIGPGDEVILPSFTFTSTANVVALYGAIPVFVDVDPKTMNIDVDAIAKAITARTRVIMPVHYAGVGCEMDKIMDLANKNNIWVVEDAAQGIFASYKGKALGAWGHMAAFSFHETKNIVCGEGGALTINDPRLVARAEIVRDKGTNRQQFLNGQVDKYTWQDKGSSYLLSELSAAFLLSQLEEGEKITARRMAIWKQYYAGMADLEAAGKVQRMTVPAEAKANAHIFYFLLPTMQTRIELWTHLKEAGIQSTFHYVPLHSAPAGLKYGKVSGSMAVTDDHSARLLRLPLWADMTAADAQFVLDEVNKFFKGK

SEQ ID NO: 3641 - DNA, 1104 bp, Leptospira interrogans serovar Copenhageni str. Fiocruz L1-130
  CDS (1)..(1104): transl_table=11
atgataaatattccttatataaatttagttgagcagtggaaaaacgaacgggaagaattacttccggttcttgattccgttttaggttccggtcagtacattggtggacaagaagtcgcaaagtttgaagaggatgtcgcaaagttctgcggagtgaaatacgcggttgctttaaatagtggaaccgatgcgctcgtatgtggacttttagaacttggtattcaaccgggcgatgaagtgattactcctccaaactcttttattgcttctacggcttcgattgttcatataaaagcgaaaccagtatttgtcgatgtaggagaggaccagaatctagatccggaaaaattggaaaaggctatcacgtctaaaacaaaagcgattatgcctgttcatctaactggccgggttgccgcgatgaatgaaattatgaggattgcagacaaatattctatacccgtaattgaagatgcagcacaatctattggttctaaatatgatggtaagtttagtggttctattggtaaaattggatgtttctctacccatccattaaagaatttaaatgcttgcggtgatggtggatttttgacaacaaatgatgagaagatttataactctgtaagtagggttagaaatcatggtctaattgataggaatactgtcggtgaatttggttttgtaacgagaatggatgcaattcaggcggcgattttaaatttccgtttaacgcgtttgccgcaagttattgaaaaaagacgtcagaatgcacaactttataaaaccttattagataaaaggaatgtttttatcccggaagataaacctttagaatttaatacttatcatactttcgtaatacaagtcgaaagaagagatgaattaaaagattatttattttcacaggggattgagacatccattcattatccgattcccatccatcttcaacccgctagtaggaatcttggatataaacagggagacttccctattacggaaaaacaagcgggccgaattttaactttgcccattcatcaatatttgaaagatgttgacttacataaaattgcccaagcggttaatcgtttctacgaatcgtaa

SEQ ID NO: 3642 - protein, 367 aa, Leptospira interrogans serovar Copenhageni str. Fiocruz L1-130
MINIPYINLVEQWKNEREELLPVLDSVLGSGQYIGGQEVAKFEEDVAKFCGVKYAVALNSGTDALVCGLLELGIQPGDEVITPPNSFIASTASIVHIKAKPVFVDVGEDQNLDPEKLEKAITSKTKAIMPVHLTGRVAAMNEIMRIADKYSIPVIEDAAQSIGSKYDGKFSGSIGKIGCFSTHPLKNLNACGDGGFLTTNDEKIYNSVSRVRNHGLIDRNTVGEFGFVTRMDAIQAAILNFRLTRLPQVIEKRRQNAQLYKTLLDKRNVFIPEDKPLEFNTYHTFVIQVERRDELKDYLFSQGIETSIHYPIPIHLQPASRNLGYKQGDFPITEKQAGRILTLPIHQYLKDVDLHKIAQAVNRFYES

SEQ ID NO: 3643 - DNA, 1116 bp, Thermus thermophilus HB27
  CDS (1)..(1116): transl_table=11
atgaactctaatggctatcattctatgaaggctatccccgtttacgacccccttcccgaggtagaagccctctggcccgagctagaagaggccttccgccgggtcatgcattcggggcagtacatcctaggccctgaggtggaagcctttgagcaagaggtggcggcttacctcggggtgaagtacgccattggggtgaactcgggcacggacgctctggtcatcgccctccgggctttgggcgtgggcccgggggacgaggtgatcaccacccccttcaccttctttgccaccgccgaggccatcagcgccgtgggcgcgaccccggtcttcgtggacatagatccgaagaccttcaacatcaaccccgacctgatagcccccgccatcaccccacgcaccaaggccatcctccccgtgcacctctacggcctccccgcagatatggacaccatcctggaaatcgcccgctcccacggcctcaaggttctggaggactgcgcccaggccttcggggccacctacaagggcaggaaggtgggtaccctgggggatgccggggccttctccttcttccccaccaagaacctggggggatacggagacggcgggctcatcgccacgaacagcgatgaggtggccgagatggcccgcatgctccgggcccacggctctcgcaggaagtaccacaacgagatggtcggctacaactccagactggacgccttgcaggccgccttcctccgggtgaaactcaagcacgtggatgctttcaacgcccgccgccgggaagtcgcggcccgttacaacgatcttctccaaggggttccgggcctggtcttgccccccttgacagaggggcatgtcttccaccagtacaccgtccgcattcccgtaggacgggaccaggtagccgaggagctggcaagcaaggggattggcaccatggtgtactacccggtacccctccaccggcttccggtctacgggtatccagaaggcaccttccccgaggccgaacgggcaagccgggaggtcctctccttacccatgggcccctttctgggtccccagaacgagcacgtggcctcgctactgcgagagattctcgcatga

SEQ ID NO: 3644 - protein, 371 aa, Thermus thermophilus HB27
MNSNGYHSMKAIPVYDPLPEVEALWPELEEAFRRVMHSGQYILGPEVEAFEQEVAAYLGVKYAIGVNSGTDALVIALRALGVGPGDEVITTPFTFFATAEAISAVGATPVFVDIDPKTFNINPDLIAPAITPRTKAILPVHLYGLPADMDTILEIARSHGLKVLEDCAQAFGATYKGRKVGTLGDAGAFSFFPTKNLGGYGDGGLIATNSDEVAEMARMLRAHGSRRKYHNEMVGYNSRLDALQAAFLRVKLKHVDAFNARRREVAARYNDLLQGVPGLVLPPLTEGHVFHQYTVRIPVGRDQVAEELASKGIGTMVYYPVPLHRLPVYGYPEGTFPEAERASREVLSLPMGPFLGPQNEHVASLLREILA

SEQ ID NO: 3645 - DNA, 1179 bp, Desulfovibrio vulgaris subsp. vulgaris str. Hildenborough
  CDS (1)..(1179): transl_table=11
atgagcttcactcccgcatccgcattcatccccttctctccgccgcagataggcccggaagaggagcacgaacttctcgaggccctgcgcagcggctggataaccaccggcccccgcgtgcgcgccttcgaagccgccacagcagccgtggcgggcgcgacccacggcgtggccacgttctcgtgcaccgacgccatgcttgtggctttggccgccttcggggtcggccccggcgacgaggtgataaccaccccgtacaccttcatctccacggcgcaggtcatcctgcatcgcggggcgcgccccgtgttcgtggatgtggacccgcgcaccttcaacatcgaccccgcccgcatcgaggccgccatcaccccgcgcacgaggggcatcatgcccgtgcacttcgcggggcaggtgtgcgacatggacgccatcctcgccatcgcccgcaggcacggtctcttcgtcatcgaggatgccgcccacgccttcggcgccacccacaacgggcaccccgtgggcacactgggcgacgtggcgtgcttcagcttctacgccaccaagaacatcaccacggccgaaggcggcatggccgtcaccagcgatgccgacctcgcacagcgtatgcgggtgctctccatgtacggcatcagcgacgcacgcgagatatggcagaagcgctacacccgcgcgggcaacatccactatgacgtgcaggagctcggctacaagtgcaacatgaccgacctgtgtgccgcgctggggctggtgcagctgcgccgcatggacgccatcgccgccgcccgccgcagctacgccgccatctacgacgaggcgttcgccgacctgcccgtgacgacgccccatgtcgccccctacgcggggcacgcatggcacctctacccgctgcggctcgaccttgaccgcatcagcctctcacgcgacgaggtcatcctgcgcctcaaggaatgcaacgtgggaacgagcgtcatgttcacgccgttgcacctcttctcgtacttccagcgcgagatggggttcaacgaaggcgacttccccgtggccgaagacctcttctcgcgcgtggtatgtctgcccatgtcgcccgccctcggtgaagagcgcatccgcaaggtggccgagaccgtggcgcacgtcgtcaccgaaggcgcgaggtag

SEQ ID NO: 3646 - protein, 392 aa, Desulfovibrio vulgaris subsp. vulgaris str. Hildenborough
MSFTPASAFIPFSPPQIGPEEEHELLEALRSGWITTGPRVRAFEAATAAVAGATHGVATFSCTDAMLVALAAFGVGPGDEVITTPYTFISTAQVILHRGARPVFVDVDPRTFNIDPARIEAAITPRTRGIMPVHFAGQVCDMDAILAIARRHGLFVIEDAAHAFGATHNGHPVGTLGDVACFSFYATKNITTAEGGMAVTSDADLAQRMRVLSMYGISDAREIWQKRYTRAGNIHYDVQELGYKCNMTDLCAALGLVQLRRMDAIAAARRSYAAIYDEAFADLPVTTPHVAPYAGHAWHLYPLRLDLDRISLSRDEVILRLKECNVGTSVMFTPLHLFSYFQREMGFNEGDFPVAEDLFSRVVCLPMSPALGEERIRKVAETVAHVVTEGAR

SEQ ID NO: 3647 - DNA, 1149 bp, Erwinia carotovora subsp. atroseptica SCRI1043
  CDS (1)..(1149)
atgacggattttttgcctttttcccgcccgaccatgggcgacgaggaaattgctgccgtggcagaagtattacgttctggctggataaccacggggccgaaatgtcagcagttagagcaggctttttgccagcagtttgggtgccaacaggcgattgcggttagctccgcgacgggcggaatgcacgttacgctgatggcgctcggcattggacctggtgacgaggttattacgccgtctcagacttgggtttcaaccgtcaatatcatcacgctattgggtgcggaaccggtgatggtggatgtggatcggcatacgttgatggtgcgatcgcaggatattgaagccgcaattacgccgaagaccaaagcgattattcccgtgcattacgccggtgcgcccgccgatctggatgcgctgcgcgcactcagtgaacgctatggcattccgctcattgaggatgcggcgcatgccgtcggtacgcaataccgtggtgagtggattggtgcgcgtggaaccgccattttctcgtttcacgcgattaaaaatatcacctgtgcggaaggtggcatggtggtgacggatgacgaagcactcgccgagcgtatacgcagtctgaaatttcacgggctgggtgtggatgcgtttgacaggcagttacaggggcgcaagccgcaggccgaagtggtgacgccggggtttaaatacaatctggcggatatcaatgcggctattgcgctggtccaactggataaactcccagcgatcaacgcccgccgtcagcagcttgccgcgcgttatctcacgcagttgcactcgctgccgctccaaccgctggcggttcctgactatccccatttgcacgcctggcacctgtttatggtgcgcgtggacgaaacgcagtgcggtatttcacgcgatgatctgatggcggcgctgcaaacacatggcattggcaccgggctgcatttcagagcggtgcatacgcagaaatattaccgtgagcgctacccgcatttgcacctgccggaaacggagtggaattcggcgtcgctcatgacgctaccgctgttccccgatatgcaggacagcgatgtcgatcgcgtcgtcgcggcgttaacctcgattctggagtctgttcgtgattga

SEQ ID NO: 3648 - protein, 382 aa, Erwinia carotovora subsp. atroseptica SCRI1043
MTDFLPFSRPTMGDEEIAAVAEVLRSGWITTGPKCQQLEQAFCQQFGCQQAIAVSSATGGMHVTLMALGIGPGDEVITPSQTWVSTVNIITLLGAEPVMVDVDRHTLMVRSQDIEAAITPKTKAIIPVHYAGAPADLDALRALSERYGIPLIEDAAHAVGTQYRGEWIGARGTAIFSFHAIKNITCAEGGMVVTDDEALAERIRSLKFHGLGVDAFDRQLQGRKPQAEVVTPGFKYNLADINAAIALVQLDKLPAINARRQQLAARYLTQLHSLPLQPLAVPDYPHLHAWHLFMVRVDETQCGISRDDLMAALQTHGIGTGLHFRAVHTQKYYRERYPHLHLPETEWNSASLMTLPLFPDMQDSDVDRVVAALTSILESVRD

SEQ ID NO: 3649 - DNA, 1131 bp, Erwinia carotovora subsp. atroseptica SCRI1043
  CDS (1)..(1131)
atgattccatttaatgcgccaccggttgtcggtacggaactggattatatgcaggctgccatgagcagcggcaaattgtgcggcgatggcggatttactcgccgctgtcagcagtggctggaacattactccggtagcaagaaagtcctgcttacgccttcctgcacagcgtcgctggagatggccgctatcctactggatattaagcccggcgatgaagtgatcatgccgagctataccttcgtctctaccgccaacgcctttgtgctgcgcggtgcgaagatcgtgtttgtcgatatccgcccagatacgatgaatattgacgagacgaaaatcgaagcggcaattacggaaaaaacacgcattatcgtgccggttcactacgcgggcgtcgcctgcgagatggacgcgattatggcactggcgaaaaaatacgatttatatgtcgtggaagatgcggcacagggcgtgatgtccagctacaaaggccgcgttctggggtctattggtcacatcggctgcttcagttttcacgaaaccaaaaactacacctcgggcggtgagggcggggccacgttgattaatgacgcgaggctggtggaacgagcggaaatcatccgtgaaaaaggcaccaaccgtagccagttcttccgtggacaggtggacaaatacacctggcgtgacatcggctcaagctatctgatggcggatattcaagctgcttatctctgggcacagctggaagccgcgcgacccatcaacgagcgtcgcctgaaactgtggcagaactactatgcggcattcaaatcgctggccgatgcggggcgtataacactgccgaccgtgcctgccaatgggatccacaacgcgcacatgttttatatcaaactgcgcgatcaggacgaccgcagtgcgtttatcaattacatgaaagaagccgaaatcatgacagtctttcattatatcccgctacatagctgcccggcgggtctgaacttcggtcgtttctccggtgacgatcgctacaccacgcaggaaagcgaacggctggtacgtttaccgctgttctacaacctgtcggacgtcaatcagcgcaccgtcattaataccattctgagcttcttctcctga

SEQ ID NO: 3650 - protein, 376 aa, Erwinia carotovora subsp. atroseptica SCRI1043
MIPFNAPPVVGTELDYMQAAMSSGKLCGDGGFTRRCQQWLEHYSGSKKVLLTPSCTASLEMAAILLDIKPGDEVIMPSYTFVSTANAFVLRGAKIVFVDIRPDTMNIDETKIEAAITEKTRIIVPVHYAGVACEMDAIMALAKKYDLYVVEDAAQGVMSSYKGRVLGSIGHIGCFSFHETKNYTSGGEGGATLINDARLVERAEIIREKGTNRSQFFRGQVDKYTWRDIGSSYLMADIQAAYLWAQLEAARPINERRLKLWQNYYAAFKSLADAGRITLPTVPANGIHNAHMFYIKLRDQDDRSAFINYMKEAEIMTVFHYIPLHSCPAGLNFGRFSGDDRYTTQESERLVRLPLFYNLSDVNQRTVINTILSFFS

SEQ ID NO: 3651 - DNA, 1077 bp, Mannheimia succiniciproducens MBEL55E
  CDS (1)..(1077): transl_table=11
atggaatttattgatttaaaggctcaacagcaaagaattaaagcgcaaattgacgcgggtattcagaaagtattggcacacggcaaatatattttagggccggaagttgcggaattggaagaaaagctggccgcttacgtcggtgcaaaatattgcattacttgcgccaacggcacggatgcattgcaaattgcgcaaatggcattgggtatcggtgccggtgatgaagtgattaccccgggatttacttatatcgctacggcggaaaccgtcgctttattaggtgctaaacccgtttatgtggatgtggatccaaaaacctataatattgatgcggagaaattagaggccgcaatcacaccgcgtaccaaagctattattcccgtcagtttatacgggcaatgtgcggattttgatgcggtaaacgccgtggcgaaaaaatacaatttaccggttattgaagatgccgcgcaaagtttcggcgcgagctataaaaaccgtaaaagttgtaatctaaccactatttcctgtaccagctttttcccgagcaagcctttgggttgttatggtgacggcggcgcaatttttactaatgatgatgcgttggccaatgtgattcgtcaggtggcgagacacggtcaggatcgccgctatcatcatattcgggtgggtgtaaacagccgattggataccttacaggcggcgattctgttaccgaaattagcgattctggatgatgaaattgccgcgcgccaaagagtagctgaaaactatactcgactgtttaatcaggcgggcgttaatacgactccgtttattgaagctcataaccaaagcgcttgggctcagtacaccattcaagtggataatcgtgccgatgtacaggaaaaactgaaaactttaggaattccgaccgcagttcattacccaatcccgttaaacaaacagccggcagtggcggatagccgtattcatttaccggtgggggatttgattgccgaacgcgtgatgagtttgcctatgcatccctatcttacgccggaagaacagcaaaaaatcgttcaaagtttagtatag

SEQ ID NO: 3652 - protein, 358 aa, Mannheimia succiniciproducens MBEL55E
MEFIDLKAQQQRIKAQIDAGIQKVLAHGKYILGPEVAELEEKLAAYVGAKYCITCANGTDALQIAQMALGIGAGDEVITPGFTYIATAETVALLGAKPVYVDVDPKTYNIDAEKLEAAITPRTKAIIPVSLYGQCADFDAVNAVAKKYNLPVIEDAAQSFGASYKNRKSCNLTTISCTSFFPSKPLGCYGDGGAIFTNDDALANVIRQVARHGQDRRYHHIRVGVNSRLDTLQAAILLPKLAILDDEIAARQRVAENYTRLFNQAGVNTTPFIEAHNQSAWAQYTIQVDNRADVQEKLKTLGIPTAVHYPIPLNKQPAVADSRIHLPVGDLIAERVMSLPMHPYLTPEEQQKIVQSLV

SEQ ID NO: 3653 - DNA, 1110 bp, Bacillus licheniformis ATCC 14580
  CDS (1)..(1110): transl_table=11
atgatcccgttagtcaatttaaaacgtcaatttcaaacagtaaaacaggatattttaaaagagtttgaacatgtgctggacagcggccaatatatattggggccaaaggttgaagaattagagaaaagaatagctgaaaagcttggtgtaaaagaagcggtcgcggtcgccaacggaacggatgcattggtgctgacgcttgaagctttcggcatcggcaaaggggatgaagtgattacgaccccgttcacttttttcgccaccgccgaagccgtctcaagggtgggggctgaacctgtgtttgctgatgtcgatcctgaaacatacaatcttgatccgaaaaaaatagaagaaaagatcacccctgctactaaagcgatcattcccgtccatatcttcggacagccggctgatatggacgagatcatggagcttgccaaaaaacacggactgcttgtgattgaggatgcctgccaagcgttcggcgcatcgtataaagagcggcctgtcggcagcatcggggatgccgcctgtttttcatttttccctacaaaaaacttgggaacattgggagacgggggaatggtgacgatttcagacccggatgcagcccggcaattaagaacactcagaacccatggcactagcaaaaaatacttccatgacaaaatcggtttcaacagccgtcttgatgaattacacgccgcagctttactcattcttcttgagaaaatcgacggctggaatgaacaaagaagaagagtggccagccgctacagagaaggtttgaaaacggcggagcacctcacactgccggcagagaaagaggaccgcacacatatctatcatctctattgtatcggcgcgaaaaaccgcgactacatcatacaatcgctgaaagagcaggacattcattcaggtgtgtattatccttgctgccttcatctgcaatcggtctattcttcactgcagtacaaaaaaggcgattttcctatagccgagtccttgtccgaaacccttttcgccattccgatggatccttttctagccgccgaggaacaagatcagattatttctgcgctgctgaaaaaaggaggaggggaaaagtga

SEQ ID NO: 3654 - protein, 369 aa, Bacillus licheniformis ATCC 14580
MIPLVNLKRQFQTVKQDILKEFEHVLDSGQYILGPKVEELEKRIAEKLGVKEAVAVANGTDALVLTLEAFGIGKGDEVITTPFTFFATAEAVSRVGAEPVFADVDPETYNLDPKKIEEKITPATKAIIPVHIFGQPADMDEIMELAKKHGLLVIEDACQAFGASYKERPVGSIGDAACFSFFPTKNLGTLGDGGMVTISDPDAARQLRTLRTHGTSKKYFHDKIGFNSRLDELHAAALLILLEKIDGWNEQRRRVASRYREGLKTAEHLTLPAEKEDRTHIYHLYCIGAKNRDYIIQSLKEQDIHSGVYYPCCLHLQSVYSSLQYKKGDFPIAESLSETLFAIPMDPFLAAEEQDQIISALLKKGGGEK

SEQ ID NO: 3655 - DNA, 1152 bp, Burkholderia pseudomallei K96243
  CDS (1)..(1152): transl_table=11
atgagccagacttccgttcctttcctgccgttcgtcaaacccgagatcgacgaggaaaccattcagggcgtggccgacgtgctgcgctccggctggatcacgaccggcccgcagtgccagcgcttcgaggccgcgctgtccgaatactgcggcgggcgtcccgtacgcgtgttcaactcgggcacggcgacgctcgagatcggcctgcggatcgcgggcgtcggccccggcgacgaagtgatcacgacgcccgcgtcgtgggtcgcgacgagcaacgtgatcctcgagacgggcgcgacgcccgtgttcgtcgacatcgatcccgtcacgcgcaacctcgatctcgacctcgtcgaaaaggcgatcacgccgcgcacgaaggcgatcatcccggtgtacctcgcgggcctgcccgtcgacatggaccgcctctacgcgatcgcgcgcgcgcacgagttgcgcgtgatcgaggacgccgcgcaggcgctcggctcgacgtggcgcggccagcgcatcggcgcgatcggcgacatcgtgtcgttcagcttccatccgaacaagaacatcacgtcgatcgaaggcggcgcgctcgtgctcaacgacgaggccgaggcgacgctcgcgcagaagtaccggctgcagggcatcacgcgcacgggcctcgacgggatggactgcgacgtgctcggcggcaaatacaatctgaccgacgtcgccgcgcgcgtcggctggggccagctcgcgcacctcgaacgcttcaacgcgacgcggcacgcgctcgcgcgccgctacttcgacgcgttcgcgaacgggcccgcgtgcgcgctcggcgtcgggctgcccgtcgcggatttcgaaaacaccaactggcacatgttccagatcacgctgccgctcgagaagctgtcgatctcgcgcggcgaattcatggagcagttgaagcagcgcggcatcggctcgggcgtccattacccggccattcatcttttcacgctgtaccgcgcgcgcggctttgcgcagggcatgttcccccacgccgagcgcttcggcgcgtcgaccgtcacgctgccgctcttcacgcagatgagcgaggcgcacgtgcaacgggtcgtcgacgccgtcaaccagatttgcgaacaatacggaaaataa

SEQ ID NO: 3656 - protein, 383 aa, Burkholderia pseudomallei K96243
MSQTSVPFLPFVKPEIDEETIQGVADVLRSGWITTGPQCQRFEAALSEYCGGRPVRVFNSGTATLEIGLRIAGVGPGDEVITTPASWVATSNVILETGATPVFVDIDPVTRNLDLDLVEKAITPRTKAIIPVYLAGLPVDMDRLYAIARAHELRVIEDAAQALGSTWRGQRIGAIGDIVSFSFHPNKNITSIEGGALVLNDEAEATLAQKYRLQGITRTGLDGMDCDVLGGKYNLTDVAARVGWGQLAHLERFNATRHALARRYFDAFANGPACALGVGLPVADFENTNWHMFQITLPLEKLSISRGEFMEQLKQRGIGSGVHYPAIHLFTLYRARGFAQGMFPHAERFGASTVTLPLFTQMSEAHVQRVVDAVNQICEQYGK

SEQ ID NO: 3657 - DNA, 1140 bp, Nocardia farcinica IFM 10152
  CDS (1)..(1140): transl_table=11
ttgagcactgaccgggtcatcttcagcaggccgtaccgggcgcgccgggaactggccaatctcgcggcggtgctcgcctccgaccacagccacggcgacggccccttcaccgcgtcggccaccgccaagctccaggcgatcaccgaggcgccgcacgcactgctgaccacctcgtgcacgtcggcgctggagatggcgggcctgctgctcgaactcggccccgaggacgaggtgatcgtgcccagtttcgcgttcacctccaccgcgacgtcgatggcgttgcgcggagccacgtgcgtgttcgccgacatcgacccggccaccgggaatctcgaccccgagtcggtcgccgcggcgatcgggccgcgcaccaaagcggtggtggtcatccactacggcggcgtggccgccgacatggccgggctgctcgagctggccgcgactcacggcttcgcgatcgtcgaggacaacgcgcacggcctgggcggccggtggcgcggcaggccgctcggcaccatcggcaccctgggcacgctcagcttccacgacaccaagaacgtgcactgcggcgagggcggcgcgctgctgctcaccgacgacatcctgatgggccgcgcggagatcatccgggagaagggcaccgaccgcgcccggttcctgcgcggcgcggtggacaagtactcctggcaggacatcggctcgagctacctgcccagcgaactcaacgccgcggtgctcgacgcccagctcgacgagttcgaccgcatccaggcgggcaggcaccgggtgtggaacgcctacgcggcgggcctgccggactgggcggcgcgcaacgacgtccggctgatgtcggtgcccgccgaccgcgaacacaccgcccatctgttctacctgcgcacacccaccgagcagcgccgcgacgacctgatcgcgcatctggccgcgcgcggcatctccgcgccgttccactacgtgccgctggactccagcccggccgggctcaagctgggccgcacaccgtatccgtgtgtgcgcagcgccgagttctccggcaccgtcgtgcgcctgccactgtggcccgatctggccgacgcccaggtcgagcgggtgatcgaggccgtcaccgcgttcacggtgtga

SEQ ID NO: 3658 - protein, 379 aa, Nocardia farcinica IFM 10152
MSTDRVIFSRPYRARRELANLAAVLASDHSHGDGPFTASATAKLQAITEAPHALLTTSCTSALEMAGLLLELGPEDEVIVPSFAFTSTATSMALRGATCVFADIDPATGNLDPESVAAAIGPRTKAVVVIHYGGVAADMAGLLELAATHGFAIVEDNAHGLGGRWRGRPLGTIGTLGTLSFHDTKNVHCGEGGALLLTDDILMGRAEIIREKGTDRARFLRGAVDKYSWQDIGSSYLPSELNAAVLDAQLDEFDRIQAGRHRVWNAYAAGLPDWAARNDVRLMSVPADREHTAHLFYLRTPTEQRRDDLIAHLAARGISAPFHYVPLDSSPAGLKLGRTPYPCVRSAEFSGTVVRLPLWPDLADAQVERVIEAVTAFTV

SEQ ID NO: 3659 - DNA, 1158 bp, Salmonella enterica subsp. enterica serovar Paratypi A str. ATCC
  CDS (1)..(1158): transl_table=11
atggctgaaggaaaaatgatgttggactttttgcctttctcccgtccggcgatgggcgcggaagagcttgctgccgttaagaccgtactggactcaggttggataacaaccggcccgaaaaatcaggaactggaagcggcgttttgtcggctaactggcaatcaatatgccgttgccgtcagttcagccactgccggtatgcacatcgcgttgatggcgctgggcattggtgaaggcgacgaggtcattacaccgtcaatgacgtgggtttctacgctaaatatgatcgttttactcggcgcgaaccccgtcatggtcgatgtcgatcgcgatacgctgatggtcacgcctgaacatatcgaagccgcgattacgccacaaaccaaagcaattatccccgtccactacgctggtgcgcccgccgatctggacgctatttacgctcttggcgagcgttatggcattccagtgattgaagacgcggcgcacgcgacaggaaccagctacaaaggtcgccacattggcgcccggggcaccgcgattttctccttccacgccattaagaacattacctgcgctgaaggcggtatcgtcgtcacggataacccgcaattcgccgataaactgcgcagtctcaagtttcacgggcttggcgttgatgcctgggatcgacagagcggaggacgcgcgccacaagcggaagtcctggcgccgggctacaaatataatttgcccgacctcaacgccgctatcgcgcttgcccagttacagaaactggatgcgcttaacgctcgccgcgccgccatcgcagcgcagtaccaccaagcaatggcagacctgccttttcagcctctgagccttccgtcgtgggagcatattcacgcctggcatttattcattatccgggtcgatgaagcccgttgcggtattacccgggatgctctgatggcatcgctgaaaacgaaaggcatcggcacagggctgcatttccgcgccgcgcatacgcaaaaatattatcgcgaacgtttcccaacgctcacgctgcctgacaccgagtggaacagcgagcggatctgctcactgccgctcttcccggacatgaccgagagtgactttgatcgggtcattaccgcccttcatcagatagcaggacaataa

SEQ ID NO: 3660 - protein, 385 aa, Salmonella enterica subsp. enterica serovar Paratypi A str. ATCC
MAEGKMMLDFLPFSRPAMGAEELAAVKTVLDSGWITTGPKNQELEAAFCRLTGNQYAVAVSSATAGMHIALMALGIGEGDEVITPSMTWVSTLNMIVLLGANPVMVDVDRDTLMVTPEHIEAAITPQTKAIIPVHYAGAPADLDAIYALGERYGIPVIEDAAHATGTSYKGRHIGARGTAIFSFHAIKNITCAEGGIVVTDNPQFADKLRSLKFHGLGVDAWDRQSGGRAPQAEVLAPGYKYNLPDLNAAIALAQLQKLDALNARRAAIAAQYHQAMADLPFQPLSLPSWEHIHAWHLFIIRVDEARCGITRDALMASLKTKGIGTGLHFRAAHTQKYYRERFPTLTLPDTEWNSERICSLPLFPDMTESDFDRVITALHQIAGQ

SEQ ID NO: 3661 - DNA, 1143 bp, Idiomarina loihiensis L2TR
  CDS (1)..(1143): transl_table=11
atgattccatttaataagccgcctttgacaggcaacgaagttcaatacattacagaagcattgaagggtaataagatttccggagacggcccttttggaaaacgctgtcagcaatggtttgaagaaaatttaccaactcaaaaggctcttttaacgccttcctgtactgcagcactcgagcttgccgctatccttattgatgtccagtctggcgatgaaataattatgccaagctacaccttcgttagcacagccaacgcatttgtattgcggggagctaaaatcgttttcgtcgatattcgccctgatacgatgaatattgatgaaacgaaaattgaggctgcaattacagatagaactaaagcgattgttcccgtccattatgcgggagttagttgtgaaatggacgccattatggatattgctgggcgttatagtctttacgttatcgaagatgcagctcagggagtaatgagtagctataaagaaagacctttaggcactattggccatttgggcgcttttagcttccatgaaaccaaaaactatacgagtggtggcgaaggcggcctgttaataattaatgatgctcgatttacagaacgagctgaagttattcgtgaaaaaggtactaatagaagtcaattttttagagggcaagtagacaagtatacttgggttgatattggtagtagctacctgcctagtgaaatgcaggcggcatacctttgggctcagcttgagaaagcaaatgaaataaatgatgctcgactccgtacttggaaatcttactatgattcttttagaaaattaattcaggaaggttttatagagttgccgataattcctgattattgtatccacaatgctcatatgttctatataaaagttaaaaacttacaagtgcgaactgagttactcgaatttttaaaaaataaaaatattttgggggcttttcactatatacctttacattcgactcctgtaggtaaggactgggggcgattttctgaggatgaagtgtatacaacatctgaaagcgaacgtttgttaagactaccaattttttttggtataaaagatgaagaagtttcgctagtagtaaaagaagtatcaaatttctttaaggaacctcatgcttaa

SEQ ID NO: 3662 - protein, 380 aa, Idiomarina loihiensis L2TR
MIPFNKPPLTGNEVQYITEALKGNKISGDGPFGKRCQQWFEENLPTQKALLTPSCTAALELAAILIDVQSGDEIIMPSYTFVSTANAFVLRGAKIVFVDIRPDTMNIDETKIEAAITDRTKAIVPVHYAGVSCEMDAIMDIAGRYSLYVIEDAAQGVMSSYKERPLGTIGHLGAFSFHETKNYTSGGEGGLLIINDARFTERAEVIREKGTNRSQFFRGQVDKYTWVDIGSSYLPSEMQAAYLWAQLEKANEINDARLRTWKSYYDSFRKLIQEGFIELPIIPDYCIHNAHMFYIKVKNLQVRTELLEFLKNKNILGAFHYIPLHSTPVGKDWGRFSEDEVYTTSESERLLRLPIFFGIKDEEVSLVVKEVSNFFKEPHA

SEQ ID NO: 3663 - DNA, 1128 bp, Synechococcus elongatus PCC 6301
  CDS (1)..(1128): transl_table=11
atggctaagcaatcctatcggaaaattccttacaccaagccttcaattactgagctggagattcaatatgcaactgatgcagcccgaaacggctggggtgaacattgctatgactacatcatccgctttgaagaagcatttaaacaacacctaggtgtgcaatatgccattgcaaccagtagctgtactggtgctttgcacatgggtatgcatgctttagggattggtcctggtgatgaggtgatactggccgatacgaattggatagctactgcagctccaattattcatctcggggctataccagtctttgtggatattttgccggatagttggtgtttagatcctgagcaagttcaagctgctattacacctaagacaaaggcaatcatagcagtgcatttatatggaaatctttgtgagatggatgctttgctggcaatcggagagcgatacagcattcctgttattgaagatgcagccgaggcaattgggtcggtctatcacggtaagcgggcaggtagcatgggtcgcttcggagcattctcatctcatggtaccaagaccattacaactggtgaaggcgggatgtttgtcaccaatgatccggaactatatgaacatgttctaacgctttctaatcatggaagagctcgcgggcagactaagcaattttggcctgacatggtcggctttaagtacaaaatgagtaatatccaagctgcaattggctatgctcaaatgcaacgcatcgagattcttatacatatgaaacgtaaaatcttttcgatgtatcagaactatcttaaggatctcccagttcaaatgaatcatgagcctagaggctgtacgaatgggtactggatgccaacatttgtggttaacgaaaaagtttcttttaatcgcaataagttgattagcaagctgaaatcaaatggggtggatgctagggtgtttttctggcctcttagctcaacatcaaccggaggccgtaaagccttagataagccttacctttcagaaagcattcatctacatgcactaaatcttccttctcactaccaacttagcaatgaagaaagtatgtttatttgcactcttataaagaatacatccttttctgggtaa

SEQ ID NO: 3664 - protein, 375 aa, Synechococcus elongatus PCC 6301
MAKQSYRKIPYTKPSITELEIQYATDAARNGWGEHCYDYIIRFEEAFKQHLGVQYAIATSSCTGALHMGMHALGIGPGDEVILADTNWIATAAPIIHLGAIPVFVDILPDSWCLDPEQVQAAITPKTKAIIAVHLYGNLCEMDALLAIGERYSIPVIEDAAEAIGSVYHGKRAGSMGRFGAFSSHGTKTITTGEGGMFVTNDPELYEHVLTLSNHGRARGQTKQFWPDMVGFKYKMSNIQAAIGYAQMQRIEILIHMKRKIFSMYQNYLKDLPVQMNHEPRGCTNGYWMPTFVVNEKVSFNRNKLISKLKSNGVDARVFFWPLSSTSTGGRKALDKPYLSESIHLHALNLPSHYQLSNEESMFICTLIKNTSFSG

SEQ ID NO: 3665 - DNA, 1116 bp, Rhizobium leguminosarum bv. viciae 3841
  CDS (1)..(1116): transl_table=11
atgacagggaaggaactctattacattgctgaagcaaagtttggaaacatgcttgccggagacggcccatttaccaaaagatgtcatgagtggcttgagcaaacaagcggctgcaacaagtcgctactaactcactcatgcactgcggcgctcgaaatggcggctctgcttctcgacattcagccgggtgacgagatcataatgccatcatacactttcgtctcgactgcaaacgccttcgtcctgcgcggcggagtcccggtattcgtcgacatccgtgaagacactctgaatctagatgaaagcttgattgaagcggcgatcaccccgcgcactcgcgctatagtcccagttcactacgcgggcgttgcatgcgaaatggacaccattatgcgcatcgccaaacaacacggtctcaaggtcgtagaggacgcggcacagggcgtgatggccgcatataaggggcgcccgatcggcagcatcggcgatctcgcggcatacagttttcacgagaccaagaatgtcatttctggcgaaggcggagcgctattggtcaatgatcctgcgctggctctgcgggccgaagtcatccgtgaaaaaggcactgatcgcagtcgtttcttccggggtgaagttgacaagtacacttggcaggaagtgggctcgtccttcctgccgggggagttgatcgcggccttcttgtgggcgcaactcgaagagtcagagcgcattacaaaagaccgtctggcgatctggcattattatcacgcgatccttgagccgctcgaaacggaggggctgctccgtcgccctatcgtgcctgatgattgccagcataatgcccacatgtactatgtactgctgccggaagagagagaccgtcaaaaggtactaggtgagctgaaaagcaacggcatttcgtcagtcttccattacgtccctcttcattcctcgcccgcaggaagacgatatgcgcggatgtcaggcgagttgccggtaacgacttcgcagtcagagcgtctgatacgcttgcccttgtgggtaggcctgacgttcgagcagcagaaccgcgttgcggcagttctggctgacgcgctggaaggatgggcggcgtag

SEQ ID NO: 3666 - protein, 371 aa, Rhizobium leguminosarum bv. viciae 3841
MTGKELYYIAEAKFGNMLAGDGPFTKRCHEWLEQTSGCNKSLLTHSCTAALEMAALLLDIQPGDEIIMPSYTFVSTANAFVLRGGVPVFVDIREDTLNLDESLIEAAITPRTRAIVPVHYAGVACEMDTIMRIAKQHGLKVVEDAAQGVMAAYKGRPIGSIGDLAAYSFHETKNVISGEGGALLVNDPALALRAEVIREKGTDRSRFFRGEVDKYTWQEVGSSFLPGELIAAFLWAQLEESERITKDRLAIWHYYHAILEPLETEGLLRRPIVPDDCQHNAHMYYVLLPEERDRQKVLGELKSNGISSVFHYVPLHSSPAGRRYARMSGELPVTTSQSERLIRLPLWVGLTFEQQNRVAAVLADALEGWAA

SEQ ID NO: 3667 - DNA, 1143 bp, Azoarcus sp. BH72
  CDS (1)..(1143): transl_table=11
atgctggaagagaagaagatcccgttcaactggccttacatgacaggcaaggagttgtactacatcgctgaagcacactttaatggcaggttggcaggggatgggcctttcacaaagcgctgccatcgctggctggaggagaggactggatgcaataagggcttgcttacgcactcgtgcacggcagcactcgagatggctgctttattgctggatattcagcctggtgatgagatcatcatgccgtcatacacctttgtatctaccgccaatgcctttgtgcttcgtggtggagtcccagtgtttgtcgatatcagagaagattcgctgaatttggacgaacgtctgatcgagtctgccataacgccgcgtacccgtgccattgctccggttcattacgcgggagtcgcgtgcgagatggatacgatcatgatcatggcccgagagcatggattgaaagtcgttgaggatgcggcgcagggggtgatgtcgacctacaaggggcggcctctgggtagcattggtgatctcggagtttacagttttcacgaaacaaagaacctgatctctggagaaggcggcgcgctgctcgtcaatagtcccgacatgagccttcgcgcagagatcattcgcgagaaagggactgaccgaagccgattcttcaggggagaagtcgataagtacacttggcaagaggtgggctcgtctttcctgccaggggagttgattgccgctttcctgtgggcgcaacttgaagaagcggatcgaattactaaagagcggttggctagctggcaacgttatcacgagtttctggagccgcttgaagccaaaggaatactgaggcgcccgattgttccaggtgactgtcagcacaatgctcacatgtactacgttctcctggcgcctgaaattaatcgtcaagaggtccttgattcgttcaaacgaaatgaaatctggtcggttttccattacgtaccgcttcactcatcccctgccggtaagcgttatggtcggtcgcatggcgacctggatgtcacaactcggctgtctgaaaggttggtccgcttgccgatgtgggttgggttgacgaatgagcagcaagaaagagtcgttgaggtgctgagtgaagcggttagctga

SEQ ID NO: 3668 - protein, 380 aa, Azoarcus sp. BH72
MLEEKKIPFNWPYMTGKELYYIAEAHFNGRLAGDGPFTKRCHRWLEERTGCNKGLLTHSCTAALEMAALLLDIQPGDEIIMPSYTFVSTANAFVLRGGVPVFVDIREDSLNLDERLIESAITPRTRAIAPVHYAGVACEMDTIMIMAREHGLKVVEDAAQGVMSTYKGRPLGSIGDLGVYSFHETKNLISGEGGALLVNSPDMSLRAEIIREKGTDRSRFFRGEVDKYTWQEVGSSFLPGELIAAFLWAQLEEADRITKERLASWQRYHEFLEPLEAKGILRRPIVPGDCQHNAHMYYVLLAPEINRQEVLDSFKRNEIWSVFHYVPLHSSPAGKRYGRSHGDLDVTTRLSERLVRLPMWVGLTNEQQERVVEVLSEAVS

SEQ ID NO: 3669 - DNA, 1101 bp, Magnetospirillum magnetotacticum MS-1
  CDS (1)..(1101)
atggccgataacatccctctcgtcgatctcaaggctcagttccgctccatcgaggcggatgtcaacgccgccatcgccgccgtgctggcgcggggcgatttcattctgggcaaggacgttgacggttttgagaaggaattcgcggcattttcgggggcgtcccactcggtgggctgcgccaacggcaccgatgcgctgcagctggccatgatggcgctggatatcggtccgggcgacgaggtgatcgttccggccatgaccttcatcgccaccgcgctgggcgtcagtctggcgggagccacgccggttctggtggacgtggaggccgagaccggcctgctggacccagccaaggccgaggcggccatcacgccgaagaccaaggccatcctgccggtgcacctgttcggccagatggcaaatctcaaggcgctgaaggctatctgcgacaagcataagctgtatctggtggaagatgcggcgcaagcccatggcgccagccgtgacgggctgaaggctggcacggtggggtccatcggctgcttctcgttctatcccggcaagaatctcggcgcctatggtgatgccggtggtctgctgaccaacgaccctgccctggcccagaagcttttcctgctgcgccatttgggttcatccaagaagtaccaccacgagatcatcggccccaattcgcgcctggacaccatccaggccgccattctgcgggtcaagctgccccatctggctggctggaacgacgcgcgccgcaagcatgccaagcgttacgacgcggccctggccgacatcaagggtgtgcgcctgaccaagagcgatccgggcagcgtctatcatctttacgttatccgcgtggaagagcgcgaccgggtgctgaaggccctgaacgaagctggcatcggcgcgggcatccactatcccttcgccctgcacgagctggaggcctatgcttccctgggccataagcccggcgccttccccatggccgaggactgggcgcaccactgcatcagcctgcccatctacgccgaactgcccgatgatgccgcttcgcgcgctgccgccgtgctgcgccaggtgatctga

SEQ ID NO: 3670 - protein, 366 aa, Magnetospirillum magnetotacticum MS-1
MADNIPLVDLKAQFRSIEADVNAAIAAVLARGDFILGKDVDGFEKEFAAFSGASHSVGCANGTDALQLAMMALDIGPGDEVIVPAMTFIATALGVSLAGATPVLVDVEAETGLLDPAKAEAAITPKTKAILPVHLFGQMANLKALKAICDKHKLYLVEDAAQAHGASRDGLKAGTVGSIGCFSFYPGKNLGAYGDAGGLLTNDPALAQKLFLLRHLGSSKKYHHEIIGPNSRLDTIQAAILRVKLPHLAGWNDARRKHAKRYDAALADIKGVRLTKSDPGSVYHLYVIRVEERDRVLKALNEAGIGAGIHYPFALHELEAYASLGHKPGAFPMAEDWAHHCISLPIYAELPDDAASRAAAVLRQVI

SEQ ID NO: 3671 - DNA, 1152 bp, Nostoc punctiforme PCC 73102
  CDS (1)..(1152)
atgccagaattcatccctttcgctttacctgatattggagaagaagaaattagtgaggttgttgattctttacgatctggttggttgactacaggacctaagaccaaacgttttgagcaatattttgcagatttcattggttctggagtagaagcgatcgcagttaattctgccacatcagggttacatctcgctctggaagcattgggaattggtcccggagatgaagtaattaccacagtccacaccttcacggctacagcagaagtgattcgttacttaggagccaatccagtctttgttgatattaatttagctactctcaacattgatgctagcaaaattgaggctgctattactccccgcactaaagccatcatgcctgtccattttggtggacttgcttgtgatatgcaatcaattttaacaattgcccaaaagcatcaattgaaagtagttgaagatgctgcccatgctatcccgacaacctatcagggtaagttgattggtagcttagatagtgatgtcaccgtctatagcttttatgcaaccaaaaccattgctacaggtgaagggggtatgctagtaacccgtaacccggaaatagctcaaagatgccgaactatgcgcttacatggcatcaatcgagatgctttcgatcgctatacctcaactaaaccctcatggtattacgaggtagttgcaccaggcttcaaatataatatgacagatgtcgcggcttctcttggtatccatcaattgaagaaagccaagacactacagcaacaacgagctgcgatcgctaatcgatacaatatagaactaagcgacttacctttacatctgccagcattacctgctgatggagatattcactcttggcatctatatgtaattcgtttagccgattctgtacaagttagtcgcaataactttattgagcaattggctgctaaagggattggttgtagcgttcactatattcctttacacttgcatccctactggcgcgacacttacaatctctgcttagaagattttcctcaagcatcctatgcttctgaacggatagtaagcctaccaatctacacaaaaatgactgaggcagatcaaactcatatcattgaaatcatcaacaaaactttgacttga

SEQ ID NO: 3672 - protein, 383 aa, Nostoc punctiforme PCC 73102
MPEFIPFALPDIGEEEISEVVDSLRSGWLTTGPKTKRFEQYFADFIGSGVEAIAVNSATSGLHLALEALGIGPGDEVITTVHTFTATAEVIRYLGANPVFVDINLATLNIDASKIEAAITPRTKAIMPVHFGGLACDMQSILTIAQKHQLKVVEDAAHAIPTTYQGKLIGSLDSDVTVYSFYATKTIATGEGGMLVTRNPEIAQRCRTMRLHGINRDAFDRYTSTKPSWYYEVVAPGFKYNMTDVAASLGIHQLKKAKTLQQQRAAIANRYNIELSDLPLHLPALPADGDIHSWHLYVIRLADSVQVSRNNFIEQLAAKGIGCSVHYIPLHLHPYWRDTYNLCLEDFPQASYASERIVSLPIYTKMTEADQTHIIEIINKTLT

SEQ ID NO: 3673 - DNA, 1149 bp, Pseudomonas syringae pv. syringae B728a
  CDS (1)..(1149)
atgagtcaaacttttcttgccttttcacggccgtccattggcgatgaagaaattgctgcagtgacgcgcgtgctgcgttccggatggatcaccaccggaccggaatgtcagaagctggaggaagagttcgccgcgcgggtcggcgcgcggcatgcagtggcattgtcttcggccaccggggcaatgcacgttgcgctgctggcgctgggtgtagggcctggcgatgaagtgattacgccgtcgcaaacctgggtgtcgacagccaatatgatctgcctgctgggagccactccggtgtttgtcgatgtcgaccgcgacaccctgatgaccagcgccgcgttgatagagcatgccatcactccgcggaccaaggcgatcgtgccagtgcattatgcaggcgcggcattcgatcttgacccgctgtatgcgctggccgaccggcacggcatcaccgtgatcgaagacgctgcgcatgctgccggcactgcttaccaaggacgcccggtcggccagcagggcactgcgatcttttcgtttcacgcgatcaagaacatgacctgtgccgaaggcgcgatgctggtcaccgacaatgcacggctggctgatcgggtgcgtcagcttaaattccatggcctgggtgtcgatgcctacgatcgcctgaccctgggtcgcaaaccgcaggccgaggtcatggagcctggcttcaaatacaacctggccgacattaatgcgagcattgcgcgggtgcagttgcagcgcctcgacgccatcaatgcacagcgccaggcgctcgccagccattacctcgaacgactggccaatagccccgttctgcctctcgccctgccccggtatgcccagcaacacgcttggcacctgttcattctgcgcattgatcccgagcgctgcgggctggatcgcgatgccttcatgaaggccttgcaagcgcgaaatatcggcaccggcatccacttcatcgcgacccacctgcacagctattaccgcaagcgtttcccggatgtacgcctgcccgacactgaatggaattcatcacggctgtgttccatccccctgttccccgacatgagcctcgatgatgtcgagcgggttgtcggtgccattgaatcgaccctggaatccagccattga

SEQ ID NO: 3674 - protein, 382 aa, Pseudomonas syringae pv. syringae B728a
MSQTFLAFSRPSIGDEEIAAVTRVLRSGWITTGPECQKLEEEFAARVGARHAVALSSATGAMHVALLALGVGPGDEVITPSQTWVSTANMICLLGATPVFVDVDRDTLMTSAALIEHAITPRTKAIVPVHYAGAAFDLDPLYALADRHGITVIEDAAHAAGTAYQGRPVGQQGTAIFSFHAIKNMTCAEGAMLVTDNARLADRVRQLKFHGLGVDAYDRLTLGRKPQAEVMEPGFKYNLADINASIARVQLQRLDAINAQRQALASHYLERLANSPVLPLALPRYAQQHAWHLFILRIDPERCGLDRDAFMKALQARNIGTGIHFIATHLHSYYRKRFPDVRLPDTEWNSSRLCSIPLFPDMSLDDVERVVGAIESTLESSH

SEQ ID NO: 3675 - DNA, 1161 bp, Desulfovibrio desulfuricans G20
  CDS (1)..(1161)
atgcgtgagtcctttctggttttcggacagccccttatcgaacaggacgaaatagacgaagtcgtggactccatgcacaaggcatggatcggcaccggtcccaaggtgcatcagtttgaacgcgatttcgccgcatacaagggcgtggcgcatgccgccgccgtcaactcgtgcacggcagccctgcaccttgcctgtcttacactcgaccttgcacccggcgacgaggtgataaccaccgccatgaccttctgcgcgtcggtcaatgccatcatccatgccggcggtactcccgtgctggctgatgcagaccccgtcacgcttaatatttcggccgaaaccatagccccgcacatcggcccgcgcacccgcgccatcatggtggtgcactacgcaggacgctgctgcgatatggaccccataatggagctggcccgcaaacacggtctgattgtcatcgaagactgcgcccacgccattgaaagcgaatacaaagggcgcaaagccggcaccatagggcacataggctgcttcagcttttacgccaccaaaaacatcgtcaccggcgaaggcggcatgatcatttctgacgacaaagccgccatagaccgctgcaaaataatggcactgcacggcatgagcgccgacgcatgggccagattcagcgatgcgggctacaagcactatcaggttgttgatcacggctttaagtacaacatgatggatattcaggcggccatgggcatccatcagctgcggcgcgtggaagaatactggaaacgccgcgcctgcatatggcagaagtacaatgaaggactggccggacttggcatgggcctgcccgccgacgccgaggaacatacccgccatgcgtaccacctgtacaccatacgggtgtcggccgcgtgctgcggcgtggaacgcgacgccatgcttgaagcgctgagggcgcacaacataggcgtgggcgtacactatctggcagttcccgaacacccctactaccggcgccgtttcggctgggacccggcagacactccggtggccacagcttacgggcgcgagactgtcagcctgcccctttcccccaaactgtcagacggtgatgtggacgatgtcatagaagccatccgcgccatctgcacggaatctgccagatga

SEQ ID NO: 3676 - protein, 386 aa, Desulfovibrio desulfuricans G20
MRESFLVFGQPLIEQDEIDEVVDSMHKAWIGTGPKVHQFERDFAAYKGVAHAAAVNSCTAALHLACLTLDLAPGDEVITTAMTFCASVNAIIHAGGTPVLADADPVTLNISAETIAPHIGPRTRAIMVVHYAGRCCDMDPIMELARKHGLIVIEDCAHAIESEYKGRKAGTIGHIGCFSFYATKNIVTGEGGMIISDDKAAIDRCKIMALHGMSADAWARFSDAGYKHYQVVDHGFKYNMMDIQAAMGIHQLRRVEEYWKRRACIWQKYNEGLAGLGMGLPADAEEHTRHAYHLYTIRVSAACCGVERDAMLEALRAHNIGVGVHYLAVPEHPYYRRRFGWDPADTPVATAYGRETVSLPLSPKLSDGDVDDVIEAIRAICTESAR

SEQ ID NO: 3677 - DNA, 1077 bp, Methanococcoides burtonii DSM 6242
  CDS (1)..(1077)
atgatcccaatagcaaaaccagatatcggtgaagaagaaattgaagccgtttgtaaagtactccgctcaggaatgatagcagaaggaaaacgtgttgcagaattcgaagaagaatttgcaagctacatcggaacggaacatgcagttgcagtcaattccggcacagcagctcttcacgctgcactccttgcacatggaataggaaatggggatgaagtaataacaacttcattcagctttattgccaccgcaaactcgataatgtacaccggcgcaaaacctgtatttgtggacattgtcccagacacgttcaatatcgatcccacgcttgtcgaagaaaagatcactgataacacaaaggcaataatgccagtccacctctacggacatcctgcagagatgaaggccattaccgatattgcaaaggaccatgacctgatactcatcgaagacgcatgccaggcacatggagctgcctatggcgggaagaaggtcggttcatttggaacaggagcattcagcttctacccaaccaagaacatgacgaccagcgaaggcggaatgatgactaccaacgatgaagaggtcgccaaaaaagcaaaaatgatacgtgcccatggatcacagcagcgttacctccacgaaatgatcggatataatctaagaatgacagacatcggagctgccataggattaacacaacttaaaaaactgccatcatacaattccctaaggcaacgaaatgcatccttgctctcaaaaggactaagaaatacagacggaattaccatacctgttgtgaaagagggatgtgagcacatgttccaccaatacaccatccgtctaaacaacagggatgaaatgctaacaaagctagggcaggcaggaataggcactggagtatattatccgatacccatacacatgcaaccgatctacaaagatgcaggttatacagacaaacttccagaatgtgagaaagcatcaaaagaagtgctctccctgccagtgcatccaggagtttcagaagatgaaattcaacagataatcgatgcagtcataaagggagttgaatga

SEQ ID NO: 3678 - protein, 358 aa, Methanococcoides burtonii DSM 6242
MIPIAKPDIGEEEIEAVCKVLRSGMIAEGKRVAEFEEEFASYIGTEHAVAVNSGTAALHAALLAHGIGNGDEVITTSFSFIATANSIMYTGAKPVFVDIVPDTFNIDPTLVEEKITDNTKAIMPVHLYGHPAEMKAITDIAKDHDLILIEDACQAHGAAYGGKKVGSFGTGAFSFYPTKNMTTSEGGMMTTNDEEVAKKAKMIRAHGSQQRYLHEMIGYNLRMTDIGAAIGLTQLKKLPSYNSLRQRNASLLSKGLRNTDGITIPVVKEGCEHMFHQYTIRLNNRDEMLTKLGQAGIGTGVYYPIPIHMQPIYKDAGYTDKLPECEKASKEVLSLPVHPGVSEDEIQQIIDAVIKGVE

SEQ ID NO: 3679 - DNA, 1149 bp, Anabaena variabilis ATCC 29413
  CDS (1)..(1149)
atgatccaaagcctaagttcgattcccgcctttgatatcaagcagcaatatgcttccatagaagccgaagtcagcagagccgttgtagaagcactggcttctgggcgttatattggtggccctccagtcgaaagttttgagcaacaatttgctgcttatcatggcgttactgattgtgtcgcttgtaattctggtacagacgctctatttctagctttacgcgccttaggaatcggtgcaggcgatgaagtaattactacaccattcacctttgtcgctacggctgaagtgatcagcgccgtaggtgcaaaaccggtatttgttgacatcgatgagacaagttttaacctagatttacagcaagtagcggcggcgattacaccccgaaccaaagcgattatcccagtgcatctatttggacagcccgtggatatgacaacgctaatggcgatcgctcaagctcacaatatcgcagtaattgaagattgcgctcagtccacaggcgcgacttgggacggcaaaaaagtcggtagtattggacatattggctgttttagcttctaccccaccaaaaatctaggtgcttgcggtgatggtggcgcgattacaaccaacgatccagaaattgctgccaaggtgcggatcatcaaggaacatggacagagacatcgttatcaatatgaagaaataggtgttaatagccgcttagatgcgattcaagcagtaattttgcagattaaactaccttatcttgatacttggaatcgccaaagacaagcgatcgccgcctattaccaaaaatatctcagtcaaattcccggtatcatccccccgcaagaactagctggtggcgtgagcgtgtggaatcaatatactattcgcgtcatcaccgcaggaaggaacggtaatagcgccacacaccgggaggcggtaaaaaatagcttgcaagaaaagcaagtaggctcgatggtttactatccctaccctttacatttgcaaccagtttatcaatatctcggttatcagccaggacaattaccagttgcagaacaagcttgcaatgaagttttatccttacccatgtttcccgaactaacaaccgaacagcaagatcaagtaatttatgcgttgaaggatattcttttgtag

SEQ ID NO: 3680 - protein, 382 aa, Anabaena variabilis ATCC 29413
MIQSLSSIPAFDIKQQYASIEAEVSRAVVEALASGRYIGGPPVESFEQQFAAYHGVTDCVACNSGTDALFLALRALGIGAGDEVITTPFTFVATAEVISAVGAKPVFVDIDETSFNLDLQQVAAAITPRTKAIIPVHLFGQPVDMTTLMAIAQAHNIAVIEDCAQSTGATWDGKKVGSIGHIGCFSFYPTKNLGACGDGGAITTNDPEIAAKVRIIKEHGQRHRYQYEEIGVNSRLDAIQAVILQIKLPYLDTWNRQRQAIAAYYQKYLSQIPGIIPPQELAGGVSVWNQYTIRVITAGRNGNSATHREAVKNSLQEKQVGSMVYYPYPLHLQPVYQYLGYQPGQLPVAEQACNEVLSLPMFPELTTEQQDQVIYALKDILL

SEQ ID NO: 3681 - DNA, 1176 bp, Synechococcus elongatus PCC 7942
  CDS (1)..(1176)
atgacgtctatccccgcctttaatctgactgagcagtaccgccgtatcggtgctgagctagaaactgcgacagccaaggtcttagcctcggggggctacatcggcggacagactgttgcggactttgaagcggcttttgcagcggccatgggtgtgacggaagccgtgggctgcaattcgggcaccgatgcgctgcatctagcactgcgggcattagacatcgggcctggggacgaagtcatcacttcgccgtttaccttttttgcctctgcagaagcgattagtttggcgggggccacacccgtcctagtcgacatcgaaccccagttcttcaacctcgactatcgccagatcgaagcagcgattaccccgcgcaccaaggcgattattcccgttcatctgttcggccatccggcggcgatgtcggagattatggcgattgcccgagcccacaatctgcgcgtgattgaggattgtgcccaagcgacgggagcaacttggcagggtcagccggttggcagctttggcgactgtggctgctttagcttctatccgaccaaaaatttgggggcctgcggcgatggcggcctcgtcacaaccaagaatcctgaagtggccgatcgcctgcgatcgctgcgtcagcatggcatgcgggtgcgctactaccacgatgagatcggcctgaatagccgtttggatgcgctgcaggcggtgattctctcgattaagctgcgctacttggatgagtggaatcagcagcgccaagcgatcgcgcagcgctatggcgaagcgatcgccgcgattcccggtctggtcgcccccagcgtgcacgccgatgccgtccatgtctggcaccaatacacggtgcgggtgcaggcctgtggcgatcgcagccgctgtgtcagtcatccctgcgatcgccaaggactttgccgcgactggctgcaacaacaactgcaagcccaaggcattggctcgatgatctactaccccgtgcctgtgcatctgcagcaggcctacagccagttaggctacaagactggcgacttccctgaagccgagcgtgccgcccaagaagtcctgtcgctgccgatgttcccggaactcaacgaggatgatcaggctcgggtgatcacggctctgaaggatctggcgatcgcagccgtccagtcctag

SEQ ID NO: 3682 - protein, 391 aa, Synechococcus elongatus PCC 7942
MTSIPAFNLTEQYRRIGAELETATAKVLASGGYIGGQTVADFEAAFAAAMGVTEAVGCNSGTDALHLALRALDIGPGDEVITSPFTFFASAEAISLAGATPVLVDIEPQFFNLDYRQIEAAITPRTKAIIPVHLFGHPAAMSEIMAIARAHNLRVIEDCAQATGATWQGQPVGSFGDCGCFSFYPTKNLGACGDGGLVTTKNPEVADRLRSLRQHGMRVRYYHDEIGLNSRLDALQAVILSIKLRYLDEWNQQRQAIAQRYGEAIAAIPGLVAPSVHADAVHVWHQYTVRVQACGDRSRCVSHPCDRQGLCRDWLQQQLQAQGIGSMIYYPVPVHLQQAYSQLGYKTGDFPEAERAAQEVLSLPMFPELNEDDQARVITALKDLAIAAVQS

SEQ ID NO: 3683 - DNA, 1137 bp, Crocosphaera watsonii WH 8501
  CDS (1)..(1137)
atgccagtgaataccatcccccctgtagatttagtccgtcaatacaagcttattagtgaagaggttgatcgtgctgtcctcgaagttgtccgttccgggcgttatatcggtggtgaagttgttaaggactttgaagaacaactcgctaaatatgtcggtagtgcgcactgtattggttgtaactcaggaaccgatgccctatatttggccttacgagcattaaatattggtgctggagatgaggtcatcaccacaccatttacctttattgccaccacagaaaccgtcagtttagtgggagctaaaccagtttttgtggatattgaacgggataccttgaatatggatgtgggagccattgaagcagctattacccctcaaaccaaagccattatccctgtacatctctttggccaaccggttaacatggcccgtttaatggacattgcccaaaaacataatctgtatgtgatcgaagactgcgctcaaagtacaggggcaaaatgggaagaggatctgacaggaaatattggtcatgttggttgttttagtttctttcccaccaaaaacttaggaacttgtggggatggtggtgcggttaccacaaatgatccggcgatcgccgaaactattaaagttattaaagaacacggttcagcacaacgatattatcacgatgttgtgggtatcaatagccgtcttgatagtatccaagcagctattcttcgggttaaattgtcttatcttgatcagtggaataaacaacgaagagaaatttcccaacggtatcatcaactattagcaggtattcctggaatacaacttcctcaagaaattaagggaggttatcatgtatggaatcaatacactattttagtaaaaaatcataacaataatgaaaaaaccacaagagatgacctgagagaaaagttacaagaaaatggtatcatctcaatgatttattatcccattcccttacatttacaaaaggtttatcataatttaggttatcaaaagggtgctttttctgtaacagaagaagcagcaaatgaagtgttatccttacctatgttccccgatatttctcccgaagaacaagaacaagttgcttatgctttaagagattattttgcttaa

SEQ ID NO: 3684 - protein, 378 aa, Crocosphaera watsonii WH 8501
MPVNTIPPVDLVRQYKLISEEVDRAVLEVVRSGRYIGGEVVKDFEEQLAKYVGSAHCIGCNSGTDALYLALRALNIGAGDEVITTPFTFIATTETVSLVGAKPVFVDIERDTLNMDVGAIEAAITPQTKAIIPVHLFGQPVNMARLMDIAQKHNLYVIEDCAQSTGAKWEEDLTGNIGHVGCFSFFPTKNLGTCGDGGAVTTNDPAIAETIKVIKEHGSAQRYYHDVVGINSRLDSIQAAILRVKLSYLDQWNKQRREISQRYHQLLAGIPGIQLPQEIKGGYHVWNQYTILVKNHNNNEKTTRDDLREKLQENGIISMIYYPIPLHLQKVYHNLGYQKGAFSVTEEAANEVLSLPMFPDISPEEQEQVAYALRDYFA

SEQ ID NO: 3685 - DNA, 1176 bp, Ralstonia eutropha JMP134
  CDS (1)..(1176)
atgaccgctaccgccgcttccgaattccttcccttcgtccggcccgagatcgacgcggacaccattgccgaagtcggcaaggtgctggcatccggctggatcacctccggcccgaagatgcaggcgttcgaggacgccctgtcccagctctttggcggacgccccgtgcgcaccttcgccaatggctcggccacgatggaaatcgcgctgcggatcgcggacatcggccccggcgatgaagtcatcaccacgccgatcacgtgggtcgccaccgcgaacgtggtgctcgccgtgggcgcgaagcccgtgttcgtcgacatcgacccgcgcacgcgcaatatcgacctcgacgccgtggaagcggccatcacgccgcgtacgcgcgccatcatgccggtgtacctgtctggcctgccggtcgacatggaccgcctctatgcgatcgccaccaaatacaatctgcgcgtgatcgaagatgccgcgcaggccatcgattcgcgctggcaaggcaagcgcatcggcgcctttggcgacctggtcagcttcagcttccaggccaacaagaacatcaccagcgtcgagggcggctgcctggtgatgaacacgccggaagaagccgtgcgcgccgaacgcctgcgcctgcagggcgtgatccgctcgggcatggacggcatggacgtcgaagagcccggtggcaagttcaacctgaccgacgtgaatgccgcgatcggcctcgcgcagctcgcaaagctcgacgccatcaccgcgcgccgcgccgcactggccgagacctatttccgatgcgccgccgacgcggggctggccgaactcggcattgaactgccccagccgctggacccgcagcaagccacgaccaactggcacatgttccaggtcgtgctgcccacggagcgcctcgaaggcggcccgcagcaggctcgccagaacgtgatgcaggccatgcgcgagcgcggcatcggcaccggcgtgcactatcccccgattcaccttttcacctactaccgttcccttggctggcgcgctggcatgctgccgcacgccgaacgcatcggtcgcggcatcgtcacgctgccgctgttccccgccatgcaagccgccgatgtggaacgggtctgcgcaactctcagcgaaacatgcaaacgtctctccaaatga

SEQ ID NO: 3686 - protein, 391 aa, Ralstonia eutropha JMP134
MTATAASEFLPFVRPEIDADTIAEVGKVLASGWITSGPKMQAFEDALSQLFGGRPVRTFANGSATMEIALRIADIGPGDEVITTPITWVATANVVLAVGAKPVFVDIDPRTRNIDLDAVEAAITPRTRAIMPVYLSGLPVDMDRLYAIATKYNLRVIEDAAQAIDSRWQGKRIGAFGDLVSFSFQANKNITSVEGGCLVMNTPEEAVRAERLRLQGVIRSGMDGMDVEEPGGKFNLTDVNAAIGLAQLAKLDAITARRAALAETYFRCAADAGLAELGIELPQPLDPQQATTNWHMFQVVLPTERLEGGPQQARQNVMQAMRERGIGTGVHYPPIHLFTYYRSLGWRAGMLPHAERIGRGIVTLPLFPAMQAADVERVCATLSETCKRLSK

SEQ ID NO: 3687 - DNA, 1149 bp, Pseudomonas aeruginosa UCBPP-PA14
  CDS (1)..(1149)
atgtcactggactttctgccattctcccggccaagcatcggcgaggacgaaatcgccgccgtggagcaggtcctgcgttccggctggatcaccaccgggccgaagaaccaggagcttgaacagcgcttcgccgaacgcctcggctgccgccacgcggtggcgctatcctcggccaccggcgccctgcacgtcaccctgctggcgctgggcatcggccccggcgacgaagtgatcacgccgtcgctgacctgggtctccaccgccaacgtcatcaccctgctcggcgccaccccggtgttcgtcgacgtcgaccgcgacaccctgatgtgttcggcgcaggcagtggaagccgccatcggcccgcgcacccgcgccatcgtgccggtgcactacgccggctccaccctggatctcgaaggcctgcgcacggtcgccgggcgccacggcatcgccctggtcgaggacgccgcccacgcggtcggcagcgaataccgcgggcgcccggtaggctcccgcggcacggcgatcttttccttccacgcgatcaagaacctgacctgcgccgaaggcgcgatgttcgtcagcgacgacagcgccctcgccgaacgggtccgccgcctcaagttccacggcctcggggtcgatgcctacgaccgcctgagccatggacgcaagccgcaggcggaagtgatcgagcccggtttcaaatacaacctggccgacctcaacgccgccctcgcgctggtccagctcaagcgcctggacgcgctcaacgcgcgccgccaggccctcgccgaacgctacctggagcgcctcgccggcctgccgctggcgccgctcggcctgcccgcgcacaagcagcgccacgcctggcacctgttcatcctgcgcatcgacgccgaggcctgcggcctgggccgcgacgccttcatggaagccctgaaggcgcgcggcatcggtagcggcatccatttcatcgccagtcacctgcaccactactaccgccagcgccagccgcgcctgagcctgcccaacagcgagtggaactcggcccgcctgtgctccatcccgctgttccccgacatgcgcgacgacgacatcgagcgcgtcgcccgcgccatcgaggacatcctggagaaacgtcgatga

SEQ ID NO: 3688 - protein, 382 aa, Pseudomonas aeruginosa UCBPP-PA14
MSLDFLPFSRPSIGEDEIAAVEQVLRSGWITTGPKNQELEQRFAERLGCRHAVALSSATGALHVTLLALGIGPGDEVITPSLTWVSTANVITLLGATPVFVDVDRDTLMCSAQAVEAAIGPRTRAIVPVHYAGSTLDLEGLRTVAGRHGIALVEDAAHAVGSEYRGRPVGSRGTAIFSFHAIKNLTCAEGAMFVSDDSALAERVRRLKFHGLGVDAYDRLSHGRKPQAEVIEPGFKYNLADLNAALALVQLKRLDALNARRQALAERYLERLAGLPLAPLGLPAHKQRHAWHLFILRIDAEACGLGRDAFMEALKARGIGSGIHFIASHLHHYYRQRQPRLSLPNSEWNSARLCSIPLFPDMRDDDIERVARAIEDILEKRR

SEQ ID NO: 3689 - DNA, 1158 bp, Burkholderia cepacia R18194
  CDS (1)..(1158)
atgttcggcccacccaatctcgactgcattccattcggccgcccgttcgtggtcggcaaggagctctactacatcgcgaaagcggtcgagcagggcggcctcgccggcgaccaggcgttcacgaagctctgccaccgctggctggaagcgcgcatcggctgccagcgcgcgctgctcacgcactcgtgcacggccgcgctcgagatggccgcgatcctcgccgacgtgcagcccggcgacgaagtgatcatgccgtcctacacgttcgtgtcgaccgccaacgcgttcgtgctgcgcggcgcgacgccggtgttcgtcgacatccgccgcgacacgctgaaccttgacgagacgcagatcgccgccgcgatcacccagcgcacgcgcgcgatcgtgccggtgcactacgcgggcgtcgcatgcgacatggacgtgatcgggcagctcgcggcggaccacgacctgtgggtgatcgaggacgccgcccaggcgctgcagtcgacgtggaacggcaagccgctcggcagcctcggccacctcgcgtgcctcagcttccacgagaccaagaacgtgatctcgggcgaaggcggcgcgctgctggtcaacgacccgcgcctcgtcgagcgcgcggagatcatccgcgagaagggcaccaaccgcagtcagttcttccgcgggcaggtggacaagtacacatgggtcgacgtcggctcgtcgttcctgccgggcgagctgatcgcggcattcctgtacgcgcagttcgagcacgcggacgtgatcaccgcgcagcggcgcgcgaccgtgcagcgctaccaggacgcgctgcagccgctgcacgcggacgggctgatcgagctgcccgcgatttcgctcgccgagcgcggcaacggccacatgttctatttcctcgcacgcgacctcgccgaacgcaccgatctgctgcagcagatccgcgcggtgggcgtgaacgcggtgttccattacgtgccgctgcacagttcgccggccggccagcgctacgggcgctgcgggtccggcatggcggtgacggacctcgtcgccgaccggctcgtccggctgccgctgtaccacgacatgaccgaagccgaacaggatcgcatcctcgaagtggtcttcgatttctaccgcacccgataa

SEQ ID NO: 3690 - protein, 385 aa, Burkholderia cepacia R18194
MFGPPNLDCIPFGRPFVVGKELYYIAKAVEQGGLAGDQAFTKLCHRWLEARIGCQRALLTHSCTAALEMAAILADVQPGDEVIMPSYTFVSTANAFVLRGATPVFVDIRRDTLNLDETQIAAAITQRTRAIVPVHYAGVACDMDVIGQLAADHDLWVIEDAAQALQSTWNGKPLGSLGHLACLSFHETKNVISGEGGALLVNDPRLVERAEIIREKGTNRSQFFRGQVDKYTWVDVGSSFLPGELIAAFLYAQFEHADVITAQRRATVQRYQDALQPLHADGLIELPAISLAERGNGHMFYFLARDLAERTDLLQQIRAVGVNAVFHYVPLHSSPAGQRYGRCGSGMAVTDLVADRLVRLPLYHDMTEAEQDRILEVVFDFYRTR

SEQ ID NO: 3691 - DNA, 1152 bp, Burkholderia cepacia R18194
  CDS (1)..(1152)
atgagccagactaccgctccgtttctgccgttcacccgccccgagatcgatgaggaaaccatccagggcgtcgtcgaagtgctgcgctcgggctggatcaccaccggcccgcagagccagaaattcgaagcggcgctgtccgagtactgcggcggccgtccggtccgcgcgttcaactcgggcacctgcacgctcgagatcggcctgcgcatcgcgggcgtcggtgccggcgacgaggtgatcacaacgccggcgtcgtgggtctcgaccagcaacgtgatcatcgagaccggcgcgacgcccgtgttcgccgacatcgatcctgtcacgcgcaacatcgacctcgacaagctcgagcaggcgatcacgccgcgcacgaaggcgatcatccccgtgttcctgtccggcctgccggtcgacatggaccgtctgtacgcgatcgcacgcgcgcacaagctgcgcgtgatcgaggatgcggcgcaggcattcggctcgacgtggaacggcaagcgcatcggcgcgatcggcgacatcgtgtcgttcagcttccacgcgaacaagaacctgacgacgatcgaaggcggcgcactcgtgctgaacaacgaggaagaagcgacgctcgcgcagaagtaccggctgcagggcatcacgcgcacgggcttcgacgggatggactgcgacgtgctcggcggcaagtacaacctgaccgacgtcgccgcacgtgtcggcctcggccagctgccgcacatcgaccgcttcaccgcgcagcgccgcgcgctcgcacgggcgtatttcgccgcgttcgacggcagcgcggccgtgaagctcggcgtcggcctgccggttgccgacttcgagaacagcaactggcacatgttcctgatcacgctgccgctcgagcggctgacgatcacgcgcgccgaattcatggcgcaactgaaggaacgcggcatcggcacgggcatccactacccggcgatccatcttttcacgctgtaccgtgcgcgcggcttcaaggagggcatgttcccccacgccgaacggtacggcgcgtcgaccgtcacgctgccgctcttcacgcagatgacggaaggcgacgtgcgtcgcgtagtcgacgccatcaaccagatttgcgaacaatacggaaaataa

SEQ ID NO: 3692 - protein, 383 aa, Burkholderia cepacia R18194
MSQTTAPFLPFTRPEIDEETIQGVVEVLRSGWITTGPQSQKFEAALSEYCGGRPVRAFNSGTCTLEIGLRIAGVGAGDEVITTPASWVSTSNVIIETGATPVFADIDPVTRNIDLDKLEQAITPRTKAIIPVFLSGLPVDMDRLYAIARAHKLRVIEDAAQAFGSTWNGKRIGAIGDIVSFSFHANKNLTTIEGGALVLNNEEEATLAQKYRLQGITRTGFDGMDCDVLGGKYNLTDVAARVGLGQLPHIDRFTAQRRALARAYFAAFDGSAAVKLGVGLPVADFENSNWHMFLITLPLERLTITRAEFMAQLKERGIGTGIHYPAIHLFTLYRARGFKEGMFPHAERYGASTVTLPLFTQMTEGDVRRVVDAINQICEQYGK

SEQ ID NO: 3693 - DNA, 1152 bp, Burkholderia cepacia R1808
  CDS (1)..(1152)
atgagccagactaccgctccgttcctgccgttcacccgccccgaaatcgacgaggaaaccattcagggcgtcgtcgaagtgctgcgctcgggctggatcaccaccggcccgcagaaccagaagttcgaggccgcgctgtccgagtactgcggcggccgtccggtgcgcgcgttcaactccggcacctgcacgctcgagatcggcctgcgcatcgcgggcgtcggccctggcgacgaggtgatcaccacgcccgccacgtgggtgtcgaccagcaacgtgattatcgaaaccggcgcgacgcccgtgttcgccgacatcgatccggtcacgcgcaacatcgacctcgacaagctcgaacaggcgatcacgccgcgcacgaaggcgatcatcccggtctacctgtccggcctgccggtcgacatggaccgcctgtacgcgatcgcccgcgcgcacgacctgcgcgtgatcgaagacgccgcgcaggcgctcggctcgacgtggaaaggccagcgcatcggcgcgatcggcgacatcgtgtcgttcagcttccacgcgaacaagaacctgacgacgatcgaaggcggcgcactcgtgctgaacgatgaggacgaggcggcgctcgcgcagaagtaccggctgcagggcatcacgcgcaccggcttcgacggcatggactgcgacgtgctcggcggcaagtacaacctgaccgacgtcgccgcgcgcgtcggcctcggccagctgccgcacctcgagcgcttcaccgcgcagcgccgggcgctcgcgcgcgcgtatttcgccgcgctcgacggcggtgcggccgtgaagctcgggctcggcctgccggtcgccgacttcgagaacagcaactggcacatgttccaggtcacgctgccgctcgagcggctgtcgctctcgcgcgccgatttcatggcgcagatgaaggagcgcggcatcggcaccggcgtccactatccggccatccatcttttcacgctgtatcgtgcgcgcggcttcaaggagggcatgttcccccacgccgaacggtacggcgcctcgaccgtcacgctgccgctgttcacgcagatgacggaagacgacgtgcgtcgcgtggccgacgccatcaatcagatttgcgaacaatacggaaagtaa

SEQ ID NO: 3694 - protein, 383 aa, Burkholderia cepacia R1808
MSQTTAPFLPFTRPEIDEETIQGVVEVLRSGWITTGPQNQKFEAALSEYCGGRPVRAFNSGTCTLEIGLRIAGVGPGDEVITTPATWVSTSNVIIETGATPVFADIDPVTRNIDLDKLEQAITPRTKAIIPVYLSGLPVDMDRLYAIARAHDLRVIEDAAQALGSTWKGQRIGAIGDIVSFSFHANKNLTTIEGGALVLNDEDEAALAQKYRLQGITRTGFDGMDCDVLGGKYNLTDVAARVGLGQLPHLERFTAQRRALARAYFAALDGGAAVKLGLGLPVADFENSNWHMFQVTLPLERLSLSRADFMAQMKERGIGTGVHYPAIHLFTLYRARGFKEGMFPHAERYGASTVTLPLFTQMTEDDVRRVADAINQICEQYGK

SEQ ID NO: 3695 - DNA, 1107 bp, Rubrivivax gelatinosus PM1
  CDS (1)..(1107)
atgaaccagcaccggattcctgtctaccgcccagatctcagcgggaacgtcaaagcctatgtcaacgagtgcatcgactcgtcgtggatctcctcgcgcggccgcttcgtcggagagttcgagtccgcgttcgcggcgtacatcggggtcgagcacgccgcctccgtctgcaacggcacggtcgccctgcatctggcgctgctggcgctgggcatcggaccgggcgacgaggtcatcgttcccacgctcacctacatcgcgcccgtcaatgccatctcgtacaccggcgccacgcccgtcttcgtggattcgctgcgcagcagctggcagatggacccggaggacgtgcggcgccacatcacgccgcgcacacgcgcgatcctcgcggtccatctctacggtcagacctgcgacatggccgcgctggccgcgatcgcgcgcgagcaccgcctgttcctcgtggaagactgcgcggaggccttcggatcgacgtacgcgggccggcatgccgggaccttcggcgacatcgccacgttcagcttcttcggaaacaagaccatcacgaccggcgaaggcggcatggtcgtcaccaatgacaagaccctgaacgaacgcgcgcgccacttcaagggccagggtctggccgcgcaccgcgagtactggcacgacgtggtcggctacaactaccgcatgacgaacatcgccgcggccatcggcctcgcgcaactcgagcgggccgacgagatcatcgcgcgcaagcgggatctggcccagcagtacgcgcgtcgcctcgccggcctgccgatcgagctccacgccgaggcgcccgacacgcagcacagctactggatggtgtcgatcctgaccgagcgcgccgaagcgcgtgagccgctgcgtgcggctctggccgaagcgggcatcgagacccgccccctgttctatccagtgcacacgatgccgatgtatgcccgcagctaccgcaagcacccggtggcggaggacctggcatggcgcggcatcaacctgccgagctggcccggcctgagcggcgaacagatcgaccacatcgcccactcgatcgcaagcttctgctccaggtcggcatga

SEQ ID NO: 3696 - protein, 368 aa, Rubrivivax gelatinosus PM1
MNQHRIPVYRPDLSGNVKAYVNECIDSSWISSRGRFVGEFESAFAAYIGVEHAASVCNGTVALHLALLALGIGPGDEVIVPTLTYIAPVNAISYTGATPVFVDSLRSSWQMDPEDVRRHITPRTRAILAVHLYGQTCDMAALAAIAREHRLFLVEDCAEAFGSTYAGRHAGTFGDIATFSFFGNKTITTGEGGMVVTNDKTLNERARHFKGQGLAAHREYWHDVVGYNYRMTNIAAAIGLAQLERADEIIARKRDLAQQYARRLAGLPIELHAEAPDTQHSYWMVSILTERAEAREPLRAALAEAGIETRPLFYPVHTMPMYARSYRKHPVAEDLAWRGINLPSWPGLSGEQIDHIAHSIASFCSRSA

SEQ ID NO: 3697 - DNA, 1167 bp, Rubrivivax gelatinosus PM1
  CDS (1)..(1167)
atgaccgcgccgcccttcctgcccttcgcgctgcccgagatcggcgaggaggagatcgccgaggtcgtcgacacgctgcgctcgggctgggtcaccaccgggccgaaggcgcggcgcttcgagcaggacttcgcggccttcctcggcgatccgacgctgcaggccatcgccgtcaactccgccaccgccggcctgcacctcgcgctcgaggcgctgggcatcggcccgggcgacgaggtcatcaccaccacccacaccttcaccgccacggccgaggtggtgcgctacctcggcgccgacgtggtgctggtcgacatcgacccggccacgctgaacatcgacccggcccgggtcgaggccgcgatcacgccgcgcacccgcgccatcatccccgtccactacgccggcctcgcggcgaacgtggacgcgatcctcaccctggcgcgctgccacggcctgaaggtggtggaggacgcggcgcacgcgctgcccaccacctgcggcggcgcgctggtcggcacgctgggcagcgacgccacggtgttcagcttctacgccaacaagaccatcaccaccggcgagggcggcatggtggtcacgcgcgacccggagctcgcgaagcgcgtgaaggtgatgcgcctgcacggcatcagccgcgatgccttcgaccgcttcaccgccaagacgccgagctggcactacgagatcgtcgcgccgggctacaagtacaacctcaccgacatcgccgcggcgctgggcatccaccagctccagcgcgcacgcggcttccagcagcgccgggcggcgatcgcgcagcgctaccgcgccgccttcgccgacctgccggtgcagctgccgcccgagcctgcggccggcgagctgcacgcctggcacctctacgtgctgcggctggccgacgcggcaccgctggcgcgcgacgccttcatcgagcggctgttcgcgctgggcatcggcgtcagcgtgcactacatcccgctgcacctgcacccctactggcgcgagcgctacggcctggatgcggcgcagttcccccacagccagcacgcctacgaacgcatgctgagcctgccgctgtacacgaagatgagcgaggcggacatcgagcgcgtgatcgcggccgtgcggcagcagctgctgcagggctga

SEQ ID NO: 3698 - protein, 388 aa, Rubrivivax gelatinosus PM1
MTAPPFLPFALPEIGEEEIAEVVDTLRSGWVTTGPKARRFEQDFAAFLGDPTLQAIAVNSATAGLHLALEALGIGPGDEVITTTHTFTATAEVVRYLGADVVLVDIDPATLNIDPARVEAAITPRTRAIIPVHYAGLAANVDAILTLARCHGLKVVEDAAHALPTTCGGALVGTLGSDATVFSFYANKTITTGEGGMVVTRDPELAKRVKVMRLHGISRDAFDRFTAKTPSWHYEIVAPGYKYNLTDIAAALGIHQLQRARGFQQRRAAIAQRYRAAFADLPVQLPPEPAAGELHAWHLYVLRLADAAPLARDAFIERLFALGIGVSVHYIPLHLHPYWRERYGLDAAQFPHSQHAYERMLSLPLYTKMSEADIERVIAAVRQQLLQG

SEQ ID NO: 3699 - DNA, 1149 bp, Pseudomonas fluorescens PfO-1
  CDS (1)..(1149)
atgagtcaggcgtttctccccttctcccgccccagtatcggtgatgaagaaattgccgccgtggagcaagtcctgcgctccggctggatcaccaccgggccgaaaaaccaggccctcgaagaacaatttgcccagtacgtcggcagtcgtcatgccgtggcactttcctcggccaccggtgccatgcatgtaacgttactggcgttgggaatcggccccggcgatgaagtcatcaccccgtcgcagacctgggtgtcgaccgccaacatgatctcgctgctcggcgccacgccggtgttcgtcgatgtcgaccgcgacaccctgatgaccgacgccgcgcgcatcgaagccgccatcaccccgcgcaccaaagcaatcattccggtgcattacgctggcgccgcgtttgatctcgacccgctctacgcgctggccgacaagcatggtatcgccgtgatcgaagacgccgcccacgccgccggcacccgctacaagggtcgtcacgtcggctcgcaaggcaccgcaatcttttctttccacgcgatcaagaacatgacctgcgccgaaggcgcgatgttcgtcaccgacgacgaagccctggccaaccgcgtgcgcatgctcaagttccatggcctgggtgtcgatgcctacgaccgcctgacccacggccgcaaaccccaggcccaggtgatcgagcccggtttcaaatacaacctggccgacatcaacgccgcgattgcgctggtgcaactggagcgtctggacgcaatcaacgcccgccgcaccgagctggccacgcaatacctgcaaaaactcgaaggcctgcccgtgcaaccgctggccgtgccgaactacccgcaacagcacgcctggcacctgttcatcctgcgcatcgacagcgaacgctgcggcatggaccgcgaagccttcatgaagggcttgcaggagcaaggcatcggcaccggcatccacttcatcgccacccacctgcacacctggtatcgccagcgtgccccgcacctgtccctgcccgacaccgagtggaactcggcgcggctgtgctcgattcccttgtttcccgacatgaccgaccaggatctggaccgggtcgtcggggccattgaacacctgatggggaaacgcccgtga

SEQ ID NO: 3700 - protein, 382 aa, Pseudomonas fluorescens PfO-1
MSQAFLPFSRPSIGDEEIAAVEQVLRSGWITTGPKNQALEEQFAQYVGSRHAVALSSATGAMHVTLLALGIGPGDEVITPSQTWVSTANMISLLGATPVFVDVDRDTLMTDAARIEAAITPRTKAIIPVHYAGAAFDLDPLYALADKHGIAVIEDAAHAAGTRYKGRHVGSQGTAIFSFHAIKNMTCAEGAMFVTDDEALANRVRMLKFHGLGVDAYDRLTHGRKPQAQVIEPGFKYNLADINAAIALVQLERLDAINARRTELATQYLQKLEGLPVQPLAVPNYPQQHAWHLFILRIDSERCGMDREAFMKGLQEQGIGTGIHFIATHLHTWYRQRAPHLSLPDTEWNSARLCSIPLFPDMTDQDLDRVVGAIEHLMGKRP

SEQ ID NO: 3701 - DNA, 1176 bp, Ralstonia metallidurans CH34
  CDS (1)..(1176)
atgactgcttccgctccgcaggatttcctgccgttcgtccgcccaaatattgacgatgccaccatagccgaagtcggcaaggtgctggcatccggctggatcacgtccggacccaaggtgcaggcgttcgaggccacgctgtccgatctgttcggcggccgccccgtgcgcacgttctccaacggctcggcaacgatggaaatcgcgctgcgcatcgccgacatcggccccggcgacgaagtcatcaccacgccaatcacctgggtcgccacggcaaacgtggtcctgacggttggcgcccgtccggtcttcgtcgatatcgatccgcgcacgcgcaatatcgacctggatgccgtagaagccgccatcacgccgcgcacgcgagccatcatcccggtctacctgtccggtctgccggtcgacatggaccgcctctacgccatcgcgaagcgccataacctgcgtgtgatcgaagatgccgcgcaggctatcgactcgcgctggcgcggccagcgcatcggcgcatttggcgatctggtcagcttcagcttccaggccaacaagaacatcaccacgatcgagggcggctgcctcgtcatgaactcgcccgaggaagcgcagcgcgcggagcgcctgcggctgcaaggcgtgatccgcaccggcatggacggcatggacgtcgaggagccgggcggcaagttcaacctgaccgacgtcaacgctgccattgggctggcccagctccagcatctggacgcgatcaccgcacgccgcgccgaactggccgagacctatttccgctgcgccgccaacgccggactggccgatctcggtatcgaactgccgctgccgcgcgacccggacgtggctaccaccaactggcacatgttccaggtggtgctgccgaccgaccgcctgcgtggcggcgccgcggaagcgcgcaagcacgtcatggagtcgatgcgcgagtcaggcatcggcactggcgtgcattacccaccggttcacctgtttacttacttccgctccctgggctggcgcgaaggcatgctgccgcatgccgagcgcattggccgcggcatcgtcacgctgccgatgttccccgccatgcagacagccgacgtggagcgggtttgcgcaactctaagcgaaacatgcaaacgcctctctctctaa

SEQ ID NO: 3702 - protein, 391 aa, Ralstonia metallidurans CH34
MTASAPQDFLPFVRPNIDDATIAEVGKVLASGWITSGPKVQAFEATLSDLFGGRPVRTFSNGSATMEIALRIADIGPGDEVITTPITWVATANVVLTVGARPVFVDIDPRTRNIDLDAVEAAITPRTRAIIPVYLSGLPVDMDRLYAIAKRHNLRVIEDAAQAIDSRWRGQRIGAFGDLVSFSFQANKNITTIEGGCLVMNSPEEAQRAERLRLQGVIRTGMDGMDVEEPGGKFNLTDVNAAIGLAQLQHLDAITARRAELAETYFRCAANAGLADLGIELPLPRDPDVATTNWHMFQVVLPTDRLRGGAAEARKHVMESMRESGIGTGVHYPPVHLFTYFRSLGWREGMLPHAERIGRGIVTLPMFPAMQTADVERVCATLSETCKRLSL

SEQ ID NO: 3703 - DNA, 1083 bp, Methanosarcina barkeri str. fusaro
  CDS (1)..(1083)
atgatttcaattgccaagcccctgatgggtaaggaagagattgatgcagtaacaaaggtcctgagatcaggcatgattgcacagggcccaaaagtcgaagaatttgaacttgctttttctgaatacactggttgtgagtatggggttgccgtgagctctggcactgcagctttgtacattgcgcttcttgcccatggcataggaaaaggagatgaagtgattacaagccccttcagtttcattgcaacagcaaacagcgtcctttataccggggcaaaacctgtttttgcagatattgaatcagatacatataatatagatcctgaaaaagttcaggagaaaataactccaaaaaccagagcaattttgcctgttcacctctatgggcatcctgcagacatgaaagcgataatggaaattgcagatgataataagcttattgtaattgaagatgcctgccagtcccatggtgcagaatgccttggaaaaaaagtgggcagtttcggaacaggagcattcagcttttaccctactaaaaatatgacaacaagcgaaggcggaattctcactacggacgacaaggaaattgcagagaaggcaaaaatgatccgtgctcacggctcaaaagttcggtatctgcatgaaatgctgggcttcaacctgcgtatgactgatattgcagctgcaatcggacttgtacagcttggaaagctggacgggtttacagcggccagacaaaagaatgcagagattctttcagcagggttaaaaggtatatccggaattatgccaccggtaataagagctgactgcacccatgtattccaccagtatacggtcagagcagaaaaaagagatcaactggcaactttcctgaaagaaaaagaaataggaacaggaatccattatcctatatccattcacaaacaacctttctacagggaacttggatacagggattctctaccggtcgcagaaaaggcggcggaagaggttatttctctccccgtgcaccctgcattatccaaaactgatttgcaggaaatagtcgaggcgaccaaagaattttatgcaaaggattga

SEQ ID NO: 3704 - protein, 360 aa, Methanosarcina barkeri str. fusaro
MISIAKPLMGKEEIDAVTKVLRSGMIAQGPKVEEFELAFSEYTGCEYGVAVSSGTAALYIALLAHGIGKGDEVITSPFSFIATANSVLYTGAKPVFADIESDTYNIDPEKVQEKITPKTRAILPVHLYGHPADMKAIMEIADDNKLIVIEDACQSHGAECLGKKVGSFGTGAFSFYPTKNMTTSEGGILTTDDKEIAEKAKMIRAHGSKVRYLHEMLGFNLRMTDIAAAIGLVQLGKLDGFTAARQKNAEILSAGLKGISGIMPPVIRADCTHVFHQYTVRAEKRDQLATFLKEKEIGTGIHYPISIHKQPFYRELGYRDSLPVAEKAAEEVISLPVHPALSKTDLQEIVEATKEFYAKD

SEQ ID NO: 3705 - DNA, 1164 bp, Geobacter metallireducens GS-15
  CDS (1)..(1164)
atgcgcagcgaatttctccccttttccaaaccaaccatagacgacgacgagatcaatgaggtcgttgcatccctgaaatccgggtggatcaccaccggccccaaggtgaagcgcttcgaggaggcgttcaaggcctacgtcggcgcctcctacgccgtccccctgagttccgccaccgccgggctccacctgacgctcatcgccctgaagctggacgaaggggacgagatcatcaccacccccatgacctttgcctccacggtgagcatgatcgtcctctgtggggcaaagccggtgctcgtcgacatcgagccgggaaccctcaacatcgacgcggcaaagatccgcgaaaagatcaccccccgcacgaaggcgatcatcccggtccactttgccggccagtcgtgtgatatggaccccatcttcgccctggccaaggagttcggcctcaccgtcatcgaggacgcggcccacgccgccggcaccgagtacaaggggaagaggatcggctccctcgacagcatctccatcttttccttccaccccaacaagaacatcaccaccggcgaagggggaatggtctgcaccgccgacgagaccctggccgaggagatctcgctcctgaagttccacggcatgagccgcgaggcgtggaagcgcttcgccgccagcggcacccccaactacgacatcctccttcccggctacaagtacaacatgatggacatccaggccgccatcggcatccaccagctcccgaagctggacgggttcatcgagaagcgccgggaaatagccgaattctacaaggccgcctttgccgacgtccatgaactggctaccccggccctcgccccctacgaccagcgccatgcctggcacctctacacgccgctggtccgggtggagaagctcaccatcgatcgggacaccttcatggccgagctgaagaatctcaacatcggcaccggcctccactacaaggcgatccaccaccacgcctggtaccgggagaacatgccggtccccgcgggatcccttcccaacgccgactacgcctccgaccgcatcctctccctcccccttttcccggccatgaccatggacgacgcccgggacgtggtggcggcggtgaaggatgtcattgcccggaacaggaagtag

SEQ ID NO: 3706 - protein, 387 aa, Geobacter metallireducens GS-15
MRSEFLPFSKPTIDDDEINEVVASLKSGWITTGPKVKRFEEAFKAYVGASYAVPLSSATAGLHLTLIALKLDEGDEIITTPMTFASTVSMIVLCGAKPVLVDIEPGTLNIDAAKIREKITPRTKAIIPVHFAGQSCDMDPIFALAKEFGLTVIEDAAHAAGTEYKGKRIGSLDSISIFSFHPNKNITTGEGGMVCTADETLAEEISLLKFHGMSREAWKRFAASGTPNYDILLPGYKYNMMDIQAAIGIHQLPKLDGFIEKRREIAEFYKAAFADVHELATPALAPYDQRHAWHLYTPLVRVEKLTIDRDTFMAELKNLNIGTGLHYKAIHHHAWYRENMPVPAGSLPNADYASDRILSLPLFPAMTMDDARDVVAAVKDVIARNRK

SEQ ID NO: 3707 - DNA, 1089 bp, Ferroplasma acidarmanus
  CDS (1)..(1089)
atgattccagtatcagagcctgatataggcgagaaggaaatagaatatgtggatgatgcggtaagatcaggatgggtaagttcacatggcgaatatataaacagatttgaggataattttaagtcattcataggcacaaaattcgggcttacaacgtcaaatggaaccactgcactgcaccttgcattatctgctatgggcattaaggaaggggatgaggtaatagttcctgatttaacattcataagcccggtgaatgcagtgctatataaccatgcaacacctgttttatgcgatattgatcctgagaactggtgcattgatgcagaaaaaattgaaaaattaattacagaaaaaactaaagcaataatagtggtacatctttatggcaactctgctaatatggataggcttatggagataaaggaaaaatataatctttatttgatcgaggatacagcagaatcacttggtacggaatataaggggaaaaaactcggttcgttcggtgatgccggatgcttctccttttatggaaataaaacaatgacaacaggagaaggtgggttctgcacaaccaataatgaggaaatttacagaatgatgctgctgctcagagaccatggaatgaggcctgaaaacagatactggcatgattatattggatataattacaggatgacaaatctccaggctgcactgggagttgctcagcttgagaggttaaactcttttatagagaagaagaggcatattgcatcagaatataagaaaaacttaccgggaaatgtattgccacatcctgaggggaaattatataagggaacctactggctctactctatactcgctaaggataaggatgaaagggaacggttaataagcttcttattcggtaaaggaatagatacaaggaagttcttttatcctgtgcatgttatgccaccctataaggagtttaataaggtgaattatcccaatagcaccagcatctcagaaaggggaatcaatttgcccagcagtgtgaaattatctgacgatgaaataggatatatctgtgattgcattaaatcattttataaattataa

SEQ ID NO: 3708 - protein, 362 aa, Ferroplasma acidarmanus
MIPVSEPDIGEKEIEYVDDAVRSGWVSSHGEYINRFEDNFKSFIGTKFGLTTSNGTTALHLALSAMGIKEGDEVIVPDLTFISPVNAVLYNHATPVLCDIDPENWCIDAEKIEKLITEKTKAIIVVHLYGNSANMDRLMEIKEKYNLYLIEDTAESLGTEYKGKKLGSFGDAGCFSFYGNKTMTTGEGGFCTTNNEEIYRMMLLLRDHGMRPENRYWHDYIGYNYRMTNLQAALGVAQLERLNSFIEKKRHIASEYKKNLPGNVLPHPEGKLYKGTYWLYSILAKDKDERERLISFLFGKGIDTRKFFYPVHVMPPYKEFNKVNYPNSTSISERGINLPSSVKLSDDEIGYICDCIKSFYKL

SEQ ID NO: 3709 - DNA, 1134 bp, Cytophaga hutchinsonii
  CDS (1)..(1134)
atgatcccttttaataaaccgcatttaacaggtaaagaagttcattacatctatgaggctgttcattcagggaaaatttcaggaaatggcatttttactaaaaaatgtcatgatttctttacttccacatacggtttcacaaagacattgatgacatcaagctgtacagatgcgctggaaatgtcgtcattgttaatggatattcaaccgggggatgaaattatattaccaacgtttacgtttgtttcaacggcaaacgcttttgtattaagaggcgcaaagcttgtatttgtagatagtttagcaactgaaccaaatatgaacgttgagttgattgaaggtctgatcacatctaaaacaaaggcgattgttgtggtgcattatgccggcgtagcgtgtgatatggatgttgtaatgaacattgcaaaaaaatatcagttattcgtagtggaagatgccgcgcaggcaataagctcctattataaagataaaccattgggcggcattggcgattttggtgcattcagttttcatgaaacaaaaaatatcatttccggagaaggcggactgttggcaataaacaattcagattattgtaacaggtctgaaattatctgggaaaaaggtacaaaccgtagcgctttttttagaggcgaaacagataagtatggttgggtagatgttggttcctcgtttttaccatctgaaattataagcgcctttttatatgcgcagttagaaaacgtagctgaaattcaggctaagcgactggaaatctggaatacctattacaatacactaagccccttagcggaacataaaaaactcaggttgccttatataccggcgtatgcaaccaacaacgcacatatgttttatgtgatctgcaattctctggaagagcggaccgcattgattgattatttaaaagcacataatattctggctgtgtttcattatttatcgcttcataaatcaccttacttttcagataaacacgatggaagatcgatggattatgcagatcagtatgcagaaacgttggttcggttgcccttgttttatgatctttccaccgaagatcaggaatttatttgtactaaaatcttatctttttattcagaaaaaatatga

SEQ ID NO: 3710 - protein, 377 aa, Cytophaga hutchinsonii
MIPFNKPHLTGKEVHYIYEAVHSGKISGNGIFTKKCHDFFTSTYGFTKTLMTSSCTDALEMSSLLMDIQPGDEIILPTFTFVSTANAFVLRGAKLVFVDSLATEPNMNVELIEGLITSKTKAIVVVHYAGVACDMDVVMNIAKKYQLFVVEDAAQAISSYYKDKPLGGIGDFGAFSFHETKNIISGEGGLLAINNSDYCNRSEIIWEKGTNRSAFFRGETDKYGWVDVGSSFLPSEIISAFLYAQLENVAEIQAKRLEIWNTYYNTLSPLAEHKKLRLPYIPAYATNNAHMFYVICNSLEERTALIDYLKAHNILAVFHYLSLHKSPYFSDKHDGRSMDYADQYAETLVRLPLFYDLSTEDQEFICTKILSFYSEKI

SEQ ID NO: 3711 - DNA, 1137 bp, Microbulbifer degradans 2-40
  CDS (1)..(1137)
atgatgaaaacgataaaatttaatgagccttttttagcgggcaacgagttgaaatacttaaaagatgtttttcgacaagatcatttttatgggaatggtaagtatacaagattgtgcgccgaatttattcgaaaaaagctaagtgtagaaaatgttttgattaccgatagttgtacatctgcacttgagattgcggcgctgttaatgagagaaacaggtcaggagcaagaaattattttaccatcttatactttttcttccactgcttctgcatttgcgagggctgggtttaagttggtttttgcagaaatagatccgaaaacaatgatgatggatgttcgagatgtaagagaaaagtttactcaaaatacagcagcagtagttgtagtgcattatggtggttattgtgcagaagttaatgagtttagagcgctttgtgatgcaaatgaagtctacctcgtcgaagatgctgcgcaggcatttaattgctttttaaacaataaggcgctcggcacaataggtgattttggttgcttttcgttccatgagacaaaaaatgttcacgcaggcttatctggtgcattaattataaaagacaatagttttgttaatagagctacatatatatgggagcgtggaacaaataggcaggatgttttgaaggggcttgcaaacaaatattcttgggttgaaataggtggtagcttttatcctacggaattacaaactgcttttttgtacgctcaactggaagcgctcgaaagaaatatagaagaaaggaaagtgatttatgatgaatataaaataggtttggctcctttaaagttagccggtgtggtgtattacccagaatttcatgttgattataaatctaattatcatgcattttttgtggtttttaatagtgaaagtaaagcagatcaggttcgagagttcttaagggcaagaaatgttcatgcctatattgggtatattccactgcattcttcaccagtggggttgaaaatggggtatgaaattaactccttgccaataacagagaaatattcaaagcgagtgctccgcttaccattgcataataagttgacgcttactcaagttgcaggaatagttgacttaataaaaggatgtatttag

SEQ ID NO: 3712 - protein, 378 aa, Microbulbifer degradans 2-40
MMKTIKFNEPFLAGNELKYLKDVFRQDHFYGNGKYTRLCAEFIRKKLSVENVLITDSCTSALEIAALLMRETGQEQEIILPSYTFSSTASAFARAGFKLVFAEIDPKTMMMDVRDVREKFTQNTAAVVVVHYGGYCAEVNEFRALCDANEVYLVEDAAQAFNCFLNNKALGTIGDFGCFSFHETKNVHAGLSGALIIKDNSFVNRATYIWERGTNRQDVLKGLANKYSWVEIGGSFYPTELQTAFLYAQLEALERNIEERKVIYDEYKIGLAPLKLAGVVYYPEFHVDYKSNYHAFFVVFNSESKADQVREFLRARNVHAYIGYIPLHSSPVGLKMGYEINSLPITEKYSKRVLRLPLHNKLTLTQVAGIVDLIKGCI

SEQ ID NO: 3713 - DNA, 1146 bp, Actinobacillus pleuropneumoniae serovar 1 str. 4074
  CDS (1)..(1146)
atgcaaattccttttaataaaccgccgattgtcggtacggaactcggttatatgcaacaagcgatggcaagcgggaaattatccggcgacggcttttatagccggcgttgcgagcggtggctggaaaatcaattcggtacggcaaaagcattgcttacgccgtcttgtaccgctgcattggaaatggcggcgatattaatcgatattcaagccggcgatgaagtgattatgccgagttatacctttgtttcgaccgctaacgcatttgtgttgcgtggagcaaagattgtgtttgtcgatattcgtcccgatacgatgaatattgatgaaacgaaaattgaagcggcgattacaccgaaaaccaaagcgattgtgccggtacattacgccggtatcgcctgtgaaatggatacgattatggcaatagccgaaaaatatcggttgtatgtgatcgaagatgcggcgcaagcggtaatgtcctcttacaaaggtaaagcattaggcactattgggcatttcggctgttatagttttcacgaaactaagaattatagtgccggcggcgaaggcggtgctttattgattaatgatgatcgatttattgctcgtgcggaagtgatccgagaaaaaggcacaaatcgtagtcaattctttcgtggtgaaacggataaatacacttggcgagatctcggatccagttttttaatgtcggaattacaagcggcctatttatatgcacaattggaagtcgcacaacaaatcaagcagacccgtttagccgtttggcaacactattttgaagtcttacgtccgtttgccgaacaaggtcgtcttgagttaccgacttgcccgcccgaatgtgaacaaaacggccatctgttttatctgaaatggcgcaattcggatgaacgcaatgactttatcgaacggctaaaacaacacggaattttagcggtatttcattatgtgccgttacatagcagccctgccggtcagcggttcggctcgtttatcggcgaagaccgttttactacttcggaaagcgaacgcttggtgcgtttaccgctattttataatttacaaccgcaagaatcggataaaattattcgggttatattggaatttctacatcaatgcaatcattga

SEQ ID NO: 3714 - protein, 381 aa, Actinobacillus pleuropneumoniae serovar 1 str. 4074
MQIPFNKPPIVGTELGYMQQAMASGKLSGDGFYSRRCERWLENQFGTAKALLTPSCTAALEMAAILIDIQAGDEVIMPSYTFVSTANAFVLRGAKIVFVDIRPDTMNIDETKIEAAITPKTKAIVPVHYAGIACEMDTIMAIAEKYRLYVIEDAAQAVMSSYKGKALGTIGHFGCYSFHETKNYSAGGEGGALLINDDRFIARAEVIREKGTNRSQFFRGETDKYTWRDLGSSFLMSELQAAYLYAQLEVAQQIKQTRLAVWQHYFEVLRPFAEQGRLELPTCPPECEQNGHLFYLKWRNSDERNDFIERLKQHGILAVFHYVPLHSSPAGQRFGSFIGEDRFTTSESERLVRLPLFYNLQPQESDKIIRVILEFLHQCNH

SEQ ID NO: 3715 - DNA, 1116 bp, Chloroflexus aurantiacus
  CDS (1)..(1116)
atgatcccgtttgtggatttgaaagcccaatatctctcgatcaaagaagagattgatcgagcggttctggatacgctggccagtactcagtttgtgttaggaaaagaggtcgtcgcatttgaagagttatttgctgcttacacgcagtctcagtatgcgttgggtgtgaattccggtaccagtgcgctgcatctggccttgctggcctgtggtgttggtcctggagacgaggtcattacgacaccacacacctttatcgcgaccgtttcggcgatagactacactggtgcgcgaccagtgtttgtcgatatcgatccggtgacgtttaccgtcaatccggcgctcattgaagcggccatcactccgcgcacaaaagcgattattccggtgcacctctacggtcagccagccgatatggatccgatcatggcaattgcccgcaagcacaatctggtggtgatcgaagacgcagcgcaggctcacggtgcagagtataaagggcgccgggtcgggagtattggtgatgcaggttgttttagcttctatcccggtaagaatttgggggcgtatggcgaaggtggggcagtgaccaccaataaccctgaaattgcccgcactgtgcggatgctccgtgattggggagccgagcggcgttaccaccacgatctcaaaggattcaactatcgaatggaaggtgttcagggtgccatcctgcgggtgaagatggcgtatatcgaacactggacagagctgcggcgagcggcagcggcacgttacgatgcaatgctggccccacttgggatacaaactccggtagcactccctgatcgtcgtcatgtctatcatatctatgctattcgcgaccggcagcgtgatgcgctgcaaacctatcttcacgatcatggggtaagtaccggtatccattatccaatcccggttcacctgcaaaaggcgtttgctgatttgggttatcgagtcggtgatttcccgcaggccgagctggcggctgccgaggtcttgtcgctcccaatgtttcctgagttgactgttgatcaacaacaggttgtggctgaagcattgcagggatggatgcagcaggttgctgccggttgctag

SEQ ID NO: 3716 - protein, 371 aa, Chloroflexus aurantiacus
MIPFVDLKAQYLSIKEEIDRAVLDTLASTQFVLGKEVVAFEELFAAYTQSQYALGVNSGTSALHLALLACGVGPGDEVITTPHTFIATVSAIDYTGARPVFVDIDPVTFTVNPALIEAAITPRTKAIIPVHLYGQPADMDPIMAIARKHNLVVIEDAAQAHGAEYKGRRVGSIGDAGCFSFYPGKNLGAYGEGGAVTTNNPEIARTVRMLRDWGAERRYHHDLKGFNYRMEGVQGAILRVKMAYIEHWTELRRAAAARYDAMLAPLGIQTPVALPDRRHVYHIYAIRDRQRDALQTYLHDHGVSTGIHYPIPVHLQKAFADLGYRVGDFPQAELAAAEVLSLPMFPELTVDQQQVVAEALQGWMQQVAAGC

SEQ ID NO: 3717 - DNA, 1143 bp, Vibrio sp. Ex25
  CDS (1)..(1143): transl_table=11
atgattccatttaataagcccccagttgtaggtaaagagcttagctttattgagcaagctatccaaggaagtaaactctcgggagatgggccactttctgaacgatgcgagagttggtttgaaaacagagcgagctgtattaagactttgttaacgccttcatgtacccatgcgcttgaactcgccgctttactgatcgatattcagcctggtgatgaagtgattatgccaagctacacttttgttagcactgcgaatgcatttgtactgcgtggtgcaaaagtggtgtttgttgatattcgtccagatacgatgaacattgatgaaaccaaaattgaggctgcaatcactgaaaaaacggttgctattgtacctgtacattatgctggtgttgcttgtgagatggacacgatcatgagtattgcagagaagtataaactcattgttattgaagatgcggctcaaggtgtgatgtctacttacaaagggaaagcgttgggggcaattggccatctaggtgcatatagttttcatgagacgaaaaattatacgtccggtggtgaaggtggactacttcttattaatgaccaatcttttgttgagcgtgcagaaattgtcagagagaaggggacgaaccgaagtttgttcttccgtggcatggtagacaaatatacttgggttgatcttggtagtagtttgcttccaagtgagatacaagcagcatacctttgggggcagcttgaagaagctgaagggattaaccaaagacggctacaaatttggcgaaaatatctagatgagcttacgcctcttgccgcaaaacacaatatagaagtgccaactgttccttttgaatgtcagcacaatgcgcatatgttctacttgaaactggaaaatctggaattgagaagccagtttattgaaatgcttcgtgaagagggcatagtctctgcgtttcactatattccattgcatagctcaccagctggccaacagtttggtcggtttgtcggcagtgatatatatacgacacaagaaagtgagcgcttggtaaggctaccactgtacttcaatatgagtgatagtgagcagtcgtatgttattaatgctataaaaaatgttttagggcgtatggaattgtaa

SEQ ID NO: 3718 - protein, 380 aa, Vibrio sp. Ex25
MIPFNKPPVVGKELSFIEQAIQGSKLSGDGPLSERCESWFENRASCIKTLLTPSCTHALELAALLIDIQPGDEVIMPSYTFVSTANAFVLRGAKVVFVDIRPDTMNIDETKIEAAITEKTVAIVPVHYAGVACEMDTIMSIAEKYKLIVIEDAAQGVMSTYKGKALGAIGHLGAYSFHETKNYTSGGEGGLLLINDQSFVERAEIVREKGTNRSLFFRGMVDKYTWVDLGSSLLPSEIQAAYLWGQLEEAEGINQRRLQIWRKYLDELTPLAAKHNIEVPTVPFECQHNAHMFYLKLENLELRSQFIEMLREEGIVSAFHYIPLHSSPAGQQFGRFVGSDIYTTQESERLVRLPLYFNMSDSEQSYVINAIKNVLGRMEL

SEQ ID NO: 3719 - DNA, 1131 bp, Alteromonadales bacterium TW-7
  CDS (1)..(1131): transl_table=11
atggttccttttaatatacctcctaaagtaggtacagaattagcgtatatcgagcaagcgattgcatcagacaaattatgcggcgatggttacttctctaaaaaatgcgaaagatggtttgaagacagcttcaacacaacaaaagcattattaactccctcatgcaccgcatcgttagagctagctgctattctgattgatattcagcctgctgatgaagttattatgccctcatacacatttgtatctacagcgaatgcgtttgtattacgtggtgcaaaaattatatttgttgacgtacgtccagatactatgaatatggatgaaacactcattgaagctgcaattacgactaacacaaaagcaatagtgccagtacattacgcaggtgtagcttgtgaaatggatacaatacttgctatcgcagaaaaacatgacttgtgggtagtagaagatgcagcacaaggcgtaatgtctacctataaaggtaaagcactaggaactcttggtcatataggttgttatagctttcatgaaactaaaaactactcatcgggtggtgaaggtggggctattttaattaatgaccctaagctagttgaacgagctgagattatacgtgagaaaggaacaaaccgtagccaattcctacatggtattgtcgataaatacacatggcaagacataggttcgagctttttacctagcgaattacaagcggcatatttgtatgcacaactagaagcagcagacacgataaacaatttccgtttatcaatatgggaccattattacagtaaactgagcctaaaattaaaagctgagcagctacctcatattccggattcattaacgcataacgcacatatgttttatataaaattaaattcgaatgaagaacgaaatgaatttattagttatatgaaaacgcaggatattacgacaccttttcattatatcccactgcactcaagccctgcaggaaaacagtttggcgagtttttaggcaatgatacttatacaacgcaagagagttcaaggctagtacgtttgccgctgtattatggaatgactacagaaaatcaagacaaggtaataaaagcgtctttggatttcttccttgaaagctaa

SEQ ID NO: 3720 - protein, 376 aa, Alteromonadales bacterium TW-7
MVPFNIPPKVGTELAYIEQAIASDKLCGDGYFSKKCERWFEDSFNTTKALLTPSCTASLELAAILIDIQPADEVIMPSYTFVSTANAFVLRGAKIIFVDVRPDTMNMDETLIEAAITTNTKAIVPVHYAGVACEMDTILAIAEKHDLWVVEDAAQGVMSTYKGKALGTLGHIGCYSFHETKNYSSGGEGGAILINDPKLVERAEIIREKGTNRSQFLHGIVDKYTWQDIGSSFLPSELQAAYLYAQLEAADTINNFRLSIWDHYYSKLSLKLKAEQLPHIPDSLTHNAHMFYIKLNSNEERNEFISYMKTQDITTPFHYIPLHSSPAGKQFGEFLGNDTYTTQESSRLVRLPLYYGMTTENQDKVIKASLDFFLES

SEQ ID NO: 3721 - DNA, 1158 bp, Salmonella typhimurium
  CDS (1)..(1158): transl_table=11
atggctgaaggaaaaatgatgtcggactttttgcctttctcccgtccggcgatgggcgcggaagagcttgctgccgttaagaccgtactggactcaggttggataacaaccggcccgaaaaatcaggaactggaagcggcgttttgtcggctaactggcaatcaatatgccgttgccgtcagttcagccactgccggtatgcacatcgcgttgatggcgctgggcattggtgaaggcgacgaggtcattacaccgtcaatgacgtgggtttctacgctaaatatgatcgttttactcggcgcgaaccccgtcatggtcgatgtcgatcgcgatacgctgatggtcacgcctgaacatatcgaagccgcgattacgccacaaaccaaagcaattatccccgtccactacgctggcgcgcccgccgatctggacgctatttacgctcttggcgagcgttatggcattccagtgattgaagacgcggcgcacgcgacaggaaccagctacaaaggtcgccacattggcgcccggggcaccgcgattttctccttccacgccattaagaacattacctgcgctgaaggcggtatcgtcgtcacggataacccgcaattcgccgataaactgcgcagtctcaagtttcacgggcttggcgttgatgcctgggatcgacagagcgggggacgcgcgccacaagcggaagtcctggcgccgggctacaaatataatttgcccgacctcaacgccgctatcgcgcttgcccagttacagaaactggatgcgcttaacgctcgacgcgccgccatcgcagcgcagtaccaccaggcaatggcagacctgccttttcagcctgtgagccttccgtcgtgggagcatattcacgcctggcatttattcattatccgggtcgatgaagcccgctgcggtattacccgggatgctctgatggcatcgctgaagacgaaaggcatcggcacagggctgcatttccgcgccgcgcatacgcaaaaatattatcgcgaacgtttcccaacgctcacgctgcctgacaccgagtggaacagcgagcggatctgctcactgccgctcttcccggacatgaccgagagtgactttgatcgagtcattaccgcccttcatcagatagcaggacaataa

SEQ ID NO: 3722 - protein, 385 aa, Salmonella typhimurium
MAEGKMMSDFLPFSRPAMGAEELAAVKTVLDSGWITTGPKNQELEAAFCRLTGNQYAVAVSSATAGMHIALMALGIGEGDEVITPSMTWVSTLNMIVLLGANPVMVDVDRDTLMVTPEHIEAAITPQTKAIIPVHYAGAPADLDAIYALGERYGIPVIEDAAHATGTSYKGRHIGARGTAIFSFHAIKNITCAEGGIVVTDNPQFADKLRSLKFHGLGVDAWDRQSGGRAPQAEVLAPGYKYNLPDLNAAIALAQLQKLDALNARRAAIAAQYHQAMADLPFQPVSLPSWEHIHAWHLFIIRVDEARCGITRDALMASLKTKGIGTGLHFRAAHTQKYYRERFPTLTLPDTEWNSERICSLPLFPDMTESDFDRVITALHQIAGQ

SEQ ID NO: 3723 - DNA, 1188 bp, Bordetella bronchiseptica
  CDS (1)..(1188): transl_table=11
atgagcgacttcctgccctttgccctgcccgatatcggcgaggccgaaatccaagcggtcaccgaatccatgcgttcgggctggctgaccaccggccccaacgcccgcgagttcgaacgcgaattcgcggcctacatgggcgccgacgtggaggccgtggccgtcaattcggccaccgccggcctgcacctggccctggaagccataggggtcggcccgggcgacgaagtcatcaccaccacccacacattcaccgccagcgccgaagtcgcccgctacctgggcgccgaaccggtcctggtcgatatcgacccggccacgctgtgcatctcgcccgccgccatcgaacgcgccatcacgccgcgcacccgcgcaatcgtgccggtgcactacggcggcctgtcctgcgacatggacagcatcctggagatcgcccgcaagcacggcctgaaagtcatcgaggacgccgcccacgcgctgcccgcctcctggcaaggccggcgtatcggcagcctggaaagcgacctgaccgtctacagcttttacgccaccaagacgctggccaccggcgaagggggcatggtggtcacgcgcgaccccgccctcgccaagcgctgccgtgtcatgcggctgcatggcatcgaccgcgacgccttcgatcgcttcacctcgaagaagccggcgtggtactacgaaatcgtcgcccccggcttcaagtacaacatgaccgacacggccgccgcgatgggccgcgtccagttgcaacgcgtgcagcaaatgcgcgaccggcgcgcacagatcgccgcggcctatgaccaggccttcgccgatctgccgctgacactgccccccagccctggccgcacgccgggcgtcgaacgcgcggcccaccgcgacgacgacgagcattcctggcacctgtacgccatccgcatccatccgcaggcgccgctcaagcgcgacgacttcatcgtgcgcatgaccgagaacggcatcggctgcagcgtgcactacgtgccgttgcacctgcagccctattggcgcgaccgatatggcctgacgcctgacatgtacccccattcccaggccgcattcgaaggcatggccagcctgccgatctactcgcgcatgaccgatgccgatgtacagcgcgtcatcgcatcggtacggcaactgctgcacccatga

SEQ ID NO: 3724 - protein, 395 aa, Bordetella bronchiseptica
MSDFLPFALPDIGEAEIQAVTESMRSGWLTTGPNAREFEREFAAYMGADVEAVAVNSATAGLHLALEAIGVGPGDEVITTTHTFTASAEVARYLGAEPVLVDIDPATLCISPAAIERAITPRTRAIVPVHYGGLSCDMDSILEIARKHGLKVIEDAAHALPASWQGRRIGSLESDLTVYSFYATKTLATGEGGMVVTRDPALAKRCRVMRLHGIDRDAFDRFTSKKPAWYYEIVAPGFKYNMTDTAAAMGRVQLQRVQQMRDRRAQIAAAYDQAFADLPLTLPPSPGRTPGVERAAHRDDDEHSWHLYAIRIHPQAPLKRDDFIVRMTENGIGCSVHYVPLHLQPYWRDRYGLTPDMYPHSQAAFEGMASLPIYSRMTDADVQRVIASVRQLLHP

SEQ ID NO: 3725 - DNA, 1101 bp, Bordetella bronchiseptica
  CDS (1)..(1101): transl_table=11
atgcaattcattgacctgaaaacccaataccaagcgctgcgcgacaccatcaacccgcgcatccaggccgtgctggaccacggccagttcatcatgggcccggaagtcaaggaactggaggccgccttgtgcgcctacaccggcgccaagcactgcatcaccgtggcctcgggcaccgaggcgctgctgatctcgctgatggcgctgggcgtgaaggccggcgacgaagtcatcaccacctcgttcaccttcgtggccaccgctgaagtcatcgcgctgctgggcgccaagcccgtgttcgtcgacgtcgaaccggatacctgcaacatcaaggtgtccgagatcgaagcgaagatcaccccgcgcaccaaggccatcatcccggtgtcgctgtacggccaatgcggcgacatggacgaagtcaacgccgtcgcggccaagcacggcctgccggtcatcgaagacgccgcgcagagcttcggcgccacctacaagggccgcaagagctgcaacctgtcgaccatcggctgcaccagcttcttcccgagcaagccgctgggctgctacggcgacggcggcgcgctgttcaccaacgacgacgagctggcgcaagccatgcgcgaaatccgcgtgcacggccaatcgggccgctactaccacacccgcatcggcgtgggcggccgcatggacacgctgcaatgcgccgtggtgctgggcaagctggagcgtttcgattgggaaatcgcccaacgcatcaagatcggcgcgcgctaccagcaactgctggccgatttgcccggcggcgcatgtaccgtaaccgtgcgccccgaccgcgacagcgtctgggcccagttcaccgtcatggtgcccaaccgcgaagccgtcatcgcccagctgaaggaggccggcattcccaccgccgtgcactatccgcgccccatccacgcgcagccggcctatgagcaatacgccgagggcgccggcgccacgccggtttccgacgacctggccgcgcgcgtcatgagcctgccgatgcacccggatctggacgaagccacccaggacaagatcgtcgccgcgttgcgccaggccctgaactga

SEQ ID NO: 3726 - protein, 366 aa, Bordetella bronchiseptica
MQFIDLKTQYQALRDTINPRIQAVLDHGQFIMGPEVKELEAALCAYTGAKHCITVASGTEALLISLMALGVKAGDEVITTSFTFVATAEVIALLGAKPVFVDVEPDTCNIKVSEIEAKITPRTKAIIPVSLYGQCGDMDEVNAVAAKHGLPVIEDAAQSFGATYKGRKSCNLSTIGCTSFFPSKPLGCYGDGGALFTNDDELAQAMREIRVHGQSGRYYHTRIGVGGRMDTLQCAVVLGKLERFDWEIAQRIKIGARYQQLLADLPGGACTVTVRPDRDSVWAQFTVMVPNREAVIAQLKEAGIPTAVHYPRPIHAQPAYEQYAEGAGATPVSDDLAARVMSLPMHPDLDEATQDKIVAALRQALN

SEQ ID NO: 3727 - DNA, 1176 bp, Aspergillus oryzae
  CDS (1)..(1176)
atggatatgcgcaccaatactatccatacgacctgcaccaccattattggcaccgagttggccaatattgaagatgtactcactctgaacaacctttccggcaaggggaaatatacccggctgtgtgaacaatggctggagcagttcatgagaggaaataacggacgagcactggttgtctcttcctgcacctccgccctggagatggccgccatacttgccgatatccaagcaggcgacgaggtgattgtccccagctatacgtacgtgacaaccgtgaatgcattcgcactgcggggcgccgtgcctgtgtttgtagatttggacgacgccacgatgaacatcgacgcgaaccttatcgaaagggctattacacccaagacgcgagcaatcatccccattcactatggcggggttgcatgcgacatggacaaaatcatgaaggtcgctaaaagacatcaactattcgtctgcgaagatgcagccatggcatgcacatccacctataagggccagattctcggcactataggcaacatcggctgcatcagctttcaggaaaagaagaactttacagccggaggtcaaggaggtgcccttctagtcaatgatccagtattagctgagcgagccgagatcctctatgaccacgggaccaaccgttcgcgcttcatgcgcggtgaagttgatagctaccagtggctggatctggggttgaatgccactctttctgagctgcaggctgcgtttctatatgcacaattacaagctgcggatggcatcaatgcgcgcagaaggcatatctgggatcattattttgttagtttgttacctttggtccgtaagaggtacattactttgccccgtgttcctgatgataccacccaacatgcgaacgtgttctatatcagagttatagatccggcgcagcgcgaggatctgattcggcatatggctagggccaaagttcaggtacatccgcagttcatgccattacacttgtctccatttggtaggagtcatggtcactttcatggagaggaccgtgttacgtcactcgccagctcgcaaatcttgctgctgccggtgcatttggcgctgtctgatgaggcgcaggaggttgtgatccgggagatgtttgctttttggggtgagacagcagagggtagtgtttag

SEQ ID NO: 3728 - protein, 391 aa, Aspergillus oryzae
MDMRTNTIHTTCTTIIGTELANIEDVLTLNNLSGKGKYTRLCEQWLEQFMRGNNGRALVVSSCTSALEMAAILADIQAGDEVIVPSYTYVTTVNAFALRGAVPVFVDLDDATMNIDANLIERAITPKTRAIIPIHYGGVACDMDKIMKVAKRHQLFVCEDAAMACTSTYKGQILGTIGNIGCISFQEKKNFTAGGQGGALLVNDPVLAERAEILYDHGTNRSRFMRGEVDSYQWLDLGLNATLSELQAAFLYAQLQAADGINARRRHIWDHYFVSLLPLVRKRYITLPRVPDDTTQHANVFYIRVIDPAQREDLIRHMARAKVQVHPQFMPLHLSPFGRSHGHFHGEDRVTSLASSQILLLPVHLALSDEAQEVVIREMFAFWGETAEGSV

SEQ ID NO: 3729 - DNA, 1149 bp, Aspergillus oryzae
  CDS (1)..(1149)
atgataccgttcagcgttcctacagtagcgggctcagagctgcaatatgttgagcaagcggtgcggaaaggcaccctaagtggcgatggagaatacaccgtcttatgtcaaaattggctggaaaggaaattgcccgccgccaaagtattccttactccatctgggactgctgccctcgatttggcagcattggtcctgaacattcagcatggagatgaagtcattgtccccagctacacctatgtttctaccgccaatgcattcctacttcgcggggcctcgttggtgtttgtggatattgcgcccgagaccatgaacatggacatggaaaagctccaagatgccatcactgacaagacccgtgtgatcgtcccggttcactatgctggtgtcgcttgcgatatggatgctcttttgcatatagccaccgagcgagggatctatattgtggaagacgccgcgcagggtttgttctcaacctataaaggtcgtgcgttgggcacaattggccacatcgggtgcttcagcttccacgagagcaagaacgtgacagcaggcgggcaaggtggcgcgattctgatcaacgaccctggccttgtcgagcaagcggaaattatcaaagataaaggcaccaaccgccaaaagttcctgcgtggggacgtcgcccactatacctggcaacaggctggggcgagctataccctcagcgagatacaggccgcctacctttggggccagcttgaagcgtccgattgcatacaaagccaacgtttggagatctggaatttctactacagggaattatctaagctaggcgatgatgtaccaattgttctaccctctgtaccatcttactgccagcacaatgcacatatcttctttataagagtgaaggatggagcgcagcgcagagaattcattaccgccatgaaagatgcagggataacggttctcgcccattatagtcctctacactcgacggtccccggcgcccaaggtcggcacgttcttgatcgacaggacctcgcaactcgcgagagcgagaggctggttcgtcttccgatcttctatacgatgactatggagcaagcacgcaaggtggttgaaacaataaagtggtatttcatgagacgtttgactcgtatatag

SEQ ID NO: 3730 - protein, 382 aa, Aspergillus oryzae
MIPFSVPTVAGSELQYVEQAVRKGTLSGDGEYTVLCQNWLERKLPAAKVFLTPSGTAALDLAALVLNIQHGDEVIVPSYTYVSTANAFLLRGASLVFVDIAPETMNMDMEKLQDAITDKTRVIVPVHYAGVACDMDALLHIATERGIYIVEDAAQGLFSTYKGRALGTIGHIGCFSFHESKNVTAGGQGGAILINDPGLVEQAEIIKDKGTNRQKFLRGDVAHYTWQQAGASYTLSEIQAAYLWGQLEASDCIQSQRLEIWNFYYRELSKLGDDVPIVLPSVPSYCQHNAHIFFIRVKDGAQRREFITAMKDAGITVLAHYSPLHSTVPGAQGRHVLDRQDLATRESERLVRLPIFYTMTMEQARKVVETIKWYFMRRLTRI

SEQ ID NO: 3731 - DNA, 1188 bp, Bordetella pertussis
  CDS (1)..(1188): transl_table=11
atgagcgacttcctgccctttgccctgcccgatatcggcgaggccgaaatccaagcggtcaccgaatccatgcgttcgggctggctgaccaccggccccaacgcccgcgagttcgaacgcgaattcgcggcctacatcggcgccgacgtggaggccgtggccgtcaattcggccaccgccggcctgcacctggccctggaagccataggggtcggcccgggcgacgaagtcatcaccaccacccacacattcaccgccagcgccgaagtcgcccgctacctgggcgccgaaccggtcctggtcgatatcgacccggccacgctgtgcatctcgcccgccgccatcgaacgcgccatcacgccgcgcacccgcgcaatcgtgccggtgcactacggcggcctgtcctgcgacatggacagcatcctggagatcgcccgcaagcacggcctgaaagtcatcgaggacgccgcccacgcgctgcccgcctcctggcaaggccggcgtatcggcagcctggaaagcgacctgaccgtctacagcttttacgccaccaagacgctggccaccggcgaagggggcatggtggtcacgcgcgaccccgccctcgccaagcgctgccgtgtcatgcggctgcatggcatcgaccgcgacgccttcgatcgcttcacctcgaagaagccggcgtggtactacgaaatcgtcgcccccggcttcaagtacaacatgaccgacacggccgccgcgatgggccgcgtccagttgcagcgcgtgcagcaaatgcgcgaccggcgcgcacagatcgccgcggcctatgaccaggccttcgccgatctgccgctgacactgccccccggccctggccgcacgccgggcgtcgaacgcgtggcccaccgcgatgacgacgagcattcctggcacctgtacgccatccgcatccatccgcaggcgccgctcaagtgcgacgacttcatcgtgcgcatgaccgagaacggcatcggctgcagcgtgcactacgtgccgttgcacctgcagccctattggcgcgaccgatatggcctgacgcctgacatgtacccccattcccaggccgcattcgaaggcatggccagcctgccgatctactcgcgcatgaccgatgccgatgtacagcgcgtcatcgcatcggtacggcaactgctgcgcccatga

SEQ ID NO: 3732 - protein, 395 aa, Bordetella pertussis
MSDFLPFALPDIGEAEIQAVTESMRSGWLTTGPNAREFEREFAAYIGADVEAVAVNSATAGLHLALEAIGVGPGDEVITTTHTFTASAEVARYLGAEPVLVDIDPATLCISPAAIERAITPRTRAIVPVHYGGLSCDMDSILEIARKHGLKVIEDAAHALPASWQGRRIGSLESDLTVYSFYATKTLATGEGGMVVTRDPALAKRCRVMRLHGIDRDAFDRFTSKKPAWYYEIVAPGFKYNMTDTAAAMGRVQLQRVQQMRDRRAQIAAAYDQAFADLPLTLPPGPGRTPGVERVAHRDDDEHSWHLYAIRIHPQAPLKCDDFIVRMTENGIGCSVHYVPLHLQPYWRDRYGLTPDMYPHSQAAFEGMASLPIYSRMTDADVQRVIASVRQLLRP

SEQ ID NO: 3733 - DNA, 1095 bp, Salmonella enterica subsp
  CDS (1)..(1095): transl_table=11
atggaatatattccagtatatcaaccagcattatctggtaaagaaaaagaatatgttaatgattgtattgattcgacttggatttcgtcaaaagggagttatatccagcgctttgaaaaaaaattcgccgagcaaaataatatccagtatgctactactgtcagcaatgggacagtggcattgcatttggctttattagcgttaggtatttctgagggggatgaagttattgttcctacactgacatatatagcctctgtaaatgcaattaaatataccggggcgacaccggttttcgttgattcagatcttcaaacttggcaaatatcagtcgatgatattaaaaataaaataacaagtagaacaaaggctataatgtgtgttcacttgtatgggcatccttgtgatatgagtccaattttagaaattgcgaaggttaataatttatttattattgaagattgtgctgaggcttttggatcaaaatataaagataaatttgtaggtacatttggtgatatttcaacctttagcttttttggtaataaaacgataactacaggtgaaggaggaatggttgtaactaacgataaaacattgtacgatagatgtttgcattttaaagggcaagggttagctgcacacaggcaatactggcatgatgtgatcggctataattacagaatgacaaatatttgcgctgctattgggttagctcagttagagcaagcacaattatttattgctagaaaacgtgagatcgcagaaatttataaaaataatctaacccctctcattgaagtccatcaggaaggaaatgatatatttcatacttactggatggtttctatccttgccagaaatgcagaggaaagagaggtattgagatcttttctttcggaaaaattgacagagacacgtccattattttatcctgttcatacaatgcctatgtattcagataagtatcaaaagcatcctgttgccgaaaatttaggctggagaggtattaacttacctagttttcccaccttatctaacgagcaggttatatacatatgtaacgccataaatgaattttataaggataaataa

SEQ ID NO: 3734 - protein, 364 aa, Salmonella enterica subsp
MEYIPVYQPALSGKEKEYVNDCIDSTWISSKGSYIQRFEKKFAEQNNIQYATTVSNGTVALHLALLALGISEGDEVIVPTLTYIASVNAIKYTGATPVFVDSDLQTWQISVDDIKNKITSRTKAIMCVHLYGHPCDMSPILEIAKVNNLFIIEDCAEAFGSKYKDKFVGTFGDISTFSFFGNKTITTGEGGMVVTNDKTLYDRCLHFKGQGLAAHRQYWHDVIGYNYRMTNICAAIGLAQLEQAQLFIARKREIAEIYKNNLTPLIEVHQEGNDIFHTYWMVSILARNAEEREVLRSFLSEKLTETRPLFYPVHTMPMYSDKYQKHPVAENLGWRGINLPSFPTLSNEQVIYICNAINEFYKDK

SEQ ID NO: 3735 - DNA, 1110 bp, Thiobacillus ferrooxidans
  CDS (1)..(1110): transl_table=11
atgactcaaaatacagcaattcccatggtcgatttgcgcgcgcattttgcgccgctgcgggatgaaatattgacggggatagggaagattctggacgatgccagctttatcctgggaaatcaggggcgtgcgctggaggcggaggtagcgggtctctccggtgttgcccacggtgtgggctgcgcctccggtacggacgccctgatgctggccctgcgtgccctggagatcggccccggcgacgaggtgatcgtcccgaccttcacgttcatcgcgactgcggaagcggttctttacgtgggcgccacgccggtttttgtggatgtggatgatcgtttttacgccatgaccatcgccggtatcgaggccgccattacgccgcggaccaaagcgatcatccccgtacatctctacggattgccggcagatatgcccggcatcatggcgcttgctcagaagcatggcttgcgggtgattgaggattgtgcccaggccattggtgcccaaattaacggacaaggagtgggcagttttggcgacatcggttgtttttctttctttcccagcaaaaatcttggcgctgccggagacggcggcatggtggtgacggcggatgcggagctggaacgcaaattgcgcggtctgcgcaaccatggttcctggcagacctaccatcatgacgtattgggctataacagtcgtctcgacgaaatgcaggcggtgattcttcgggcggagttcccacatctcgcggcctataacgacggacggcggcgggcggcagggtggtacgccgagcatctggtgggtctcgacctgcaattgccggaagctccagcaggttatcaccacgtattccatcagttcaccattcagttgaatgcgcgggatgcggtgaagaccgccctccatgccgaaggcattgccagcgccatttactatccgattccaggacaccagcaaaagatgtttgcacaccaggcccaaacccattgtccggtggcagagcatctggcggagcgggtgctctccctgcccatgttcccggaactgcgtgaggagcagatagccaggatcgctaccgtgatccgtcgcaccctgcacggctag

SEQ ID NO: 3736 - protein, 369 aa, Thiobacillus ferrooxidans
MTQNTAIPMVDLRAHFAPLRDEILTGIGKILDDASFILGNQGRALEAEVAGLSGVAHGVGCASGTDALMLALRALEIGPGDEVIVPTFTFIATAEAVLYVGATPVFVDVDDRFYAMTIAGIEAAITPRTKAIIPVHLYGLPADMPGIMALAQKHGLRVIEDCAQAIGAQINGQGVGSFGDIGCFSFFPSKNLGAAGDGGMVVTADAELERKLRGLRNHGSWQTYHHDVLGYNSRLDEMQAVILRAEFPHLAAYNDGRRRAAGWYAEHLVGLDLQLPEAPAGYHHVFHQFTIQLNARDAVKTALHAEGIASAIYYPIPGHQQKMFAHQAQTHCPVAEHLAERVLSLPMFPELREEQIARIATVIRRTLHG

SEQ ID NO: 3737 - DNA, 1098 bp, Clostridium thermosaccharolyticum
  CDS (1)..(1098): transl_table=11
atgaaaatatcatttgcaagctttaaacctatgcatgatgaaatagaatatgaaataaagtttaaatttgaagaaatttacaaaagaaattggtttatattaggagatgaagataaaaaattcgaacaagaatttgcagattattgcaatgttaactattgtattggctgtggaaatggattagatgcattacatttaattttaaaggggtatgatataggttttggcgatgaagttattgtcccatccaatacttttatagctacggctcttgctgtttcatatacaggagcaaagccgatttttgtagaaccagatattagaacatataatattgatcctagtttaattgagtcggctatcacagaaaagactaaagccataattgctgttcatttgtatggacaaccagcagatatggatgaaataaaaagaatagctaaaaaatataaccttaagttaatagaagatgctgctcaagcacatggttcactatataagggaatgaaagtaggaagtcttggtgatgcggcaggtttcagcttttatccagctaaaaatttaggttctttaggtgatggtggtgcagtagttacaaatgacaaggatttagcagaaaaaattaaagcattatctaattatggttctgaaaagaaatatcatcatatttataaaggatttaattcaagattagatgaattacaggcaggatttttaagagttaaattaaaatatttagataaatggaatgaagagagaagaaaaattgcacaaaaatatatagctggtattaataatccaaatgttataataccagttgaagctgattacgcaaaacatgtatggtatacatttgttataagatcagaaaaaagagatgaattgcaaaaatatttaaataataatggaattggtacactcatccattatccaataccaattcatcttcaacaggcatataaagatttaggatttaaaaccggaaattttcccatcgcggaaaagatagcaaatgaaatattaagtataccaatttggtatggaatgaaaaatgaagagattgaatatgtaattgataaaataaatgcatggaaataa

SEQ ID NO: 3738 - protein, 365 aa, Clostridium thermosaccharolyticum
MKISFASFKPMHDEIEYEIKFKFEEIYKRNWFILGDEDKKFEQEFADYCNVNYCIGCGNGLDALHLILKGYDIGFGDEVIVPSNTFIATALAVSYTGAKPIFVEPDIRTYNIDPSLIESAITEKTKAIIAVHLYGQPADMDEIKRIAKKYNLKLIEDAAQAHGSLYKGMKVGSLGDAAGFSFYPAKNLGSLGDGGAVVTNDKDLAEKIKALSNYGSEKKYHHIYKGFNSRLDELQAGFLRVKLKYLDKWNEERRKIAQKYIAGINNPNVIIPVEADYAKHVWYTFVIRSEKRDELQKYLNNNGIGTLIHYPIPIHLQQAYKDLGFKTGNFPIAEKIANEILSIPIWYGMKNEEIEYVIDKINAWK

SEQ ID NO: 3739 - DNA, 1173 bp, Escherichia coli O157
  CDS (1)..(1173): transl_table=11
gtggacaggtattcaatggcggaaggaaaagcaatgtcagaatttttgcctttttcgagaccagcaatgggcgtggaggaactcgctgcagttaaagaggttctcgaatccggttggatcacaaccggtccgaagaatcacgcgcttgaacaagccttttgccagttgacgggaaatcagcatgccatcgcggtcagttcagccaccgccggaatgcatatcacgctaatggcgttggaaattggcaagggcgatgaagtgattacgccttccctgacctgggtttcaaccctcaatatgatttccttgcagggtgcaacgccggtaatggtggatgtcgatcgcgatacgctgatggtcacgcctgaagcgatcgaatcagccattacgccacgcactaaagccatcattccggtgcattatgccggtgcgccagcagatattaacgccattcgcgccattggcgaacgttacggcatcgcagttatcgaagatgctgcccatgccgtaggtacgtattacaaagggcgacatattggcgcaaaaggtaccgctattttttcatttcatgccattaaaaatattacctgtgcggaaggaggcctgattgttactgataatgaaaatattgcccgccagctacggatgctgaaatttcacggcctgggtgtcgatgcctatgacagacaaacctggggccgtgcaccgcaggctgaagtcttaacgccgggctataagtacaatctgaccgatattaacgccgcgattgccctgacacagttagccaaattagagcacctcaacacccgtcggcgcgaaattgcccagcaatatcagcaagcactggcagctctcccctttcagccattaagccttcccgcctggccgcacgttcacgcctggcatctgtttattattcgtgtcgatgaacaacgttgtggtatcagtcgcgatgcgttgatggaagcgttaaaagaaagaggtattggtaccgggttacatttccgcgccgctcacacacaaaaatattatcgcgagcgttttccctcgctgtcgttaccgaataccgaatggaatagcgaacgcatctgttctttgccgctgttcccggatatgactaccgccgatgccgaccgtgtcatcacagcccttcagcaactcgcaggacaataa

SEQ ID NO: 3740 - protein, 390 aa, Escherichia coli O157
MDRYSMAEGKAMSEFLPFSRPAMGVEELAAVKEVLESGWITTGPKNHALEQAFCQLTGNQHAIAVSSATAGMHITLMALEIGKGDEVITPSLTWVSTLNMISLQGATPVMVDVDRDTLMVTPEAIESAITPRTKAIIPVHYAGAPADINAIRAIGERYGIAVIEDAAHAVGTYYKGRHIGAKGTAIFSFHAIKNITCAEGGLIVTDNENIARQLRMLKFHGLGVDAYDRQTWGRAPQAEVLTPGYKYNLTDINAAIALTQLAKLEHLNTRRREIAQQYQQALAALPFQPLSLPAWPHVHAWHLFIIRVDEQRCGISRDALMEALKERGIGTGLHFRAAHTQKYYRERFPSLSLPNTEWNSERICSLPLFPDMTTADADRVITALQQLAGQ

SEQ ID NO: 3741 - DNA, 1140 bp, Shigella flexneri
  CDS (1)..(1140)
atgtcagaatttttgcctttttcgcgaccagcaatgggcgtggaggaactcgctgcagttaaagaggttctcgaatccggttggatcacaaccggtccgaagaatcaggcgcttgagcaagccttttgccagttgacgggaaatcagcatgccatcgcggtcagttcagccaccgccggaatgcatatcacgctaatggcgttggaaattggcaagggcgatgaagtgattacgccttccctgacctgggtttcaaccctcaatatgatttccttgctgggtgcaacgccggtaatggtggatgtcgaccgcgatacgctgatggtcacgcctgaagcgatcgaatcagccattacgccacgcactaaagccatcattccggtgcattatgccggtgcgccagcagatattgacgccattcgcgccattggcgaacgttacggcatcgcagttatcgaagatgctgcccatgccgtcggtacgtattacaaagggcgacatattggcgcaaaaggtaccgctattttttcatttcatgccattaaaaatattacctgtgctgaaggtggcctgattgtaactgataatgaaaaccttgcccgccagctacggatgctgaaatttcacggtctgggtgtcgatgcctatgacagacaaacctggggccgtgcaccgcaggctgaagtcttaacaccgggctataagtacaatctgaccgatattaacgccgcgattgccctgacacagttagtcaaattagagcacctcaacacccgtcggcgcgaaattgcccagcaatatcagcaagcactggcagctctcccctttcagccattaagccttcccgcctggccgcacgttcacgcctggcatctgtttattattcgtgtcgatgaacaacgttgtggtatcagtcgcgatgcgttgatggaagcgttaaaagaaagaggcattggtaccgggttacatttccgcgccgctcacacacaaaaatattatcgcgagcgttttcccacgctgtcgttaccgaataccgaatggaatagcgaacgcatctgttcgttgccgctgttcccggatatgactaccgccgatgccgaccgcgtcatcacagcccttcagcaactcgcaggacaataa

SEQ ID NO: 3742 - protein, 379 aa, Shigella flexneri
MSEFLPFSRPAMGVEELAAVKEVLESGWITTGPKNQALEQAFCQLTGNQHAIAVSSATAGMHITLMALEIGKGDEVITPSLTWVSTLNMISLLGATPVMVDVDRDTLMVTPEAIESAITPRTKAIIPVHYAGAPADIDAIRAIGERYGIAVIEDAAHAVGTYYKGRHIGAKGTAIFSFHAIKNITCAEGGLIVTDNENLARQLRMLKFHGLGVDAYDRQTWGRAPQAEVLTPGYKYNLTDINAAIALTQLVKLEHLNTRRREIAQQYQQALAALPFQPLSLPAWPHVHAWHLFIIRVDEQRCGISRDALMEALKERGIGTGLHFRAAHTQKYYRERFPTLSLPNTEWNSERICSLPLFPDMTTADADRVITALQQLAGQ

SEQ ID NO: 3743 - DNA, 1158 bp, Vibrio cholerae
  CDS (1)..(1158): transl_table=11
atgcattttatcccatttaacaaaccaccagtgactggcaatgaactaaaatatatttctcaagctgtttctggtgataagttatctggggatggaccattcgcaaaacaatgtgaggtatggcttgaaaagcatactcaaacaaaaaaagctttactcacaccttcttgcactcatgcactcgagcttgctgctttactgattgatattcaagctggtgatgaagtgattatgccaagctttactttcgttagtactgcaaatgcatttgtcctacgtggagccaaaattgtctttgtcgatattcgcccagacactatgaacattgatgaaaccaaaattgaatcagccattaccgctagaacaaaagcgatagtaccagtccactacgcaggagtcagctgtgatatgggtacaataatggcaatcgcgaataagtataaactatttgttatagaagatgccgcacaagggatgatgtctacatataaagatcaacctttgggctctattggtcatatggccgcatttagttttcatgagacaaaaaactacacgtctggaggagaaggaggcgcactcctgattaacgaccaacgttttattcaacgtgcagaaattttgcgagagaaaggaactaacagaagtttatttttcaaaggtatggtggataaatacacatgggttgatataggtagcagcatgctgccaagcgaaatacaagcggcatatctgtatgctcaaatggagcaggctgtagaaatcaatcatactcgcctcaatatttggaacagctatctaaatgccttttctaaatatcaagagtctggcgtaatcgaactcccatcaatcccggcgaactgtcaacacaatgctcatatgttttacataaaactacataatgttgatataagagataaatttattattcatatgaagaataatagtgttctgacggtatttcattatttacctctacatagcacagtagcgggaagaaaatttagctattttcatggtgaagatatccatacaacaaaagaaagtgagaaattagttagactcccgctatactttaatcttaaagaagaagatatgtatcgaataattgatatagcatgtgattttttagacagttattctggtaataaaaaatga

SEQ ID NO: 3744 - protein, 385 aa, Vibrio cholerae
MHFIPFNKPPVTGNELKYISQAVSGDKLSGDGPFAKQCEVWLEKHTQTKKALLTPSCTHALELAALLIDIQAGDEVIMPSFTFVSTANAFVLRGAKIVFVDIRPDTMNIDETKIESAITARTKAIVPVHYAGVSCDMGTIMAIANKYKLFVIEDAAQGMMSTYKDQPLGSIGHMAAFSFHETKNYTSGGEGGALLINDQRFIQRAEILREKGTNRSLFFKGMVDKYTWVDIGSSMLPSEIQAAYLYAQMEQAVEINHTRLNIWNSYLNAFSKYQESGVIELPSIPANCQHNAHMFYIKLHNVDIRDKFIIHMKNNSVLTVFHYLPLHSTVAGRKFSYFHGEDIHTTKESEKLVRLPLYFNLKEEDMYRIIDIACDFLDSYSGNKK

SEQ ID NO: 3745 - DNA, 1101 bp, Bordetella avium
  CDS (1)..(1101): transl_table=11
atgcaattcattgatctgaaaaaacagtaccaggcactgcgcgatcccatcaacacgcgcatccagcaggttctcgaccacggccaatacatcatggggccagaggtcaaagaactcgaaacggccctgtccgcctataccggcgccaagcattgcatcaccgtcgcctccggcaccgaagcgttgctcatcgccttgatggccttgggtatcaaggcgggcgacgaagtcatcacgacgtcgttcacctttgtggcgactgccgaggtgatcgcgctgctgggcgccgtgccggtgttcgtcgatgtcgaacccgacacctgcaatatccgggttgacgagatcgaagcgcgcatcacaccgcgcaccaaggccattattccggtatcgctctacggccagtgcggcgatatggacgaggtcaacgccatcgccgataaatacggcatcaccgtcattgaagacgctgcacagagctttggcgcgacctacaagggcaagaagagctgtaatctgtccaccattggctgtaccagcttcttcccgagcaaaccgctaggctgttatggcgacggcggcgcgctgttcacgaacgacgatgcgctcgcccaggccatgcgcgaaatccgcgtacatggccagtccgcccgctactatcacacccgtatcggcgtgggtggccgcatggacacgctgcaatgcgcggtcgtgctgggcaaactcgaacgctttgactgggaagtcgaacaacgcctacgcatcggcgcgcgctatcaggccctcttggcggatctgccagccggcgcgcgcacggtcaccgtacgccctgaccgcgacagcgtttgggcgcaattcacagtcatcgtgcccaatcgggccgccgtcgtggaacaactcaaggccgccggcatcccgacagccatccactatccgcgaccgatccacaagcagccggcttacgaacactttgccagcgagcacggcacgcccaactccgacctcctggccgaccaggtgctcagcctgcctatgcacccggatctggacgaagccacgcaagacaagattgtggccgtattgcgcgaggccctcgccggatga

SEQ ID NO: 3746 - protein, 366 aa, Bordetella avium
MQFIDLKKQYQALRDPINTRIQQVLDHGQYIMGPEVKELETALSAYTGAKHCITVASGTEALLIALMALGIKAGDEVITTSFTFVATAEVIALLGAVPVFVDVEPDTCNIRVDEIEARITPRTKAIIPVSLYGQCGDMDEVNAIADKYGITVIEDAAQSFGATYKGKKSCNLSTIGCTSFFPSKPLGCYGDGGALFTNDDALAQAMREIRVHGQSARYYHTRIGVGGRMDTLQCAVVLGKLERFDWEVEQRLRIGARYQALLADLPAGARTVTVRPDRDSVWAQFTVIVPNRAAVVEQLKAAGIPTAIHYPRPIHKQPAYEHFASEHGTPNSDLLADQVLSLPMHPDLDEATQDKIVAVLREALAG

SEQ ID NO: 3747 - DNA, 1179 bp, Bordetella avium
  CDS (1)..(1179): transl_table=11
atggcattccttccttttgcgcaacccgacatcggcgaagccgagatcgacgccgccgtccaggccatgcgttcgggatggctcaccaccggacccaatgcccgcgccttcgagcaggaattcagcgcattccttggcgaagggctggaagccatcgctgtcaattcggctaccgccggcctgcatctggcgcttgaagccatcggcatcggtgctggcgatgaagtcatcacaacgacgcacacttttacggccagtgccgaagtcgtgcgctatctgggtggcgagcccgtgctggttgacatcgatcccgccacgttctgcatctcgccgtccgccatcgaagcggccatcacgccgcgcaccaaagccatcatccccgtgcattacggcggcctgtcctgtgacatgagcgccattctggcgatcgccgccaaacatagcctgcgggtcatcgaagatgcggcccacgcgctgccctgtacctggaacggccagctgatcggtcaactgggcagcgacgccacggtctacagcttctatgccaccaagacgctcgccacgggcgaaggcggcatggtggtcacccgcaatgcacagctctccaagcgttgccgcgtgatgcgtctgcacggcatcgaccgcgacgcctttgaccgtttcacttcgagcaagcccgcctggtattacgagatcgtcgcgcccggattcaaatacaacctgcccgatccggccgctgccatcggacgggtgcaattgcagcgagtgcgcgccatgcgcgaccgccgtgccgacatcgcggcgcgttatgacagcgctttcgccgatctgccggtacaactgccgccctgcccggctaaactggccgcaggtggcgtctatcaagccagcgacctgcattcttggcatctttacgtactgcgcctgacgccggatgccccctgtgcacgcgacgacttcattgcagggatgtccgagcgcggcatcggctgcagcgtgcattatgtgccgttgcacctgcaaccctattggcgtgatcgttattccttgcgcgctgacatgttcccggcctcgcagacaacctatgagcgcatggtcagcttgccgatctactccaaaatgaacgacgccgacgtcgatcgcgttatcgaggccgtacgtagcttgttgcaatcgtga

SEQ ID NO: 3748 - protein, 392 aa, Bordetella avium
MAFLPFAQPDIGEAEIDAAVQAMRSGWLTTGPNARAFEQEFSAFLGEGLEAIAVNSATAGLHLALEAIGIGAGDEVITTTHTFTASAEVVRYLGGEPVLVDIDPATFCISPSAIEAAITPRTKAIIPVHYGGLSCDMSAILAIAAKHSLRVIEDAAHALPCTWNGQLIGQLGSDATVYSFYATKTLATGEGGMVVTRNAQLSKRCRVMRLHGIDRDAFDRFTSSKPAWYYEIVAPGFKYNLPDPAAAIGRVQLQRVRAMRDRRADIAARYDSAFADLPVQLPPCPAKLAAGGVYQASDLHSWHLYVLRLTPDAPCARDDFIAGMSERGIGCSVHYVPLHLQPYWRDRYSLRADMFPASQTTYERMVSLPIYSKMNDADVDRVIEAVRSLLQS

SEQ ID NO: 3749 - DNA, 1059 bp, Streptomyces natalensis
  CDS (1)..(1059): transl_table=11
atgtcgttcaagtaccccgtgtccaggcccactctggacggccgggagctggagtatgtgaccggtgccgtcggggacggctggatctcgtcccagggcccgatggtcgcgcggttcgagcgtgccttcgcggactacaacggcgtcgcgcacggcgtgtcctgttcgtccgggacggcggcgctcacgctggcgctgcgggcgctgggtatcggcccgggggacgaggtgatcgttccggagttcacgatggtcgcctcggcatgggcggtcacctacaccggtgcgacgcccgtgttcgtggactgcggagacgacctcaatatcgatgtcacgcgtatcgaggagaagatcacggcgcggacgaaggccgtgatgcccgtccacatctatgggcggcggtgcgatatggacgccgtgatggatatcgcgcaccagtacaacctgcgggtcgtggaggacagtgccgaggcccacggtgtccgcccggtcggggacatcgcgtgctactcgctgttcgccaacaaaatcatcacggcgggcgagggcggcatctgcctcaccgacgaccccaggctggccgggcagctggcgcatctgcgcgccatggcgttcaccaaggaccacagtttcctgcacaagaaggtcgcctacaacttccggatgacggcgatgcaggccgccgtcgcgctcgcccaggtcgagcggctggacgacatcctcgccacgcggcgggagatcgagcggcgctatgacgaggggctcgccggagttcccggtatcacgctgatgccgccgcgggacgtgctgtggatgtacgacctgcgggccgaacgccgcgaggagctacgggagttcctggccggtgagtcgatcgagacccggctgttcttcaagccgatgagccggcagcccatgtacttccaccccgactggccctcgctcaaggcgcatacgttcgccgaggacgggctgtatctgcccacccacaccggactgtccgccaccgaccaggacttcgtgatcgaccgggtccgcgcgttctacggcgcgagctga

SEQ ID NO: 3750 - protein, 352 aa, Streptomyces natalensis
MSFKYPVSRPTLDGRELEYVTGAVGDGWISSQGPMVARFERAFADYNGVAHGVSCSSGTAALTLALRALGIGPGDEVIVPEFTMVASAWAVTYTGATPVFVDCGDDLNIDVTRIEEKITARTKAVMPVHIYGRRCDMDAVMDIAHQYNLRVVEDSAEAHGVRPVGDIACYSLFANKIITAGEGGICLTDDPRLAGQLAHLRAMAFTKDHSFLHKKVAYNFRMTAMQAAVALAQVERLDDILATRREIERRYDEGLAGVPGITLMPPRDVLWMYDLRAERREELREFLAGESIETRLFFKPMSRQPMYFHPDWPSLKAHTFAEDGLYLPTHTGLSATDQDFVIDRVRAFYGAS

SEQ ID NO: 3751 - DNA, 1059 bp, Streptomyces griseus
  CDS (1)..(1059): transl_table=11
atggccttcacccatcccgtctcccggcccgctctggacggccgggaactggagtacgtctccgacgccgtctccggcggctggatctcctcccagggaccgtacgtccggcgtttcgaggaagccttcgccgagtggaacggcgtggcgcacggggtggcctgctcctccggcaccgccgccctcaccctggcgctgcgcgcgctgaacatcggcccgggtgacgaggtgatcgtgccggagttcacgatggtcgcctccgcgtgggcggtgacctacaccggcgccaccccggtcttcgtggactgcggcgacgacctgaacatcgacgtcacccgcatcgaggagaagatcactccgcgcacccgggcggtcatgccggtgcacgtctacggccggcgctgcgacatggacgccgtgatggacctcgccctgcagtacaacctgcgggtggtggaggactcggcggaggcgcacggggtccgcccggtcggcgacatcgcctgcttctcgctcttcgccaacaagatcatcacggccggcgaggggggcgtctgcctcaccgacgatccccggctcgccgaacagctggcccatctgcgggcgatggccttcacccgcgaccacagcttcctgcacaagaaactggcctacaactaccggatgacggccatgcagggcgccgtcgccctggcccagaccgagcggctcgacgagatcctcgccacccgccgggagatcgaggcccgctacgacgcggggctcaaggacctccccggcatcaccctgatgcccgcccgcgacgtcctgtggatgtacgacctgcgtgccgagcgccgcgaggaactccgcgcccacctggacgaacgcggcatcgagacccggctgttcttcaagccgatgagccgccagcccggctacctcgacccggtgtggccgacgctcaacgcccaccggttcagcgaggacggcctgtacctgcccacccacaccgggctgaccgccgccgaccaggagtacatcaccggcgccgtccgggacttctaccgcgcgggctga

SEQ ID NO: 3752 - protein, 352 aa, Streptomyces griseus
MAFTHPVSRPALDGRELEYVSDAVSGGWISSQGPYVRRFEEAFAEWNGVAHGVACSSGTAALTLALRALNIGPGDEVIVPEFTMVASAWAVTYTGATPVFVDCGDDLNIDVTRIEEKITPRTRAVMPVHVYGRRCDMDAVMDLALQYNLRVVEDSAEAHGVRPVGDIACFSLFANKIITAGEGGVCLTDDPRLAEQLAHLRAMAFTRDHSFLHKKLAYNYRMTAMQGAVALAQTERLDEILATRREIEARYDAGLKDLPGITLMPARDVLWMYDLRAERREELRAHLDERGIETRLFFKPMSRQPGYLDPVWPTLNAHRFSEDGLYLPTHTGLTAADQEYITGAVRDFYRAG

SEQ ID NO: 3753 - DNA, 1155 bp, Plesiomonas shigelloides
  CDS (1)..(1155): transl_table=11
atgaaaaattttattccttttgcgttacctgaaattggcgaagaagaaattgcagaggtaattgactctttacgttcaggttggattacgacaggtcctaaggctaagcaatttgaacaagaattttctaattacctaggagcgaacgttcaatcattagctgttaactctgctacgtcgggcttacatttggctcttgaagctgttggcgtaaaacctggagaccaagttattgtcccatcatatacattcactgctactgccgaaattgtcaggtaccttggtgctgatcctgtaattgttgatgtagatcgtaaaacatttaatatatcagttgatgccattgagaaggctattactaataaaacaaaggcgattattccagtacacttcgctggattagcttgtgacatggattcaatcttatcaattgctaaaaaatatgacctaaaggttgtcgaggatgccgctcatgcatttcctacaacatataaaggaagtaagataggaacgcttgattcagatgctacggtttttagcttctacgccaataaaactatgacaaccggtgaaggcggaatggttgtttcaaaaaataaagatataattgagcgttgtaaggtaatgcgtttacatggaatcagtcgtgacgcttttgaccggtaccagtctaaaactccttcttggttttatgaggttgtagctccagggtttaaatacaatatgcctgatatctgtgcggcaatcggtattcatcaacttagaaagatcgatgattttcagaaaaaacgtcaacgaatggcaaaaatttacgatgatgcgttaaaagaattgccacttgaattgcctgaatggcctactaatgctagtgatattcatgcttggcatctatatcctatccgcttaaaaactgattcggctattaatcgcgatgattttattaagaagttatcagatcttggaattggttgttctgtccattttataccgttgcataagcaaccggtttggcgtgatacatataatttgaacgccagtgactttccagtttctgaggagtgttatttaaatgaaatatctattcctctttatactaaaatgacggatcaagatcagttgttcgttatcgaatcgattagacaattatttatgtaa

SEQ ID NO: 3754 - protein, 384 aa, Plesiomonas shigelloides
MKNFIPFALPEIGEEEIAEVIDSLRSGWITTGPKAKQFEQEFSNYLGANVQSLAVNSATSGLHLALEAVGVKPGDQVIVPSYTFTATAEIVRYLGADPVIVDVDRKTFNISVDAIEKAITNKTKAIIPVHFAGLACDMDSILSIAKKYDLKVVEDAAHAFPTTYKGSKIGTLDSDATVFSFYANKTMTTGEGGMVVSKNKDIIERCKVMRLHGISRDAFDRYQSKTPSWFYEVVAPGFKYNMPDICAAIGIHQLRKIDDFQKKRQRMAKIYDDALKELPLELPEWPTNASDIHAWHLYPIRLKTDSAINRDDFIKKLSDLGIGCSVHFIPLHKQPVWRDTYNLNASDFPVSEECYLNEISIPLYTKMTDQDQLFVIESIRQLFM

SEQ ID NO: 3755 - DNA, 1155 bp, Shigella sonnei
  CDS (1)..(1155): transl_table=11
atgaaaaattttattccttttgcgttacctgaaattggcgaagaagaaattgcagaggtaattgactctttacgttcaggttggattacgacaggtcctaaggctaagcaatttgaacaagaattttctaattacctaggagcgaacgttcaatcattagctgttaactctgctacgtcgggcttacatttggctcttgaagctgttggcgtaaagccgggagaccaagttattgtcccatcatatacattcactgctactgccgaaattgtcaggtaccttggtgctgatcctgtaattgttgatgtagatcgtaaaacatttaatatatcagttgatgccattgagaaggctattactaatgaaacaaaggcgattattccagtacacttcgctggattagcttgtgacatggattcaatcttatcaattgctaaaaaatatgacctaaaggttgtcgaggatgccgctcatgcatttcctacaacatataaaggaagtaagataggaacgcttgattcagatgctacggtttttagcttctacgccaataaaactatgacaaccggtgaaggcggaatggttgtttcaaaaaataaagatataattgagcgttgtaaggtaatgcgtttacatggaatcagtcgtgacgcttttgaccggtaccagtctaaaactccttcttggttttatgaggttgtagctccagggtttaaatacaatatgcctgatatctgtgcggcaatcggtattcatcaacttagaaagatcgatgattttcagaaaaaacgtcaacgaatggcaaaaatttacgatgatgcgttaaaagaattgccacttgaattgcctgaatggcctactaatgctagtgatattcatgcttggcatctatatcctatccgcttaaaaactgattcggctattaatcgcgatgattttattaagaagttatcagatcttggaattggttgttctgtccattttataccgttgcataagcaaccggtttggcgtgatacatataatttgaacgccagtgactttccagtttctgaggagtgttatttaaatgaaatatctattcctctttatactaaaatgacggatcaagatcagttgttcgttatcaaatcgattagacaattatttatgtaa

SEQ ID NO: 3756 - protein, 384 aa, Shigella sonnei
MKNFIPFALPEIGEEEIAEVIDSLRSGWITTGPKAKQFEQEFSNYLGANVQSLAVNSATSGLHLALEAVGVKPGDQVIVPSYTFTATAEIVRYLGADPVIVDVDRKTFNISVDAIEKAITNETKAIIPVHFAGLACDMDSILSIAKKYDLKVVEDAAHAFPTTYKGSKIGTLDSDATVFSFYANKTMTTGEGGMVVSKNKDIIERCKVMRLHGISRDAFDRYQSKTPSWFYEVVAPGFKYNMPDICAAIGIHQLRKIDDFQKKRQRMAKIYDDALKELPLELPEWPTNASDIHAWHLYPIRLKTDSAINRDDFIKKLSDLGIGCSVHFIPLHKQPVWRDTYNLNASDFPVSEECYLNEISIPLYTKMTDQDQLFVIKSIRQLFM

SEQ ID NO: 3757 - DNA, 1155 bp, Plesiomonas shigelloides
  CDS (1)..(1155): transl_table=11
atgaaaaattttattccttttgcgttacctgaaattggcgaagaagaaattgcagaggtaattgactctttacgttcaggttggattacgacaggtcctaaggctaagcaatttgaacaagaattttctaattacctaggagcgaacgttcaatcattagctgttaactctgctacgtcgggcttacatttggctcttgaagctgttggcgtaaaacctggagaccaagttattgtcccatcatatacattcactgctactgccgaaattgtcaggtaccttggtgctgatcctgtaattgttgatgtagatcgtaaaacatttaatatatcagttgatgccattgagaaggctattactaataaaacaaaggcgattattccagtacacttcgctggattagcttgtgacatggattcaatcttatcaattgctaaaaaatatgacctaaaggttgtcgaggatgccgctcatgcatttcctacaacatataaaggaagtaagataggaacgcttgattcagatgctacggtttttagcttctacgccaataaaactatgacaaccggtgaaggcggaatggttgtttcaaaaaataaagatataattgagcgttgtaaggtaatgcgtttacatggaatcagtcgtgacgcttttgaccggtaccagtctaaaactccttcttggttttatgaggttgtagctccagggtttaaatacaatatgcctgatatctgtgcggcaatcggtattcatcaacttagaaagatcgatgattttcagaaaaaacgtcaacgaatggcaaaaatttacgatgatgcgttaaaagaattgccacttgaattgcctgaatggcctactaatgctagtgatattcatgcttggcatctatatcctatccgcttaaaaactgattcggctattaatcgcgatgattttattaagaagttatcagatcttggaattggttgttctgtccattttataccgttgcataagcaaccggtttggcgtgatacatataatttgaacgccagtgactttccagtttctgaggcgtgttatttaaatgaaatatctattcctctttatactaaaatgacggatcaagatcagttgttcgttatcgaatcgattagacaattatttatgtaa

SEQ ID NO: 3758 - protein, 384 aa, Plesiomonas shigelloides
MKNFIPFALPEIGEEEIAEVIDSLRSGWITTGPKAKQFEQEFSNYLGANVQSLAVNSATSGLHLALEAVGVKPGDQVIVPSYTFTATAEIVRYLGADPVIVDVDRKTFNISVDAIEKAITNKTKAIIPVHFAGLACDMDSILSIAKKYDLKVVEDAAHAFPTTYKGSKIGTLDSDATVFSFYANKTMTTGEGGMVVSKNKDIIERCKVMRLHGISRDAFDRYQSKTPSWFYEVVAPGFKYNMPDICAAIGIHQLRKIDDFQKKRQRMAKIYDDALKELPLELPEWPTNASDIHAWHLYPIRLKTDSAINRDDFIKKLSDLGIGCSVHFIPLHKQPVWRDTYNLNASDFPVSEACYLNEISIPLYTKMTDQDQLFVIESIRQLFM

SEQ ID NO: 3759 - DNA, 1170 bp, Bacillus subtilis
  CDS (1)..(1170): transl_table=11
atggtgcaaaagagaaatcattttctcccttactcattgccgttaatcggtaaggaagaaattcaggaggttacagaaacgcttgaatcgggatggctctctaaaggcccgaaggttcagcagtttgaaaaagagtttgccgcgtttgtcggggcgaagcacgccgtggcggtgaattcatgtaccgcagctttatttttggctttgaaagcaaaagggattgggcccggggacgaggtcattacctctccgcttacgttcagctcgaccgccaatacgattattcatacgggagcgacgcctgtgtttgcggatattgacgaaaacacgctcaatattgacccggtaaagcttgaggcggccgtcacaccgcgaacgaaagcagttgtgcccgtccactttggcgggcagtcctgcgatatggatgcaatattggctgttgcccaaaatcatggtttattcgtgctggaggatgcggcacatgcggtatatacgacttataagcaaagaatgatcggttctatcggggatgcaacggcattcagcttttacgccaccaaaaacctcgcgacaggggaaggcggcatgctgacgactgatgatgaggagcttgccgataagatacgggtgctaagccttcacggcatgagtaaagccgcatggaaccgttattcttcaaatggcagctggtactatgaagtcgaatcgcccggctataagatgaatatgtttgatttgcaggcggccctcggacttcatcagctgaaacggctggatgatatgcagaaacggagagaagagattgccggccgctatcaaaccgcttttcagcagattcctgggctgatcacgccgtttgtccatgatgacggcaggcacgcctggcatctatatgttctgcaagttgatgaaaaaaaggccggggttacgcgcagcgaaatgattacggctttaaaggatgaatacaatatcggcactagcgttcattttattccagtacacattcatccgtattatcaaaagcaatttggatataaggaagcggactttccgaatgccatgaattactataaacgaaccctttctctcccgctctatccatcaatgtctgacgatgatgtagatgatgtcattgaagctgtgcgggatatcgtaaaaggggctgattaa

SEQ ID NO: 3760 - protein, 389 aa, Bacillus subtilis
MVQKRNHFLPYSLPLIGKEEIQEVTETLESGWLSKGPKVQQFEKEFAAFVGAKHAVAVNSCTAALFLALKAKGIGPGDEVITSPLTFSSTANTIIHTGATPVFADIDENTLNIDPVKLEAAVTPRTKAVVPVHFGGQSCDMDAILAVAQNHGLFVLEDAAHAVYTTYKQRMIGSIGDATAFSFYATKNLATGEGGMLTTDDEELADKIRVLSLHGMSKAAWNRYSSNGSWYYEVESPGYKMNMFDLQAALGLHQLKRLDDMQKRREEIAGRYQTAFQQIPGLITPFVHDDGRHAWHLYVLQVDEKKAGVTRSEMITALKDEYNIGTSVHFIPVHIHPYYQKQFGYKEADFPNAMNYYKRTLSLPLYPSMSDDDVDDVIEAVRDIVKGAD

SEQ ID NO: 3761 - DNA, 1161 bp, Methanococcus jannaschii
  CDS (1)..(1161): transl_table=11
atgataagagaaagttttttgccaccatttaggccatgtattggtgaagaagagataaatgaagttatagatacattaaagtcagattggataactatgggtccaaaaacattaaaatttgaagaattgtttagaaattatattggaagtaaatttgcaatatccttaaattcatgcacagccgggttacatctgtcattggttgcattaaatataaaggataaagatgaagtcataactacaccatatacctttgcagcaactgggaacgttatagttcatcaaagggcaaagcccgtatttgttgatattgataaagaaacctataatattaacgttgaggagatagaaaatgccataactgagagaacaaaggcaataattcctgtccattatgcaggacatccatgtgaaatggatgaaatattaaaaatagcaagagactatgatttatatgtaattgaagatgctgcacatgcattgggggcagagtataaaggaaaaaaaataggtactattggagatacaacatcattcagcttttatgcaacaaaaaatataaccactggggaggggggaatggttactactgacaatgaagagattgcagaaaaaataaaaatactgcgactacatgggataagtagagacgcttggaaaagatactcatccgagggctcatggtactatgagattatcgagtgtggttataaatataacatgaccgacattcaagcatcaatcggaatacatcaactaaaaaaagcagagataatgagaaaaagaagagaagaaatcgctaaaatttataatgaagagtttgaaaatcttgaggggttaataactccaaccataaaaaaacatgttaaacatgcatggcacttatatccgttgttaataaatatcgatagattgaagataaacagaaccaaatttattgaagagttaaaaaaacagaatattggaacaagtgttcattttatcccattacacttgcatccattttataggaaaacttttggatataaaaaaggtgattttccaaatgcagagtgggtttatgagagagagatttccttgccaatatatccaaaaatgactgatgatgatgtaattgatgtagttaatgcggttaaaaaaattgtttctgagaacagatga

SEQ ID NO: 3762 - protein, 386 aa, Methanococcus jannaschii
MIRESFLPPFRPCIGEEEINEVIDTLKSDWITMGPKTLKFEELFRNYIGSKFAISLNSCTAGLHLSLVALNIKDKDEVITTPYTFAATGNVIVHQRAKPVFVDIDKETYNINVEEIENAITERTKAIIPVHYAGHPCEMDEILKIARDYDLYVIEDAAHALGAEYKGKKIGTIGDTTSFSFYATKNITTGEGGMVTTDNEEIAEKIKILRLHGISRDAWKRYSSEGSWYYEIIECGYKYNMTDIQASIGIHQLKKAEIMRKRREEIAKIYNEEFENLEGLITPTIKKHVKHAWHLYPLLINIDRLKINRTKFIEELKKQNIGTSVHFIPLHLHPFYRKTFGYKKGDFPNAEWVYEREISLPIYPKMTDDDVIDVVNAVKKIVSENR

SEQ ID NO: 3763 - DNA, 1158 bp, Escherichia coli
  CDS (19)..(1158)
atggcggaaggaaaagcaatgtcagaatttttgcctttttcgcgaccagcaatgggcgtggaggaactcgctgcagttaaagaggttctcgaatccggttggatcacaaccggtccgaagaatcaggcgcttgagcaagctttttgccagttgacgggaaatcagcatgccatcgcggtcagttcagccaccgccggaatgcatatcacgctaatggcgttgaaaattggcaagggcgatgaagtgattacgccttccctgacctgggtttcaaccctcaatatgatttccttgttgggtgcaacgccggtaatggtggatgtcgaccgcgatacgctgatggtcacgcctgaagctatcgagtcagccattacgccacgcactaaagccatcattccggtgcattatgccggtgcgccagcagatattgacgccattcgcgccattggcgaacgttacggcatcgcagttatcgaagatgctgcccatgccgtcggtacgtattacaaagggcgacatattggcgcaaaaggtaccgctattttttcatttcatgccattaaaaatattacctgtgctgaaggtggcctgattgtaactgataatgaaaaccttgcccgccagctacggatgctgaaatttcacggtctgggtgtcgatgcctatgacagacaaacctggggccgtgcaccgcaggctgaagtcttaacaccgggctataagtacaatctgaccgatattaacgccgcgattgccctgacacagttagtcaaattagagcacctcaacacccgtcggcgcgaaattgcccagcaatatcagcaagcactggcagctctcccctttcagccattaagccttcccgcctggccgcacgttcacgcctggcatctgtttattattcgtgtcgatgaacaacgttgtggtatcagtcgcgatgcgttgatggaagcgttaaaagaaagaggcattggtaccgggttacatttccgcgccgctcacacacaaaaatattatcgcgagcgttttcccacgctgtcgttaccgaataccgaatggaatagcgaacgcatctgttctttgccgctgttcccggatatgactaccgccgatgccgaccatgtcatcacagcccttcagcaactcgcaggacaataa

SEQ ID NO: 3764 - protein, 379 aa, Escherichia coli
MSEFLPFSRPAMGVEELAAVKEVLESGWITTGPKNQALEQAFCQLTGNQHAIAVSSATAGMHITLMALKIGKGDEVITPSLTWVSTLNMISLLGATPVMVDVDRDTLMVTPEAIESAITPRTKAIIPVHYAGAPADIDAIRAIGERYGIAVIEDAAHAVGTYYKGRHIGAKGTAIFSFHAIKNITCAEGGLIVTDNENLARQLRMLKFHGLGVDAYDRQTWGRAPQAEVLTPGYKYNLTDINAAIALTQLVKLEHLNTRRREIAQQYQQALAALPFQPLSLPAWPHVHAWHLFIIRVDEQRCGISRDALMEALKERGIGTGLHFRAAHTQKYYRERFPTLSLPNTEWNSERICSLPLFPDMTTADADHVITALQQLAGQ

SEQ ID NO: 3765 - DNA, 22 bp, Artificial sequence
  primer
atgattccatttaacgcaccgc

SEQ ID NO: 3766 - DNA, 27 bp, Artificial sequence
  primer
ttaggaaaagtagttcaacaaagtcgc

SEQ ID NO: 3767 - protein, 367 aa, Artificial sequence
  consensus sequence
  Variant (2)..(7): Xaa in position 2 to 7 is any amino acid
  Variant (9)..(15): Xaa in position 9 to 15 is any amino acid
  Variant (17)..(24): Xaa in position 17 to 24 is any amino acid
  Variant (25)..(26): Xaa in position 25 to 26 is any or no amino acid
  Variant (28)..(28): Xaa in position 28 is any amino acid
  Variant (30)..(31): Xaa in position 30 to 31 is any amino acid
  Variant (33)..(43): Xaa in position 33 to 43 is any amino acid
  Variant (44)..(44): Xaa in position 44 is any or no amino acid
  Variant (50)..(53): Xaa in position 50 to 53 is any amino acid
  Variant (55)..(57): Xaa in position 55 to 57 is any amino acid
  Variant (59)..(65): Xaa in position 59 to 65 is any amino acid
  Variant (68)..(69): Xaa in position 68 to 69 is any amino acid
  Variant (71)..(71): Xaa in position 71 is any amino acid
  Variant (74)..(76): Xaa in position 74 to 76 is any amino acid
  Variant (77)..(77): Xaa in position 77 is any or no amino acid
  Variant (79)..(86): Xaa in position 79 to 86 is any amino acid
  Variant (88)..(89): Xaa in position 88 to 89 is any amino acid
  Variant (92)..(93): Xaa in position 92 to 93 is any amino acid
  Variant (95)..(95): Xaa in position 95 is any amino acid
  Variant (96)..(101): Xaa in position 96 to 101 is any or no amino acid
  Variant (104)..(104): Xaa in position 104 is any amino acid
  Variant (108)..(109): Xaa in position 108 to 109 is any amino acid
  Variant (111)..(121): Xaa in position 111 to 121 is any amino acid
  Variant (123)..(127): Xaa in position 123 to 127 is any amino acid
  Variant (128)..(128): Xaa in position 128 is any or no amino acid
  Variant (130)..(130): Xaa in position 130 is any amino acid
  Variant (135)..(140): Xaa in position 135 to 140 is any amino acid
  Variant (141)..(142): Xaa in position 141 to 142 is any or no amino acid
  Variant (144)..(146): Xaa in position 144 to 146 is any amino acid
  Variant (148)..(154): Xaa in position 148 to 154 is any amino acid
  Variant (155)..(157): Xaa in position 155 to 157 is any or no amino acid
  Variant (160)..(162): Xaa in position 160 to 162 is any amino acid
  Variant (164)..(169): Xaa in position 164 to 169 is any amino acid
  Variant (170)..(170): Xaa in position 170 is any or no amino acid
  Variant (173)..(191): Xaa in position 173 to 191 is any amino acid
  Variant (193)..(202): Xaa in position 193 to 202 is any amino acid
  Variant (203)..(217): Xaa in position 203 to 217 is any or no amino acid
  Variant (219)..(227): Xaa in position 219 to 227 is any amino acid
  Variant (230)..(234): Xaa in position 230 to 234 is any amino acid
  Variant (236)..(244): Xaa in position 236 to 244 is any amino acid
  Variant (246)..(251): Xaa in position 246 to 251 is any amino acid
  Variant (253)..(327): Xaa in position 253 to 327 is any amino acid
  Variant (328)..(365): Xaa in position 328 to 365 is any or no amino acid
GXXXXXXEXXXXXXXGXXXXXXXXXXSXTXXLXXXXXXXXXXXXGDEVIXXXXTXXXTXXXXXXXGAXXVXVDXXXXTXXXXXXXXEXXITXXTXXXXXXXAIXPVHXXGXXXXXXXXXXXAXXXXXXVXEDAAXXXXXXXXGXXXGXXXXXXXXXXSFXXXKXXXXXXXGGXXXXXXXXXXXXXXXXXXXGXXXXXXXXXXXXXXXXXXXXXXXXXGXXXXXXXXXAAXXXXXLXXXXXXXXXRXXXXXXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLP

SEQ ID NO: 3768 - protein, 28 aa, Artificial sequence
  protein pattern
  Variant (2)..(2): Xaa in position 2 is Glu or Gln
  Variant (3)..(3): Xaa in position 3 is Ile or Val
  Variant (5)..(8): Xaa in position 5 to 8 is any amino acid
  Variant (9)..(9): Xaa in position 9 is Ala, Asn, Ser or Thr
  Variant (10)..(11): Xaa in position 10 to 11 is any amino acid
  Variant (12)..(12): Xaa in position 12 is Ala, Ser or Thr
  Variant (13)..(13): Xaa in position 13 is Pro, Ser or Thr
  Variant (14)..(20): Xaa in position 14 to 20 is any amino acid
  Variant (23)..(24): Xaa in position 23 to 24 is any amino acid
  Variant (26)..(26): Xaa in position 26 is any amino acid
  Variant (27)..(27): Xaa in position 27 is Ala or Val
DXXIXXXXXXXXXXXXXXXXGAXXVXXD

SEQ ID NO: 3769 - protein, 29 aa, Artificial sequence
  protein pattern
  Variant (2)..(3): Xaa in position 2 to 3 is any amino acid
  Variant (4)..(6): Xaa in position 4 to 6 is any or no amino acid
  Variant (8)..(8): Xaa in position 8 is Gly, Asn or Thr
  Variant (9)..(10): Xaa in position 9 to 10 is any amino acid
  Variant (12)..(12): Xaa in position 12 is Lys or Arg
  Variant (13)..(13): Xaa in position 13 is Ala, Gly, Ile or Val
  Variant (15)..(15): Xaa in position 15 is any amino acid
  Variant (16)..(16): Xaa in position 16 is Ala, Pro or Val
  Variant (18)..(20): Xaa in position 18 to 20 is any amino acid
  Variant (22)..(28): Xaa in position 22 to 28 is any amino acid
  Variant (29)..(29): Xaa in position 29 is Phe, Ile, Leu or Val
EXXXXXIXXXTXXIXXVXXXGXXXXXXXX

SEQ ID NO: 3770 - DNA, 1023 bp, Escherichia coli
  CDS (1)..(1023): transl_table=11
atgtttcagcagcaaaaagactgggaaacaagagaaaacgcgtttgctgcttttaccatgggaccgctgactgatttctggcgtcagcgtgatgaagcagagtttactggtgtggatgacattccggtgcgctttgtccgttttcgcgcacagcaccatgaccgggtggtagtcatctgcccggggcgtattgagagctacgtaaaatatgcggaactggcctatgacctgttccatttggggtttgatgtcttaatcatcgaccatcgcgggcagggacgttccggtcgcctgttagccgatccgcatctcgggcatgttaatcgctttaatgattatgttgatgatctggcggcattctggcagcaggaggttcagcccggtccgtggcgtaaacgctatatactggcacattcgatgggcggtgcgatctccacattatttctgcaacgccatccaggtgtatgtgacgccattgcgctaactgcgccaatgtttgggatcgtgattcgtatgccgtcatttatggcacggcagatcctcaactgggccgaagcgcatccacgtttccgtgatggctatgcaataggcaccgggcgctggcgcgcgttgccgtttgctatcaacgtactgacccacagcagacagcgatatcgacgtaacttacgcttctatgctgatgacccaacgattcgcgtcggtgggccgacctaccattgggtacgcgaaagtattctggctggcgaacaggtgttagccggtgcgggtgatgacgccacgccaacgcttctcttgcaggctgaagaggaacgcgtggtggataaccgcatgcatgaccgtttttgtgaactccgcaccgccgcgggccatcctgtcgaaggaggacggccgttggtaattaaaggtgcttaccatgagatcctttttgaaaaggacgcaatggcctcagtcgcgctccacgccatcgttgattttttcaacaggcataactcacccagcggaaaccgctctacagaggtttaa

SEQ ID NO: 3771 - protein, 340 aa, Escherichia coli
MFQQQKDWETRENAFAAFTMGPLTDFWRQRDEAEFTGVDDIPVRFVRFRAQHHDRVVVICPGRIESYVKYAELAYDLFHLGFDVLIIDHRGQGRSGRLLADPHLGHVNRFNDYVDDLAAFWQQEVQPGPWRKRYILAHSMGGAISTLFLQRHPGVCDAIALTAPMFGIVIRMPSFMARQILNWAEAHPRFRDGYAIGTGRWRALPFAINVLTHSRQRYRRNLRFYADDPTIRVGGPTYHWVRESILAGEQVLAGAGDDATPTLLLQAEEERVVDNRMHDRFCELRTAAGHPVEGGRPLVIKGAYHEILFEKDAMASVALHAIVDFFNRHNSPSGNRSTEV

SEQ ID NO: 3772 - DNA, 948 bp, Bradyrhizobium sp. ORS278
  CDS (1)..(948): transl_table=11
atgacgctcgtctcgattcccgccaatcccgtgcccgagaacgccaccgccggcaccatcaagacccctgatggcgccgagctgcgctttgcgcgctgggcgccgcccgcggggcgcaagggcaccgtttgcgtcttcaccggccgcagcgagatgatcgagaagtatttcgagacggtgcgcgatttgcgcgatcgcggcttcgcggtcgccatcatcgactggcgcggccagggccactcgtcgcggcggctgcgcgactcccgcaagggctacgtccgctcgttctccgactacgagctcgacgtcgagaccttcgtcaccgaggtcgtgctgcccgattgtccgccgccttacttcgcgctggcgcattcgatgggcggcacggtgctgctgcggctcgcgcattccggcaagcgctggttcgaccgcgtggtgctgtcggcgccgatgatcgacctgccgggcaagcgcacgtcgctgccggctcggctcctgctccgcgcgatgcgcatcgcggggcagggcggccgcaccgtgccgggtggcaacgacgagatcagcgggctggcgccgttcgtcaacaatccgctgacgtccgatcccgtccgctatgcccgcaacgccgcgatcctcgaggaggatccgacgctcggcatcgcctcgccgacggtcgcctgggccgacgcggcgttctcggcgatggcgaccttccgcggcatgacctatccgtcgcagatccgccagccgatcctgatgctcgcggcctcgagcgacaccgtggtgtcgaccgcggccatcgaggaattcgcctatcatctgcgcgccggctcgcacctcgtcatcgccggcgccaagcacgagatcctgcaggagcaggaccgctaccgttcgcagttctgggccgccttcgacgcctttgtgccgggcacgccgctgttcggctga

SEQ ID NO: 3773 - protein, 315 aa, Bradyrhizobium sp. ORS278
MTLVSIPANPVPENATAGTIKTPDGAELRFARWAPPAGRKGTVCVFTGRSEMIEKYFETVRDLRDRGFAVAIIDWRGQGHSSRRLRDSRKGYVRSFSDYELDVETFVTEVVLPDCPPPYFALAHSMGGTVLLRLAHSGKRWFDRVVLSAPMIDLPGKRTSLPARLLLRAMRIAGQGGRTVPGGNDEISGLAPFVNNPLTSDPVRYARNAAILEEDPTLGIASPTVAWADAAFSAMATFRGMTYPSQIRQPILMLAASSDTVVSTAAIEEFAYHLRAGSHLVIAGAKHEILQEQDRYRSQFWAAFDAFVPGTPLFG

SEQ ID NO: 3774 - DNA, 978 bp, Mesorhizobium loti MAFF303099
  CDS (1)..(978): transl_table=11
atgacggaccttctccacgacacgccgcttttccatgaaactgagggcaatccgcgaccggaaaacgctaccggcggctttttcattacgcgcgaccgcaagaagatccgctatggcctcttcgcggcggtggcgcgcccgatgcggggcaccgtggtgctcctgtccggccgcaacgagtgcatcgagaaatatttcgaaaccatccgcgaccttgccgcccgcggctttggtgtcgccacgctcgattggcgcggccagggcgattccgaccggctgatccgcgatcgccagcgcggctatgtcaggtccttccgcgactacacggccgatctggagcagttcttcgaggagatcgtgctgcccgattgccgcgggccgtattacatcctcgcccattcagccggagcggtgatcgcgctgcttgccgcgccgtcgatggtgaaccgcgtgcggcgcatggtgctgatcgcgccattcctgacgttgcccgacctgccggtctcgatccgaacggtccgccgcgtctgttcggtcttctgcgctttggggctcggccggctctatgccgcctggggtccacggcccagacacacgctgccgttcgaggccaacaaggtaacgtcggatccgcggcgctaccgccgcaacacgcgcatctacgaagagtatccgcgaatggcgcttggcggtccgacgatccgctggctgcaggcggcggcgaaggcgtcggaagccatcagcgaccccgacttcatggcccgcatacaggtgcctctgctgatcatcgccgccggcgccgaccgggtcgtctcgaccagggcggtggaagcctatgccagaagcctgaggctcggttcgctgctgatgatcgacggctccaagcacgaaatcctgcaagaggtcgatctctaccgcgaacaattccttgccgccttcgacgccttcatccccggctcggacgacccgacggcctga

SEQ ID NO: 3775 - protein, 325 aa, Mesorhizobium loti MAFF303099
MTDLLHDTPLFHETEGNPRPENATGGFFITRDRKKIRYGLFAAVARPMRGTVVLLSGRNECIEKYFETIRDLAARGFGVATLDWRGQGDSDRLIRDRQRGYVRSFRDYTADLEQFFEEIVLPDCRGPYYILAHSAGAVIALLAAPSMVNRVRRMVLIAPFLTLPDLPVSIRTVRRVCSVFCALGLGRLYAAWGPRPRHTLPFEANKVTSDPRRYRRNTRIYEEYPRMALGGPTIRWLQAAAKASEAISDPDFMARIQVPLLIIAAGADRVVSTRAVEAYARSLRLGSLLMIDGSKHEILQEVDLYREQFLAAFDAFIPGSDDPTA

SEQ ID NO: 3776 - DNA, 954 bp, Pasteurella multocida subsp. multocida str. Pm70
  CDS (1)..(954): transl_table=11
atgatccgtgaaccccattttactcactttgccttggctgaattacatccttttgcagcacaatttccgttgcaagacgtacaagggaaaaaaggggtacgtattacctatcggcattttgtacaagacaatcccgtacagcgtaatttggtgattttagtcaatggacgtgcagaaaacttattgaaatggactgaactggcttatgatttctatcaacaaggctacgacgtcttggtatttgatcatcgtgggcaaggctattcacagcgtttattgccagatcatgagaaaggttatattgatgagtttcgtttttatgcggacgatatggcgattttattagcgaaaatcagcgcactttatccttatgaaaatcaacatattctcgcccattccttaggtgcattgattagtacttattaccttgccaattacgatcatcaggtgaaaagtgcggtcttttctgcgccattttatggcattcctctcaaacattctttccgagatgagctcattattaatctaatgatgttattaggtcagggttcacgctatgtgtttggcaaaggacgttatcaaccggcggatttggataataatgatttaagttgttgtcgaactcgtatgcgctggatgaatcgaattaatcgtcggtatccgcatattcatttagggggaccgaccttccgttgggtgcatttatgttttagtgccattaaaaaattaccgactattttgccgcgtattgagattcctgtgctgattctacaatcggagaaagaaaagattgtggaaaataaaaatctgcgcaaactcaccgcacttttaccacgaggagagttaacacaaattgcgcaaagtaaacacgaaattttatttgagcgtgatcttatccgctccgaggcactcaagaaaattagccaattttttactgccaatagcgccaaataa

SEQ ID NO: 3777 - protein, 317 aa, Pasteurella multocida subsp. multocida str. Pm70
MIREPHFTHFALAELHPFAAQFPLQDVQGKKGVRITYRHFVQDNPVQRNLVILVNGRAENLLKWTELAYDFYQQGYDVLVFDHRGQGYSQRLLPDHEKGYIDEFRFYADDMAILLAKISALYPYENQHILAHSLGALISTYYLANYDHQVKSAVFSAPFYGIPLKHSFRDELIINLMMLLGQGSRYVFGKGRYQPADLDNNDLSCCRTRMRWMNRINRRYPHIHLGGPTFRWVHLCFSAIKKLPTILPRIEIPVLILQSEKEKIVENKNLRKLTALLPRGELTQIAQSKHEILFERDLIRSEALKKISQFFTANSAK

SEQ ID NO: 3778 - DNA, 1023 bp, Escherichia coli O157:H7 EDL933
  CDS (1)..(1023): transl_table=11
atgtttcagcagcaaaaagactgggaaacaagagaaaacgcgtttgctgcttttaccatgggaccgctgactgatttctggcgtcagcgtgatgaagcagagtttactggtgtggatgacattccggtgcgctttgtccgttttcgcgcacagcaccatgaccgggtggtagtcatctgcccggggcgtattgagagttacgtaaaatatgcggaactggcctacgatttgttccatttggggtttgatgtcttaatcatcgaccatcgcgggcagggacgttccggtcgcctgttagccgatccgcatctcgggcatgttaatcgctttaatgattatgttgatgatctggcggcattctggcaacaggaggtccagcccggtccgtggcgtaaacgctatatactggcacattcgatgggcggtgcgatctccacattatttctgcaacgccatccaggtgtatgtgacgccattgcgctaactgcgccaatgtttgggatcgtgattcgtatgccgtcatttatggcacggcagatcctcaactgggccgaagcgcatccacgtttccgtgatggctatgcaataggcaccgggcgctggcgcgcgttgccgtttgctatcaacgtactgacccacagcagacagcgatatcgacgtaacttacgcttctatgctgatgacccaacgattcgcgtcggtgggccgacctaccattgggtacgcgaaagtattctggctggcgaacaggtgttagccggtgcgggtgatgacgccacgccaacgcttctcttgcaggctgaagaggaacgcgtggtggataaccgcattcatgaccgtttttgtgaactccgcaccgccgcgggccatcctgtcgaagggggacgaccgctggtaattaaaggtgcgtaccatgagatcctttttgaaaaggacgcaatgcgctcagttgcgctccacgccatcgttgattttttcaacaggcataactcacccagcggaaaccgctctacagaggtttaa

SEQ ID NO: 3779 - protein, 340 aa, Escherichia coli O157:H7 EDL933
MFQQQKDWETRENAFAAFTMGPLTDFWRQRDEAEFTGVDDIPVRFVRFRAQHHDRVVVICPGRIESYVKYAELAYDLFHLGFDVLIIDHRGQGRSGRLLADPHLGHVNRFNDYVDDLAAFWQQEVQPGPWRKRYILAHSMGGAISTLFLQRHPGVCDAIALTAPMFGIVIRMPSFMARQILNWAEAHPRFRDGYAIGTGRWRALPFAINVLTHSRQRYRRNLRFYADDPTIRVGGPTYHWVRESILAGEQVLAGAGDDATPTLLLQAEEERVVDNRIHDRFCELRTAAGHPVEGGRPLVIKGAYHEILFEKDAMRSVALHAIVDFFNRHNSPSGNRSTEV

SEQ ID NO: 3780 - DNA, 1092 bp, Clostridium acetobutylicum ATCC 824
  CDS (1)..(1092): transl_table=11
atgaggaagttaagtaagaaggtttttttgatttttgctgtaacaacaatttttattcttggaaattcagcttgggataggaccatagcatctgaagaggataattctatgattgatggaaaacctaaagagtattatataagtgaaaaaaactataaaagagaaataaagcaagttgaaaattatcttagtgctaggcgagaatcagggcattttattggaaaggaaaatatagatatttactacgaaaaatatgttataccaaattcaaagaattcaattgtaatatcccatgggtttagggagagtatggtaaagtataatgaaacaatatattattttttgaaaaatggatattccgtatatggattggaacatagaggccatgcaagatcaggtagattaggaaaagattcaacacaaacaagtgtagataattttgattattatgtagatgattttaaaaaatatgttgatactatagtagaaccggataatagagggaaaaatttattcttatatgcacattctatgggaggagcaattggaggcttatttctagaaaggtatcctaaatatttcaaagccgcagttttaagttctccaatgtttgaggtagatacgggaagataccctgaatttttgtcaagagctgttgcaagtgtatttaactttgtgaatttaggagatacatatgctcctggtcaccatgagtattcttgtgaatcggattttgaaaattcctgcacaacaagtaatattagatatgattattatttagataaaactaacaagagtagaaaaattgaaaatggtggagcttcgtttaagtgggtaaaggaatctttaaaggcaacagatgaggttacagacggaaaaaatgcatcaaaagtaactattccagtgttgttatttcaagccgaaaatgatgatatagtaaggccaggaggacaagataagtttgcaaaagaagctaagaagtgtaaactaatagtgattaagaattcaaagcatgaaatatatagagaaaaggatagtataatggttccatatttcaataaggtatttacttttcttaataacaataagtag

SEQ ID NO: 3781 - protein, 363 aa, Clostridium acetobutylicum ATCC 824
MRKLSKKVFLIFAVTTIFILGNSAWDRTIASEEDNSMIDGKPKEYYISEKNYKREIKQVENYLSARRESGHFIGKENIDIYYEKYVIPNSKNSIVISHGFRESMVKYNETIYYFLKNGYSVYGLEHRGHARSGRLGKDSTQTSVDNFDYYVDDFKKYVDTIVEPDNRGKNLFLYAHSMGGAIGGLFLERYPKYFKAAVLSSPMFEVDTGRYPEFLSRAVASVFNFVNLGDTYAPGHHEYSCESDFENSCTTSNIRYDYYLDKTNKSRKIENGGASFKWVKESLKATDEVTDGKNASKVTIPVLLFQAENDDIVRPGGQDKFAKEAKKCKLIVIKNSKHEIYREKDSIMVPYFNKVFTFLNNNK

SEQ ID NO: 3782 - DNA, 942 bp, Agrobacterium tumefaciens str. C58
  CDS (1)..(942): transl_table=11
atgatcgaagccacattgcgcgccagtgaagacaacccggttcccggcaaccagaccgtcggatattttaccggccacggcggcaaacagcttcgttatgcgatctttcgcgccacccgctccattgcccgcggaacagtggttctgctgcacggcaggaacgaatgtatcgagaaatatttcgaaacggtcgccgatctgacggccatgggcttctgggtcgcgacattcgacacgcgcgggcagggcggttccgaaaggctcctgaaaaagcccggcgtcgggcatgtgcggcgcttttccgattatcagcgcgatatcagcctgtttctcgagcaggttgtcctgccggatacgcggctgcccttcttcatgatcgcccattccaccggcgcgcttgcggccctcgcggccgcgcccggcctgtcgaaccggatcgaccgtctggcgctgtgttcgcctttcatcgagctggatagtcagcaatcggttccacggtccgtcatccggctggttgcgacggccttgagccttgtcggcctgggcagggttcagctcggcagggaccagcgcgagcgggatttcgacggcaatccattgacctcggacgccagacgttttgcaaggaatctgaccctgcaccgacagtttccggaactgttcatcggcgcgccgacggcgcgctgggtctatgaagcgctgaagaccatggggcgagtgacccgccaggatcacctgacgaacatcaccgttccgaccctcattctggcgccgatgctggatacgattacgccctataaggcgcaggaagagctttcgcgcaatttccgggcagcacagcttcttccgataaccggcgcgcgccacgaattgctgcatgagcgcgacgttttccgcaaacaggcgctggcggccatcgacgcgtttttcgcgccggagtga

SEQ ID NO: 3783 - protein, 313 aa, Agrobacterium tumefaciens str. C58
MIEATLRASEDNPVPGNQTVGYFTGHGGKQLRYAIFRATRSIARGTVVLLHGRNECIEKYFETVADLTAMGFWVATFDTRGQGGSERLLKKPGVGHVRRFSDYQRDISLFLEQVVLPDTRLPFFMIAHSTGALAALAAAPGLSNRIDRLALCSPFIELDSQQSVPRSVIRLVATALSLVGLGRVQLGRDQRERDFDGNPLTSDARRFARNLTLHRQFPELFIGAPTARWVYEALKTMGRVTRQDHLTNITVPTLILAPMLDTITPYKAQEELSRNFRAAQLLPITGARHELLHERDVFRKQALAAIDAFFAPE

SEQ ID NO: 3784 - DNA, 984 bp, Sinorhizobium meliloti 1021
  CDS (1)..(984): transl_table=11
atgaccacgctccttcactcgatgccggaaaatccgatgccgggcgatccggtggttggctttttcgacggagcccgcaaccgcaagatccgctacgcggtgttcaggtcgaaggccccggtcattcgcggcaccatcgtcctgctgcagggtcgcaacgagtcgatcgagaaatacttcgaaacgatcggcgatctcatggcggccggtttctgggtcgcgaccttcgactggcgcggacagggcggctccgagcggctgtcgccgcaatggacccacggccatgtggaggatttcaccgattacgagcgcgacctgacgatttttctcgatgagatcgtccttcccgacacccgcctgcccttctcgatcgtcgcccattcgatgggggcgctcgtcgccctgtcgctcgctcccatgctcgcaagccgcatcgaccggatggtgctgcttgcccccttcgtcggtctggggggccaggcgatcggcgaacggggtatcgcagcgatcgcgacggtcatgcgctggatcggcctcgggaggctggcgctgagttccgacaaaggcaacggtaccccttttaggggcaatgttctgaccgcggacgaccggcgctacgcccgcaacctggcgctcatcgatgcgcgtccgcaactgcgggtcggaccgcccacggcccgctggctgagcgaggccttccgaacgatccggcgcgtcctcaagcacgaacatctgacgaggatcaccataccggccgtcatactcgccccgacggccgataagctcgtgccgtatctcccggtcgagcggttggccagcaatttccgtgcggggcatctgatcccgatcgacggcgcgcggcacgaactcctgcaggaggccgaccgctatcgcgcccaggcgatggccgcgatcctggcctttctgccgggcgccgatgcggaggaccccgcgtccctgccgcgacagttggaagaggcttaa

SEQ ID NO: 3785 - protein, 327 aa, Sinorhizobium meliloti 1021
MTTLLHSMPENPMPGDPVVGFFDGARNRKIRYAVFRSKAPVIRGTIVLLQGRNESIEKYFETIGDLMAAGFWVATFDWRGQGGSERLSPQWTHGHVEDFTDYERDLTIFLDEIVLPDTRLPFSIVAHSMGALVALSLAPMLASRIDRMVLLAPFVGLGGQAIGERGIAAIATVMRWIGLGRLALSSDKGNGTPFRGNVLTADDRRYARNLALIDARPQLRVGPPTARWLSEAFRTIRRVLKHEHLTRITIPAVILAPTADKLVPYLPVERLASNFRAGHLIPIDGARHELLQEADRYRAQAMAAILAFLPGADAEDPASLPRQLEEA

SEQ ID NO: 3786 - DNA, 981 bp, Caulobacter crescentus CB15
  CDS (1)..(981): transl_table=11
atggaggaaccggcgcctctggtctcgattcccgaggccccggttcccgaccacggcaaggctgaatggttccgcggcgcggatggggcgaccctccgcgccgcgacgtttttcccggcaggccccgcccggggttcggtggtgctcagccccggacgcagcgagccgcttgagaagtatttcgaggtcgtcgacgaccttttggcgcgcgatttcgccgtcttgctgcatgactggcgagggcaggggctgtcggcccgcgccttgccggaccgcctgaagggtcacgcgcgcggcttcaagaccttcgtttccgactacgaggcgctgctcgatgcgttcgagacgcggatgcctaagccctggatcgcggtcagccattcgatgggcggttgcctgacgaccctggccctggcccagggcgagacacgtttcgccgccgccgtgttgtcggcgccgatgctgggcctcaacaccgccggcgtgccgccgtggctggcgcggcctctggctttcgtgatgtcgcgggtgggtttggccggcgagtacgtgcagacgccgtatgacccgctgacccagaccttccagggcgacggtctgacccacgatgagacgcgctatgatcgctaccaggcgcaactgcgcgcccaccccgagatcgctctggggggcatgacctggggctgggctgatttcgccatctcagcgtgcgcgtggctcaggcgcagcaagtcggtcgaagcgatcgcgattccggtgatcattctcggcgctgaactcgacaaccgcgtgctgaacgccgactccgagtcgatcgcacgacgtatcccgaaggggcgctatgtcgaggtccccggggccttccacgagattctggtcgagaccgacgcccgccgcgcgctgttctggcaggccttcgacgagacggtcgatccgatcgctgcgcgcgaaccgcttatttcgccgaacgtctcagactga

SEQ ID NO: 3787 - protein, 326 aa, Caulobacter crescentus CB15
MEEPAPLVSIPEAPVPDHGKAEWFRGADGATLRAATFFPAGPARGSVVLSPGRSEPLEKYFEVVDDLLARDFAVLLHDWRGQGLSARALPDRLKGHARGFKTFVSDYEALLDAFETRMPKPWIAVSHSMGGCLTTLALAQGETRFAAAVLSAPMLGLNTAGVPPWLARPLAFVMSRVGLAGEYVQTPYDPLTQTFQGDGLTHDETRYDRYQAQLRAHPEIALGGMTWGWADFAISACAWLRRSKSVEAIAIPVIILGAELDNRVLNADSESIARRIPKGRYVEVPGAFHEILVETDARRALFWQAFDETVDPIAAREPLISPNVSD

SEQ ID NO: 3788 - DNA, 996 bp, Brucella melitensis 16M
  CDS (1)..(996): transl_table=11
atgtcggaactgctttttgaaaccgatgcaaatccgatcccgagccgaataagaggcggtcttttccatgcgccggacgggaaggccctgcgctactccctgctgaaagccgaaagccggccgtgccggggcacggtcatcgtgcttcagggccgcaacgaattcatcgaaaattattatgaaaccatgtccgacctcgccgggcgcggttttaccgttgccaccttcgactggcgcggccagggcggctcgcatcgcctgctgcgcgaccgcctgcgcggctatgtgcgcagcttcaacgattatgccgacgatctcgaccatttcctgaccggaatcgtgctgcccgactgcccgccgccatttttcattctcgctcactcggcaggtgcgctggtcgcgctttcctcactggaacggctctcctcccgcatcacccgcatggtgctttgcgcgcccctgatggggcttggcggacagaaaatcagcgatgacaatgtgcgccgcattaccgccgcgctgcgctggatcggcctggggagaatctatgcggcaggcgggcgcaccctgtcggcggcgcgcgcctttgccgacaatccactgaccagtgatccgttacggttcatgcgcaatgtggaaatcacacggacttatacggacctcgcgcttggcggccccaccgtgcgctgggtctggagcgcactggaaaccgcatggcgcatcaaccagccggatttttacaaaagccccatcgcgccggttctgattatcgcggctggtgctgaccgcgttgtttcaacagcggtgatcgagcgtttcgtggcgcgcacgcgaaacatctcgctcgccgttattgacggtgcgcgccacgaaatgctccaggaagcagatttctaccgcgaacaggtgctggcggctttcgacgccttcatccccggctcatcgccggtggaatccatgccccaaagtcttgaacccgacctctctcaaatctaa

SEQ ID NO: 3789 - protein, 331 aa, Brucella melitensis 16M
MSELLFETDANPIPSRIRGGLFHAPDGKALRYSLLKAESRPCRGTVIVLQGRNEFIENYYETMSDLAGRGFTVATFDWRGQGGSHRLLRDRLRGYVRSFNDYADDLDHFLTGIVLPDCPPPFFILAHSAGALVALSSLERLSSRITRMVLCAPLMGLGGQKISDDNVRRITAALRWIGLGRIYAAGGRTLSAARAFADNPLTSDPLRFMRNVEITRTYTDLALGGPTVRWVWSALETAWRINQPDFYKSPIAPVLIIAAGADRVVSTAVIERFVARTRNISLAVIDGARHEMLQEADFYREQVLAAFDAFIPGSSPVESMPQSLEPDLSQI

SEQ ID NO: 3790 - DNA, 990 bp, Clostridium perfringens str. 13
  CDS (1)..(990): transl_table=11
atgtgtaaaactttaaatagaaaatatatttataaatatggggagaaaaaagaggatgtagaaatagttgaaaatatgctaaataggatgagaaatagtggaacttttaaaggagagaattttgctaatatatattatgaaaaatacatagtggaagaatcggataaagcaatagttatatgtcatgggttttcggaatgtatagagaagtatcatgaaataatatactattttctaaatgaaggtttttcagtttatataatggaacatagaggtcatgggagatcaggctgtttaagtaaatcttgtaatacacaggtggaagtagaatcctttgattactatgttaaagatctaaagacatttttaaatgaggttgtattaaaagataagaggtttaataataatttatatttatttgcacattctatggggggagctataggtactatatttttagaaaataatcatgggtattttaagaaggtaattttaaattctccaatgtttagaataaatacaagagaatactctcatataaaatgcaaattaatagctaaatttttaattcttatgggaaaaggagagaattttatttttggacaaaaaccctttgaggaagaggagaatttagaggcatcaggaacatcagataaacttagacatggcttataccataaatttctcctagaaaatcctattttgagaagaggtggaggctctattcattggtataaagaagctgcaagggcaactgattgtttaatgaaaaagagaaatatagagagaattgacacgcctattttattatttaaaagtgagtttgattcctatgttgacacaaaatttcatgatgagtttaaaaaggtagctaagtattgtgagcttattgaagttaagggaagtaaacatgagggattttttgaaaaagatgaaattctttatgattatttagataagatatttaaatttttagaggaaaataattag

SEQ ID NO: 3791 - protein, 329 aa, Clostridium perfringens str. 13
MCKTLNRKYIYKYGEKKEDVEIVENMLNRMRNSGTFKGENFANIYYEKYIVEESDKAIVICHGFSECIEKYHEIIYYFLNEGFSVYIMEHRGHGRSGCLSKSCNTQVEVESFDYYVKDLKTFLNEVVLKDKRFNNNLYLFAHSMGGAIGTIFLENNHGYFKKVILNSPMFRINTREYSHIKCKLIAKFLILMGKGENFIFGQKPFEEEENLEASGTSDKLRHGLYHKFLLENPILRRGGGSIHWYKEAARATDCLMKKRNIERIDTPILLFKSEFDSYVDTKFHDEFKKVAKYCELIEVKGSKHEGFFEKDEILYDYLDKIFKFLEENN

SEQ ID NO: 3792 - DNA, 1014 bp, Yersinia pestis KIM
  CDS (1)..(1014): transl_table=11
atgctgttaggtcatcacatgaataattggttaacccgagaagagcaatttgctgcttttattaatgggccattgttggatttctggcagcaacgagacgaacagacgtttatgggcgtcgataatatccccattcgctatgtccgttttcgtgcgccgcatcatacccaagtcgtggtggtagtgccggggcgtatcgaaagttacgtcaaataccctgaagttgcttatgacctgttccagcagggctatgatgtgatagtgctggatcatcgcgggcaagggcgttctgggcgtatgctggatgatcataaccgtggtcacgtgattaagttcgatgactatattgaggattttgcacaactggtgcagatcgaaattaccggtagccattatcagcagcgttttgcgctggcccactcaatggggggcgcgattctgacgcgttttctagccagagagcctgatgtatttaatgccgttgcgttatgtgcgcccatgtttggtattcatttacccctgccgggctggttggcacgccgtattgttaactgggccgaagggcaccaaaagctacgggattattacgcgattggtactgggcattggcggccactgccgtatttggtcaatatgctgactcacagccgcgagcgttatcgccgctatttgcgccaatattcagacacaccagaaatccgcgtgggtggccccacttaccattggctacgtgaaagtttgctggtgggggagcaaattattgctgaagcggagaaaatcaccactccggtattattgttacaggccagtgaggatcgggtggttcataacccagcccacgatgctttttctcaggcaatgacattggcagggcacccctgtgaaggggggcgtcctcaggtcattcaaggcgcacgccatgagatcctgtttgagcgggacacgctgcgtgccgaggcgcttagcgccatattgcgctttttcgcgcaacatcaatcatcagtcggccattag

SEQ ID NO: 3793 - protein, 337 aa, Yersinia pestis KIM
MLLGHHMNNWLTREEQFAAFINGPLLDFWQQRDEQTFMGVDNIPIRYVRFRAPHHTQVVVVVPGRIESYVKYPEVAYDLFQQGYDVIVLDHRGQGRSGRMLDDHNRGHVIKFDDYIEDFAQLVQIEITGSHYQQRFALAHSMGGAILTRFLAREPDVFNAVALCAPMFGIHLPLPGWLARRIVNWAEGHQKLRDYYAIGTGHWRPLPYLVNMLTHSRERYRRYLRQYSDTPEIRVGGPTYHWLRESLLVGEQIIAEAEKITTPVLLLQASEDRVVHNPAHDAFSQAMTLAGHPCEGGRPQVIQGARHEILFERDTLRAEALSAILRFFAQHQSSVGH

SEQ ID NO: 3794 - DNA, 996 bp, Brucella suis 1330
  CDS (1)..(996): transl_table=11
atgtcggaactgctttttgaaaccgatgcaaatccgatcccgagccgaataagaggcggtcttttccatgcgccggacgggaaggccctgcgctacgccctgctgaaagccgaaagccggccgtgccggggcacggtcatcgtgcttcagggccgcaacgaattcatcgaaaattattatgaaaccatgtccgacctcgccgggcgcggttttaccgttgccaccttcgactggcgcggccagggcggctcgcatcgcctgctgcgcgaccgcctgcgcggctatgtgcgcagcttcaacgattatgccgacgatctcgaccatttcctgaccggaatcgtgctgcccgactgcccgccgccatttttcattctcgctcactcggcaggtgcgctggtcgcgctttcctcactggaacggctctcctcccgcatcacccgcatggtgctttgcgcgcccctgatggggcttggcgggcagaaaatcagcgatgacaatgtgcgccgcattaccgccgcgctgcgctggatcggcctggggagaatctatgcggcaggcgggcgcaccctgtcggcggcgcgcgcctttgccgacaatccactgaccagtgatccgttacggttcatgcgcaatgtggaaatcacacggacttatacggacctcgcgcttggcggccccaccgtgcgctgggtctggagcgcactggaaaccgcatggcgcatcaaccagccggatttttacaaaagccccatcgcgccggttctgattatcgcggctggtgctgaccgcgttgtttcaacagcggtgatcgagcgtttcgtggcgcgcacgcgaaacatctcgctcgccgttattgacggtgcgcgccacgaaatgctccaggaagcagatttctaccgcgaacaggtgctggcggctttcgacgccttcatccccggctcatcgccggtggaatccatgccccaaagtcttgaacccgacctctctcaaatctaa

SEQ ID NO: 3795 - protein, 331 aa, Brucella suis 1330
MSELLFETDANPIPSRIRGGLFHAPDGKALRYALLKAESRPCRGTVIVLQGRNEFIENYYETMSDLAGRGFTVATFDWRGQGGSHRLLRDRLRGYVRSFNDYADDLDHFLTGIVLPDCPPPFFILAHSAGALVALSSLERLSSRITRMVLCAPLMGLGGQKISDDNVRRITAALRWIGLGRIYAAGGRTLSAARAFADNPLTSDPLRFMRNVEITRTYTDLALGGPTVRWVWSALETAWRINQPDFYKSPIAPVLIIAAGADRVVSTAVIERFVARTRNISLAVIDGARHEMLQEADFYREQVLAAFDAFIPGSSPVESMPQSLEPDLSQI

SEQ ID NO: 3796 - DNA, 1023 bp, Shigella flexneri 2a str. 301
  CDS (1)..(1023): transl_table=11
atgtttcagcagcaaaaagactgggaaacaagagaaaacgcgtttgctgcttttaccatgggaccgctgactgatttctggcgtcagcgtgatgaagcagagtttactggtgtggatgacattccggtgcgctttgtccgttttcgcgcacagcaccatgaccgggtggtagtcatctgcccggggcgtattgagagctacgtaaaatatgcggaactggcctacgacctgttccatttggggtttgatgtcttaatcatcgaccatcgcgggcagggacgttccggtcgcctgttagccgatccgcatctcgggcatgttaatcgctttaatgattatgttgatgatctggcggcattctggcagcaggaggttcagcccggtccgtggcgtaaacgctatatactggcacattcgatgggcggtgcgatctccacattatttctgcaacgccatccaggtgtatgtgacgccattgcgctaactgcgccaatgtttgggatcgtgattcgtatgccgtcatttatggcacggcagatcctcaactgggccgaagcgcatccacgtttccgtgatggctatgcaataggcaccgggcgctggcgcgcgttgccgtttgctatcaacgtactgacccacagcagacagcgatatcgacgtaacttacgcttctatgctgatgacccaacgattcgcgtcggtgggccgacctaccattgggtacgcgaaagtattctggctggcgaacaggtgttagccggtgcgggtgatgacgccacgcaaacgcttctcttacaagctgaagaggaacgcgtggtggataaccgcatgcacgaccgtttttgtgaactccgcaccgccgcgggccatcctgtcgaaggaggacggccgttggtaataaaaggtgcttaccatgagatcctttttgaaaaggacgcaatgcgctcagtcgcgctccacgccatcgttgattttttcaacaggcataactcacccagcggaaaccgctctacagaggtttaa

SEQ ID NO: 3797 - protein, 340 aa, Shigella flexneri 2a str. 301
MFQQQKDWETRENAFAAFTMGPLTDFWRQRDEAEFTGVDDIPVRFVRFRAQHHDRVVVICPGRIESYVKYAELAYDLFHLGFDVLIIDHRGQGRSGRLLADPHLGHVNRFNDYVDDLAAFWQQEVQPGPWRKRYILAHSMGGAISTLFLQRHPGVCDAIALTAPMFGIVIRMPSFMARQILNWAEAHPRFRDGYAIGTGRWRALPFAINVLTHSRQRYRRNLRFYADDPTIRVGGPTYHWVRESILAGEQVLAGAGDDATQTLLLQAEEERVVDNRMHDRFCELRTAAGHPVEGGRPLVIKGAYHEILFEKDAMRSVALHAIVDFFNRHNSPSGNRSTEV

SEQ ID NO: 3798 - DNA, 990 bp, Shewanella oneidensis MR-1
  CDS (1)..(990): transl_table=11
atgagccaaacgccatcagttttttcaacggaacacgatttaaatacctctgaacagcaagccttttggcaaaccgttgtccaagacacactcaacacgcccgatggattaaccttggcctatatgatggttaagcatcctaaagcccatgccagcatagtcatcagcagtggccgcgtggaatcctacctaaagtatcaagagttgatttttgacttgtatcagcaaggctactcggtgtttgctatcgaccaccgcggtcaaggattatcgagtcgaatgaccgcaaatccccatcaaggacatgtacggagatttaatgactacattgatgattttgcgctgtttatgcaaacggttgtgcttaaacacgccacctcaccactgttcttacttgggcactctatgggcggtgccatcggcaccttgtatctaaaacagcatcccgatgtctttaccgctgccgtattttcagcacctatgtatggcatcaagttacccatgcctaaagggtttgtccgttggttagccagtaaactcgataccagtctcaacggtggagagcctaattatgtgctaagtggtcaaaactataaggcagtcccagtcccctttaagggaaatgatctcacccattgccagagccgttaccaagcctaccgagaattgtatgaggcggcgccaaagctgcagctaggttctccgactaaccgttggcttactgaatccttagatgcagccgatgcttgtgtattggcaacaacgcatatacgtacacctattctgatcctacaggccggtgaggataaaattgtcgacaatgcagcgcaaaatctcgcagtgagctctaattgccaattaaaggtgattgcaggagcagcccatgagatatttatggagaaagatagctatcgcaatcaagcgctgaattacgcactcgatttttttaaacgctacgcaacaagggacgtggacaaacaagctgtttaa

SEQ ID NO: 3799 - protein, 329 aa, Shewanella oneidensis MR-1
MSQTPSVFSTEHDLNTSEQQAFWQTVVQDTLNTPDGLTLAYMMVKHPKAHASIVISSGRVESYLKYQELIFDLYQQGYSVFAIDHRGQGLSSRMTANPHQGHVRRFNDYIDDFALFMQTVVLKHATSPLFLLGHSMGGAIGTLYLKQHPDVFTAAVFSAPMYGIKLPMPKGFVRWLASKLDTSLNGGEPNYVLSGQNYKAVPVPFKGNDLTHCQSRYQAYRELYEAAPKLQLGSPTNRWLTESLDAADACVLATTHIRTPILILQAGEDKIVDNAAQNLAVSSNCQLKVIAGAAHEIFMEKDSYRNQALNYALDFFKRYATRDVDKQAV

SEQ ID NO: 3800 - DNA, 948 bp, Bradyrhizobium japonicum USDA 110
  CDS (1)..(948): transl_table=11
atgacgctgatctcgattccgtccaatcccgttcccgaagacgtcgtcagcggcaccatcaagacacccgatggcgccgagctgcgctttgcgcgctgggcgccgccggcgaaccgcaagggcacggtctgcgtcttcaccggacgcagcgagcagatcgagaaatatttcgagaccgtgcgcgacctgcgcgaccgcggctttgcggtggcgatgatcgactggcgcgggcagggccactcctcgcgccgcctgcgcgatccgcgcaagggctatgtgcgcgacttcgccgatttcgaaatcgacgtcgagaccttcgtgcagcaggtggtgctgccggattgcccgccgcccttcttcgcgctcgcccactccatgggcggtacggtgttgctgcgcgttgcgcatgcgggcaagcgctggttcgaccgcatggtgctgtcggcgccgatgatcgacctgccaggccgcaccacctcgtttccgtcgcgggcgcttctgaagacgatgcgcctgatggggatgggcggccgctatgttcccggcggcagcgaccgcatcaccgggctcgatcccttcatcaacaatcccctgaccagcgatcccgtgcgttatgcgcgcaacgccgcgatcctggaggaggatccgacgctcgggctggcgtcaccgacggtcgcctgggccgatagcgccttccgcgccatgcacaccttcaagggcatgaactacccctccgagatccgccagccgatcctgatgctggcggcctccagcgacaccgtggtttcgaccgccgcgatcgaggagttcgcctaccatttgcgcgccggctcccatctcgtgatcgccggctcgaagcacgagatcctccaggagcaggaccgctaccgctcccagttctgggccgccttcgacgccttcgtgccgggcacgccgctgttcaagtga

SEQ ID NO: 3801 - protein, 315 aa, Bradyrhizobium japonicum USDA 110
MTLISIPSNPVPEDVVSGTIKTPDGAELRFARWAPPANRKGTVCVFTGRSEQIEKYFETVRDLRDRGFAVAMIDWRGQGHSSRRLRDPRKGYVRDFADFEIDVETFVQQVVLPDCPPPFFALAHSMGGTVLLRVAHAGKRWFDRMVLSAPMIDLPGRTTSFPSRALLKTMRLMGMGGRYVPGGSDRITGLDPFINNPLTSDPVRYARNAAILEEDPTLGLASPTVAWADSAFRAMHTFKGMNYPSEIRQPILMLAASSDTVVSTAAIEEFAYHLRAGSHLVIAGSKHEILQEQDRYRSQFWAAFDAFVPGTPLFK

SEQ ID NO: 3802 - DNA, 1011 bp, Vibrio parahaemolyticus RIMD 2210633
  CDS (1)..(1011): transl_table=11
atggctactaaccattcacctttgacttatactcaagagactttatttgagcaagcaattggtggtccgatcgcagcactttggcaaactcgccaagagggctttgttaaagggacagagaaaaagaaaatctactggtgcaaactcaccaaccctgaacacaaaaaagccgtgctgatcgtcaatggccgcatcgaatcttcctggaagtaccaagagctgttttacgatctctaccgccaaggttacgatgtgtattcctttgaccaccgaggacaaggtttatcagatcgcctattatctgactctgatatgggtcacgtctatgactttactgactatattgatgatatggacgtggtgatcaaacaacacgaccttaaacaatatcagcagtgctttatcatcgcgcactccatgggcggtgctatcgcgacgcgctatctgcaaacccacccagagcacccattcactggtttgattttaagcgcccccatgtttggcattaacttgccgtggtacttatcgcctatcgctatcccagtgacgcaaattctttctgccgtgtcaccactgccgcgttatgcgccgggccacaagccgtactttcccaagccttttgaggacaatcctctcagccaaagcgcaggccgctaccagtggtttcgcaatctctatacagaaaaaccggaactgcaagtcggcggaccaagcacgcgctgggtatggcaaggactcatggcagcgaaacagtgctttttgttaactcgccaagtaaaagtgcctgtgctactggttcaagcaggcaatgatcgtatcgtcagcaatctcgcacaaaaacgctttatcgagaagctgcgtaaaaccaatcctcatgcggcattgctttctattgaaggcgcacagcatgaaatcttgttcgaaacagaccagtaccgcaatcaagcgctcgatgcgatcttccgctttatggatgaccctacttcgtcgtcagacgaaaaaatgcaataa

SEQ ID NO: 3803 - protein, 336 aa, Vibrio parahaemolyticus RIMD 2210633
MATNHSPLTYTQETLFEQAIGGPIAALWQTRQEGFVKGTEKKKIYWCKLTNPEHKKAVLIVNGRIESSWKYQELFYDLYRQGYDVYSFDHRGQGLSDRLLSDSDMGHVYDFTDYIDDMDVVIKQHDLKQYQQCFIIAHSMGGAIATRYLQTHPEHPFTGLILSAPMFGINLPWYLSPIAIPVTQILSAVSPLPRYAPGHKPYFPKPFEDNPLSQSAGRYQWFRNLYTEKPELQVGGPSTRWVWQGLMAAKQCFLLTRQVKVPVLLVQAGNDRIVSNLAQKRFIEKLRKTNPHAALLSIEGAQHEILFETDQYRNQALDAIFRFMDDPTSSSDEKMQ

SEQ ID NO: 3804 - DNA, 1017 bp, Salmonella enterica subsp. enterica serovar Typhi Ty2
  CDS (1)..(1017): transl_table=11
atgtttcagcagcaaaatgactgggaaacaagagaaaatgcgtttgccgcttttgctatggggccgctgaccgatttttggcgtcagcgggaagaggcggagtttatcggcgtggataacattccggtgcgctttgtccgttttcggaatgactccaacgatcggacgatcgtcatttgtcctggccgcattgagagttatgtaaaatacgctgaactggcgtatgacctttttcatctcggttttgatatcttcatcatcgaccaccgtggtcaagggcgctccgggcggatgttatcggacccgcatcggggtcatgtcgatcattttaacgattatgttgaggacttagcggcgttctggcagcaggaaattgagccggggtcgtggcgtaagcgttatatcctggcgcactcaatggggggcgcgatagccaccctgttcctgcaacgccatcgtgtgcggtgcgacgctattgcgctcaccgcgccgatgtttggtattgtgatacgcttgccttcctttatggtgcgccatattctcgactgggccgaagggcatcagcgtatccgtgaagattacgctattggtaccggtcagtggcgggcgttgccgtttgggatgaatgcgctgacccacagccgccagcgttatcagcgcaacttacgattttatgccgacgagccgcagctgcgcgttggcggccccacctggcattgggtacgcgaaggcattctggcgggtgagcaggtactggctggggcgagcgatgacacgacgcctacgctactgattcaggcggaagaagagcgggtagtggataaccgcacccacgatcgtttttgtgaaattcgcgccgcggcgggatacccttgtgaagggggaaaaccgctggttatcaaaggcgcgtaccatgagatcctttttgaaaaggacgccatgcgctcagtcgcgcttaacgccattgttgaatttttcaacaagcctaatttatccagcggaaatcgctttgcttag

SEQ ID NO: 3805 - protein, 338 aa, Salmonella enterica subsp. enterica serovar Typhi Ty2
MFQQQNDWETRENAFAAFAMGPLTDFWRQREEAEFIGVDNIPVRFVRFRNDSNDRTIVICPGRIESYVKYAELAYDLFHLGFDIFIIDHRGQGRSGRMLSDPHRGHVDHFNDYVEDLAAFWQQEIEPGSWRKRYILAHSMGGAIATLFLQRHRVRCDAIALTAPMFGIVIRLPSFMVRHILDWAEGHQRIREDYAIGTGQWRALPFGMNALTHSRQRYQRNLRFYADEPQLRVGGPTWHWVREGILAGEQVLAGASDDTTPTLLIQAEEERVVDNRTHDRFCEIRAAAGYPCEGGKPLVIKGAYHEILFEKDAMRSVALNAIVEFFNKPNLSSGNRFA

SEQ ID NO: 3806 - DNA, 999 bp, Photorhabdus luminescens subsp. laumondii TTO1
  CDS (1)..(999): transl_table=11
atgacgccagaaatgttgaaagaaagttggttcaatcgtgaggtgcagttctctgtttttgccaatgggcctctgttagatttttggcaagctagggaagagtgtgaatttatcggcgtcgataatgtactgatacgttatgttcgtttttgcacaacaataaaaaatgatagagcggttgttatctttcctggccgtagtgaaagttatgtcaaatactcggaagtagcatttgatttttatcaccttggttacgacatttttattattgatcatcgtgggcaggggcgatccagcaggatacttgcagatccacaaaaagggcatgtagaaaaatttgatgattatattgatgacgttgaaatattaatagaaagagaaattcttcctcgtcattattctcattgttatgcgttagctcattcaatgggagcggcaatattagggggatttttattacgtcacagccaggtatttgatgcagcagccctttgtgctcctatgtttggtattaactttcctatgccacgttggttggcaactttcctggtaaatcgggctgaaaagcggccggatatgcgcaaccattatgcggtatttactgggaaatggcgtccgttgccttatttgataaaccttctgacacacagttatgaacgttatagccgttacctccgttattacgcggattatccggaattacatatcgggggaccgacatatcgttgggtgcgggaaagtatctggattggcgatatgctgatagaaaaagccggagaaattgagacgccattgataattttaaaagccagtgaagataaggttgttaataattgccgattacgggctttttgtgaatcacgtaataaagtgagggctttcatcaaagaacgttcacctttgattattcaaggggcgcatcatgagatcctgtttgaaaaagataaattacgtagccaggcactcaacgccatttgtgatttttttgaccagaattga

SEQ ID NO: 3807 - protein, 332 aa, Photorhabdus luminescens subsp. laumondii TTO1
MTPEMLKESWFNREVQFSVFANGPLLDFWQAREECEFIGVDNVLIRYVRFCTTIKNDRAVVIFPGRSESYVKYSEVAFDFYHLGYDIFIIDHRGQGRSSRILADPQKGHVEKFDDYIDDVEILIEREILPRHYSHCYALAHSMGAAILGGFLLRHSQVFDAAALCAPMFGINFPMPRWLATFLVNRAEKRPDMRNHYAVFTGKWRPLPYLINLLTHSYERYSRYLRYYADYPELHIGGPTYRWVRESIWIGDMLIEKAGEIETPLIILKASEDKVVNNCRLRAFCESRNKVRAFIKERSPLIIQGAHHEILFEKDKLRSQALNAICDFFDQN

SEQ ID NO: 3808 - DNA, 999 bp, Vibrio vulnificus YJ016
  CDS (1)..(999): transl_table=11
atggttaataacagctcacctctctcttatacgcaagaggctttatttgagcaagcaataggtggtccgatcgctgccctatggcagcagcgacaagagggtttcctaaaaacgcgcgataagatgcagttgtattggtgtaagctgaccaacccgcaacacaaaaaggcggtgctggtagtgaatggcagaatcgaatctgcttggaagtaccaagaacttctgtttgatctctaccgtcaaggctatgacgtctacagctacgatcatcgaggccaaggtttatcagatcgcctggtgaaagactctgatattggtcacgtctacgagtttgatgattacattctcgacatggaagccgtgattgcgcattttgatttctctccttatcagcagcgacacattgtttctcattcgatgggcggtgccgtcgccacgcgctacttacaaacccacccacaacatggttttgataagttggtgctcagtgcgccgatgtttggtatcgatctcccttggtatttgagtccagtggccatggcggtcagccaaattctcaccgccgtgtacccaacgcctacttatgcgccgggacacaaaagttattatgagaagccctttgaagataacccgctcagccagagccaagcgcgttatcaatggtttagacagttgtatcgtgacaagcccgagctgcaagtgggtggcccgagcacccgttgggtgtggcaaggcttaatggccgccaaacagtgcattttgctgacgcgccaactcaccattccggtgttgctgttgcaggcagggggcgatcgcatcgtcagcaatcaagcacagtcgcagtttttcaaaaagctgcacaaaaccaataagcgcagcgaaatggtgacgattgaaggtgcgcaacatgaattgttgtttgagaaagaccactaccgtaatcaagcactcagcgcgatgttccgctttttgcagaaagaggaaagcaaccaagcttaa

SEQ ID NO: 3809 - protein, 332 aa, Vibrio vulnificus YJ016
MVNNSSPLSYTQEALFEQAIGGPIAALWQQRQEGFLKTRDKMQLYWCKLTNPQHKKAVLVVNGRIESAWKYQELLFDLYRQGYDVYSYDHRGQGLSDRLVKDSDIGHVYEFDDYILDMEAVIAHFDFSPYQQRHIVSHSMGGAVATRYLQTHPQHGFDKLVLSAPMFGIDLPWYLSPVAMAVSQILTAVYPTPTYAPGHKSYYEKPFEDNPLSQSQARYQWFRQLYRDKPELQVGGPSTRWVWQGLMAAKQCILLTRQLTIPVLLLQAGGDRIVSNQAQSQFFKKLHKTNKRSEMVTIEGAQHELLFEKDHYRNQALSAMFRFLQKEESNQA

SEQ ID NO: 3810 - DNA, 1047 bp, Rhodopseudomonas palustris CGA009
  CDS (1)..(1047): transl_table=11
atgggaggggtgtttcggggttcaagagggggcccgaagctgttcgcgcccgccgctttcatccagattttccaggcattttctcccctccggactcggtccatgacgctcgtctcgactcctgccaatccggtgcccgaagacgccgtctccggcttcatcaagacgcccgacggcgtgcaactccgctttgcgcgatgggagccgccggggcaccgcaaaggcaccgtatgcgtcttcaccggacgcaccgaacagatcgagaagtacttcgagacggtgcgcgatctgcgcgatcgcggctttgcagtcgcggcgctcgactggcgcggccagggccattcggagcgccggctgcgcgactatcgcaagggctatgtgcgcaacttcgccgacttcgaggtcgacgtcgaaaccttcgtgcgtgaagtcgtgctgccggactgcccgccgccgcatttcgcactggcgcattcgatgggcggggcggtgatgctgcggatcgcccgctccggcaagcgctggttcgaccgcatggtgctgtcggccccgatgatcgaccttgcgggcaacaccaccgcgctgccgatcaggctattgctgcgggcgatgcggctggccggccaaggcggccgttacgttcccggcggcaacgacgtgctcgccaacaccgagccgttcgtcggaaacaagctgacctcggatccggtacgctacgcccgcaacgccgcaatcgtcgccgaagatccgaccctgggcctcgcctcgccgaccgtcgcctgggctgacaccgctttccgcgccatgcacgccttcaaggcgaccaactatccgtcgcaaatccggcagccgatcctgatgatcgcggccggtatggacggcgtggtgtcgacgccggcgatcgaagagttcgcttatcatttgcgggccggctcgcatctggtgatccccggcgccaagcacgaaatcctccaggagcaggatcgctaccgccagcaattctgggcggcgttcgatgctttcgtaccggggacgccgcttttctga

SEQ ID NO: 3811 - protein, 348 aa, Rhodopseudomonas palustris CGA009
MGGVFRGSRGGPKLFAPAAFIQIFQAFSPLRTRSMTLVSTPANPVPEDAVSGFIKTPDGVQLRFARWEPPGHRKGTVCVFTGRTEQIEKYFETVRDLRDRGFAVAALDWRGQGHSERRLRDYRKGYVRNFADFEVDVETFVREVVLPDCPPPHFALAHSMGGAVMLRIARSGKRWFDRMVLSAPMIDLAGNTTALPIRLLLRAMRLAGQGGRYVPGGNDVLANTEPFVGNKLTSDPVRYARNAAIVAEDPTLGLASPTVAWADTAFRAMHAFKATNYPSQIRQPILMIAAGMDGVVSTPAIEEFAYHLRAGSHLVIPGAKHEILQEQDRYRQQFWAAFDAFVPGTPLF

SEQ ID NO: 3812 - DNA, 1038 bp, Erwinia carotovora subsp. atroseptica SCRI1043
  CDS (1)..(1038): transl_table=11
atgattcaacgccacaatacgttgtttacgtcggaacggttaacacctgaatcgttaacggcagatctgttaacgcgagaagcgcagtttgccgcttttgctaccggagaattactgaatttctggcgtcagcgcgaagagggcgaattctctggtgtggatgatgtgccgatccggtttgttcgctttaccgcgccgcaacacgacaagattgtcgtggttttttctggccgcatcgaaagttacgtcaaatatagcgaagtggcgtatgacctctttcatcgcggctatgatgtgctcatcatggatcaccgtgggcaagggcggtctgggcgggtgctgcaagatggccaccgcggacacgtgcaacgcttcagtgattatgtcgatgatgctgaaacactgtgccagcagcacattgaacctacgcgatatacccgtcggtttgcgctggcgcattcaatgggcggcgcgattctggcacagcttttggttcgtcaacctgcgatgtttgatgcggcggcgctgtgtgcgccgatgtttggcattcgtttaccgcttcctcattgcgttgccgagtggatcgtcgattgggcggagcgtcacccagcgatacgtgattattacgctataggcacgggacagtggcgtcctctgccttatcgaatgaatgtgctgacgcacagccgcgaacgctaccagcgtagtattcgattttacgcggattcgcctgatttgcgcgtaggcggccctacttaccactgggtgcgtgaggcgatactggcggggaagtacctgctgacacaggccagcgccgtgacaacgccgcttctgctgctacaagcggaagaggagcgcgtggtggataatcgcagtcagaatgtgttttgccagacactgacgcagagcggtgatgccaattcgaacggcgttttgcaggttatccacggcgcgcggcatgaaattctctttgagacggatcgtctccgcgctcaggcatttgcgctgatttttacgcactttgcgcgctatcattaa

SEQ ID NO: 3813 - protein, 345 aa, Erwinia carotovora subsp. atroseptica SCRI1043
MIQRHNTLFTSERLTPESLTADLLTREAQFAAFATGELLNFWRQREEGEFSGVDDVPIRFVRFTAPQHDKIVVVFSGRIESYVKYSEVAYDLFHRGYDVLIMDHRGQGRSGRVLQDGHRGHVQRFSDYVDDAETLCQQHIEPTRYTRRFALAHSMGGAILAQLLVRQPAMFDAAALCAPMFGIRLPLPHCVAEWIVDWAERHPAIRDYYAIGTGQWRPLPYRMNVLTHSRERYQRSIRFYADSPDLRVGGPTYHWVREAILAGKYLLTQASAVTTPLLLLQAEEERVVDNRSQNVFCQTLTQSGDANSNGVLQVIHGARHEILFETDRLRAQAFALIFTHFARYH

SEQ ID NO: 3814 - DNA, 951 bp, Mannheimia succiniciproducens MBEL55E
  CDS (1)..(951): transl_table=11
atgctaaacagagaacctaaatttagcaattttgcattaaccgaactgcttccctttgcggaacgctgtccgctaaattatatcaagggcaaaaacaacataaaaatcgcttatcgccattttaaacatgaacatgacggtaatgacaggttattggtgttagtaaacggacgtgcggaaaatttgctgaaatggactgaagtggcttatgatttttatcgccagggttatgatgtgctgagtttcgatcatcgagggcaaggttattccgatcggctattaaaaaatagagataaaggttacattgatgaattccgctattatacggacgatatggcggcggttatcgctgaggcttattcctatcgtcaatacagctcctgccacctagtggctcattcattaggggcgttaatcagcacctattatcttgctaactatgatcaccatataaaaagtgccgtgttatccgcacctttttacggtttacagttacgtcgcccgtttatcgatcaaattatcattaatttgatgatactattcggacaaggaaaacgttatgtaccgggaaaagaaggctataagccggctaatttaaacaataacgatctcagtttctgcaaaacccgcatgaaatggatgaacagaattaatcgcaatcatccggcaattcatcttggcggaccgacattccgttgggttcatttatgcttaaacgcgataaaaggtctgcctaaaattattccccgcattgaaatacctattttaattttgcattccgataaagagaaaatcgtaaataacaaaaatctacaaaaattaaccgcactttttcaacatgttcaagtggaagaaatacaaaatgcaaaacatgaaattctgtttgagcgtgatgcattaagggctcgggcgattcaacgaatcagtaaatttttcacggacttcaaataa

SEQ ID NO: 3815 - protein, 316 aa, Mannheimia succiniciproducens MBEL55E
MLNREPKFSNFALTELLPFAERCPLNYIKGKNNIKIAYRHFKHEHDGNDRLLVLVNGRAENLLKWTEVAYDFYRQGYDVLSFDHRGQGYSDRLLKNRDKGYIDEFRYYTDDMAAVIAEAYSYRQYSSCHLVAHSLGALISTYYLANYDHHIKSAVLSAPFYGLQLRRPFIDQIIINLMILFGQGKRYVPGKEGYKPANLNNNDLSFCKTRMKWMNRINRNHPAIHLGGPTFRWVHLCLNAIKGLPKIIPRIEIPILILHSDKEKIVNNKNLQKLTALFQHVQVEEIQNAKHEILFERDALRARAIQRISKFFTDFK

SEQ ID NO: 3816 - DNA, 963 bp, Silicibacter pomeroyi DSS-3
  CDS (1)..(963): transl_table=11
atgaccctgacgccggcccccctgttcgaagatgtggccggcggccccgccggtggcgcggcccattggatgcagaccagcgacgggctgcgcatccgtgccggtcactggcgccccgagggcgaggtacgcggcaccgtgctgatgtttcccgggcgcaccgaatatgtcgagaaatacggcaatgcggcgcaggcctttgtgacgcgcggctttgccatgctggcggtggactggcgcggccagggcctggccgaccggctgctggaggaccggcgcctgggccatgtgctggagttcaccgattaccagcgcgacgtggcggcagtggtggaactggccaccacgctggacctgcccagaccctggttcgtggtcggccattccatgggcggcgccatcgggctgcgcgcggtgatggaggggctgccggtggcggcctgcgcctttaccggcccgatgtggggcattttctttaccccggtgatgaagccgctgagctggatcaccgccaacctcgctccggcgatcggaatggggcacaaacatcccgccaccaccacgctggaaccctatgtgcaggcgcaggagttcgagggcaattcgctgacccgcgacccggcgatgtacgagatgatgcgcagccagctggccgcgcatccggaactggcacttggggcgcccaccaatatctggctgcgcgaggcgctggccgaatgccgtgcactcagcgatcgcccctcgcccgatctgccctgcctgacctttctgggcagccatgagcagatcgtcgaccgcaaggcggtgcgcgcccgcatggcgcgctggccgcgcggcgagctggtcgagatcccggacggcgaacacgaggtgctgatggaggcccccgaggtgcgtgacccggcctatgaccggatggcggccctgttctcggcccccgaccagttgcaacgcagcgcctga

SEQ ID NO: 3817 - protein, 320 aa, Silicibacter pomeroyi DSS-3
MTLTPAPLFEDVAGGPAGGAAHWMQTSDGLRIRAGHWRPEGEVRGTVLMFPGRTEYVEKYGNAAQAFVTRGFAMLAVDWRGQGLADRLLEDRRLGHVLEFTDYQRDVAAVVELATTLDLPRPWFVVGHSMGGAIGLRAVMEGLPVAACAFTGPMWGIFFTPVMKPLSWITANLAPAIGMGHKHPATTTLEPYVQAQEFEGNSLTRDPAMYEMMRSQLAAHPELALGAPTNIWLREALAECRALSDRPSPDLPCLTFLGSHEQIVDRKAVRARMARWPRGELVEIPDGEHEVLMEAPEVRDPAYDRMAALFSAPDQLQRSA

SEQ ID NO: 3818 - DNA, 936 bp, Haemophilus influenzae 86-028NP
  CDS (1)..(936): transl_table=11
atgatcagagaaccttattttcatcaatttgctcttgcagaattattgcctttttttgagcaatttcctacccaatatctttctggtaaacgaaatataaaattagcttatcgtcatttgattcaacctgaaagtgcggtcagaaaattgatgattttagtaaatggtcgtgcagaaaatatgttgaaatggtcagagctcgcttatgatttttatcatcaaggttatgatgtattgctatttgatcatcgcggtcaaggctattcacagcgtattattcctcaaaaagggcatttagacgaatttcgtttctatgttgatgatatggcgaaaatcatcgaaaaagtaaccgcacttttcagctattcaacgcagcatttgcttgctcattcgatgggcgcattgattgcaacctattatttggcaaattatgatcatcacattaataaagcggtactttcttcgcctttttacggtattcttttaaaacatcccattagagatgaactgattattgccctaatgaatattttaggacaaggcgagcgttatgtttttggtaaagggccttatcaacaagcccacttggaatacaatgaattaactttctgtaaaaccagaatgaaatggatgaatcgtgtaaatcgtaaaaatccagcaattaatcttggcgggccaacattccgttgggtacatttgtgtttgaacgcaattaaacgcttgccgaaagttattcctaagattgaaattccaatcctaattttacaagccgaaaaagaaaaaatagtagataacaacaatcttgaaaaattaaccgtactttttccgaatgctagatgtgaagttgtattcaatgctaaacacgaaattctatttgaacaggacaaattaagaaaggaaacaatctttaaaatattagaatttttaaataattag

SEQ ID NO: 3819 - protein, 311 aa, Haemophilus influenzae 86-028NP
MIREPYFHQFALAELLPFFEQFPTQYLSGKRNIKLAYRHLIQPESAVRKLMILVNGRAENMLKWSELAYDFYHQGYDVLLFDHRGQGYSQRIIPQKGHLDEFRFYVDDMAKIIEKVTALFSYSTQHLLAHSMGALIATYYLANYDHHINKAVLSSPFYGILLKHPIRDELIIALMNILGQGERYVFGKGPYQQAHLEYNELTFCKTRMKWMNRVNRKNPAINLGGPTFRWVHLCLNAIKRLPKVIPKIEIPILILQAEKEKIVDNNNLEKLTVLFPNARCEVVFNAKHEILFEQDKLRKETIFKILEFLNN

SEQ ID NO: 3820 - DNA, 1005 bp, Colwellia psychrerythraea 34H
  CDS (1)..(1005): transl_table=11
ttgagtaaataccactcctttaattcagagaaaaacatcaaatacaaactaccaaatgagattaccttattttggaataaaggcctatttgactcatttatagggatagataaagtaaacatacactatgcgcaatttattcaagagcaagtagagtgtcctacgatagtcatagtgccagggcgctgtgagagctacttaaagtaccaagagctgtcatttgatttataccagcaagggtataacatttttatcatagatcatcgaggtcagggactatcaggacgaatgctgctaaacgtaaacaaaggttatgttacaaaatttcaagactatgtggatgacttacggtatttcattgaaaatatcgtgacacccaaatcttcagaaaaaccatacctcttagcgcactcaatgggtgggactattgccacccgttttatgcaagactctccaaatgcaattaaagccgccgtgatatcttcacctatgttgggcttttattctggtttgttaccaaagagcatagctaaaatactggtagccattaagctgaaattcaataatattatcagcaatacgccatggtattttttaggacaaaaagactactcccctgtcaattttactgataataaattaactcattcaataccgcgctatcaatactttgttgatttgtataaaaagaataaaatcatccaacttggtggtgttaccactcactggttagcacaaagtatcgcggctcaaaaagagcttttctctaagattgttcagcttaagacgcctatattattgcttcaagctagcggtgatactgtcgtttgccaacaagcacaagatgatttttgccagcaattacatacattgcaaccacaatcatgtccaaatggcgtaccgagtaacattgataacgccttccatgagctattttttgagaccgatgatcttagaaataaagcaataacacaaagccttgcttggtttgaacaacatacttaa

SEQ ID NO: 3821 - protein, 334 aa, Colwellia psychrerythraea 34H
MSKYHSFNSEKNIKYKLPNEITLFWNKGLFDSFIGIDKVNIHYAQFIQEQVECPTIVIVPGRCESYLKYQELSFDLYQQGYNIFIIDHRGQGLSGRMLLNVNKGYVTKFQDYVDDLRYFIENIVTPKSSEKPYLLAHSMGGTIATRFMQDSPNAIKAAVISSPMLGFYSGLLPKSIAKILVAIKLKFNNIISNTPWYFLGQKDYSPVNFTDNKLTHSIPRYQYFVDLYKKNKIIQLGGVTTHWLAQSIAAQKELFSKIVQLKTPILLLQASGDTVVCQQAQDDFCQQLHTLQPQSCPNGVPSNIDNAFHELFFETDDLRNKAITQSLAWFEQHT

SEQ ID NO: 3822 - DNA, 993 bp, Novosphingobium aromaticivorans DSM 12444
  CDS (1)..(993): transl_table=11
atggatttcgacacgggcaggcggatcgaccggagagcgattccagccgacgctgtcgaggggacatggacggcaagcgacggtcatccgatacgccgcatagactggcccggccattccgaaccggacgctcccacggcgccgcgaggttcgctcctgttcctgccaggacgaggggatttctacgaaaagtatctggaatccctggattactggcattgcgaagggtggcgggtcaccgcgctcgactggcgagggcaagctggctccggtcggctttcgtcggatccgatgacagggcatgttcccgatttcgggctgtggctggacgaccttggcgcgttctggacggattgggttcgtgacacgcccggtccccatgtggtcgtgggccattcgatgggcgggcatctcgtgcttcgcgccctcgccgagcgccggatcgatccggccgcggtggtgctgagcgcgcccatgctcggattcctgacaccaggcccgaatcgggttcttcaccgggtggccgagttcatgtgccgaatcggcgaccccgaacgaagcgcctggaagagcagcgaaaagcccggggcaaccacggccgcgcgcaatacgctcctcacgcatgacgaggcccgttacggtgacgagacgcactggaagacggtgcggcccgaacttgcaatggggccgggaagctggcgctgggtggagcgggcctacgcctcgatgctggtgctggacagaccggggctgctggaggcggtcgacgtgccggtgcttttgcttgccgcgcgccatgacgggctcgtttcctggcgcgcgatcgagcgtgcggcgcggcgcctgccgcgcgcgcaactgatgacctggggccgcgaggcaaggcacgagttgctccgtgaggccgatccggtaagggacaaggtcatgcacgccatcgacgattttcttgaccgccttgccccgccgaccggggaggacgcacccgcgtga

SEQ ID NO: 3823 - protein, 330 aa, Novosphingobium aromaticivorans DSM 12444
MDFDTGRRIDRRAIPADAVEGTWTASDGHPIRRIDWPGHSEPDAPTAPRGSLLFLPGRGDFYEKYLESLDYWHCEGWRVTALDWRGQAGSGRLSSDPMTGHVPDFGLWLDDLGAFWTDWVRDTPGPHVVVGHSMGGHLVLRALAERRIDPAAVVLSAPMLGFLTPGPNRVLHRVAEFMCRIGDPERSAWKSSEKPGATTAARNTLLTHDEARYGDETHWKTVRPELAMGPGSWRWVERAYASMLVLDRPGLLEAVDVPVLLLAARHDGLVSWRAIERAARRLPRAQLMTWGREARHELLREADPVRDKVMHAIDDFLDRLAPPTGEDAPA

SEQ ID NO: 3824 - DNA, 948 bp, Silicibacter sp. TM1040
  CDS (1)..(948): transl_table=11
atggcagaaaccgcccccgcgccctatttcagcgagattgcgcgcggcccggatcaggtcgaggcccattggctgaccactcaggatggtcagcgtatccgcgcaggcctctggcgtagccacggtccttctgcgggcacaatcctgctgtttcccggtcgcacagaatacatcgagaaatatggcccactggccattgacctgacggatcggggttttgacgtcctgaccgtggactggcgcggacaggggcttgcggatcgcagcctgagcgatggccgcctcgggcatgttgcagaatttggcgcgttccagctcgacgtggcggcgctggtggcgcatgccgaggccctcaacttgccacgcccgtggtatctgctgggacattccatgggcggcgccatcggcctgcgggctctccacgagggtctgccagttgcggcctgcgccttcactgccccgatgtgggcgatccgcattccctttgcgctgcgaccggctgcccggcttttggcgcggtttgggacggcgctgggtgtgagcgagaagctggtgcccacaaccaccatcgaacaatacgtccaggtcacaccctttgagggcaacacgctgacaaatgacccggaaatgtacgctttcttgcagatgcagatgacccagcaccccgaattggccctcggggggccgacggtacaatggttgtctcaggccatgctggagtgcgcagatctgcgcgcgcgcccctcacccgatgtgccttgcgtgacctttctgggggaaaacgaacagatcgtcgccacagaggccattcatgatcgcatggcacgctggccatcaggcaagctcgagatgatcccggacgcccagcacgaaatcctgatggaaatccctcagacacgcaggcagacctgcgccatcctgacggcgcacttcaaaaaacacgtctag

SEQ ID NO: 3825 - protein, 315 aa, Silicibacter sp. TM1040
MAETAPAPYFSEIARGPDQVEAHWLTTQDGQRIRAGLWRSHGPSAGTILLFPGRTEYIEKYGPLAIDLTDRGFDVLTVDWRGQGLADRSLSDGRLGHVAEFGAFQLDVAALVAHAEALNLPRPWYLLGHSMGGAIGLRALHEGLPVAACAFTAPMWAIRIPFALRPAARLLARFGTALGVSEKLVPTTTIEQYVQVTPFEGNTLTNDPEMYAFLQMQMTQHPELALGGPTVQWLSQAMLECADLRARPSPDVPCVTFLGENEQIVATEAIHDRMARWPSGKLEMIPDAQHEILMEIPQTRRQTCAILTAHFKKHV

SEQ ID NO: 3826 - DNA, 972 bp, Mesorhizobium sp. BNC1
  CDS (1)..(972): transl_table=11
atggccgacctgctccgcgaaattccggaaaaccccgtgccgcccggcgcaatatcgggcatgatgaccgcacgcgaccgtcggcgcatccgctacgctctattcccctcctccggcgagtacggaaccgtggtcatcctgcccgggcgcaacgaatgtatcgagaaatatttcgagacggtgcgcgacctgtcggagcgcggcttcgcggtggcaatgttggattggcgcggccaaggtggatcggaccgtcttctcaaggatcctcggcgtggacatgtgcggtccttcaaccaatacacctccgatctcgaccagttcttccgcgaggtcgtgctgccggattgccgcccccctttcaccgtgctcggccactcgaccggctcgcttgcggctttactcgccgcaccttatctcaccacccgcgttcgacgcatggtgctcgttgcgccgctgcttgaaatccagacctcgcttccgcttggcccggcgaaaatgcttgcaaaactgctctgcgccgtcggccttggccgcatctatattgccgggcgaagcaggcgcgggaaggaagtccctttccagcccaatgtattgacgagcgatcaggaacggcacagccgaaaccaggcgctcctccacgcctttccggagctttttgtgggaggccctacagctgcgtggctgaatgcggcctggtcggcgataaagcgcgtcaacgaccccgatttccaggcatcggttcgcattcccattctcttcctggcggccgggatggacagggtggtttcgacgcccgcgatcgagcgctatgcgcgctgcctgcgctcggcaagggtgttaaccatcgacggtgcgcggcatgaaattctgcaggaggtcgatatgtttcgggaacaggctctcgccgccttcgagaccttcgcaaagggccaccaggaaagagccgccgcaaacgagcctgtggggatgtag

SEQ ID NO: 3827 - protein, 323 aa, Mesorhizobium sp. BNC1
MADLLREIPENPVPPGAISGMMTARDRRRIRYALFPSSGEYGTVVILPGRNECIEKYFETVRDLSERGFAVAMLDWRGQGGSDRLLKDPRRGHVRSFNQYTSDLDQFFREVVLPDCRPPFTVLGHSTGSLAALLAAPYLTTRVRRMVLVAPLLEIQTSLPLGPAKMLAKLLCAVGLGRIYIAGRSRRGKEVPFQPNVLTSDQERHSRNQALLHAFPELFVGGPTAAWLNAAWSAIKRVNDPDFQASVRIPILFLAAGMDRVVSTPAIERYARCLRSARVLTIDGARHEILQEVDMFREQALAAFETFAKGHQERAAANEPVGM

SEQ ID NO: 3828 - DNA, 990 bp, Clostridium perfringens ATCC 13124
  CDS (1)..(990): transl_table=11
atgtgtaaaactttaaatagaaaatatatttataaatatggggagaaaaaagaggatgtagaaatagttgaaaatatgctaaataggatgagaaatagtggaacttttaaaggagagaattttgctaatatatattatgaaaaatacatagtggaagaatcggataaagcaatagttatatgtcatgggttttcggaatgtatagagaagtatcatgaaataatatactattttctaaatgaaggtttttcagtttatataatggaacatagaggtcatgggagatcagggtgtttaagtaaatcttgtaatacacaggtggaagtagaatcctttgattactatgttaaagatctaaagacatttttaaatgaggttgtattaaaagataagaggtttaataataatttatatttatttgcacattctatgggaggagctataggtactatatttttagaaaataatcatggatattttaagaaggtaattttaaattctccaatgtttagaataaatacaagagaatactctcatataaaatgcaaattaatagctaaatttttaattcttatgggaaaaggagagagttttatttttggacaaaaaccctttgaggaagaggagaatttagaggcatcaggaacatcagataaacttagacatggcttataccataaatttctcctagaaaatcctattttgagaagaggtggaggctctattcattggtataaagaagctgcaagggcaactgattatttaatgaaaaagagaaatatagagagaattgacacacctattttattatttaaaagtgagtttgattcctatgttgacacaaaatttcatgatgagtttaaaaaattagccaaggactgtgaacttattgaagtgaagggaagtaaacatgaggggttttttgaaaaagatgaaattctttatgattatttagataagatatttaaatttttagaggaaaataattag

SEQ ID NO: 3829 - protein, 329 aa, Clostridium perfringens ATCC 13124
MCKTLNRKYIYKYGEKKEDVEIVENMLNRMRNSGTFKGENFANIYYEKYIVEESDKAIVICHGFSECIEKYHEIIYYFLNEGFSVYIMEHRGHGRSGCLSKSCNTQVEVESFDYYVKDLKTFLNEVVLKDKRFNNNLYLFAHSMGGAIGTIFLENNHGYFKKVILNSPMFRINTREYSHIKCKLIAKFLILMGKGESFIFGQKPFEEEENLEASGTSDKLRHGLYHKFLLENPILRRGGGSIHWYKEAARATDYLMKKRNIERIDTPILLFKSEFDSYVDTKFHDEFKKLAKDCELIEVKGSKHEGFFEKDEILYDYLDKIFKFLEENN

SEQ ID NO: 3830 - DNA, 957 bp, Haemophilus somnus 129PT
  CDS (1)..(957): transl_table=11
atgagtcaacatgaatctcacttcaatcattttgccttagccgaactttatccttttgctacacaatttcctttgcaaaatataataggaaaaaaaggaatacgaatcgtctatcgccattttgttcaagaacattgtgctgaacgcagattagtgattttggtcaatggacgtgcagaaaacttgttgaaatggacagagttggcttataacttttatcgacaaggctatgatgttttagcgtttgatcatcgtggacaaggctattctcagcgtttattaaaagaccatgacaaaggctatattgatgagtttcgtttttatgcggatgatcttactttgttagtggaaaaaattacttcgttgtatcactatcgcagccaacatattttggcacattctttaggcgctttaatcagcacttattatcttgccaatgataatcaccaaataaaaagtgcggtattttctgcaccattttatggtattccactacagcattcattacgagatgaattcattattaatttaatgatgttgcttgggcagggctcacgctatgtatttggcaaaggtgagtataaacccgctgatttagataagaatgatttgagtctttgtcgtactagaatgaaatggatgaatcgtattaatcgtcgatacccacatattcatttaggcggaccaacttttcgttgggtatatgagtgtatgtatgccattaaaaaattacccgttgtcttaccccgaattgaaattccggtactagttttacaatcagaaagagaaaaaattgtggataaccaaaatctgcaaaaattgaccgcacttttgcctcaagctcaactagtgcagattgaacatagtaggcatgagattttatttgaacgtgatcgaattcgagatttagcactagcaaaaatcaatcagttttttactgaaaataacgccaaataa

SEQ ID NO: 3831 - protein, 318 aa, Haemophilus somnus 129PT
MSQHESHFNHFALAELYPFATQFPLQNIIGKKGIRIVYRHFVQEHCAERRLVILVNGRAENLLKWTELAYNFYRQGYDVLAFDHRGQGYSQRLLKDHDKGYIDEFRFYADDLTLLVEKITSLYHYRSQHILAHSLGALISTYYLANDNHQIKSAVFSAPFYGIPLQHSLRDEFIINLMMLLGQGSRYVFGKGEYKPADLDKNDLSLCRTRMKWMNRINRRYPHIHLGGPTFRWVYECMYAIKKLPVVLPRIEIPVLVLQSEREKIVDNQNLQKLTALLPQAQLVQIEHSRHEILFERDRIRDLALAKINQFFTENNAK

SEQ ID NO: 3832 - DNA, 1014 bp, Shewanella sp. MR-7
  CDS (1)..(1014): transl_table=11
atgagccaaacgcccctaaactttccaagggaagagttttccaaggtagctttttcaacggaacacaatttaaatacttctgaacagcaagccttctggcaaaccgttgtccaagacacactcaaaacgtccgatggattaaccttggcctacatgatggtcaagcatcccaaggcccatgccagcatagtcatcagtagtggccgggttgagtcctacttaaagtatcaagaactcgtttttgatttgtaccagcaaggctattcggtatttgctatcgatcaccgcggccagggattatcgagccgcatgacggccaccccccatcaaggccacgtgcgacgattcaacgactatatcgacgactttgccctgtttatgcaaaccgttgtactcaaacatgccacttcgccactgttcttgctcgggcattctatgggcggcgctatcggcaccttgtatctcaaacaacatcccgatgtgtttacggcggcagcattctccgcccccatgtacggcattaagttacctatgcccaaagggtttgtccgttggcttgcgagtaagctcgatgccagtctcaacggtggagagcctaactatgtcctcagcgggcaaaactataaggcagctccctttaagggcaatgatctcacccattgccagagtcgttatcaagcctaccgagagttgtacgatgcggcgccaaagctgcaattaggctcacccactaaccgctggttgactgaatccttagatgcggccgatgcctgtgtcttggccacagcacatatccgtacgcctattctgatcctgcaagccagtgaggataagatcgtcgacaatgctgcacaaaatctggcggtaagctcaaattgccaattaaaggtgattgcaggggctgcccatgagatttttatggagaaagatagctaccgtaatcaagcgcttaattacgcgctcgacttttttaaacgctacgcaacaagggacgtggacaaacaagctgtttaa

SEQ ID NO: 3833 - protein, 337 aa, Shewanella sp. MR-7
MSQTPLNFPREEFSKVAFSTEHNLNTSEQQAFWQTVVQDTLKTSDGLTLAYMMVKHPKAHASIVISSGRVESYLKYQELVFDLYQQGYSVFAIDHRGQGLSSRMTATPHQGHVRRFNDYIDDFALFMQTVVLKHATSPLFLLGHSMGGAIGTLYLKQHPDVFTAAAFSAPMYGIKLPMPKGFVRWLASKLDASLNGGEPNYVLSGQNYKAAPFKGNDLTHCQSRYQAYRELYDAAPKLQLGSPTNRWLTESLDAADACVLATAHIRTPILILQASEDKIVDNAAQNLAVSSNCQLKVIAGAAHEIFMEKDSYRNQALNYALDFFKRYATRDVDKQAV

SEQ ID NO: 3834 - DNA, 1125 bp, Rhizobium leguminosarum bv. viciae 3841
  CDS (1)..(1125): transl_table=11
gtgcatcgtcccttcttcttcagtctcaacttcggccggccgcgagcaccctcatgctcccgccggcccttttcccccaccgctttccaagccggatgccatgcgctatccctgatgcgaagcagtcagcagcggcgcattggcaaagtcatggatcaggttctctattcgacgcccgataatcccgccccggaaaaccgcacggaggggttcttcgaaacccatgacggccaccagctgcgttacgccgtcttccgctcgagtggccagattgccaagggcaccgtcgtcatcctgcacggccgaaacgaatatatcgagaaatatttcgaaaccatccgcgacctcacggccaaaggcctctgggtcgcgaccttcgatatgcgtggccagggcggttcgccgcggctcctgaagagccgcaaccacggccacatccgccgcttcgtcgattacgagcgtgatctcgataccttcctggaaaaggtagtgctgccggatacccgcctgcccttctatctgctggcgcattccaccggcggcctgatcgcactctcggccgccccctatctcaccacccgtatcgatcgcatggtgctgtcggcgcccttcatcggcctgaccggccagtcggcctcgccccgcgtcatccgcgctctcgccggcacgctgaccgccctcggcctcggcttcctgccgctgacctcgaaactgaaggagccgaacttcagcgacaacccgctgacctcggacgaacaccgattcgagcgcaatgtcgcgatgatgaagacccatccggaattgacgctcggaccgccaacggcccgctggctgatcgaggctttccgcacgatggaccgggtcacctcacccaatcatctcttctcgatcaccatcccgaccatcgtcatcgccccgacgcgcgacggtgtcgtgccctacacggcgcaggagcggctttcacgttatttccgcgccggccagctagtgccgatcaacggcgcccgtcacgagatcttccaggaacgggatatctaccgcgccgccgcccttgcggccttccacgccttcattcccggcagcgatgccgaagaaaaccaggacgtcgccgccctcggcacgtga

SEQ ID NO: 3835 - protein, 374 aa, Rhizobium leguminosarum bv. viciae 3841
MHRPFFFSLNFGRPRAPSCSRRPFSPTAFQAGCHALSLMRSSQQRRIGKVMDQVLYSTPDNPAPENRTEGFFETHDGHQLRYAVFRSSGQIAKGTVVILHGRNEYIEKYFETIRDLTAKGLWVATFDMRGQGGSPRLLKSRNHGHIRRFVDYERDLDTFLEKVVLPDTRLPFYLLAHSTGGLIALSAAPYLTTRIDRMVLSAPFIGLTGQSASPRVIRALAGTLTALGLGFLPLTSKLKEPNFSDNPLTSDEHRFERNVAMMKTHPELTLGPPTARWLIEAFRTMDRVTSPNHLFSITIPTIVIAPTRDGVVPYTAQERLSRYFRAGQLVPINGARHEIFQERDIYRAAALAAFHAFIPGSDAEENQDVAALGT

SEQ ID NO: 3836 - DNA, 1014 bp, Shewanella sp. ANA-3
  CDS (1)..(1014): transl_table=11
atgagccaaacgcccctaaactttccaagggaagagttttccaaggtagctttttcaacggaacacgatttaaatacttctgaacagcaagccttctggcaaaccgttgtccaagacactctcaaaacgcccgatggattaaccttggcctacatgatggtcaagcatcccaaggcccatgccagcatagtcatcagcagcggtcgggttgaatcctacttaaagtatcaagaattggtatttgatttgtaccagcaaggctattcggtatttgccatcgatcaccgcggccagggattatcgagccgcatgacggccaatccccatcaaggccatgtgcggcggttcaacgactatatcgacgactttgccctgtttatgcaaaccgttgtgctcaaacatgccacttcgccactgttcttgctcgggcattctatgggcggcgccatcggtaccttgtatctcaaacaacatccggatgtgtttacggcggcggcattttcagctcccatgtatggcattaagttacctatgccgaaagggtttgtccgttggcttgcgagtaagctcgatgccagtctcaacggcggagagcctaactatgtcctcagcgggcaaaactataaggccgctccttttaagggaaatgatctcacccactgccagagccgttatcaagcctaccgagagttgtacgatgcggcgccgaagctgcaattaggctcaccgactaaccgctggttgactgaatccttagatgcggccgatgcctgtgttttggccacggcacatatccgcacgcccattctgatcctgcaagccagtgaggataagattgtcgacaatgccgcccaaaatctggcggtaagctcaaattgccaattaaaagtgattgcaggggcagcccatgagatttttatggagaaagatagctaccgtaatcaagcgcttaattacgcactcgacttttttaaacgctacgcaacaagggacgtggacaaacaagctgtttaa

SEQ ID NO: 3837 - protein, 337 aa, Shewanella sp. ANA-3
MSQTPLNFPREEFSKVAFSTEHDLNTSEQQAFWQTVVQDTLKTPDGLTLAYMMVKHPKAHASIVISSGRVESYLKYQELVFDLYQQGYSVFAIDHRGQGLSSRMTANPHQGHVRRFNDYIDDFALFMQTVVLKHATSPLFLLGHSMGGAIGTLYLKQHPDVFTAAAFSAPMYGIKLPMPKGFVRWLASKLDASLNGGEPNYVLSGQNYKAAPFKGNDLTHCQSRYQAYRELYDAAPKLQLGSPTNRWLTESLDAADACVLATAHIRTPILILQASEDKIVDNAAQNLAVSSNCQLKVIAGAAHEIFMEKDSYRNQALNYALDFFKRYATRDVDKQAV

SEQ ID NO: 3838 - DNA, 957 bp, Haemophilus somnus 2336
  CDS (1)..(957): transl_table=11
atgagtcaacatgaatctcacttcaatcattttgccttagccgaactgtatccttttgctacacaatttcctttgcaaaatataataggaaaaaaaggaatacgaatcgtctatcgccattttgttcaagaacattgtgctgaacgtagattagtgattttggtcaatggacgtgcagaaaacttgttgaaatggacagagttggcttatgacttttatcgacaaggctatgatgttttagcgtttgatcatcgtggacaaggctattctcagcgtttattaaaagaccatgacaaaggctatattgatgagtttcgtttttatgcggatgatcttactttgttagtggaaaaaattacttcgttgtatcactatcgtagccaacatattttggcacattctttaggcactttaatcagcacttattatcttgccaatgataatcaccaaataaaaagtgcggtattttctgcaccattttatggtattccactgcagcattcattacgagatgaattcattattaatttaatgatgttgcttgggcagggctcacgctatgtatttggcaaaggtgagtataaacccgctgatttagataagaatgatttgagtctttgtcgtactagaatgaaatggatgaatcgtattaatcgtcgatacccacatattcatttaggcggaccaacttttcgttgggtatatgagtgtatgtatgccattaaaaaattacccgttgtcttaccccgaattgaaattccggtactagttttacaatcagaaagagaaaaaattgtggataaccaaaatctgcaaaaattgaccgcacttttgcctcaagctcaactagtgcagattgaacatagtaggcatgagattttatttgaacgtgatcgaattcgagatttagcactagcaaaaatcaatcagttttttactgaaaataacgccaaataa

SEQ ID NO: 3839 - protein, 318 aa, Haemophilus somnus 2336
MSQHESHFNHFALAELYPFATQFPLQNIIGKKGIRIVYRHFVQEHCAERRLVILVNGRAENLLKWTELAYDFYRQGYDVLAFDHRGQGYSQRLLKDHDKGYIDEFRFYADDLTLLVEKITSLYHYRSQHILAHSLGTLISTYYLANDNHQIKSAVFSAPFYGIPLQHSLRDEFIINLMMLLGQGSRYVFGKGEYKPADLDKNDLSLCRTRMKWMNRINRRYPHIHLGGPTFRWVYECMYAIKKLPVVLPRIEIPVLVLQSEREKIVDNQNLQKLTALLPQAQLVQIEHSRHEILFERDRIRDLALAKINQFFTENNAK

SEQ ID NO: 3840 - DNA, 942 bp, Haemophilus influenzae R2846
  CDS (1)..(942): transl_table=11
atgatcagagaacctcattttcatcaatttgctcttgcagaattattgcctttttttgagcaatttcctacccaatatctttctggtaaacgaaatataaaattagcttatcgtcatttgattcaacctgaaagtgcggtcagaaaattgatgattttagtaaatggtcgagcagaaaatatgctgaaatggtcagagctcgcttatgatttttatcatcaaggttatgatgtattgctatttgatcatcgcggtcaaggctattcacagcgtattattcctcaaaaagggcatttagacgaatttcgtttctatgtcgatgatatggcaaaaatcattgaaaaagcgaccgcactttatgcttatcaagcgcaatatattctcgcacattccctcggcgctttgatttccacctattatctagcaaattatgatcatcacattaataaagcggtactttcttcgcctttttacggtattcttttaaaacatccaattagagatgaactgattattaccctaatgaatattttaggacaaggcgagcgttatgtttttggtaaagggccttatcaacaagcccacttggaatacaatgaattaactttctgtaaaaccagaatgaaatggatgaatcgtgtaaatcgtaaaaatccagcaattaatcttggcgggccaacattccgttgggtacatttatgtttgaacgcaattaaacgcttgccgaaagttattcctaagattgaaattccaatcctaattttacaagccgaaaaagaaaaaatagtagataacaacaatcttgaaaaattaaccgcactttttccgaatgctcaatgtaaagttgtattgaacgctaaacatgaggtgttatttgaaaaagataatgttcgaagaaatgtacttaaaagtgttaatcattttctaaatgtgcaaagttga

SEQ ID NO: 3841 - protein, 313 aa, Haemophilus influenzae R2846
MIREPHFHQFALAELLPFFEQFPTQYLSGKRNIKLAYRHLIQPESAVRKLMILVNGRAENMLKWSELAYDFYHQGYDVLLFDHRGQGYSQRIIPQKGHLDEFRFYVDDMAKIIEKATALYAYQAQYILAHSLGALISTYYLANYDHHINKAVLSSPFYGILLKHPIRDELIITLMNILGQGERYVFGKGPYQQAHLEYNELTFCKTRMKWMNRVNRKNPAINLGGPTFRWVHLCLNAIKRLPKVIPKIEIPILILQAEKEKIVDNNNLEKLTALFPNAQCKVVLNAKHEVLFEKDNVRRNVLKSVNHFLNVQS

SEQ ID NO: 3842 - DNA, 942 bp, Haemophilus influenzae R2866
  CDS (1)..(942): transl_table=11
atgatcagagaaccttattttcatcaatttgctcttgcagaattattgcctttttttgagcaatttcctacccaatatctttctggtaaacgaaatataaaattagcttatcgtcatttgattcaacctgaaagtgcggtcagaaaattgatgattttagtaaatggtcgagcagaaaatatgctgaaatggtcagagctcgcttatgatttttatcatcaaggttatgatgtattgctatttgatcatcgcggtcaaggctattcacagcgtattattcctcaaaaagggcatttagacgaatttcgtttctatgtcgatgatatggcaaaaatcatcgaaaaagtgaccgcacttttcagctattcaacacagcatttgcttgctcattcaatgggcgcattgattgcaacctattatttggcaaattgtgatcattacattaataaagcggtactttcttcgcctttttacggtattcttttaaaacatcccattagagatgaactgattattaccctaatgaatattttaggacaaggcgagcgttatgtttttggcaaaggtgcttatcaacaagcccacttggaatacaatgaattaactttctgtaaaaccagaatgaaatggatgaatcgtgtaaatcgtaaaaatccagcaattaatcttggcgggccaacattccgttgggtacacttgtgtttgaacgcaattaaacgcttgccgaaagttattcctaagattgaaattccaatcctaattttacaagccgaaaaagaaaaaatagtagataacaaaaatcttgaaaaattaaccgcactttttccgaatgctcaatgtaaagttgtattgaacgctaaacatgaggtgttatttgaaaaagataatgttcgaagaaatgtacttaaaagtgttaatcattttctaaatgtgcaaagttga

SEQ ID NO: 3843 - protein, 313 aa, Haemophilus influenzae R2866
MIREPYFHQFALAELLPFFEQFPTQYLSGKRNIKLAYRHLIQPESAVRKLMILVNGRAENMLKWSELAYDFYHQGYDVLLFDHRGQGYSQRIIPQKGHLDEFRFYVDDMAKIIEKVTALFSYSTQHLLAHSMGALIATYYLANCDHYINKAVLSSPFYGILLKHPIRDELIITLMNILGQGERYVFGKGAYQQAHLEYNELTFCKTRMKWMNRVNRKNPAINLGGPTFRWVHLCLNAIKRLPKVIPKIEIPILILQAEKEKIVDNKNLEKLTALFPNAQCKVVLNAKHEVLFEKDNVRRNVLKSVNHFLNVQS

SEQ ID NO: 3844 - DNA, 945 bp, Sulfitobacter sp. EE-36
  CDS (1)..(945): transl_table=11
atgctggaaaccgcgccctttttcaccgacattgcgccgctgcccgaaacgggtcaggcgcattgggccgagacatcggatggtaaaaagctgcgcgtcgcgcattggccgctgaacggggcaaagggcaccgtgctgcttttccccggccgcaccgaatacgtggaaaaatatgcgatgaccgcaagcgcctttgcgaaaaaggggctggcggtcatggcgattgactggcgggggcaaggtctgtcggaccggttgatctccgaccgcaacatcggccatgtcgatgtcttctctgactatcaaaaagacgtggcggccatgatgcggacagcccgcgccttgcagctgccgcgcccgtatttcctgctggcacactctatgggcggggccatcggcctacgcgcctgtatggagggtctgtccgtgcaggccgccgcctttaccgcgccgatgtgggggatccatatcgcgccgcatatgcgtctggtggcggcggggctgacacagctgatgccgcgcatcggtcagggctacaagctgcccatgggcacgcaggcggcatcctatatctcgaccgcgccgttcgagaacaacatgctcaccaccgaccccgagatgtacgagatgatgcgcacgcaactggcggcccatcccgaactgtctttgggcgggcccagctttatctggctgcgcgaggctttatccgagaccaagcatctgtccctgcgcgccgcccccagcctgccctgcgccacattcctcgggtccaacgaacgtatcgtgcacaagggccgcatccacgcccgtatagagacttggaaaggcggcaagctgaatatcattgacggcgcagagcacgaagtgctgatggaaatccccgccacccgcgacaaagcggtggatgagatggcggccctgttctttggaaacgccaaaaagtag

SEQ ID NO: 3845 - protein, 314 aa, Sulfitobacter sp. EE-36
MLETAPFFTDIAPLPETGQAHWAETSDGKKLRVAHWPLNGAKGTVLLFPGRTEYVEKYAMTASAFAKKGLAVMAIDWRGQGLSDRLISDRNIGHVDVFSDYQKDVAAMMRTARALQLPRPYFLLAHSMGGAIGLRACMEGLSVQAAAFTAPMWGIHIAPHMRLVAAGLTQLMPRIGQGYKLPMGTQAASYISTAPFENNMLTTDPEMYEMMRTQLAAHPELSLGGPSFIWLREALSETKHLSLRAAPSLPCATFLGSNERIVHKGRIHARIETWKGGKLNIIDGAEHEVLMEIPATRDKAVDEMAALFFGNAKK

SEQ ID NO: 3846 - DNA, 975 bp, Oceanicola batsensis HTCC2597
  CDS (1)..(975): transl_table=11
atggaacaggcccccttcttcgccgatatcgccgaaggcccgccgggcggccgggcggtctggacgaccgcctcggacggcgtgcgcatccgcgtcggctggtggccggcgcgggacggcgggacggcgaaaggcacgatcctgatctttcccggccggaccgagtatatcgagaaatacggccgcgacgcccggaccctgaccgaggccggctttgccgtgctcgcaatcgactggcgcggccagggcatcgccgaccggctggtggccaatgcgcgcgtcggtcacgtggaccggttccacgactatcagctggacgtcgccgccgctctggccgtggccgaagaggccgggctgcccaggccgtggcacctgctgggccattcgatgggcggctgcatcggcctgcgctcggtgctcgagggggtgccggtgaactcggccgtcttctcggcgccgatgtggggcatccggcttgccgcgccgacccgacccgccgcctgggtcctgacctggggcggctcgcggctggggctggggcacctgatgtcgcccggcaccaaggaggccccctacccgctcgacgtggcgttcggcgagaacaagctgacctcggaccgcgacatgttcgactacatgcggcggcagctgaccgaacagcccgacctcgggctgggcggcccgtcgctgcactggctcaaccaggcgctgaccgagacgctggcgctggcccggcggcccgcgcccgacctgccctgcctgacattcctcggcgcggacgaagccatcgtggacccggcccggatccatgcccggatggaaaactggcgcgagggcgacctggtggtgctgcccggcgctcgacacgaagtgctgatggagacgcccgagacccgtgcgcgcatcttcgaacggatgctgcccttcctcgacgcccacgccgccatcgccgcgccgccggcgcgcagcgcataa

SEQ ID NO: 3847 - protein, 324 aa, Oceanicola batsensis HTCC2597
MEQAPFFADIAEGPPGGRAVWTTASDGVRIRVGWWPARDGGTAKGTILIFPGRTEYIEKYGRDARTLTEAGFAVLAIDWRGQGIADRLVANARVGHVDRFHDYQLDVAAALAVAEEAGLPRPWHLLGHSMGGCIGLRSVLEGVPVNSAVFSAPMWGIRLAAPTRPAAWVLTWGGSRLGLGHLMSPGTKEAPYPLDVAFGENKLTSDRDMFDYMRRQLTEQPDLGLGGPSLHWLNQALTETLALARRPAPDLPCLTFLGADEAIVDPARIHARMENWREGDLVVLPGARHEVLMETPETRARIFERMLPFLDAHAAIAAPPARSA

SEQ ID NO: 3848 - DNA, 960 bp, Pseudoalteromonas tunicata D2
  CDS (1)..(960): transl_table=11
atgtttattagtcaagaagataagttaattgaaaaccaagccgaaattaatttattttggcagcagcaggttgtacaagataagttattacttagtgatcatacgctgcattacgcttatgtcattccagcccaggcaatacaggcagttgtaataagcagtggtcgtattgaaagcttattaaaataccaagagcttatttgggaattagcacaaaataactacgcggtgtttattattgatcatcgaggccaaggattatcaagtcgtgatttagttaatccgcacaaagggtatattgcggattttaaaaactataccgatgacttttcactttttaatcagcaaattgttgattcactttggcacggaaaaaaatatttattagcgcactcgatgggctctgcgattgccacattatatttagatcattacccacatcgttttagtaaggtagctttgtgtggtccaatgtttggcattgatttaggcaaggcgcctgcatggttagcaaaagggctcactcaaacattaaatcgtcttggggcaggtaaacgctattttatcgaccaaggtgattatctagcaaaaccttttagtgaaaatgagctcacaacaagtgcattgcgttatcaactatttcgccaaacttaccaagcaaatcctgttgttcaattaggtggggtaactgtagcttggctcaatgctgcttttattgcgatggaaaaattaagtaaaatcaacctcactttgccaaccctagttttacaagccggtgccgattctatcgttgataacagcgcgcaaaatgcatggctgagtcataacaaacacgcccaattgaaatgctttgagcaagccaaacatgaactgctgtccgaacaagataaaattcgaacaccagtcatgactgctatttatgaattttttgatctcagtactacagagacaggatcttga

SEQ ID NO: 3849 - protein, 319 aa, Pseudoalteromonas tunicata D2
MFISQEDKLIENQAEINLFWQQQVVQDKLLLSDHTLHYAYVIPAQAIQAVVISSGRIESLLKYQELIWELAQNNYAVFIIDHRGQGLSSRDLVNPHKGYIADFKNYTDDFSLFNQQIVDSLWHGKKYLLAHSMGSAIATLYLDHYPHRFSKVALCGPMFGIDLGKAPAWLAKGLTQTLNRLGAGKRYFIDQGDYLAKPFSENELTTSALRYQLFRQTYQANPVVQLGGVTVAWLNAAFIAMEKLSKINLTLPTLVLQAGADSIVDNSAQNAWLSHNKHAQLKCFEQAKHELLSEQDKIRTPVMTAIYEFFDLSTTETGS

SEQ ID NO: 3850 - DNA, 921 bp, Photobacterium sp. SKA34
  CDS (1)..(921): transl_table=11
atgacgaatgcggtaagtgaaatgtggcaacaacgtcacgaaggaaaattcactggcgttaaacaatgtgaattaggatgggtcagtttaaccccaaagcgcagtgataaagtcattatcgtggttaatgggcgagtagaaacctattggaaataccaagagctgttctacgatttagttaaacaaggctaccacgtttattccttcgatcatcgtggccagggcgtctctgaacgattagttgctgatcatgaattaggatatgtcgaacactttgatgactacgttgaagacctgcatctttttatgcaaaacatcgtaaaaccacaagattataaacagcacttcatccttggtcattcgatgggaggggcaataaccagtttagcactggctcgttatcccactctttttgaccgcgccgtacttagtgcacccatgcatggcatctatgttaaacctcacttaaagccctttgccgaagcactgatcggcatcaccgaattattttgtcgtcaacctcactatgctattggtcaaaagccctattatgcaaaaccgttcgatggcaacttactcacccacagccaaacacgttaccaatggtttcgcgatctttacgatgttcgccctgaattacgcattggtggcgcaagtaatcactgggtatgggaaagtattaaagcggcccgtcaagcgattcagcaagccaataccatcactatctctgttcttttacttcaaggcagtgaagataaaattgttgataacgcctgtcagcagcagtttcagcaacggctaaaccaaggctcagggcactgtaattttcagattattgaaggttctcgccatgagatcttatttgaaagtgatccgctccgtaatcaagcgattacggcactcttggcgcattttgcttaa

SEQ ID NO: 3851 - protein, 306 aa, Photobacterium sp. SKA34
MTNAVSEMWQQRHEGKFTGVKQCELGWVSLTPKRSDKVIIVVNGRVETYWKYQELFYDLVKQGYHVYSFDHRGQGVSERLVADHELGYVEHFDDYVEDLHLFMQNIVKPQDYKQHFILGHSMGGAITSLALARYPTLFDRAVLSAPMHGIYVKPHLKPFAEALIGITELFCRQPHYAIGQKPYYAKPFDGNLLTHSQTRYQWFRDLYDVRPELRIGGASNHWVWESIKAARQAIQQANTITISVLLLQGSEDKIVDNACQQQFQQRLNQGSGHCNFQIIEGSRHEILFESDPLRNQAITALLAHFA

SEQ ID NO: 3852 - DNA, 918 bp, Photobacterium sp. SKA34
  CDS (1)..(918): transl_table=11
atggcgagtgaagtccattatatgtggcagaagagggagcaaggtgaatttaaaggtgttgatggaataccgatcaggtggataagtattcggcatcctcaaaatgagcgttgtgttgtcatcgttaatgggcgtaatgagagcttctggaaatatcaggagctatgttatgagttatctcgtaaaggctacgatgtgtacgcttatgatcatcgtggtcaaggcgcatcagggcgattaacgaacgatagcgaacttgggcatgtgatttgttttgatgattatgtgtcagaccttcatttatttattacaaatgttgttggaaaacaagcatacagacaacggtttttattagctcattcaatgggaggtgcggtagcaacattatatttagaacgttatcaaactcattttaatgccgttgttcttaatgcacctatgtttggtatcaatcttcctgtaccgttaaaattagtagcctcttcaatcgcaaaaattatcgagcattatcaaacacaaccgtcttatgtgtttggatataagccgtatcacgaagcgccttttgaagaaaatgatcaatgccaaagtcaaatacgttacgtttgggcaaagcatttgtatcagtgccatccagaactgcgtgttggtggtcctagtgctcgatgggtatggcaagcattagctgccgcgaaaagctgtatacgggatgtagatcatattcatacgcccgtattattgttgcaggcaggtgacgatacaattgtcgataatgattctcatcatcttttttactctaagtgctcagagtgtcaaataaaagtgatcccacatgctcgacatgaattattaatggaaaaagattgcttacgtaatcaagcattagaagatacgttagatttttttgagacttatagttaa

SEQ ID NO: 3853 - protein, 305 aa, Photobacterium sp. SKA34
MASEVHYMWQKREQGEFKGVDGIPIRWISIRHPQNERCVVIVNGRNESFWKYQELCYELSRKGYDVYAYDHRGQGASGRLTNDSELGHVICFDDYVSDLHLFITNVVGKQAYRQRFLLAHSMGGAVATLYLERYQTHFNAVVLNAPMFGINLPVPLKLVASSIAKIIEHYQTQPSYVFGYKPYHEAPFEENDQCQSQIRYVWAKHLYQCHPELRVGGPSARWVWQALAAAKSCIRDVDHIHTPVLLLQAGDDTIVDNDSHHLFYSKCSECQIKVIPHARHELLMEKDCLRNQALEDTLDFFETYS

SEQ ID NO: 3854 - DNA, 948 bp, Xanthobacter autotrophicus Py2
  CDS (1)..(948): transl_table=11
atgacattgttcgcccttccgaaccatccggtgccagacggctgcgtcaccggcgaactcgtcgccgaagacggcgtgaagctgcggtttgcccgctgggcgcccgagagcggcagtgtgaagggcaccgtcgccctgtttggcgggcgctgtgaattcatcgagaaatatttcgaggtggtgcgcgagctgcgttcccgcggctttgccgtggccatggtggactggcgcggccagggcggctcccagcgcctgctgcgcaaccggttgaaggggcacgtgccccgcttctcggactatctgctggacctcgaggtgttcgcccgcgaggtgatgctacccgattgcccgccgccccacttcgcgctgggccattccatgggcggcaccatccttttgtcctcggtgctggacggccagcgctggttcgaccgcatggtgctcaccgcccccatgctgggactggatgcggtgccgttcgaggacttcgttcgcccgctgtcgtcgctgctcgcccatatgggcttcgcccgcgcctatgtgcccggcggccacggcaggacgatctcgcgcatgcggttcgaaggcaatctcctgacctcggaccgcgcgcggttcgagcgcactcaggccctcgtcaaagcctttccggagctggacctcggcgcgccgaccgtgggctggctcgcaggcgcggaggccctcatggcagagctgacacatccggacaccatcagccgcatccgccagcccctgctcatcatcgccgccgggggcgagcggctggtctcgaacaaggccatcgagcatttctcggcccggctcatcgccggcgcccatgtggtggtgccggccagccgccacgagctgatgatggagaaggacatcttccgcgcccagttctgggccgcgttcgatgccttcatccccggaacgccgatcctgtga

SEQ ID NO: 3855 - protein, 315 aa, Xanthobacter autotrophicus Py2
MTLFALPNHPVPDGCVTGELVAEDGVKLRFARWAPESGSVKGTVALFGGRCEFIEKYFEVVRELRSRGFAVAMVDWRGQGGSQRLLRNRLKGHVPRFSDYLLDLEVFAREVMLPDCPPPHFALGHSMGGTILLSSVLDGQRWFDRMVLTAPMLGLDAVPFEDFVRPLSSLLAHMGFARAYVPGGHGRTISRMRFEGNLLTSDRARFERTQALVKAFPELDLGAPTVGWLAGAEALMAELTHPDTISRIRQPLLIIAAGGERLVSNKAIEHFSARLIAGAHVVVPASRHELMMEKDIFRAQFWAAFDAFIPGTPIL

SEQ ID NO: 3856 - DNA, 1050 bp, Vibrio sp. Ex25
  CDS (1)..(1050): transl_table=11
atgatacatcgcgtaaacaacgtatcttcaggtaatcgactaatggctactaaccattcacctttgacttatactcaagagtcattatttgagcaagcaattggtggtccgatcgcggcactttggcaaactcgccaagaaggctttgttaaaggaactgagaaaaagaacatttactggtgcaaactgaccaacccagaacataaaaaagccgtgctcatcgttaatgggcgcattgagtcttcctggaaataccaagaactgttttacgatctctatcgccaaggcttcgacgtctattcctttgaccaccgcggacaaggtttatcagatcgtctattgtctgactcagatatgggtcacgtctatgactttactgattatattgacgatatggacgtggtcgtaaacaaacacgaccttagcgactatcagcaatgtttcatcattgcccactccatgggcggcgcaatcgctacacgttatctgcaaactcacccagaacatccttttaccggcttgattcttagtgcgcctatgtttggtattaatctgccatggtacttatcgccaatagcgattccagtaacacaaattatgtcagcggtatccactttgccacgttatgcgccaggacatcaggcctactttcctaaaccctttgaagataacccgctcagccaaagctatggtcgctaccaatggttccgaaatctctatacggaaaaaccggaactgcaagtcggtggaccgagcacacgatgggtatggcaagggctaatggcagcaaaacaatgctttttattgactcgccaagtcaaagtaccggtgctcctgattcaagctggaaacgatcgtattgtcagcaatctggcacaaaaacgttttatcgataaattgcgtaaaaccaacccacatgcggagctactttctatcgaaggcgcacagcatgagatcttattcgagaccgaccagtatcgtaatcaagcactcgatgcgatcttccgctttatgaatgacccgaaatcatcgccaaacgaaagaacataa

SEQ ID NO: 3857 - protein, 349 aa, Vibrio sp. Ex25
MIHRVNNVSSGNRLMATNHSPLTYTQESLFEQAIGGPIAALWQTRQEGFVKGTEKKNIYWCKLTNPEHKKAVLIVNGRIESSWKYQELFYDLYRQGFDVYSFDHRGQGLSDRLLSDSDMGHVYDFTDYIDDMDVVVNKHDLSDYQQCFIIAHSMGGAIATRYLQTHPEHPFTGLILSAPMFGINLPWYLSPIAIPVTQIMSAVSTLPRYAPGHQAYFPKPFEDNPLSQSYGRYQWFRNLYTEKPELQVGGPSTRWVWQGLMAAKQCFLLTRQVKVPVLLIQAGNDRIVSNLAQKRFIDKLRKTNPHAELLSIEGAQHEILFETDQYRNQALDAIFRFMNDPKSSPNERT

SEQ ID NO: 3858 - DNA, 948 bp, Alteromonadales bacterium TW-7
  CDS (1)..(948): transl_table=11
atgttttatagtagtgagcgcgagcttaaaggtaaccaatcagccattaatgatttttatcaaaacacattagttaaagcgtatttaaatacgcctaatgggcagttattttatgcgcatgcccagccagataaagctcatgttgccatagttattagctcaggcagaatcgaagggctcgataaatacaaagagttgttatgggagctttatactaataattttgctgtttttattgttgaccaccaaggacagggtcgctcttaccgctatttaaaaaataaacataagggccatgtaaataattttggtgactacagtgccgaccttaatttatttaacacccaaatagtcgacaccgtttggcaaggtaaaaagctattagtgagccactcgatgggaggtgctattgcatttgattatttggcaaactatgagcatagttttagcggtgcgtttttatcagccccaatgttcgatatacacaccaaaggtattccaaagcctttagcccgaataattgcaagtaatgccgtacgtcttggttttcagtttagctatgcccttggacaaaccgactacaccccagaagaattccctttaaacgtattaacaagttgcgaattacgctacagcctatttaggcaaacatataatgaggagcctttactgcaacttggcggggttacttatgggtggctaaattcaacctttacttttttatcatcaatagatgagcttactgttgatattccactttacattgcaagcgcaaaaaacgatgtagttgtcgataatgaagcgcactatagactagctaataagtacgcaaatattaccctagaaagctttactgatgccaaacacgaactattctttgaatgtgatgatgtacgccagccagtacttaagagtctgtataagttttgtgagtcggtgacggcttag

SEQ ID NO: 3859 - protein, 315 aa, Alteromonadales bacterium TW-7
MFYSSERELKGNQSAINDFYQNTLVKAYLNTPNGQLFYAHAQPDKAHVAIVISSGRIEGLDKYKELLWELYTNNFAVFIVDHQGQGRSYRYLKNKHKGHVNNFGDYSADLNLFNTQIVDTVWQGKKLLVSHSMGGAIAFDYLANYEHSFSGAFLSAPMFDIHTKGIPKPLARIIASNAVRLGFQFSYALGQTDYTPEEFPLNVLTSCELRYSLFRQTYNEEPLLQLGGVTYGWLNSTFTFLSSIDELTVDIPLYIASAKNDVVVDNEAHYRLANKYANITLESFTDAKHELFFECDDVRQPVLKSLYKFCESVTA

SEQ ID NO: 3860 - DNA, 1576 bp, Escherichia coli O6
  CDS (118)..(1140): transl_table=11
aggtcatgatgaactcccggtgtgtctatttttgtgccacaatacgctactgtcgcagcgttgtgtcaggcacgctaaaaaaaacgattttacgtggtttaagaggcagattacccgatgtttcagcagcaaaaagactgggaaacaagagaaaacgcgtttgctgcttttaccatgggaccgctgactgatttctggcgtcagcgtgatgaagcagagtttactggtgtggatgacattccggtgcgctttgtccgttttcgcgcacagcaccatgaccgggtggtagtcatctgcccggggcgtattgagagctacgtaaaatatgcggaactggcctatgacctgttccatttggggtttgatgtcttaatcatcgaccatcgcgggcagggacgttccggtcgcctgttagccgatccgcatctcgggcatgttaatcgctttaatgattatgttgatgatctggcggcattctggcagcaggaggttcagcccggtccgtggcgtaaacgctatatactggcacattcgatgggcggtgcgatctccacattatttctgcaacgccatccaggtgtatgtgacgccattgcgctaactgcgccaatgtttgggatcgtgattcgtatgccgtcatttatggcacggcagatcctcaactgggccgaagcgcatccacgtttccgtgatggctatgcaataggcaccgggcgctggcgcgcgttgccgtttgctatcaacgtactgacccacagcagacagcgatatcgacgtaacttacgcttctatgctgatgacccaacgattcgcgtcggtgggccgacctaccattgggtacgcgaaagtattctggctggcgaacaggtgttagccggtgcgggtgatgacgccacgccaacgcttctcttgcaggctgaagaggaacgcgtggtggataaccgcatgcatgaccgtttttgtgaactccgcaccgccgcgggccatcctgtcgaaggaggacggccgttggtaattaaaggtgcttaccatgagatcctttttgaaaaggacgcaatgcgctcagtcgcgctccacgccatcgttgattttttcaacaggcataactcacccagcggaaaccgctctacagaggtttaaatttcttatgtaccaggttgttgcgtctgatttagatggcacgttactttctcccgaccatacgttatccccttacgccaaagaaactctgaagctgctcaccgcgcgcggcatcaactttgtgtttgcgaccggtcgtcaccacgttgatgtggggcaaattcgcgataatctggagattaagtcttacatgattacctccaatggtgcgcgcgttcacgatctggatggtaatctgatttttgctcataacctggcgttgaatgcatgcccggcgtccgggtacacgataatctctgctttcgcattagcagcccgcagcgcctggcgcatggtttcaacgctctcctgcggaatgctgttatcctgaccaccatataagccgagaatcggcgcgttaagatcggttgcgatatcaacaggttgtttcggtgaa

SEQ ID NO: 3861 - protein, 340 aa, Escherichia coli O6
MFQQQKDWETRENAFAAFTMGPLTDFWRQRDEAEFTGVDDIPVRFVRFRAQHHDRVVVICPGRIESYVKYAELAYDLFHLGFDVLIIDHRGQGRSGRLLADPHLGHVNRFNDYVDDLAAFWQQEVQPGPWRKRYILAHSMGGAISTLFLQRHPGVCDAIALTAPMFGIVIRMPSFMARQILNWAEAHPRFRDGYAIGTGRWRALPFAINVLTHSRQRYRRNLRFYADDPTIRVGGPTYHWVRESILAGEQVLAGAGDDATPTLLLQAEEERVVDNRMHDRFCELRTAAGHPVEGGRPLVIKGAYHEILFEKDAMRSVALHAIVDFFNRHNSPSGNRSTEV

SEQ ID NO: 3862 - DNA, 942 bp, Haemophilus influenzae
  CDS (1)..(942): transl_table=11
atgatcagagaaccttattttcatcaatttgctcttgcagaattattgcctttttttgagcaatttcctacccaatatctttctggtaaacgaaatataaaattagcttatcgtcatttgattcaacctgaaagtgcggtcagaaaattgatgattttagtaaatggtcgagcagaaaatatgctgaaatggtcagagctcgcttatgatttttatcatcaaggttacgatgtattgctatttgatcatcgcggtcaaggctattcacagcgtattattcctcaaaaagggcatttagatgaatttcgtttctatgtcgatgatatggcgaaaatcatcgaaaaagtaaccgcacttttcagctattcaacgcagcatttgcttgctcattcaatgggcgcattgattgcaacctattatttggcaaattatgatcatcacattaataaagcggtactttcttcgcctttttacggtattcttttaaaacatcccattagagatgaactgattattaccctaatgaatattttaggacaaggcgagcgttatgtttttggcaaaggtgcttatcaacaagcccacttggaatacaatgaattaactttctgtaaaaccagaatgaaatggatgaatcgtataaatcgtaaaaatccagcaattaatcttggcgggccaacattccgttgggtacatttgtgtttgaacgcaattaaacgcttgccgaaagttattcctaagattgaaattccaatcctaattttacaagccgaaaaagaaaaaatagtagataacaaaaatcttgaaaaattaaccgcactttttccgaatgctagatgtgaagtcatattaaatgctaaacatgaggtgttatttgaaaaagataatgttcgaagaaatgtacttaaaagtgttaatcattttctaaatgtgcaaagttga

SEQ ID NO: 3863 - protein, 313 aa, Haemophilus influenzae
MIREPYFHQFALAELLPFFEQFPTQYLSGKRNIKLAYRHLIQPESAVRKLMILVNGRAENMLKWSELAYDFYHQGYDVLLFDHRGQGYSQRIIPQKGHLDEFRFYVDDMAKIIEKVTALFSYSTQHLLAHSMGALIATYYLANYDHHINKAVLSSPFYGILLKHPIRDELIITLMNILGQGERYVFGKGAYQQAHLEYNELTFCKTRMKWMNRINRKNPAINLGGPTFRWVHLCLNAIKRLPKVIPKIEIPILILQAEKEKIVDNKNLEKLTALFPNARCEVILNAKHEVLFEKDNVRRNVLKSVNHFLNVQS

SEQ ID NO: 3864 - DNA, 24 bp, Artificial sequence
  primer
atgtttcagcagcaaaaagactgg

SEQ ID NO: 3865 - DNA, 24 bp, Artificial sequence
  primer
ttaaacctctgtagagcggtttcc

SEQ ID NO: 3866 - protein, 275 aa, Artificial sequence
  consensus sequence
  Variant (3)..(3): Xaa in position 3 is any amino acid
  Variant (5)..(7): Xaa in position 5 to 7 is any amino acid
  Variant (10)..(10): Xaa in position 10 is any amino acid
  Variant (12)..(19): Xaa in position 12 to 19 is any amino acid
  Variant (21)..(22): Xaa in position 21 to 22 is any amino acid
  Variant (24)..(26): Xaa in position 24 to 26 is any amino acid
  Variant (28)..(28): Xaa in position 28 is any amino acid
  Variant (33)..(33): Xaa in position 33 is any amino acid
  Variant (35)..(35): Xaa in position 35 is any amino acid
  Variant (37)..(41): Xaa in position 37 to 41 is any amino acid
  Variant (42)..(44): Xaa in position 42 to 44 is any or no amino acid
  Variant (46)..(49): Xaa in position 46 to 49 is any amino acid
  Variant (51)..(52): Xaa in position 51 to 52 is any amino acid
  Variant (54)..(55): Xaa in position 54 to 55 is any amino acid
  Variant (57)..(76): Xaa in position 57 to 76 is any amino acid
  Variant (77)..(79): Xaa in position 77 to 79 is any or no amino acid
  Variant (82)..(82): Xaa in position 82 is any amino acid
  Variant (84)..(104): Xaa in position 84 to 104 is any amino acid
  Variant (105)..(106): Xaa in position 105 to 106 is any or no amino acid
  Variant (108)..(149): Xaa in position 108 to 149 is any amino acid
  Variant (150)..(155): Xaa in position 150 to 155 is any or no amino acid
  Variant (157)..(157): Xaa in position 157 is any amino acid
  Variant (160)..(163): Xaa in position 160 to 163 is any amino acid
  Variant (165)..(175): Xaa in position 165 to 175 is any amino acid
  Variant (177)..(180): Xaa in position 177 to 180 is any amino acid
  Variant (182)..(182): Xaa in position 182 is any amino acid
  Variant (184)..(186): Xaa in position 184 to 186 is any amino acid
  Variant (188)..(205): Xaa in position 188 to 205 is any amino acid
  Variant (206)..(209): Xaa in position 206 to 209 is any or no amino acid
  Variant (211)..(211): Xaa in position 211 is any amino acid
  Variant (213)..(221): Xaa in position 213 to 221 is any amino acid
  Variant (223)..(244): Xaa in position 223 to 244 is any amino acid
  Variant (245)..(254): Xaa in position 245 to 254 is any or no amino acid
  Variant (257)..(259): Xaa in position 257 to 259 is any amino acid
  Variant (261)..(261): Xaa in position 261 is any amino acid
  Variant (263)..(264): Xaa in position 263 to 264 is any amino acid
  Variant (266)..(274): Xaa in position 266 to 274 is any amino acid
GRXEXXXKYXEXXXXXXXXGXXVXXXDXRGQGXSXRXXXXXXXXGXXXXFXXYXXDXXXXXXXXXXXXXXXXXXXXXXXHSXGXXXXXXXXXXXXXXXXXXXXXXXPXXXXXXXXXXXXXXXXXXXXXXXXXXXXXXXXXXXXXXXXXXXXXXXXNXLTXXXXRXXXXXXXXXXXPXXXXGXPXXXWXXXXXXXXXXXXXXXXXXXXXXPXLXXXXXXXXXVXXXXXXXXXXXXXXXXXXXXXXXXXXXXXXXXHEXXXEXDXXRXXXXXXXXXF

SEQ ID NO: 3867 - protein, 21 aa, Artificial sequence
  protein pattern
  Variant (2)..(2): Xaa in position 2 is any amino acid
  Variant (3)..(7): Xaa in position 3 to 7 is any or no amino acid
  Variant (9)..(9): Xaa in position 9 is His or Trp
  Variant (14)..(14): Xaa in position 14 is any amino acid
  Variant (15)..(15): Xaa in position 15 is Ala or Ser
  Variant (16)..(16): Xaa in position 16 is any amino acid
  Variant (18)..(20): Xaa in position 18 to 20 is any amino acid
  Variant (21)..(21): Xaa in position 21 is Asp, Asn, Gln or Thr
GXXXXXXDXRGQGXXXRXXXX

SEQ ID NO: 3868 - DNA, 3396 bp, Saccharomyces cerevisiae
  CDS (1)..(3396)
atgagtggttcgcattcaaatgatgaggatgacgtagtgcaagtgcccgagacgtcctctcccaccaaggtagcatcgtcgtctcccttaaagcctacttcgccaacagttccggatgcaagtgtggcgtctttgagaagcaggtttactttcaagccttcagatcccagcgaaggagctcatacttcgaagccgctcccatctgggagtcctgaggtagcactggttaaccttgcgagagagttccccgatttctctcaaactctggtgcaggctgttttcaaatctaactcttttaacttacagtctgccagggaacgtcttacaagattgaggcagcaaagacaaaattggacatggaacaagaacgcatctcccaagaagtcagaaaccccgccacctgtcaagaagtcattaccactggcaaacacaggccgtttatcatctatccatggcaatatcaacaacaaatcctccaagattaccgtggccaaacagaaaacgtccatttttgaccgttactcaaacgtcatcaaccagaaacaatacacttttgagctgccaactaacttgaatatagactcggaggcactgagcaagttgcccgtgaactacaacaaaaagagaaggctggtaagggcagatcagcatccaattggcaagtcttatgagtcatccgctacacaattaggttctgcaagagagaaactactggcgaaccgcaaatacggtcgtcatgcaaacgacaacgatgaagaggaggaagagagtatgatgacggacgatgacgatgcaagtggcgacgactacacagaatccacgccgcagataaatctggatgaacaagttttacagtttattaatgactctgatattgtcgatctctcggacctctcagataccacgatgcataaggctcaactcatagcctcacataggccatattcttctttaaatgcctttgtaaacacaaatttcaatgataaggacactgaggagaacgcatcgaacaagagaaaaagacgtgcggctgcatccgccaatgagagtgagaggctgctcgataaaatcacccaaagtataagaggttacaatgcaattgagtctgtgatcaagaaatgttcttcctacggtgatttggtcacttcgcaaatgaagaaatggggtgtgcaagtggaaggcgataactctgagttggacctgatgaaccttggggaagacgatgacgacgacaatgatgatggcaataacgataataataatagcaacaataacaataccgctggcgcagacgccactagcaaggaaaaagaagatacaaaggccgtagtggaaggttttgatgaaactagcgcagaacctactccagcaccagcaccagcaccagtggaaagagaaacaaaacgaattagaaacacaactaagccaaaagtggtcgaagatgaagatgacgatgtagatttggaggcaatcgatgacgaattgccgcagtctgagcatgaagatgatgactatgaagaggaggacgaagactataacgatgaggaagaagatgtggaatatgatgatggtgacgatgatgacgatgatgacgatgaatttgtcgctaccagaaaaaacacacacgtgatctccaccacgagcagaaatggccgtaaacctattgtcaagttcttcaagggcaaacccagactgttaagcccggaaatttcactaaaagactaccaacaaacgggtataaactggttgaatctgctataccaaaacaagatgtcatgtatccttgcagacgacatgggtctaggtaaaacatgtcaagtcatttcatttttcgcatatttgaaacaaataaacgaaccgggtcctcacttggttgttgtgccatcatcgacgctagaaaattggttaagggagttccagaaattcgcacctgctttgaagattgaaccctactatggctctttacaagaaagggaagaattgcgtgatatcctggaaaggaacgctgggaaatatgatgttatcgtgaccacgtataacttggctgcaggtaataaatacgacgtttcgtttttgaaaaatagaaacttcaatgttgtggtttatgatgaaggtcatatgttgaaaaattccacttcagagagatttgccaaactgatgaaaattcgtgccaatttccgccttttattaactggtacgccattacaaaataacttgaaggaactaatgtcgctgttggaatttatcatgccaaatcttttcatttccaaaaaggaatcatttgacgcaatcttcaaacaacgtgccaagaccacagacgataacaaaaatcacaacccgctattagcgcaagaagccattacaagagctaaaacgatgatgaagccatttattttgagaagacgtaaggatcaagtgttgaaacatttgccaccaaagcacacgcatattcagtattgtgaattgaacgcaatacaaaaaaaaatatatgataaggaaatacaaatcgtgttagaacataagagaatgattaaagatggcgaattgccaaaagatgcaaaagaaaagtctaaattacaatcttcaagttccaaaaatttaataatggcattgcgaaaggcctctctgcatccacttttgttcagaaatatctataatgataaaatcatcactaaaatgagtgatgccatattggatgaacctgcttatgctgaaaacggtaacaaagagtatattaaggaagatatgagctatatgacggattttgagttgcacaaactatgctgcaatttcccgaacacgttatccaaataccaacttcataatgacgagtggatgcaatctgggaagatagacgctttgaaaaaattgctgaaaacaatcattgttgacaaacaggaaaaggtgctgatattttccttattcactcaagtcctggatattctagagatggttttgtccaccttagattataaatttttaagattagatggttccacgcaagtgaatgatagacaactactaatagataagttttatgaagataaggatattcccattttcatcttatcaacaaaggcaggtggattcggtattaatttggtgtgcgcaaataatgttattatattcgatcaaagttttaacccacatgatgacagacaagctgctgatagggcacatcgtgtgggacaaacaaaggaagttaatataaccactttaattactaaggattccatagaggaaaagattcatcaactggccaaaaataaactagctttagattcgtatatcagtgaagataaaaaatctcaagatgtgttggaaagtaaagttagtgatatgttggaggatataatttatgatgaaaactcgaaaccgaagggaaccaaagaataa

SEQ ID NO: 3869 - protein, 1131 aa, Saccharomyces cerevisiae
MSGSHSNDEDDVVQVPETSSPTKVASSSPLKPTSPTVPDASVASLRSRFTFKPSDPSEGAHTSKPLPSGSPEVALVNLAREFPDFSQTLVQAVFKSNSFNLQSARERLTRLRQQRQNWTWNKNASPKKSETPPPVKKSLPLANTGRLSSIHGNINNKSSKITVAKQKTSIFDRYSNVINQKQYTFELPTNLNIDSEALSKLPVNYNKKRRLVRADQHPIGKSYESSATQLGSAREKLLANRKYGRHANDNDEEEEESMMTDDDDASGDDYTESTPQINLDEQVLQFINDSDIVDLSDLSDTTMHKAQLIASHRPYSSLNAFVNTNFNDKDTEENASNKRKRRAAASANESERLLDKITQSIRGYNAIESVIKKCSSYGDLVTSQMKKWGVQVEGDNSELDLMNLGEDDDDDNDDGNNDNNNSNNNNTAGADATSKEKEDTKAVVEGFDETSAEPTPAPAPAPVERETKRIRNTTKPKVVEDEDDDVDLEAIDDELPQSEHEDDDYEEEDEDYNDEEEDVEYDDGDDDDDDDDEFVATRKNTHVISTTSRNGRKPIVKFFKGKPRLLSPEISLKDYQQTGINWLNLLYQNKMSCILADDMGLGKTCQVISFFAYLKQINEPGPHLVVVPSSTLENWLREFQKFAPALKIEPYYGSLQEREELRDILERNAGKYDVIVTTYNLAAGNKYDVSFLKNRNFNVVVYDEGHMLKNSTSERFAKLMKIRANFRLLLTGTPLQNNLKELMSLLEFIMPNLFISKKESFDAIFKQRAKTTDDNKNHNPLLAQEAITRAKTMMKPFILRRRKDQVLKHLPPKHTHIQYCELNAIQKKIYDKEIQIVLEHKRMIKDGELPKDAKEKSKLQSSSSKNLIMALRKASLHPLLFRNIYNDKIITKMSDAILDEPAYAENGNKEYIKEDMSYMTDFELHKLCCNFPNTLSKYQLHNDEWMQSGKIDALKKLLKTIIVDKQEKVLIFSLFTQVLDILEMVLSTLDYKFLRLDGSTQVNDRQLLIDKFYEDKDIPIFILSTKAGGFGINLVCANNVIIFDQSFNPHDDRQAADRAHRVGQTKEVNITTLITKDSIEEKIHQLAKNKLALDSYISEDKKSQDVLESKVSDMLEDIIYDENSKPKGTKE

SEQ ID NO: 3870 - DNA, 3855 bp, Schizosaccharomyces pombe 972h-
  CDS (1)..(3855)
atgcttccttacaattcaaattacttatcggacaacgggaaacgaaagttttccgacgaaaatcctcaatcggaagtttatggttcttcgcaaacaggtttgccttcttcatacggaaatcctcaaagctatggtacgccccctgtccaacagtcttccgctatgtacggggtgaataattccatgggtggtggaatgtataatacttctgagaacactcaatttatgaatactgattattcgcaaacttcttcgtatgcgtcgactccaatgtccaatgcttattccagagatgctcccgctgcaatcaacaacaattttggttattcatacgtgggacaatcatcgcagccagtcccttcttataaccccctgccctcttacaatactgcgtctttgcccaatgctggaattcccgcagcaatgcctggtatgccatctggttatccaggcactgttccaatacctcagggtggttataatgcacattatagttccccttataataacggctatcctatcggtgctgtcaatcctacatcggcaatacccgcgcagcctccagcacaacccgtcaataatgttttacccagctacgttcgttcaaactcgcgctcatctgcacgctccacagcgcgttctgctccacgctctactcagcgatctcgttcctcctccgcaaatcccgtgactaccccaccagtcaacaataccttgcttacacctcccgctccacctgtcgagcttcctcctgtaaccactacttctcctaatgctattattcgttctgttcaatggatacgctcatttgttccccaggctccgattcaccaggtgatcaacacacttgctcaaactaagtgggatgagactgcagcactttctattttatctcaaaaatatttgagttgtgaccttggtattccaatacaagagcataaaaggtttaagcaaagtcccgttgctagcaatatgcctacttatggaagctctaaccgtacggttcaatcccaaaagcgctcgattcgggacaaatatatacaaatgccaaatgattctacgcaagcttcccttatgccttcttataccagaaaaactagcaatgcatcaaagaaacttactactgaagaagatgaattttatgactcagaagaagagcctgaagccatagttcacagggatacatcggcgttagagagaactgtactcaattttataaacagcagtactgctaaggaactctctgatactgctagttgccctttgtcccactcgaaactccttttagagcatcgtcctttccagacacttgccgaagcttgtatcatcaaacatcctgatgacgttcctagcaaacctggtagacgtggaaggcgtcgtgaaaaaaatcctatgggccaaaaaatcgtcaatgcttgtatggaaaccatggaaggatattatgcaattgataatctaattgccaaatgcgagtttcttggtaatcgtatatctaaaggtatggcctcgtggggaattaaattagaaatgtctaatggtgaactgaacatcgttgacatggagtcggttcctaccgaggcagcggataacagtgatttccctaaatttgttacagagcaacccaaaactcttgcaagtgacgtccagcttaaaagttatcaactcgttggcgttaattggttacatttgctttatcaacagaaactgtcagggattttggctgatgagatgggtcttggaaaaacttgccaagtagtcgccttttttgcacttcttctggaacaaggacaccacggacctcatttagttgtagtcccttcttcaacgcttgaaaattggcttagggaacttgcccggttttgccctagcctccgcgtggaaccttactacggaagtcaacaagagcgagcaaatattcgcgaagcaatagaagaaaacgaaataaagtatgacattttggttactacttatcagttagctacgaacaacaaagaggaccgatcttttcttaaacatcaaaactttgatgtctgcgtttacgacgaaggtcattatttgaaaaatagaatgtcggagcgttacaaacatctcatgaaccttaacgctaactttagactgctgctgactggtactcctttacaaaacaatctcaaagaattagtttccttgctcgctttcattcttcctaatatgtttgacagtgacatggacgatttggatgtaatttttaaagctaaaccaaccgcagatgcggatatagaacaagccttactttctaagcaacgtattagccgtgccaagactatgatgactccgtttgtccttcgccgtcggaaaaaccaagttcttaatgatttgccaaaaaagactcagattattgaacattgtaagttatcagaaaaccagttggaaatttacaatcgatatgctgctttgcaaaaaaatcaacaacttcggagagacgataaacgaaacaagcgtagtaagaacgatgaagaaagcgatggcaagtcattatcggccggtcatgttctcatgcagcttcgcaaagctgcaaatcatgccttactttttcgcaaattttatgacgatgagaagttaaagcaaatggctaaggatataatgcaagaggaacaatataaaaatgccaatgaacaatatatatatgaagatatggaagttatgtctgactttgaattgcatcgactttgccgcagtttccctacgctgcagtcatatacgttgaaggatgatccctggatggattcaggtaaaattcgagtgttgaaagaattacttcctaaaatgaaagaagaaggaagcaggatccttttgtttagtcagtttactcagatgctcgatattttggaacaggtgctggatactttgaaaatatcatatgttcgattggatggttcaacacaagttgaagtacgtcaggatattatagatcaatttcacaaagaggaagatgttactgtattccttctttcaacaaaagctggcggttttggaattaatttagcgtgtgcaaatgtggtgatattgtatgactgctcttataatccattcgatgatttgcaggctgaagaccgtgctcatcgtgttggacaagtccgtgaggtaacggtaattcggttaatcaccgataatacgattgaagaatatattcaaaaattagcgaacaccaaacttgcgcttgacatgagcttaagctctgatggtaaggatagagaagaaattggcgaacgtcttgtgcaagacatgcttgacgaagaaaataatggcaacaatacaaaacctgaaattacgggaaacgagagtgatggagagttcaaggtcagcagcagtaataattccaaacaaacggatgcggaggagactaatacaggagttcccttagagggttctcaaccgaactctgtggagaaaactgacttggctgacggggacgaaaaggctaacataaaaactgagatgaagagtgagactgtagagggtgataataaggaacttcgagaaaccatgaagggcgaaaatgttcaaacggattctaatgctgctgtaccgtcgtcaaaatcttcaaccgaagaaccaaacgaatctgtacttagcggccatttagatttagacaccgaggcgtcacctgtcgtaagcacaatagaaaaaactaccaagggcgatgtttccgttacggaagagcaacagtccgctaatatcgacggtcaattggagaaacccgaaattgaggaaagtaaaaagcctgatgtcttgaatcaagtttccttgtctattgaagaagaaaaaccaaaaaataaagaatcggaggttgacaataatgctgctaaagactga

SEQ ID NO: 3871 - protein, 1284 aa, Schizosaccharomyces pombe 972h-
MLPYNSNYLSDNGKRKFSDENPQSEVYGSSQTGLPSSYGNPQSYGTPPVQQSSAMYGVNNSMGGGMYNTSENTQFMNTDYSQTSSYASTPMSNAYSRDAPAAINNNFGYSYVGQSSQPVPSYNPLPSYNTASLPNAGIPAAMPGMPSGYPGTVPIPQGGYNAHYSSPYNNGYPIGAVNPTSAIPAQPPAQPVNNVLPSYVRSNSRSSARSTARSAPRSTQRSRSSSANPVTTPPVNNTLLTPPAPPVELPPVTTTSPNAIIRSVQWIRSFVPQAPIHQVINTLAQTKWDETAALSILSQKYLSCDLGIPIQEHKRFKQSPVASNMPTYGSSNRTVQSQKRSIRDKYIQMPNDSTQASLMPSYTRKTSNASKKLTTEEDEFYDSEEEPEAIVHRDTSALERTVLNFINSSTAKELSDTASCPLSHSKLLLEHRPFQTLAEACIIKHPDDVPSKPGRRGRRREKNPMGQKIVNACMETMEGYYAIDNLIAKCEFLGNRISKGMASWGIKLEMSNGELNIVDMESVPTEAADNSDFPKFVTEQPKTLASDVQLKSYQLVGVNWLHLLYQQKLSGILADEMGLGKTCQVVAFFALLLEQGHHGPHLVVVPSSTLENWLRELARFCPSLRVEPYYGSQQERANIREAIEENEIKYDILVTTYQLATNNKEDRSFLKHQNFDVCVYDEGHYLKNRMSERYKHLMNLNANFRLLLTGTPLQNNLKELVSLLAFILPNMFDSDMDDLDVIFKAKPTADADIEQALLSKQRISRAKTMMTPFVLRRRKNQVLNDLPKKTQIIEHCKLSENQLEIYNRYAALQKNQQLRRDDKRNKRSKNDEESDGKSLSAGHVLMQLRKAANHALLFRKFYDDEKLKQMAKDIMQEEQYKNANEQYIYEDMEVMSDFELHRLCRSFPTLQSYTLKDDPWMDSGKIRVLKELLPKMKEEGSRILLFSQFTQMLDILEQVLDTLKISYVRLDGSTQVEVRQDIIDQFHKEEDVTVFLLSTKAGGFGINLACANVVILYDCSYNPFDDLQAEDRAHRVGQVREVTVIRLITDNTIEEYIQKLANTKLALDMSLSSDGKDREEIGERLVQDMLDEENNGNNTKPEITGNESDGEFKVSSSNNSKQTDAEETNTGVPLEGSQPNSVEKTDLADGDEKANIKTEMKSETVEGDNKELRETMKGENVQTDSNAAVPSSKSSTEEPNESVLSGHLDLDTEASPVVSTIEKTTKGDVSVTEEQQSANIDGQLEKPEIEESKKPDVLNQVSLSIEEEKPKNKESEVDNNAAKD

SEQ ID NO: 3872 - DNA, 3381 bp, Candida glabrata CBS 138
  CDS (1)..(3381)
atgtccggaaacgaaggcactgagggccagccgggcaacaatctatctcctgttcagtacaaaactgtatcttcttctccattgaaacccgaagcgagtactcaggatgcacagaaattacgcgaacagtttgttttcaagcccaataataatctctctagcgccatcacgagtacaggtcaaacagcgtcatctgccacaagtggtaccgcagctcctgtaaatccaaatgcatttgaatcgttggtggctgaatttccagacttttcgcagacgctagtgcaagcagtctacaaatctaactcttttgatttgtctcttgctagagaaaggcttacaagaattcggaaccagagaaagaactgggtcagctcaaagaatttaaactcaaatgttgctcgtggaagcagggctgctagtactggtacggggagattaagtggcattaataatacatctgactcttcaaaaattgtgttggaaaaacagaagaaatctatcttcgatagatattcgagcgctgtaaatagtaatgcacagaacagtggaatcaactctgagctgtttgaaaaaatgcaacgtaacggaagtcataagaagagaaagcttgtcagaggcgataaattggctggtgatgagagttatgtagatagctcaaattctcagttagctaaagcaaagcaacagctactgaaaagtcgtaataaaaagttcaatctttctgatgatgaagaggaagtaggcaatgataatggagacttttcagacgctagtggagatgaatacgaggagcatactcctgtggctaatattgatgatcagatcttggaatttttgaataactctgaaatagatgatattatggatttgggtgaagtttcttatgaaagagctaaaataattcaatccgcaagacccttcacttccttgtattcgttttctcaacaagaatttttgacagaagaagagaaggaaaagcaggctaaacttctagctcagcctaagaagaggggtagaagaggagctgcccaaagaaaggaaggtgagaaagttctagatagagtttcacaagctatgagaggttataatgccattgaatctgtcatcaagacatgttcacaatatggtaaactagtctcctctcaaataaaaaaatggggtgtcaaagtagacgcggaaaatggtgatgatggagagcttgattttattaatgttggttctgaaactgaaggtgacgccattgttgaggattttagctcgtccgctcaaactccagcacccgaaatgtcagatagcgaaggctcagaagaaattaagcttgaagatgtcaataagaaactcgagagcactactgataataataacaaggacgatggagccacacttgaaactgcttcagaacctaagcttgacactatggaagagaaggataaaaccactgacacttctgttgaaaaaactgaagaaaatacggctaatgtcaaggtagaagacacagacaaagcaaatgacgatccagatagcgattttcaggctgatgaagaaatggaatttattgatgaggatgaggaagatgaggaatacgatgaagaacttccggtaacaagaaggactaggaatactggcgggaatttcagaaaggaagttgtgaaaaagaatagtgttgttaaatttttcagagggagaccaaaacttctaaaccctgatgtttcattgaaagactatcaacagactggtatcaactggctaaacttattatatcacaatcaaatttcttgtatattggctgatgatatgggtctgggaaagacatgtcaagtcatatctttcctagcttatttgaaacaaatcggtcagccaagtccgcatttgattgtggttccttcttcgacgttagaaaactggttgagagaattccaaaaattttgtccttcattaaaaattgagccatattacggtactcaacaagaaagagctgatcttcgagagatattagagcgtaatgatgggaaatatgatgttattgtcacaacatataaccttgctgcaggtaacaagtacgatgtatcatttttgaagaccagaaatttcaatgtagttgtatatgatgaaggccatatgttaaagaactcaatgtctgagagatttaataagctgatgagaattcatgctaatttcaggctgcttctaacgggtacaccattgcaaaataacttaaaggagctaatgtctttgttagagtttattatgccgaatctttttgtatccaaaaaggagtccttagctgcagttttcaaacaaagggcgaagacatcagatgataacaagggacacaaccctctgttggctcaacaagcaatcaccagagcgaagaccatgatgaaaccatttattttacgtagaaggaaggatcaagtgttgaagcacttgcctgcaaagcatgtccgtaccagttactgtgcaatgaatgacactcagagggagatatacaaccgtgaagtgaagcttgtaatggagcacaagcaaatgatcagggatggcacattacctgaagacaagaaagagcgtagtaagattgagaacaacagctcaaagaatttgatcatgtctctaagaaaagcatctattcatccattattgttccgtcacatctatgatgacgcgaagatagacaagatgtgtgatgcgattttggatgagccagcttacgcggagaatggtaataaggagtatatcagggaggatatgagttttatgactgattttgagttgcacaggctatgttgcaacttccctaacacactaggtgattatcagctgaaaaacgatgaatggatgaatagtggtaaagtggatgctctaaagaagttgctagatgatatcatcaacaagaaacgtgagaaagtgttgatcttcacactgttcacgcaggtgttagatatcctggagaaagtattgagcaccttgaactataaatttctgagactcgatgggtccacccaggtgaacgacagacaaacgatgatcgacaagttctacgacgataacaccatccccatcttcatgctatctaccagagcaggtgggtttggtatcaatctggtgtgtgcgaaccatgtgatcatcttcgaccaaagtttcaacccacacgacgatagacaggcggccgacagagcgcaccgtgtgggccagaccaaggaagtcacagtgaccacgctgattaccaaggacagcatagaggagaagatcttccagctggcgaagaccaagctggcgctggacagtcaagtcagcagcagcgaggaccaaagcgatctgatagacaacaaggtcagcgatctcctggaagacatcatatacacagaagctcaaaagaagtaa

SEQ ID NO: 3873 - protein, 1126 aa, Candida glabrata CBS 138
MSGNEGTEGQPGNNLSPVQYKTVSSSPLKPEASTQDAQKLREQFVFKPNNNLSSAITSTGQTASSATSGTAAPVNPNAFESLVAEFPDFSQTLVQAVYKSNSFDLSLARERLTRIRNQRKNWVSSKNLNSNVARGSRAASTGTGRLSGINNTSDSSKIVLEKQKKSIFDRYSSAVNSNAQNSGINSELFEKMQRNGSHKKRKLVRGDKLAGDESYVDSSNSQLAKAKQQLLKSRNKKFNLSDDEEEVGNDNGDFSDASGDEYEEHTPVANIDDQILEFLNNSEIDDIMDLGEVSYERAKIIQSARPFTSLYSFSQQEFLTEEEKEKQAKLLAQPKKRGRRGAAQRKEGEKVLDRVSQAMRGYNAIESVIKTCSQYGKLVSSQIKKWGVKVDAENGDDGELDFINVGSETEGDAIVEDFSSSAQTPAPEMSDSEGSEEIKLEDVNKKLESTTDNNNKDDGATLETASEPKLDTMEEKDKTTDTSVEKTEENTANVKVEDTDKANDDPDSDFQADEEMEFIDEDEEDEEYDEELPVTRRTRNTGGNFRKEVVKKNSVVKFFRGRPKLLNPDVSLKDYQQTGINWLNLLYHNQISCILADDMGLGKTCQVISFLAYLKQIGQPSPHLIVVPSSTLENWLREFQKFCPSLKIEPYYGTQQERADLREILERNDGKYDVIVTTYNLAAGNKYDVSFLKTRNFNVVVYDEGHMLKNSMSERFNKLMRIHANFRLLLTGTPLQNNLKELMSLLEFIMPNLFVSKKESLAAVFKQRAKTSDDNKGHNPLLAQQAITRAKTMMKPFILRRRKDQVLKHLPAKHVRTSYCAMNDTQREIYNREVKLVMEHKQMIRDGTLPEDKKERSKIENNSSKNLIMSLRKASIHPLLFRHIYDDAKIDKMCDAILDEPAYAENGNKEYIREDMSFMTDFELHRLCCNFPNTLGDYQLKNDEWMNSGKVDALKKLLDDIINKKREKVLIFTLFTQVLDILEKVLSTLNYKFLRLDGSTQVNDRQTMIDKFYDDNTIPIFMLSTRAGGFGINLVCANHVIIFDQSFNPHDDRQAADRAHRVGQTKEVTVTTLITKDSIEEKIFQLAKTKLALDSQVSSSEDQSDLIDNKVSDLLEDIIYTEAQKK

SEQ ID NO: 3874 - DNA, 3147 bp, Kluyveromyces lactis NRRL Y-1140
  CDS (1)..(3147)
atggatcttccaataccgaaaagtccccagaacaaacaggatgaagttcaagttccaagttcatctcccttgttacagacaaatgaagaatcttctccgttaaggcccgaaactggtacgcggatagatgaatcgccaatatcaagtaactctacttcttcccttttgagggacaagttcacgtatcaaccggctacgaaagcaagaaatggttactctcagaatgatttatcgcatgaacaagctttaaaagtgttggttcaagaatacaaggacctatcacccactttgattaatgcaattttcaagcaaaactctatgtctatctcctcgtcaagaaagcgtttggaccatattgtcgcctcacgtaccgggggatcgtggagattccaatctaaaacaaacgtgaacccgacacttaacttaaataaacccaactctcccatggatctgtcaaaatctagattaatctcattgaaagagggtggctcctccgggaacagcatcaaaagcaatcctgctattaatttgccctctagaaatgtatccacttccaagataaccatcgaaaagcaaaagacaagcattttcgaccgttactctcatgtaatgaaagtttcgcaaccctcccccgcaagatccatggcggatagaaccaccatgagtactatcaaaaatttatcttcaaagaagggtaaattggttagaggagacgccataaagaagaaacaaaaaatcaaactcagtgatgatgaagaagatgaaattactgatcaatccaacgatgacggagagctcgatactgaaccagaatatgaggagaaagttactgaaagtaattttgatcaagtgttgaagttcttgaatgaagcagatccgaaagatttagctgatcttggtgaaatatccatagaaaaagctgccctcgttataaaagaaaggccatttgaagacctggaacaatttcaacaattagatttccaatctaaatccccttctccggcaccaggcaaggctagaaaatcacaacagaaaaaagacggtttgaaaatacttgacaaaattgagcaatcgatcaagggatataatgctatcgagtcgttgatccgtaaatgttcaaaatatggtgatgtaatagcgaatcaaatgacgaattggggtgttgacttcagttcatccaaagatacggaattgaatatcttagacgttgatacttattcggatgatgaggctaatgaaactataactaacgattctgcaaatgttcaaataatcaaatcttcgaccacgtccagagaaaactcattaggtccatcgaaacgtaaaagaaatgacgatgaagaggagttttctgatgtggactacgaagaaagtgatgatgatgattttgatgtaaaaccaagagctaggacgaagcagaagaaaacatccataactcaacttcgcaataatcaaatgaaattcataaggcaaaaacctaagcttttatcttccgatgttgaattgaaggactatcagcaaacaggtatcaactggctgcacttgctttaccagaacgatttatcttgcatcctagctgatgaaatgggtctcggtaaaacttgtcaagtcatctcctttttagcgtatttgaaacaaacacaccataatggccctcatttggtagttgttccatcctctaccttggaaaactggcttcgtgaattcaataaattttgtccacacttgaaagttgaaccttactatggctctcaacaagaaagggcggaactacgtgatatcctagaagaaaacgaaggccagtatgatgttattgttactacatataatctagccgctggaaccaaatatgacgtttccttcctaagaaatcgtaattttgacgttgtggtgtatgatgaaggtcatatgttgaaaaactcgatgtcagaaagattcaacaaattgatgaaaattaatgcacatttccgtttgttacttacaggtaccccacttcaaaataacttgaaggaattaatgtctcttttggaatttatcatgccaaacctttttgtctctaaaaaggatgatcttgcaaccgttttcaagcagaaaacaagaacatctgacgctgataagggatataacccgcttttagccgagcatgctattgaaagagcaaaaacaatgatgaaaccattcattttaagaagaaagaaagatcaagtgttaaaacacttacctagaaagcataatcatatattacactgtgaaatgactgagctacaaaaaaccttgtaccaacaagaaatcaagcaggttatggagcacagaagaaagattaaagaaggtgttaaaatggaaaaagcatcacgcaatgtttcaaaaaaccttattatggcattgagaaaagcatctattcatccacttctcttcaggcatatttacaacgataaaattatttcaaagatgagcaaggctatcattgccgagcctgaatattatgaaaatggtaatattgagtatatcaaagaagatatgtcatatatgacagactttgaattgcacaaattatgttgcaaatttccctctctttacaagttcaaattacaatccgacgaatggatgaattcaggtaaagttgaacaacttaagtctgtattgcataaaatcattgacattcagcacgaaaaggttttagtgttttcactattcactcaagtcttggacattttagaatttgtattatccacacttaacatcaaattccttcgtttagacggtcaaacgcaggtgaatgaccgtcagtctctaattgacaggttctacgaagatgatactattccagtttttctactctcaaccaaggccggtggattcggaatcaatttggtttgtgcaaataatgtgattattttcgaccaaagttttaatccgcacgatgatagacaggccgcagatagagctcatcgtgtcggccaaactaaagaagtccaggttacaactttaatcagtagagataccattgaagagaaaattcttcatttggccaaaaacaaactagcattggatacacatattagtcaagaagacaagaaaaacgaggaggcccttgaaaataaggttacagatcttttagaagatattatttttgatgaaaatcagtaa

SEQ ID NO: 3875 - protein, 1048 aa, Kluyveromyces lactis NRRL Y-1140
MDLPIPKSPQNKQDEVQVPSSSPLLQTNEESSPLRPETGTRIDESPISSNSTSSLLRDKFTYQPATKARNGYSQNDLSHEQALKVLVQEYKDLSPTLINAIFKQNSMSISSSRKRLDHIVASRTGGSWRFQSKTNVNPTLNLNKPNSPMDLSKSRLISLKEGGSSGNSIKSNPAINLPSRNVSTSKITIEKQKTSIFDRYSHVMKVSQPSPARSMADRTTMSTIKNLSSKKGKLVRGDAIKKKQKIKLSDDEEDEITDQSNDDGELDTEPEYEEKVTESNFDQVLKFLNEADPKDLADLGEISIEKAALVIKERPFEDLEQFQQLDFQSKSPSPAPGKARKSQQKKDGLKILDKIEQSIKGYNAIESLIRKCSKYGDVIANQMTNWGVDFSSSKDTELNILDVDTYSDDEANETITNDSANVQIIKSSTTSRENSLGPSKRKRNDDEEEFSDVDYEESDDDDFDVKPRARTKQKKTSITQLRNNQMKFIRQKPKLLSSDVELKDYQQTGINWLHLLYQNDLSCILADEMGLGKTCQVISFLAYLKQTHHNGPHLVVVPSSTLENWLREFNKFCPHLKVEPYYGSQQERAELRDILEENEGQYDVIVTTYNLAAGTKYDVSFLRNRNFDVVVYDEGHMLKNSMSERFNKLMKINAHFRLLLTGTPLQNNLKELMSLLEFIMPNLFVSKKDDLATVFKQKTRTSDADKGYNPLLAEHAIERAKTMMKPFILRRKKDQVLKHLPRKHNHILHCEMTELQKTLYQQEIKQVMEHRRKIKEGVKMEKASRNVSKNLIMALRKASIHPLLFRHIYNDKIISKMSKAIIAEPEYYENGNIEYIKEDMSYMTDFELHKLCCKFPSLYKFKLQSDEWMNSGKVEQLKSVLHKIIDIQHEKVLVFSLFTQVLDILEFVLSTLNIKFLRLDGQTQVNDRQSLIDRFYEDDTIPVFLLSTKAGGFGINLVCANNVIIFDQSFNPHDDRQAADRAHRVGQTKEVQVTTLISRDTIEEKILHLAKNKLALDTHISQEDKKNEEALENKVTDLLEDIIFDENQ

SEQ ID NO: 3876 - DNA, 3324 bp, Aspergillus nidulans FGSC A4
  CDS (1)..(3324)
atggacgacactgttcctgacacccctgtcagtaacagaaaaatcgttcacagcactcctggaggcatggacgaagatggggaatatgagacgatcgccacactccctgtgaatcctgcgcagaacacattgcttgcaacacaatcaatgacaccctcctcgcagcgactgactcaacctacgcaaattgtggatgttccttatacatcaaaaggcagttctgtcgtgcaggttgcagcttcttctcctctaagacccgcttcatccccttcacgcccttccccagccgggcctggtcgcctttccagcttgatggcgcccagcggtacgcgattttgccctcccgcgaagcgtgcgccattgattgatctagaagacgatggtccaacttatcgaggaggctcctcagatgacgatatccagatgagcacagacataaagcccgctacgttcacgtcaagaaacccggaaaagagcacagcgattgacagattcaaagagatcacttcttctgctatctacgatccttcgagcaccaagcgcgccgcctcgcagatggatcctaccccaaagggcgtcgccgtcaaaagggttcgccaggagggaccttcacgcgctcaaccggtcgacacacaatcattgtcgttgcaggatattgatgactatcaagtacggataaaagtggagagaatgttaaaggttctcccgcgaaaatcagtacacgactgcgtgcaggctcttctagcaaagaaaggaagttatgaagatgctctagaatgcctagccagcaccgaggatcaaaatggccatgctgactcttcagaggatgagctaagcacgattaagaagacgtcgccagtggccccagcgaagcaaaatatcaaggcccgggggagaatccaggataaatggacggcaccaaacctgccgaaaagtacattacaaaagcagccagaagaggattcaagaccgcggaaacggttgattcgaggaccaaaaacccgggtgtccccgataccgtcaagccccactcagaacgaaacacctccaaagaagagcttcggtcggctggtccaagggcgcaggcgcccttcacctacacgatcagagtctcctgaggctcctcttgtgacctccgatgattctgactctgcatttgatgcgcaagatggcgcggatctggagacgaaagttcttggtttctttaacggatgcaccgcaccggctcttgcggacctagccgcgattactgaggaccttgctgagtacataattgcaaggcggccattctcatcccttgatgaagtccgcgtgattcctgctccggaaaccgaacaaactgcaaccaagactggaaggaaacgcaaggcacccaagccggtcggagaccgtatcgttgacaaatgtcttgatatgtgggtaggctacgaagccgtggattcgttagtcgctcgatgcgaggcgctaggaaagccggttgcgaccgagatgaagaaatggggagttgacatatttggcaagcgagagggtgaactggacctagtttcgatggagccttcaggatctcacgactctggtataggaactcccgctagtcaaccatctgatgaagatagtgatggtcctgggtcaaggtctcgaaaagctcggttcatttcgcagcctggaataatggctgaggatctcaaaatgaagaattatcagattgttggtattaactggctgtctttgctttttgagaatgaactaagctgcattctggccgatgatatgggtctcggaaagacctgccaggtgatagcgtttctggcccacctatatgagaaaggaatcaaaggaccgcatcttgttgttgtgccgtcatcaaccattgagaactggcttcgagagtttcaaaagttttgtcccactctgtccgtgatgccatactatgccgaccaaaatgtgcgggcccagattcgggaacagatcgaaggaaacagagacgacatcaatgtcgttataacgacctatactattgcaaagggcaaggttgatgcgcacttcttacgcaacatggacttttgcgcatgtgtctacgatgaagggcacatgcttaagagcagcacatcggttctgtacgaaaagctgatcaggatccgtgctcgtttcaggcttcttctgacaggaacgccgcttcagaacaacctgcaagaacttgcctccttattggggtttatcctccctaaggtctttcaagagcgaaaggatgatctacagtacatattctcgaacaaagcaaaaacggttgatgaatcccattccgcactgctttctgcgcagaggatcgaaagggcaaaatccatgctgaaaccgttcgttctacggcgaaagaagcaccaagttattgatttgcctgcaaagatctcgcgcgttgagtactgtgaaatgaacgctgcccagcgggagatatacgaacatgagaagaacgaagtaaagaagctcttggaagacagagcagccggcaaaaagacgggcaacaagtccgcgaacatcctcatgaaactccgtcaagcagccattcacccactccttcaccgacgccactacaacgacaaaattttaaccaagatgtccaaagcttgtctgcaagaagagaaatgggccgaatccgacccaaaactcatctacgaagatttacaaccctacaatgactttgagtgccatcaactctgtgtggaaaaccccaaatcccttggcaaattcgctctcaagaataatgagtggatggattccggaaaggtcgacaaactctgcgaactccttcgccgcttcaaagaaaacggcgaccgcgttcttgtcttctcccagttccgtttggcaatggatattcttgaagttgtcctcgaaaatcaacatctcaagtttgttcgtcttgatggaacgaccagcgtcgaagaccgccaatccattatggacaccttccatgagaacacggacatcccggtctttttgctctccactaaagctggcggcgccgggatcaaccttgcctgcgctaataaggtcatcatcttcgactccagctttaacccgcaggaagacgtgcaagctgagaaccgcgctcatcgtgttggtcagacgcgtgaggtcgaggttatccgtcttgtgacgaaagatacgatcgaagagcagatctatgctcttggccagacgaaactggctcttgaccaggctgttgccggagaggatggggctgattcgaagaaatccgaggaagccgggatcaaggccgttgaagagatgtttactgcggagattacccaaaaggagaggtctacttaa

SEQ ID NO: 3877 - protein, 1107 aa, Aspergillus nidulans FGSC A4
MDDTVPDTPVSNRKIVHSTPGGMDEDGEYETIATLPVNPAQNTLLATQSMTPSSQRLTQPTQIVDVPYTSKGSSVVQVAASSPLRPASSPSRPSPAGPGRLSSLMAPSGTRFCPPAKRAPLIDLEDDGPTYRGGSSDDDIQMSTDIKPATFTSRNPEKSTAIDRFKEITSSAIYDPSSTKRAASQMDPTPKGVAVKRVRQEGPSRAQPVDTQSLSLQDIDDYQVRIKVERMLKVLPRKSVHDCVQALLAKKGSYEDALECLASTEDQNGHADSSEDELSTIKKTSPVAPAKQNIKARGRIQDKWTAPNLPKSTLQKQPEEDSRPRKRLIRGPKTRVSPIPSSPTQNETPPKKSFGRLVQGRRRPSPTRSESPEAPLVTSDDSDSAFDAQDGADLETKVLGFFNGCTAPALADLAAITEDLAEYIIARRPFSSLDEVRVIPAPETEQTATKTGRKRKAPKPVGDRIVDKCLDMWVGYEAVDSLVARCEALGKPVATEMKKWGVDIFGKREGELDLVSMEPSGSHDSGIGTPASQPSDEDSDGPGSRSRKARFISQPGIMAEDLKMKNYQIVGINWLSLLFENELSCILADDMGLGKTCQVIAFLAHLYEKGIKGPHLVVVPSSTIENWLREFQKFCPTLSVMPYYADQNVRAQIREQIEGNRDDINVVITTYTIAKGKVDAHFLRNMDFCACVYDEGHMLKSSTSVLYEKLIRIRARFRLLLTGTPLQNNLQELASLLGFILPKVFQERKDDLQYIFSNKAKTVDESHSALLSAQRIERAKSMLKPFVLRRKKHQVIDLPAKISRVEYCEMNAAQREIYEHEKNEVKKLLEDRAAGKKTGNKSANILMKLRQAAIHPLLHRRHYNDKILTKMSKACLQEEKWAESDPKLIYEDLQPYNDFECHQLCVENPKSLGKFALKNNEWMDSGKVDKLCELLRRFKENGDRVLVFSQFRLAMDILEVVLENQHLKFVRLDGTTSVEDRQSIMDTFHENTDIPVFLLSTKAGGAGINLACANKVIIFDSSFNPQEDVQAENRAHRVGQTREVEVIRLVTKDTIEEQIYALGQTKLALDQAVAGEDGADSKKSEEAGIKAVEEMFTAEITQKERST

SEQ ID NO: 3878 - DNA, 25 bp, Artificial sequence
  primer
atgagtggttcgcattcaaatgatg

SEQ ID NO: 3879 - DNA, 25 bp, Artificial sequence
  primer
ttattctttggttcccttcggtttc

SEQ ID NO: 3880 - protein, 1135 aa, Artificial sequence
  consensus sequence
  Variant (3)..(6): Xaa in position 3 to 6 is any amino acid
  Variant (8)..(60): Xaa in position 8 to 60 is any amino acid
  Variant (61)..(68): Xaa in position 61 to 68 is any or no amino acid
  Variant (70)..(78): Xaa in position 70 to 78 is any amino acid
  Variant (80)..(103): Xaa in position 80 to 103 is any amino acid
  Variant (104)..(110): Xaa in position 104 to 110 is any or no amino acid
  Variant (112)..(123): Xaa in position 112 to 123 is any amino acid
  Variant (124)..(134): Xaa in position 124 to 134 is any or no amino acid
  Variant (136)..(137): Xaa in position 136 to 137 is any amino acid
  Variant (139)..(139): Xaa in position 139 is any amino acid
  Variant (140)..(141): Xaa in position 140 to 141 is any or no amino acid
  Variant (143)..(156): Xaa in position 143 to 156 is any amino acid
  Variant (157)..(165): Xaa in position 157 to 165 is any or no amino acid
  Variant (167)..(167): Xaa in position 167 is any amino acid
  Variant (169)..(170): Xaa in position 169 to 170 is any amino acid
  Variant (173)..(206): Xaa in position 173 to 206 is any amino acid
  Variant (207)..(212): Xaa in position 207 to 212 is any or no amino acid
  Variant (214)..(226): Xaa in position 214 to 226 is any amino acid
  Variant (227)..(249): Xaa in position 227 to 249 is any or no amino acid
  Variant (251)..(281): Xaa in position 251 to 281 is any amino acid
  Variant (282)..(283): Xaa in position 282 to 283 is any or no amino acid
  Variant (285)..(285): Xaa in position 285 is any amino acid
  Variant (287)..(299): Xaa in position 287 to 299 is any amino acid
  Variant (301)..(314): Xaa in position 301 to 314 is any amino acid
  Variant (315)..(315): Xaa in position 315 is any or no amino acid
  Variant (317)..(322): Xaa in position 317 to 322 is any amino acid
  Variant (324)..(324): Xaa in position 324 is any amino acid
  Variant (326)..(340): Xaa in position 326 to 340 is any amino acid
  Variant (341)..(349): Xaa in position 341 to 349 is any or no amino acid
  Variant (351)..(366): Xaa in position 351 to 366 is any amino acid
  Variant (368)..(376): Xaa in position 368 to 376 is any amino acid
  Variant (378)..(394): Xaa in position 378 to 394 is any amino acid
  Variant (395)..(397): Xaa in position 395 to 397 is any or no amino acid
  Variant (399)..(406): Xaa in position 399 to 406 is any amino acid
  Variant (407)..(409): Xaa in position 407 to 409 is any or no amino acid
  Variant (411)..(413): Xaa in position 411 to 413 is any amino acid
  Variant (415)..(498): Xaa in position 415 to 498 is any amino acid
  Variant (499)..(567): Xaa in position 499 to 567 is any or no amino acid
  Variant (570)..(573): Xaa in position 570 to 573 is any amino acid
  Variant (575)..(576): Xaa in position 575 to 576 is any amino acid
  Variant (578)..(579): Xaa in position 578 to 579 is any amino acid
  Variant (581)..(582): Xaa in position 581 to 582 is any amino acid
  Variant (585)..(585): Xaa in position 585 is any amino acid
  Variant (588)..(589): Xaa in position 588 to 589 is any amino acid
  Variant (595)..(595): Xaa in position 595 is any amino acid
  Variant (599)..(599): Xaa in position 599 is any amino acid
  Variant (601)..(602): Xaa in position 601 to 602 is any amino acid
  Variant (609)..(609): Xaa in position 609 is any amino acid
  Variant (620)..(620): Xaa in position 620 is any amino acid
  Variant (622)..(622): Xaa in position 622 is any amino acid
  Variant (624)..(624): Xaa in position 624 is any amino acid
  Variant (626)..(631): Xaa in position 626 to 631 is any amino acid
  Variant (651)..(651): Xaa in position 651 is any amino acid
  Variant (656)..(656): Xaa in position 656 is any amino acid
  Variant (658)..(659): Xaa in position 658 to 659 is any amino acid
  Variant (665)..(665): Xaa in position 665 is any amino acid
  Variant (671)..(672): Xaa in position 671 to 672 is any amino acid
  Variant (674)..(676): Xaa in position 674 to 676 is any amino acid
  Variant (678)..(678): Xaa in position 678 is any amino acid
  Variant (680)..(682): Xaa in position 680 to 682 is any amino acid
  Variant (686)..(686): Xaa in position 686 is any amino acid
  Variant (691)..(691): Xaa in position 691 is any amino acid
  Variant (694)..(694): Xaa in position 694 is any amino acid
  Variant (696)..(696): Xaa in position 696 is any amino acid
  Variant (698)..(698): Xaa in position 698 is any amino acid
  Variant (700)..(700): Xaa in position 700 is any amino acid
  Variant (704)..(706): Xaa in position 704 to 706 is any amino acid
  Variant (709)..(709): Xaa in position 709 is any amino acid
  Variant (711)..(711): Xaa in position 711 is any amino acid
  Variant (723)..(723): Xaa in position 723 is any amino acid
  Variant (727)..(728): Xaa in position 727 to 728 is any amino acid
  Variant (732)..(732): Xaa in position 732 is any amino acid
  Variant (734)..(734): Xaa in position 734 is any amino acid
  Variant (736)..(736): Xaa in position 736 is any amino acid
  Variant (754)..(754): Xaa in position 754 is any amino acid
  Variant (758)..(758): Xaa in position 758 is any amino acid
  Variant (761)..(761): Xaa in position 761 is any amino acid
  Variant (764)..(764): Xaa in position 764 is any amino acid
  Variant (766)..(766): Xaa in position 766 is any amino acid
  Variant (768)..(768): Xaa in position 768 is any amino acid
  Variant (770)..(771): Xaa in position 770 to 771 is any amino acid
  Variant (773)..(775): Xaa in position 773 to 775 is any amino acid
  Variant (778)..(780): Xaa in position 778 to 780 is any amino acid
  Variant (781)..(781): Xaa in position 781 is any or no amino acid
  Variant (783)..(783): Xaa in position 783 is any amino acid
  Variant (785)..(789): Xaa in position 785 to 789 is any amino acid
  Variant (790)..(791): Xaa in position 790 to 791 is any or no amino acid
  Variant (794)..(797): Xaa in position 794 to 797 is any amino acid
  Variant (799)..(799): Xaa in position 799 is any amino acid
  Variant (809)..(809): Xaa in position 809 is any amino acid
  Variant (813)..(813): Xaa in position 813 is any amino acid
  Variant (815)..(815): Xaa in position 815 is any amino acid
  Variant (819)..(819): Xaa in position 819 is any amino acid
  Variant (820)..(820): Xaa in position 820 is any or no amino acid
  Variant (823)..(823): Xaa in position 823 is any amino acid
  Variant (825)..(830): Xaa in position 825 to 830 is any amino acid
  Variant (832)..(836): Xaa in position 832 to 836 is any amino acid
  Variant (838)..(839): Xaa in position 838 to 839 is any amino acid
  Variant (842)..(843): Xaa in position 842 to 843 is any amino acid
  Variant (845)..(847): Xaa in position 845 to 847 is any amino acid
  Variant (849)..(857): Xaa in position 849 to 857 is any amino acid
  Variant (859)..(859): Xaa in position 859 is any amino acid
  Variant (860)..(868): Xaa in position 860 to 868 is any or no amino acid
  Variant (870)..(874): Xaa in position 870 to 874 is any amino acid
  Variant (876)..(878): Xaa in position 876 to 878 is any amino acid
  Variant (879)..(880): Xaa in position 879 to 880 is any or no amino acid
  Variant (882)..(882): Xaa in position 882 is any amino acid
  Variant (887)..(888): Xaa in position 887 to 888 is any amino acid
  Variant (895)..(896): Xaa in position 895 to 896 is any amino acid
  Variant (898)..(898): Xaa in position 898 is any amino acid
  Variant (900)..(903): Xaa in position 900 to 903 is any amino acid
  Variant (906)..(907): Xaa in position 906 to 907 is any amino acid
  Variant (910)..(911): Xaa in position 910 to 911 is any amino acid
  Variant (913)..(914): Xaa in position 913 to 914 is any amino acid
  Variant (916)..(916): Xaa in position 916 is any amino acid
  Variant (918)..(918): Xaa in position 918 is any amino acid
  Variant (919)..(919): Xaa in position 919 is any or no amino acid
  Variant (921)..(922): Xaa in position 921 to 922 is any amino acid
  Variant (925)..(925): Xaa in position 925 is any amino acid
  Variant (929)..(930): Xaa in position 929 to 930 is any amino acid
  Variant (932)..(932): Xaa in position 932 is any amino acid
  Variant (938)..(938): Xaa in position 938 is any amino acid
  Variant (941)..(942): Xaa in position 941 to 942 is any amino acid
  Variant (945)..(945): Xaa in position 945 is any amino acid
  Variant (946)..(946): Xaa in position 946 is any or no amino acid
  Variant (948)..(951): Xaa in position 948 to 951 is any amino acid
  Variant (953)..(954): Xaa in position 953 to 954 is any amino acid
  Variant (959)..(959): Xaa in position 959 is any amino acid
  Variant (963)..(965): Xaa in position 963 to 965 is any amino acid
  Variant (968)..(968): Xaa in position 968 is any amino acid
  Variant (971)..(979): Xaa in position 971 to 979 is any amino acid
  Variant (980)..(980): Xaa in position 980 is any or no amino acid
  Variant (983)..(983): Xaa in position 983 is any amino acid
  Variant (986)..(986): Xaa in position 986 is any amino acid
  Variant (990)..(990): Xaa in position 990 is any amino acid
  Variant (996)..(996): Xaa in position 996 is any amino acid
  Variant (999)..(999): Xaa in position 999 is any amino acid
  Variant (1002)..(1003): Xaa in position 1002 to 1003 is any amino acid
  Variant (1006)..(1006): Xaa in position 1006 is any amino acid
  Variant (1011)..(1011): Xaa in position 1011 is any amino acid
  Variant (1015)..(1015): Xaa in position 1015 is any amino acid
  Variant (1019)..(1020): Xaa in position 1019 to 1020 is any amino acid
  Variant (1023)..(1023): Xaa in position 1023 is any amino acid
  Variant (1025)..(1029): Xaa in position 1025 to 1029 is any amino acid
  Variant (1032)..(1032): Xaa in position 1032 is any amino acid
  Variant (1034)..(1034): Xaa in position 1034 is any amino acid
  Variant (1047)..(1047): Xaa in position 1047 is any amino acid
  Variant (1051)..(1051): Xaa in position 1051 is any amino acid
  Variant (1057)..(1057): Xaa in position 1057 is any amino acid
  Variant (1062)..(1062): Xaa in position 1062 is any amino acid
  Variant (1065)..(1065): Xaa in position 1065 is any amino acid
  Variant (1068)..(1068): Xaa in position 1068 is any amino acid
  Variant (1078)..(1078): Xaa in position 1078 is any amino acid
  Variant (1081)..(1081): Xaa in position 1081 is any amino acid
  Variant (1083)..(1084): Xaa in position 1083 to 1084 is any amino acid
  Variant (1088)..(1088): Xaa in position 1088 is any amino acid
  Variant (1090)..(1090): Xaa in position 1090 is any amino acid
  Variant (1094)..(1094): Xaa in position 1094 is any amino acid
  Variant (1096)..(1097): Xaa in position 1096 to 1097 is any amino acid
  Variant (1100)..(1101): Xaa in position 1100 to 1101 is any amino acid
  Variant (1107)..(1109): Xaa in position 1107 to 1109 is any amino acid
  Variant (1111)..(1119): Xaa in position 1111 to 1119 is any amino acid
  Variant (1120)..(1120): Xaa in position 1120 is any or no amino acid
  Variant (1122)..(1123): Xaa in position 1122 to 1123 is any amino acid
  Variant (1125)..(1125): Xaa in position 1125 is any amino acid
  Variant (1127)..(1127): Xaa in position 1127 is any amino acid
  Variant (1130)..(1134): Xaa in position 1130 to 1134 is any amino acid
SSXXXXPXXXXXXXXXXXXXXXXXXXXXXXXXXXXXXXXXXXXXXXXXXXXXXXXXXXXXXXXXXXXXTXXXXXXXXXSXXXXXXXXXXXXXXXXXXXXXXXXXXXXXXXPXXXXXXXXXXXXXXXXXXXXXXXGXXSXXXIXXXXXXXXXXXXXXXXXXXXXXXKXSXXDRXXXXXXXXXXXXXXXXXXXXXXXXXXXXXXXXXXXXXXXXRXXXXXXXXXXXXXXXXXXXXXXXXXXXXXXXXXXXXDXXXXXXXXXXXXXXXXXXXXXXXXXXXXXXXXXQXLXXXXXXXXXXXXXLXXXXXXXXXXXXXXXPXXXXXXFXQXXXXXXXXXXXXXXXXXXXXXXXXRXXXXXXXXXXXXXXXXQXXXXXXXXXSXXXXXXXXXXXXXXXXXXXXVXXXXXXXXXXXLXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKFXXXXPXXLXXDXXLKXYQXXGINWLXLLYXNXXSCILADXMGLGKTCQVIXFXAXLXXXXXXGPHLVVVPSSTLENWLREFXKFCPXLXXEPYYGXQQERAXXRXXXEXNXXXYDVXVTTYXLAXGXKXDXSFLXXXNFXVXVYDEGHMLKNSXSERXXKLMXIXAXFRLLLTGTPLQNNLKELXSLLXFIXPNXFXSXKXXLXXXFKXXXXTXDXXXXXXXLLXXXXIXRAKTMMKPFXLRRXKXQVLXXLPXKXXXXXXCXXXXXQXXIYXXEXXXVXXXXXXXXXGXXXXXXXXXXKXXXXXSXXXXXMXLRKAXXHPLLFRXXYXDXXXXKMXXAIXXEXXYXEXXNXXYIXEDMXXMXDFELHXLCXXFPXXLXXXXLXXDEWMXSGKXXXLKXLLXXXXXXXXXXVLXFSXFTQXLDILEXVLXTLXXKFXRLDGXTQVXDRQXXIDXFXXXXXIPXFXLSTKAGGFGINLXCANXVIIFDXSFNPXDDXQAXDRAHRVGQTXEVXVXXLITXDXIEEXIXXLAXXKLALDXXXSXXXXXXXXXXEXXVXDXLEXXXXXE

SEQ ID NO: 3881 - protein, 62 aa, Artificial sequence
  protein pattern
  Variant (6)..(6): Xaa in position 6 is Asp or Glu
  Variant (17)..(17): Xaa in position 17 is Ala or Ser
  Variant (19)..(19): Xaa in position 19 is Phe or Leu
  Variant (21)..(22): Xaa in position 21 to 22 is any or no amino acid
  Variant (24)..(24): Xaa in position 24 is any amino acid
  Variant (26)..(29): Xaa in position 26 to 29 is any amino acid
  Variant (30)..(31): Xaa in position 30 to 31 is any or no amino acid
  Variant (35)..(35): Xaa in position 35 is Ile or Val
  Variant (42)..(42): Xaa in position 42 is Ile or Leu
  Variant (50)..(50): Xaa in position 50 is Asn or Gln
  Variant (53)..(53): Xaa in position 53 is Ala or Cys
  Variant (55)..(55): Xaa in position 55 is any amino acid
  Variant (57)..(57): Xaa in position 57 is any amino acid
  Variant (58)..(58): Xaa in position 58 is Ile or Val
  Variant (59)..(59): Xaa in position 59 is any amino acid
CILADXMGLGKTCQVIXFXAXXYXKXXXXXXPHLXVVPSSTXENWLREFXKFXPXLXXXPYY

SEQ ID NO: 3882 - protein, 60 aa, Artificial sequence
  protein pattern
  Variant (2)..(2): Xaa in position 2 is any amino acid
  Variant (4)..(4): Xaa in position 4 is His or Tyr
  Variant (5)..(5): Xaa in position 5 is Asp or Glu
  Variant (6)..(6): Xaa in position 6 is Asp or Asn
  Variant (7)..(7): Xaa in position 7 is any amino acid
  Variant (8)..(8): Xaa in position 8 is Asp or Thr
  Variant (11)..(11): Xaa in position 11 is Ile or Val
  Variant (13)..(13): Xaa in position 13 is any or no amino acid
  Variant (15)..(15): Xaa in position 15 is any or no amino acid
  Variant (18)..(18): Xaa in position 18 is Lys or Arg
  Variant (22)..(22): Xaa in position 22 is any amino acid
  Variant (27)..(27): Xaa in position 27 is Ala or Val
  Variant (31)..(31): Xaa in position 31 is any amino acid
  Variant (37)..(37): Xaa in position 37 is Gln or Ser
  Variant (42)..(42): Xaa in position 42 is any amino acid
  Variant (43)..(43): Xaa in position 43 is any or no amino acid
  Variant (45)..(45): Xaa in position 45 is any amino acid
  Variant (48)..(48): Xaa in position 48 is Ala or Glu
  Variant (49)..(49): Xaa in position 49 is Asp or Asn
  Variant (58)..(58): Xaa in position 58 is Lys or Arg
DXFXXXXXIPXFXLXSTXAGGXGINLXCANXVIIFDXSFNPXXDXQAXXRAHRVGQTXEV

SEQ ID NO: 3883 - protein, 60 aa, Artificial sequence
  protein pattern
  Variant (3)..(3): Xaa in position 3 is Asp or Asn
  Variant (5)..(5): Xaa in position 5 is any or no amino acid
  Variant (7)..(7): Xaa in position 7 is any or no amino acid
  Variant (13)..(13): Xaa in position 13 is any amino acid
  Variant (17)..(17): Xaa in position 17 is Arg or Ser
  Variant (18)..(18): Xaa in position 18 is any amino acid
  Variant (22)..(22): Xaa in position 22 is Phe or Tyr
  Variant (23)..(23): Xaa in position 23 is any amino acid
  Variant (24)..(24): Xaa in position 24 is His or Lys
  Variant (27)..(27): Xaa in position 27 is any amino acid
  Variant (28)..(28): Xaa in position 28 is Ile or Leu
  Variant (29)..(29): Xaa in position 29 is any amino acid
  Variant (31)..(31): Xaa in position 31 is any amino acid
  Variant (49)..(49): Xaa in position 49 is Met or Val
  Variant (53)..(53): Xaa in position 53 is Ala or Glu
  Variant (56)..(56): Xaa in position 56 is Leu or Met
  Variant (59)..(59): Xaa in position 59 is Leu or Met
NFXVXVXYDEGHXLKNXXSERXXXLMXXXAXFRLLLTGTPLQNNLKELXSLLXFIXPNXF

SEQ ID NO: 3884 - protein, 39 aa, Artificial sequence
  protein pattern
  Variant (2)..(2): Xaa in position 2 is any amino acid
  Variant (5)..(5): Xaa in position 5 is any amino acid
  Variant (7)..(7): Xaa in position 7 is Ala or Ser
  Variant (8)..(8): Xaa in position 8 is Ile or Leu
  Variant (13)..(13): Xaa in position 13 is Phe or His
  Variant (15)..(16): Xaa in position 15 to 16 is any amino acid
  Variant (18)..(18): Xaa in position 18 is Asp or Asn
  Variant (20)..(20): Xaa in position 20 is any or no amino acid
  Variant (23)..(23): Xaa in position 23 is any amino acid
  Variant (24)..(24): Xaa in position 24 is any or no amino acid
  Variant (27)..(27): Xaa in position 27 is Cys or Ser
  Variant (28)..(28): Xaa in position 28 is Asp or Lys
  Variant (30)..(30): Xaa in position 30 is any amino acid
  Variant (31)..(31): Xaa in position 31 is Ile or Leu
  Variant (32)..(32): Xaa in position 32 is Ala, Asp or Gln
  Variant (34)..(34): Xaa in position 34 is Glu or Pro
  Variant (35)..(35): Xaa in position 35 is any amino acid
  Variant (36)..(36): Xaa in position 36 is Trp or Tyr
  Variant (37)..(37): Xaa in position 37 is any amino acid
  Variant (39)..(39): Xaa in position 39 is Asn or Ser
MXLRXAXXHPLLXRXXYXDXKIXXKMXXAXXXEXXXXEX

SEQ ID NO: 3885 - protein, 28 aa, Artificial sequence
  protein pattern
  Variant (3)..(3): Xaa in position 3 is any or no amino acid
  Variant (5)..(6): Xaa in position 5 to 6 is any amino acid
  Variant (7)..(7): Xaa in position 7 is any or no amino acid
  Variant (9)..(9): Xaa in position 9 is Glu or Thr
  Variant (13)..(13): Xaa in position 13 is Ser or Thr
  Variant (15)..(15): Xaa in position 15 is Leu or Met
  Variant (19)..(19): Xaa in position 19 is Ile or Val
  Variant (23)..(23): Xaa in position 23 is Lys or Arg
  Variant (25)..(25): Xaa in position 25 is Asp or His
  Variant (28)..(28): Xaa in position 28 is Ile or Leu
LLXAXXXIXRAKXMXKPFXLRRXKXQVX

SEQ ID NO: 3886 - protein, 40 aa, Artificial sequence
  protein pattern
  Variant (3)..(3): Xaa in position 3 is Ile or Val
  Variant (5)..(5): Xaa in position 5 is Ser or Thr
  Variant (6)..(6): Xaa in position 6 is any amino acid
  Variant (8)..(9): Xaa in position 8 to 9 is any amino acid
  Variant (10)..(10): Xaa in position 10 is Ala or Val
  Variant (11)..(11): Xaa in position 11 is Leu or Met
  Variant (16)..(16): Xaa in position 16 is any amino acid
  Variant (19)..(20): Xaa in position 19 to 20 is any amino acid
  Variant (21)..(22): Xaa in position 21 to 22 is any or no amino acid
  Variant (24)..(25): Xaa in position 24 to 25 is any or no amino acid
  Variant (28)..(28): Xaa in position 28 is Leu or Val
  Variant (33)..(33): Xaa in position 33 is Gln, Ser or Thr
  Variant (35)..(35): Xaa in position 35 is Gln or Ser
  Variant (37)..(37): Xaa in position 37 is Glu or Asn
VLXFXXFXXXXDILEXVLXXXXLXXKFXRLDGXTXVXDRQ

SEQ ID NO: 3887 - protein, 25 aa, Artificial sequence
  protein pattern
  Variant (2)..(2): Xaa in position 2 is any amino acid
  Variant (3)..(3): Xaa in position 3 is Glu or Gln
  Variant (6)..(6): Xaa in position 6 is any amino acid
  Variant (10)..(10): Xaa in position 10 is Glu or Ser
  Variant (11)..(11): Xaa in position 11 is any amino acid
  Variant (13)..(13): Xaa in position 13 is Ser or Thr
  Variant (19)..(19): Xaa in position 19 is Lys or Arg
  Variant (22)..(23): Xaa in position 22 to 23 is any amino acid
NXXYIXEDMXXMXDFELHXLCXXFP

SEQ ID NO: 3888 - protein, 27 aa, Artificial sequence
  protein pattern
  Variant (2)..(2): Xaa in position 2 is any amino acid
  Variant (5)..(5): Xaa in position 5 is Asp or Glu
  Variant (6)..(6): Xaa in position 6 is Asn or Ser
  Variant (7)..(7): Xaa in position 7 is Leu or Val
  Variant (9)..(9): Xaa in position 9 is any or no amino acid
  Variant (11)..(11): Xaa in position 11 is any or no amino acid
  Variant (13)..(13): Xaa in position 13 is Glu or Ser
  Variant (14)..(15): Xaa in position 14 to 15 is any amino acid
  Variant (17)..(18): Xaa in position 17 to 18 is any amino acid
  Variant (19)..(19): Xaa in position 19 is Ile or Val
  Variant (20)..(20): Xaa in position 20 is Ala, Ser or Thr
  Variant (21)..(21): Xaa in position 21 is any amino acid
  Variant (22)..(22): Xaa in position 22 is Gly or Gln
  Variant (23)..(23): Xaa in position 23 is Ile or Met
  Variant (24)..(25): Xaa in position 24 to 25 is any amino acid
YXAIXXXIXKXCXXXGXXXXXXXXXWG

SEQ ID NO: 3889 - protein, 27 aa, Artificial sequence
  protein pattern
  Variant (2)..(2): Xaa in position 2 is Lys or Arg
  Variant (3)..(3): Xaa in position 3 is any amino acid
  Variant (5)..(5): Xaa in position 5 is Ala, Asn or Ser
  Variant (6)..(6): Xaa in position 6 is Pro or Ser
  Variant (7)..(7): Xaa in position 7 is Asp or Glu
  Variant (8)..(8): Xaa in position 8 is Ile or Val
  Variant (9)..(9): Xaa in position 9 is Glu, Gln or Ser
  Variant (12)..(12): Xaa in position 12 is Asp or Ser
  Variant (15)..(15): Xaa in position 15 is any amino acid
  Variant (16)..(16): Xaa in position 16 is Thr or Val
  Variant (18)..(18): Xaa in position 18 is Ile or Val
  Variant (22)..(22): Xaa in position 22 is any amino acid
  Variant (26)..(26): Xaa in position 26 is any amino acid
  Variant (27)..(27): Xaa in position 27 is Asn or Gln
PXXLXXXXXLKXYQXXGXNWLXLLYXX

SEQ ID NO: 3890 - protein, 31 aa, Artificial sequence
  protein pattern
  Variant (2)..(2): Xaa in position 2 is Ser or Thr
  Variant (3)..(3): Xaa in position 3 is any amino acid
  Variant (7)..(7): Xaa in position 7 is Ala or Glu
  Variant (8)..(8): Xaa in position 8 is Asp, Glu or Asn
  Variant (9)..(9): Xaa in position 9 is Ile or Leu
  Variant (11)..(11): Xaa in position 11 is any amino acid
  Variant (12)..(12): Xaa in position 12 is any or no amino acid
  Variant (14)..(14): Xaa in position 14 is any amino acid
  Variant (16)..(16): Xaa in position 16 is any or no amino acid
  Variant (18)..(18): Xaa in position 18 is Ala, Asp or Glu
  Variant (19)..(19): Xaa in position 19 is Gly or Ile
  Variant (20)..(20): Xaa in position 20 is any amino acid
  Variant (23)..(23): Xaa in position 23 is any or no amino acid
  Variant (25)..(25): Xaa in position 25 is Leu or Val
  Variant (26)..(26): Xaa in position 26 is Thr or Val
  Variant (28)..(30): Xaa in position 28 to 30 is any amino acid
  Variant (31)..(31): Xaa in position 31 is Ala or Leu
GXXQERXXXRXXIXEXNXXXYDXIXXTXXXX

SEQ ID NO: 3891 - protein, 29 aa, Artificial sequence
  protein pattern
  Variant (2)..(3): Xaa in position 2 to 3 is any or no amino acid
  Variant (5)..(5): Xaa in position 5 is any amino acid
  Variant (6)..(7): Xaa in position 6 to 7 is any or no amino acid
  Variant (9)..(9): Xaa in position 9 is any amino acid
  Variant (10)..(10): Xaa in position 10 is Asp, Asn or Ser
  Variant (12)..(12): Xaa in position 12 is Glu or Pro
  Variant (15)..(15): Xaa in position 15 is Asp, Asn or Gln
  Variant (19)..(19): Xaa in position 19 is Ile or Val
  Variant (20)..(20): Xaa in position 20 is Asp, Glu or Arg
  Variant (21)..(21): Xaa in position 21 is any amino acid
  Variant (24)..(24): Xaa in position 24 is any amino acid
  Variant (25)..(25): Xaa in position 25 is Leu or Val
  Variant (27)..(28): Xaa in position 27 to 28 is any amino acid
  Variant (29)..(29): Xaa in position 29 is Ile or Met
LXXYXXXLXXDXWMXSGKXXXLKXXLXXX

SEQ ID NO: 3892 - protein, 26 aa, Artificial sequence
  protein pattern
  Variant (3)..(3): Xaa in position 3 is Ser or Thr
  Variant (4)..(4): Xaa in position 4 is Asp, Lys or Arg
  Variant (5)..(5): Xaa in position 5 is Asp or Asn
  Variant (6)..(6): Xaa in position 6 is Ser or Thr
  Variant (10)..(10): Xaa in position 10 is any amino acid
  Variant (12)..(13): Xaa in position 12 to 13 is any amino acid
  Variant (16)..(16): Xaa in position 16 is any amino acid
  Variant (17)..(17): Xaa in position 17 is Asn or Thr
  Variant (23)..(24): Xaa in position 23 to 24 is any amino acid
  Variant (25)..(25): Xaa in position 25 is Ile, Leu or Val
LIXXXXIEEXIXXLAXXKLALDXXXS

SEQ ID NO: 3893 - protein, 24 aa, Artificial sequence
  protein pattern
  Variant (2)..(2): Xaa in position 2 is any or no amino acid
  Variant (4)..(4): Xaa in position 4 is any or no amino acid
  Variant (6)..(9): Xaa in position 6 to 9 is any amino acid
  Variant (10)..(10): Xaa in position 10 is Glu, Gln or Ser
  Variant (11)..(11): Xaa in position 11 is His or Tyr
  Variant (13)..(13): Xaa in position 13 is any amino acid
  Variant (14)..(14): Xaa in position 14 is Leu or Met
  Variant (15)..(15): Xaa in position 15 is Asn or Ser
  Variant (16)..(16): Xaa in position 16 is Ala, Asp or Glu
  Variant (17)..(17): Xaa in position 17 is any amino acid
  Variant (19)..(19): Xaa in position 19 is any amino acid
  Variant (20)..(20): Xaa in position 20 is Glu or Lys
  Variant (23)..(23): Xaa in position 23 is Asp, Glu or Asn
  Variant (24)..(24): Xaa in position 24 is His, Lys or Arg
LXPXKXXXXXXCXXXXXQXXIYXX

SEQ ID NO: 3894 - protein, 41 aa, Artificial sequence
  protein pattern
  Variant (2)..(2): Xaa in position 2 is Phe, Ile or Leu
  Variant (4)..(4): Xaa in position 4 is Asp, Glu, Gly or Asn
  Variant (5)..(5): Xaa in position 5 is Ala, Cys or Ser
  Variant (6)..(6): Xaa in position 6 is Asp, Glu or Thr
  Variant (7)..(7): Xaa in position 7 is Ala, Ile or Pro
  Variant (8)..(8): Xaa in position 8 is any amino acid
  Variant (9)..(9): Xaa in position 9 is Ala or Asp
  Variant (10)..(10): Xaa in position 10 is Ile or Leu
  Variant (11)..(11): Xaa in position 11 is any amino acid
  Variant (14)..(14): Xaa in position 14 is Ala, Gly or Ser
  Variant (15)..(15): Xaa in position 15 is Ala, Asp or Glu
  Variant (16)..(16): Xaa in position 16 is any amino acid
  Variant (17)..(17): Xaa in position 17 is Ser or Thr
  Variant (18)..(18): Xaa in position 18 is any amino acid
  Variant (19)..(19): Xaa in position 19 is Asp, Glu or His
  Variant (20)..(20): Xaa in position 20 is any amino acid
  Variant (22)..(23): Xaa in position 22 to 23 is any amino acid
  Variant (24)..(24): Xaa in position 24 is any or no amino acid
  Variant (26)..(27): Xaa in position 26 to 27 is any amino acid
  Variant (28)..(28): Xaa in position 28 is any or no amino acid
  Variant (31)..(31): Xaa in position 31 is Phe or Tyr
  Variant (32)..(32): Xaa in position 32 is Glu, Ser or Thr
  Variant (33)..(33): Xaa in position 33 is Asp or Ser
  Variant (35)..(35): Xaa in position 35 is any amino acid
  Variant (36)..(36): Xaa in position 36 is Ala, Glu, Gln or Ser
  Variant (37)..(37): Xaa in position 37 is Phe or Val
  Variant (38)..(40): Xaa in position 38 to 40 is any amino acid
  Variant (41)..(41): Xaa in position 41 is Asp, Glu, Asn or Pro
FXNXXXXXXXXDLXXXXXXXAXXXIXXXRPXXXLXXXXXXX

SEQ ID NO: 3895 - DNA, 2064 bp, Saccharomyces cerevisiae
  CDS (1)..(2064)
atgccaaacttaaagagactacccatcccgccactgcaggacacgctcaaccgctacctggcacgcgtggaacccctgcaggacgagcgccaaaaccgccgtacgcgccgcactgtgctctccgcagaaaacctggacgcattgaacacgctgcacgagcggctgctagaatacgacgcacggctcgcggaaagcaacccagagtcctcatacatcgagcagttctggtatgacgcgtacttgctatatgatgcaactgtcgttctcaacgtcaacccgtacttccaactgcaggacgacccaaccatcaaagacacaccagagacggcggcacagggcccctatggcgcacacacggtgcaggttcgtcgtgccgcacgactcaccacctctattctcaagttcatccgccagattcgccacggcacactccgcacagacactgtgcgcggcaaaacgccgctgtcgatggaccagtatgagcggctattcggctccagtagaatccctccgggtcccggcgagccctcttgccacttgcaaacagacgccacgtcgcatcacgtggtggcgatgtatcgtggccagttctactggttcgacgtgctggacacacgcaacgagcccatcttcgccaccccagaacaactggagtggaacctctactcgatcatcatggacgcggaatccgccggaagcggatccgcgccctttggcgtgttcaccacagagtcgcgccgggtgtggtccaacatcagggactatctgttccatgcggacgactgcaccaactggcgcaatctcaagctgatcgactccgcgctgttcgtggtctgtctcgacgacgtggcgtttgccgccgatcagcaggacgagctcacgcgttcgatgctgtgcgggacttctaccatcaatctcgacccgcaccaacaccagccgccattgaacgtgcagacaggcacctgtctcaaccgctggtacgacaagttacaactgatcgtgaccaagaacggtaaggcgggcatcaacttcgaacacaccggtgtggacggccacactgtgctgcggctcgccacagacatctacacagactcgatcctgagcttcgcacgcggtgtcaccaagaacgtcgtcgacatctttagcgacgacgatggaaaaccatcgtcgtcgtcgttggcctcggcggctcactccgccaacttgatcaccatccctcgtaaactggaatggcgcactgacaatttcctgcaatcgtcgctgcactttgccgagacgcgcatctcggacttgatctcgcaatacgagtttgttaatcttgacttctccaactacggcgcgtcccatatcaagacagtgttcaagtgctcgccagacgccttcgtgcagcaggtgttccaggtcgcatacttcgcgttgtacggtcgcttcgagaccgtgtacgagcctgccatgaccaaggcgttccaaaacggccgcacagaggccatccgctccgtcacgggccaatcgaagctctttgtcaagtcactactggaccaggatgcctcggacgccaccaaaattcagctcttgcacgacgcctgtacggcgcactcgcaaatcacaagggaatgctcccaggggctcggccaggaccgtcacttgtatgcgctctactgcctctggaaccaatggtacaaggacaagttggagctcccacccatcttccgcgacaagtcctggactaccatgcagaacaacgtcttgagcacctccaactgcggtaacccctgcctcaagagcttcgggttcgggcctgtcaccgccaacggcttcggcatcggctacatcatcagagaccactccgtctctgtggtggtgtcctcaaggcatcgccagactgctcggtttgcgtcgctcatggaaaagtcgctgctggagatcgaccgcatcttcaaacggcagcaagctcgcgcagcaaaacccgctgccaggaccactgctagcgccaacaccaaatcagaagacatgaaatacctgttgtccggctacgattacttcgacgtgagcgtgtccggttga

SEQ ID NO: 3896 - protein, 687 aa, Saccharomyces cerevisiae
MPNLKRLPIPPLQDTLNRYLARVEPLQDERQNRRTRRTVLSAENLDALNTLHERLLEYDARLAESNPESSYIEQFWYDAYLLYDATVVLNVNPYFQLQDDPTIKDTPETAAQGPYGAHTVQVRRAARLTTSILKFIRQIRHGTLRTDTVRGKTPLSMDQYERLFGSSRIPPGPGEPSCHLQTDATSHHVVAMYRGQFYWFDVLDTRNEPIFATPEQLEWNLYSIIMDAESAGSGSAPFGVFTTESRRVWSNIRDYLFHADDCTNWRNLKLIDSALFVVCLDDVAFAADQQDELTRSMLCGTSTINLDPHQHQPPLNVQTGTCLNRWYDKLQLIVTKNGKAGINFEHTGVDGHTVLRLATDIYTDSILSFARGVTKNVVDIFSDDDGKPSSSSLASAAHSANLITIPRKLEWRTDNFLQSSLHFAETRISDLISQYEFVNLDFSNYGASHIKTVFKCSPDAFVQQVFQVAYFALYGRFETVYEPAMTKAFQNGRTEAIRSVTGQSKLFVKSLLDQDASDATKIQLLHDACTAHSQITRECSQGLGQDRHLYALYCLWNQWYKDKLELPPIFRDKSWTTMQNNVLSTSNCGNPCLKSFGFGPVTANGFGIGYIIRDHSVSVVVSSRHRQTARFASLMEKSLLEIDRIFKRQQARAAKPAARTTASANTKSEDMKYLLSGYDYFDVSVSG

SEQ ID NO: 3897 - DNA, 2405 bp, Oryza sativa
  CDS (64)..(2352)
aacctctgccaacttctcgccgcaacatccacccgcccgtagacaacgtcctcctttatcgagatggccccgggtctcatgtccgccgacgcgaaaggcgtcttcaatgcccaggctgtcgaggccaagtccgctgccaaagacgatggcggcgccaacgaaggcctcggtggcggcaagacgttcgagggccagtccaagctgccccaccttcccatccccaagctcgaagacacatgccagcgatacctctcgagtctgctcccgctccagtcgcccgagcagcacgccgtaacccaacgcatcgtcgacgactttctccagaaccaaggccccacgctccagaagcagctgcaggagtatgccagcacgcgcgccagctatattgaagagttctgggacgagagctacctccaggcctcggactcggtcgtgctcaacctcaaccccttcttcatcctcgaggatgaccccaccccgacgcgcggcaaccagctcatgaggaccgccaacctcatcctcgccagtctggcgttcatccacgatctgcgcacaggcgttctcgagccagacaacgtgcgcggcactccgttggacatgtaccaatatacacgcctctttgctacctcgcgcatccccaccgccaacggatgcaggatggaggtcgagcccgagtcgaggcatatcgtcgtcatgcgccgcggtcagatctactggttcgaggcgctcgacgaggagcaccgtccgctcctgaccgagcgcgccatgctgggcaacctgcaggctatcgtgcgcgacgccgacaagatccagatcgacgacgttgccaaaggatcggtgggcatcctcaccacggagaagcgtcccatctggtccatgtaccgcgagcacctgcgcgaggactcgcacaaccgcaagtgtctcgaggtcgtcgacacggcgctctttgtcgtgtgcatggacgactctgaacccgccgatgcggccgagctgagcaacaacatgctctgcggaacctacaagctgcagcgcggcatccaggcgggcacgtgcaccaaccgatggtacgacaagctccagatcatcgtctgtgccaatggtgctgccggcatcaactttgagcacacgggcgtcgacggccataccgtgctgcgctatgcggccgacgtgtacaccgagctcatcatgcgcttcgccaaatccatcaactcggccaccaagagtctcttcaaggccaagaccagtccgtacgccaaaggcgccggcaagaaggccaacggttcgttcagcgaggccgatgcgcagaaggcccaggacgtcaaccaagcaacggcacccaagaagctcgagtggaacctcaccaaaaagctcacagacggcatcaagtacggcgagacgaggctgtcggacctcatctgccagaacgagtgccaggtgctcgagttcgaccgctacggcaagaacttcatcacaaggcacaggttctcgccagacgcgtatgtgcagatggccttccaggcggcatactacacgctctacggaaggtgcgagacgacgtacgagccggccatgaccaaggccttcttacacggacgcaccgaggccatccgaacggttcagccgcactcggccaggttcgtcgagacgtacatgtcggatgccaagaccgacgccaagctggacgcgctcaaaaaggcgtgcgagggccatgcgaagctctccaaagcgtgtgctaccggtcagggtcacgaccgacacctgtacgcgctgcacaatctgtggaagaagatgcaggctgagcgatcggacgatcaaccagcacccaagatcttcacagatgcaggctatgccaagctcaaccacacggtggtgtccacctcgaactgtggcaatcccgcactgcgcatgtttgggtttggtccggttgtgccagacggttttggcatcggatacatcatcaaggacgatgggatcacggtatgtgcgtcgagcaagcatctgcagaccaagaggttcctggacacgctcgaggcgtacctgctcgacacgcagcgcatgatcatcgagacgtacaaggcggccaatgtgcgttcgcagtcgacgtacatcgaccatgctggtgtggaatgcgatgtgcgaacaggtctgcccatcggatccaagaacaacggctattcactcgattacgaccaggtgcccgcacagcatttcggccagtccgggtactcgttcttcggagatgaaaaagccgccgccaaaaaggacgaacaacacaaggaagactcggcacagagcaggaggagaagcagactcgccagtgtcggcaagaccatcctctacgacgattattgatcgaggactggcaaacggaatgtgctcagctcgcaatgcaatgtgccaaagtg

SEQ ID NO: 3898 - protein, 762 aa, Oryza sativa
MAPGLMSADAKGVFNAQAVEAKSAAKDDGGANEGLGGGKTFEGQSKLPHLPIPKLEDTCQRYLSSLLPLQSPEQHAVTQRIVDDFLQNQGPTLQKQLQEYASTRASYIEEFWDESYLQASDSVVLNLNPFFILEDDPTPTRGNQLMRTANLILASLAFIHDLRTGVLEPDNVRGTPLDMYQYTRLFATSRIPTANGCRMEVEPESRHIVVMRRGQIYWFEALDEEHRPLLTERAMLGNLQAIVRDADKIQIDDVAKGSVGILTTEKRPIWSMYREHLREDSHNRKCLEVVDTALFVVCMDDSEPADAAELSNNMLCGTYKLQRGIQAGTCTNRWYDKLQIIVCANGAAGINFEHTGVDGHTVLRYAADVYTELIMRFAKSINSATKSLFKAKTSPYAKGAGKKANGSFSEADAQKAQDVNQATAPKKLEWNLTKKLTDGIKYGETRLSDLICQNECQVLEFDRYGKNFITRHRFSPDAYVQMAFQAAYYTLYGRCETTYEPAMTKAFLHGRTEAIRTVQPHSARFVETYMSDAKTDAKLDALKKACEGHAKLSKACATGQGHDRHLYALHNLWKKMQAERSDDQPAPKIFTDAGYAKLNHTVVSTSNCGNPALRMFGFGPVVPDGFGIGYIIKDDGITVCASSKHLQTKRFLDTLEAYLLDTQRMIIETYKAANVRSQSTYIDHAGVECDVRTGLPIGSKNNGYSLDYDQVPAQHFGQSGYSFFGDEKAAAKKDEQHKEDSAQSRRRSRLASVGKTILYDDY

SEQ ID NO: 3899 - DNA, 2613 bp, Magnaporthe grisea 70-15
  CDS (1)..(2613)
atgcccagccaagttcgcatatttactccacccaagcctttgggtgagaccctggccgagccagatcaagacccagtcaaggcacagcagccgcttccaaggcggcagctgaaacctatgtccaagaatcacggcgggatacccgaggagggcggtatcactttcgccgcccaggattctctgccgaagcttcctatcccagacctagagcgcacttgcgaaaagtacctcgctgctctgaagccattacagtcgcccagggagcatggcgaaactcggaatgccgtccaggaattcttgaggcacgacggcccagagctacaagagaagctgaagaagtatgctgagggccagacgagctacatcgagcaattttggtacgactcgtacctgaatttcgataacccagtggttctcaatcttaaccctttctttctccttgaggatgacccaactcctgctcgtaataaccaagtcacccgtgccgcttcactcgtcgtatcagcactcgagtttgttcgtgcagtgagaaaggaggagctgccgccagacaaggtcaaaaacacgccactatgcatgtaccagtactcccgcctctttggcaccgctcgtgtgcctaccgagaatggctgccagatcgagcaagacccccactcgaaacatattgtagtcatggcgcatggtcagttctattggtttgacgcactcgacgacaattcggacgttatcatgacggagaaggacatttctatcaaccttcagactattgttgacgacgccagccttactcctattcaggaggcagccaagggtgctctcggtgtcctgagcaccgagaaccgcaaggtctggtcaggcctcagggatatcttgacccgcgacgaagggtccaacaacgccgactgtctcggcatcatcgactcggccctcttcatcctctgcctcgactacaccgagcccgcgacggccgcagagctctgccaaaacatgctgtgcggcacaagcgagattgagaagggtgttcaaattggaacatgcacaaatcggtggtacgacaagctgcaaatcattgtttgtaagaacggcagcgcaggcatcaactttgaacacaccggtgtcgatggacacacagttctccggttcgccagcgacgtctacaccgacactatccttcgttttgccaggactatcaatggccactcccccaccctttgggcgtcaaccagtccagacccttccaaaagggatcccgagagctttggagatgtcattccgactccgcacaaattggagtgggatctggtacccgaggtcagcatagcagtacgcttcgcagaaaccagacttgctgacctgatcggccaaaatgagtttgagtgcctcgacttctcggcgtacggcaagaatttcatcacctcgatggggttctctcctgatgcatttgtccagatggcctaccaggctgcctactatggcctttacggccgcgcagagtgcacctacgagcccgccatgaccaagttctttctccatggccggacagaggccgtccgctccgtcacggatgagtccatcaacttcatacagaacttttgggcagacaacccagcagaagccaaagtcgaggcgctacgggcggcttgcaagaagcacgtgaacatgacgaaagactgcgccaaggctcaggggtgcgacagacatttgtatgcgcttttctgcctctggcagcgattagtcgatgaggatgccggcacgacgacaaacgggtactcgagcggaatgagcgacaacgaaggggccgtttcggagaggtcgccgtcccctaccgccaccactgccaccgccactggggagaaggagaaggaaaacggcgaggggctgagatctaggggtgaaagcacctcgtcatcgcaacgttccgtcaagtacgcgacgctaccgctcatctttgccgatccaggctgggacaagctcaacacaacgatcctctccacgtccaactgcggcaacccctccctccgccagttcggcttcggccccgtctcgggcgacggtttcggcatcggctacatcatcaaggacgagcgcatctcgatgtgcgtagcgagcaagcaccggcagactaagcgcttcgtcgacgccctcgagagctacctgctcgagattcgccggatccttcgcctcgccagccgcagggccgcctcctccaccgccgacgggggcccactggccggcagcattgccgaggcaaagcagcagacgacgcgcgcccgcgaggtcgacgacgaacaacgccagcagtaccgccgcccctcgcagcagactaacagactcaagtccaggggcaggatgatcgccggcccggggctggaggggctgatgcgctcaaagtcatcgatgacgggcacgacttcgcccacgtcggaaagtctggctatgagtgaggatgacgagcttggcggctacggctttttcgacgcgggaatgctgctgcaggccctcaaggcccgcaacacccactttgacgtgggcgagacgagggcgagcgagagggcggccgtgcaggcgaggaggaacaatgtcggcaagaagctgcggctcatcgactactaa

SEQ ID NO: 3900 - protein, 870 aa, Magnaporthe grisea 70-15
MPSQVRIFTPPKPLGETLAEPDQDPVKAQQPLPRRQLKPMSKNHGGIPEEGGITFAAQDSLPKLPIPDLERTCEKYLAALKPLQSPREHGETRNAVQEFLRHDGPELQEKLKKYAEGQTSYIEQFWYDSYLNFDNPVVLNLNPFFLLEDDPTPARNNQVTRAASLVVSALEFVRAVRKEELPPDKVKNTPLCMYQYSRLFGTARVPTENGCQIEQDPHSKHIVVMAHGQFYWFDALDDNSDVIMTEKDISINLQTIVDDASLTPIQEAAKGALGVLSTENRKVWSGLRDILTRDEGSNNADCLGIIDSALFILCLDYTEPATAAELCQNMLCGTSEIEKGVQIGTCTNRWYDKLQIIVCKNGSAGINFEHTGVDGHTVLRFASDVYTDTILRFARTINGHSPTLWASTSPDPSKRDPESFGDVIPTPHKLEWDLVPEVSIAVRFAETRLADLIGQNEFECLDFSAYGKNFITSMGFSPDAFVQMAYQAAYYGLYGRAECTYEPAMTKFFLHGRTEAVRSVTDESINFIQNFWADNPAEAKVEALRAACKKHVNMTKDCAKAQGCDRHLYALFCLWQRLVDEDAGTTTNGYSSGMSDNEGAVSERSPSPTATTATATGEKEKENGEGLRSRGESTSSSQRSVKYATLPLIFADPGWDKLNTTILSTSNCGNPSLRQFGFGPVSGDGFGIGYIIKDERISMCVASKHRQTKRFVDALESYLLEIRRILRLASRRAASSTADGGPLAGSIAEAKQQTTRAREVDDEQRQQYRRPSQQTNRLKSRGRMIAGPGLEGLMRSKSSMTGTTSPTSESLAMSEDDELGGYGFFDAGMLLQALKARNTHFDVGETRASERAAVQARRNNVGKKLRLIDY

SEQ ID NO: 3901 - DNA, 2565 bp, Gibberella zeae PH-1
  CDS (1)..(2565)
atgactcaagtccggaccttcactcctcctcagtctcttggagagagactctccgacccatcttctgcgccaacatctgccggcatcgccgttcctaggactcttcctgacatccctgagctggctcaacctcgacgagcttctccgccaagactcagcggcgactataaacgctatccaatggccgacgaatcaaagaaagacggtggtataacctttgctggccaggataagttgccgaagttacccattccggagctagaatccagctgcaagaaatacctagaagctctcaagccacttcaaacggttcgcgaacatgcacaaacacagcatgcagtgaatgaattccttaaaggtgacggccctgagctgcatgagaaactgaaggcatatgccgagggtaagacgagttacatcgagcagttttggtatgactcgtatctaaactttgacaatcccgttgtgctcaatctgaacccattctttcttttggaagacgacccaacacctgctcgtaatgaccaggtcacccgcgccgcttctttggtcgtttcctcgcttgaatttgtccgtgctgtacgcaaagaagagcttgcaccagacaaggtcaagggaacccccctttgcatgtaccaattttcgagactattcggtactgctcgtgtgcccaccgaggaaggttgccaaatcgagcaagatcccgaatcgaagcacattgttgttatgtgccacggccaattctactggttcgacgtactggacgacaactcagatgttatcatgagtgaaaaggacatcacaataaacctacagaccatcgtcgatgatgcgacccaagtacctatccaagatgctgcaaaaggagccctaggagtactgagtactgagaaccgtaaggtctggtccggccttcgagatgttttgaccagtgagccaggctccaacaacgcagactctctcggtattgtagacactgctctttttgttctttgcctggactatgcggaaccgacagatgccgcagccctctgccaaaacatgctttgcggtactagtgagattgagaagggtgttcaaattggcacttgcaccaaccgatggtacgacaagcttcagatcattgtctgtaagaacggaagtgctggcatcaacttcgagcacactggtgtggatggccacacagttctgcgcttcgctagcgatgtctataccgataccattcttcggttcgctcgcaccatcaacggcatggcgccttcgctctgggcttcttctagtccagatccctcaaagcgcgaccccgagagctttggcgatgtcagtgtcaccccgcggaagttggagtgggatatgattcctgagctcagtgttgctgtccgcttcgccgagactcgtctagccgatttgattgagcagaacgagtttcagacactggacttcagccactatggcaagaacttcattacctctatggggttctctcctgatgcatttgttcagatggctttccaggccgcctactacggtctctacggtcgtgtcgagtgcacttatgaacccgccatgaccaagatgttcctgcatggccgaaccgaggcaatcaggacagtatcggaagaggtggttgatttcgtccaaaccttctgggccgagaaccctgctgaggccaaaatcgaagcgctcaggaaagcttgtcagaagcacaccgcaaatacacgacaatgcgccaaggccgagggctgcgatcgacatttatatgctttgttctcagtttggcaacggagtttagatgaggatctcgattacagcaacggttactccagtcccggtgacgaatactcagaccagaccggatcgcccgttggcagccccgtccaaggttcacatccttccatcgatggtgtcgaggtgaggcccacgcgagatcgtggttatagcgtcaactctcgatctcgagaccaagcccctctccccgctctattcgccgatgctggatgggataaactcaacaacaccatcctttcaacatccaactgtggcaaccctgctcttcgtcaattcggttttggtcctacttcgggagatggattcggtattgggtatatcatcaaggatgaaggacttgctatttgtgtcgccagcaagcaccgccagacaaagcgattcgtcgacactttcgagagctacctcctagaaatccgccgtatcctacgcatcggcaaccgcaagatgtctactggcaaagcaagccgtgcccgtgaggtagagatagaacgacccaagcttctcagtcgcatcaagtctcgaggacgtcccatcaccgcagtcgaaagcctgcgctcagccacaggcaccacatcacctacgaacgagagcagcacatttagtgaagatgatgaaatgggcggatatggatttttcgatgctggtatgcttttgcaagctctcaaggcccgtagcgagaatttcgaatcatctgacagtcgtgcctcggagagagccgccgctgcacaggcccgccgccgcgatattggaaagaaattgagactgagtgattattga

SEQ ID NO: 3902 - protein, 854 aa, Gibberella zeae PH-1
MTQVRTFTPPQSLGERLSDPSSAPTSAGIAVPRTLPDIPELAQPRRASPPRLSGDYKRYPMADESKKDGGITFAGQDKLPKLPIPELESSCKKYLEALKPLQTVREHAQTQHAVNEFLKGDGPELHEKLKAYAEGKTSYIEQFWYDSYLNFDNPVVLNLNPFFLLEDDPTPARNDQVTRAASLVVSSLEFVRAVRKEELAPDKVKGTPLCMYQFSRLFGTARVPTEEGCQIEQDPESKHIVVMCHGQFYWFDVLDDNSDVIMSEKDITINLQTIVDDATQVPIQDAAKGALGVLSTENRKVWSGLRDVLTSEPGSNNADSLGIVDTALFVLCLDYAEPTDAAALCQNMLCGTSEIEKGVQIGTCTNRWYDKLQIIVCKNGSAGINFEHTGVDGHTVLRFASDVYTDTILRFARTINGMAPSLWASSSPDPSKRDPESFGDVSVTPRKLEWDMIPELSVAVRFAETRLADLIEQNEFQTLDFSHYGKNFITSMGFSPDAFVQMAFQAAYYGLYGRVECTYEPAMTKMFLHGRTEAIRTVSEEVVDFVQTFWAENPAEAKIEALRKACQKHTANTRQCAKAEGCDRHLYALFSVWQRSLDEDLDYSNGYSSPGDEYSDQTGSPVGSPVQGSHPSIDGVEVRPTRDRGYSVNSRSRDQAPLPALFADAGWDKLNNTILSTSNCGNPALRQFGFGPTSGDGFGIGYIIKDEGLAICVASKHRQTKRFVDTFESYLLEIRRILRIGNRKMSTGKASRAREVEIERPKLLSRIKSRGRPITAVESLRSATGTTSPTNESSTFSEDDEMGGYGFFDAGMLLQALKARSENFESSDSRASERAAAAQARRRDIGKKLRLSDY

SEQ ID NO: 3903 - DNA, 2241 bp, Candida glabrata CBS 138
  CDS (1)..(2241)
atgagcgaacttaccgctgtgaagagtcggagcgatccagcgctggaagccacaaaggagagcaagttgctgaagaggctgcctatcccgccgctggaggatactttgaagaggtacttggaccgtgtgcagcctttgcaggatgaaaaacagttcaaacggacaaagaggactgtgatgtcagcagagaatctcgatgtcatgaggactttgcaagagaaacttttgcaatatgaccaggagttggccaacgaaaccccagaatcgtcatacattgagcaattttggtacgattcgtacttactatatgaccagagtgtggtcctgaacgttaatccttacttccaactggaggacgatccaactatattgaaagatgtacaaagggactctcaatactcaggtccctacggtaaatacacactacaaataaagagatgtgcaaaacttgtcacctctatcctgaagtttatcaaacaagtaagacacggtacattagctgaggataaaattagaactactccattatcaatggatcagtacaaaaaattatttggctctagtagaattccacctggaccaggtgaggaatcgtgccatttacaaaccgacccaacctcgcaccatattatggtgatgtacaaatcccaattttactggtttgatgttttagatatcaataacttcccgattttccaagcgcctgaagaactcgaatggaatctgtactcaattattatggatactgaaagacatatcggtgatcacttacaaagtagggacgaatttatccgttatcttgtacctatgggagtctttactactgaatcaagaagagtgtggtcaaatattcgtgactacatataccatgactcagattcaacaaattggaaaaacttgaagttgatcgatagtgcgttatttgtcatttgtcttgacgatcttcagtttgacagcaaggatcccaagacaagtagtcaattagtacagtccatgctatgtggtacatcaaacattaacctaggtgaagatgaaaactctaaagtgcctcttaatattcagcatggtacatgcatgaaccgttggtttgagaaattgcaactaattgttactagagatggtaaggctggtatcaactttgagcataccggtgtagatggacacactgttttaagatttgcaactgacatctataccgattctatactgagctttgcaaggggtgtgaccaaaaatgttcctgatatctttgcagaaaaggaaatggaagctagtttgatgaagaaacaatccagggctaacttgattactattcccagaaaacttgaatggagaccagattccttcctgttatcatctttgcattttgcagaaacaaggatctctgacttgatatctcaatatgaatttgtctcattagattttgaaacttatggtgcagcccacatcaaggcaatgttcaaatgttctccagacgcttttacacagcaagtcttccaaatagcctactatgctctttatggtaaatttgaagccgtgtatgagccagctatgacgaaaactttccaaaatggtagaacagaagccatcagatcagttaccaatcaatctaagaaatttgtcaagtcaatgtttgacagtaaggcaacgaacgctcagagaattgactacttgcaaaaggctgccaaggagcactctcggattacgaaagagtgctctatgggtttgggccaggatcgtcatctttatgctctgtactgtgtctggaacgagtggtatagagattccttgccaatgccacccttatttcaggatcattcatggagtgtcataaataacaatgtcttgagtacttccaattgtggtaacccatgtctgaaaaactttgggtttgggccagtcaccgccaatgggtttggtattgggtatgtaatccgtgaagattctatctctattgtcgtgtcttcaagacacagacaaactgaaagatttgtgtcacttttggagaaatcgttcttggaaatagatagaatattcagaagagaacatgagagacaagaggcattagcaaaagtaccaagttacacaccacaggacgacaaggataaaaaagaagaaagagaaaactacctcagggagctcagaaagagagcgggttctatgtcccagaatactaaatcagacgacttacaattcttactttccggttacgactactttgacatcagtgtttctggttga

SEQ ID NO: 3904 - protein, 746 aa, Candida glabrata CBS 138
MSELTAVKSRSDPALEATKESKLLKRLPIPPLEDTLKRYLDRVQPLQDEKQFKRTKRTVMSAENLDVMRTLQEKLLQYDQELANETPESSYIEQFWYDSYLLYDQSVVLNVNPYFQLEDDPTILKDVQRDSQYSGPYGKYTLQIKRCAKLVTSILKFIKQVRHGTLAEDKIRTTPLSMDQYKKLFGSSRIPPGPGEESCHLQTDPTSHHIMVMYKSQFYWFDVLDINNFPIFQAPEELEWNLYSIIMDTERHIGDHLQSRDEFIRYLVPMGVFTTESRRVWSNIRDYIYHDSDSTNWKNLKLIDSALFVICLDDLQFDSKDPKTSSQLVQSMLCGTSNINLGEDENSKVPLNIQHGTCMNRWFEKLQLIVTRDGKAGINFEHTGVDGHTVLRFATDIYTDSILSFARGVTKNVPDIFAEKEMEASLMKKQSRANLITIPRKLEWRPDSFLLSSLHFAETRISDLISQYEFVSLDFETYGAAHIKAMFKCSPDAFTQQVFQIAYYALYGKFEAVYEPAMTKTFQNGRTEAIRSVTNQSKKFVKSMFDSKATNAQRIDYLQKAAKEHSRITKECSMGLGQDRHLYALYCVWNEWYRDSLPMPPLFQDHSWSVINNNVLSTSNCGNPCLKNFGFGPVTANGFGIGYVIREDSISIVVSSRHRQTERFVSLLEKSFLEIDRIFRREHERQEALAKVPSYTPQDDKDKKEERENYLRELRKRAGSMSQNTKSDDLQFLLSGYDYFDISVSG

SEQ ID NO: 3905 - DNA, 1989 bp, Candida glabrata CBS 138
  CDS (1)..(1989)
atgactgtaggcaccgaggaagagtacaagaacttccagacattggaaaggcttcctatacctcctctagaggccaccctcaagagatacattgacagaactgaaccactgctgggtagtgaagaagcacagaagactaaaaaagtagtctactcagagagtaacctcgaggtattgagctatttgcaggataaattgttagagtacgaaaactggctcgctacttttgaaccccagtcctcatacattgaacaattctggtacaatgcctatttgatgtatgactctccagtggttcttaacgttaacccattctttgagcttgaagatgaccctacacttgattattcgatgcgcacaggtgtattccaggaatacacattgcaaattaaaagggcatcccgagtggtaacatctgcattgcgttttgcgagtcagatcaggaataatacattaaagccagatattttgcggaatgatgtaccgctgtctatggaccagtaccaaaagttgtttggctcgagccggatcccgccaaaacctaagcagcagtcgtgccatttacagaccgactctacgtctcaccacatagttatcatgtacaaaggtagtttctactggtttgatgtcctggattgtcagaatgagctcatatttcaaagcgccgaagagatagagtggaatttgtactccataattatggatagagagaggctaaacaaggaaaaccacaaaggattcttggaaatgggtattctgactacagagagcagaagaacttgggccaacatccgtgaacacatacacaagcaggactctcggcaaaattggcagaatttgaagattatagacagcgctctatttgtcctatgtcttgatgactacgagtcacacctggatgatccaaactctttgttaaaattgtttctaacaggcacatctgagatagatttcaatagtcctttcgagattgatgagtacgtgcatgcaccaaaaaaccttcagcgaggaacatgcatcaacagatggtttgacaagttacagatcatagtcaccaaatgcggtaaagcaggtgtgaactttgagcacactggtgtagatggccatacagtgctgcgactagcgaatgagatatacactgatgcaattacaagctttgcacagacagtcacttcaagaacgccgaggaccttgccacaagcagacagtaacctgataacagtgcctagaaagctggagtggctgaaagacgagtatctgtgcagggcggtgcactttgcagaagtgaaatgtacagacttgatctcccagtatgagatagagagtctcgagtttggaggctatggttcagcgcggatcaagagcgttttcaagtgctcaccagatgcatttgtacagcagatgttccaagtagcgttctatgcactttacggtacatttgaaaccatatatgagcccgcaatgacgaagacctttcttaatgggcggactgaggctatacgaccagtgactcatgactcgatcaaatttgtcaaatccgtgttcaaccacaggagcacggacactgagcgtatagatcttctgcacagagcatgccaggagcacacgcgcatcacgagggagtgctccatggggatgggccaggacagacacctctatgcgttgcaatgcatatggcagaaactacaagctgagacgccagacgaccccatcacacactcgacaccaccgatcttcgaagacaacgcatggcacaaaattaacaagaacatcctgagcacttcaaactgcggcagtcctgcactgaaatggtttgggttcggacctgtggacaaggacgggttcggcattggatacattatcaaggacagcaagatcagtgtcacagtgtcctcgagacacagacagacagcacggttcatcaccatgctggacagagcacttaacgagctggacaccatattcaacagggcaccaaagactatatag

SEQ ID NO: 3906 - protein, 662 aa, Candida glabrata CBS 138
MTVGTEEEYKNFQTLERLPIPPLEATLKRYIDRTEPLLGSEEAQKTKKVVYSESNLEVLSYLQDKLLEYENWLATFEPQSSYIEQFWYNAYLMYDSPVVLNVNPFFELEDDPTLDYSMRTGVFQEYTLQIKRASRVVTSALRFASQIRNNTLKPDILRNDVPLSMDQYQKLFGSSRIPPKPKQQSCHLQTDSTSHHIVIMYKGSFYWFDVLDCQNELIFQSAEEIEWNLYSIIMDRERLNKENHKGFLEMGILTTESRRTWANIREHIHKQDSRQNWQNLKIIDSALFVLCLDDYESHLDDPNSLLKLFLTGTSEIDFNSPFEIDEYVHAPKNLQRGTCINRWFDKLQIIVTKCGKAGVNFEHTGVDGHTVLRLANEIYTDAITSFAQTVTSRTPRTLPQADSNLITVPRKLEWLKDEYLCRAVHFAEVKCTDLISQYEIESLEFGGYGSARIKSVFKCSPDAFVQQMFQVAFYALYGTFETIYEPAMTKTFLNGRTEAIRPVTHDSIKFVKSVFNHRSTDTERIDLLHRACQEHTRITRECSMGMGQDRHLYALQCIWQKLQAETPDDPITHSTPPIFEDNAWHKINKNILSTSNCGSPALKWFGFGPVDKDGFGIGYIIKDSKISVTVSSRHRQTARFITMLDRALNELDTIFNRAPKTI

SEQ ID NO: 3907 - DNA, 2079 bp, Kluyveromyces lactis NRRL Y-1140
  CDS (1)..(2079)
atgccatctattaaagatacgaaccaggaagttttgcccaggttgccaatccctcctttggaagatacgttaaagcggtacttggctagattagagcctttgcaagattctagaagctatgaaaagacgaagcgagctgtggcagagtcagagcaaagcttgaggattatagatcatgaattgagaaagtatgacgaacatcttgctcaacgtgaacctatgtcttcgtatatcgaacagttctggtttgattcgtaccttgaatacgacgaatcagttgttttgaatttgaacccttatttccagttagctgatgatccaaccatgaacaatgtgccaaaagtcagttccagattctctcacttcaacaggcaagtcaagagaacatccaaattagtggtatcgatgttgaaattcgttaaagcgatcagaactggtaccttgcctactgacaacgtaaggggcaaatcaatgaccatggatcaatatggtaagttgttcggaagttctagattgccaccttctttgaacgattctactttatcgtcgtgtcatttacagactgatcccacctcacaccatgttgtcatcatgtacaagtcccaattctactggtttgacgtcttggatatcaataacgaacctatctttcaacaaccggaggaattggaatggaatttgtattcaatcataatggattctgagcagaacagtttggatcaaaatcttcaaaatagctgccccatgggtgttttcacaaccgaaaacagacgtgtgtggtcaaacgttagagattacatcagcaagtcagaagatcagactaactggcgtaacttgaagattatcgatagtgctttattcattatatgccttgatgattctgatttggaaggtgaacgtgactggatcaaatccatgatttgtggtacttctaaaattgatttgaatgataaagatgaagataagacgaaaccctctctcggtttacaaacagggacttgtaccaaccgctggtacgataaattgcagttgattgttgacagaggcggaagagcaggtatcaacttcgaacacactggtgttgatggtcatacagtattgcgaatgaccatggacatctataccgattctatcgtcaattttgctcagggtattaccagaaacgttccaaaagttttcgaagatgacgacgacgaccgcagagctaataggtcaactaaacaagctaatctaatcactattcctaggaaattagagtggtccgttgattcgttcatcctttcatctatgcactttgctgaaactcgtgccagtgatttgatatctcagattgagttcgaatatttggacttcaaacagttcggcgccgcccatatcaaaaaccagttcaaatgctcaccagatgcgttcttgcaaatgtgttttcaaacagcttactatgctctatacggtaaatttgagacaacgtacgaaccagctatgaccaagttcttccaaaatggacgtactgaagccatcagaaccgtttctgatcaatcaaaatcgtttgtcaaatcattcttcaacacagcggtatcaaatcctgacaagataaagttactacaagaagcatgcaaacagcattcaaatgtgacaagagaatgttccatggggctgggtcaagaccgtcatttgtatgctctatactgcatttggaaaaaagtatttgcaaaagatcctaaggtcccattaccacaattattccaagacgctggctggtccaccttgaataccaacgtgattagtacttcaaactgtggtaacccttgtttgaaaaactttgggttcggtcccgtttgtagcaacggtttcggtatcggttacattattagaaatgataccctatctgtggttgtctcttcaagacacaggcaaacggctcgtttcgttgaattgatgcaaagattcttgctcgaaatcaacagaattgtccgcaacgaagaacaatcttccaaaacttcaatgggttccttgcaatcggataacatgaaatatttattaagtggatatgattactttgacgttagtgtaactggatag

SEQ ID NO: 3908 - protein, 692 aa, Kluyveromyces lactis NRRL Y-1140
MPSIKDTNQEVLPRLPIPPLEDTLKRYLARLEPLQDSRSYEKTKRAVAESEQSLRIIDHELRKYDEHLAQREPMSSYIEQFWFDSYLEYDESVVLNLNPYFQLADDPTMNNVPKVSSRFSHFNRQVKRTSKLVVSMLKFVKAIRTGTLPTDNVRGKSMTMDQYGKLFGSSRLPPSLNDSTLSSCHLQTDPTSHHVVIMYKSQFYWFDVLDINNEPIFQQPEELEWNLYSIIMDSEQNSLDQNLQNSCPMGVFTTENRRVWSNVRDYISKSEDQTNWRNLKIIDSALFIICLDDSDLEGERDWIKSMICGTSKIDLNDKDEDKTKPSLGLQTGTCTNRWYDKLQLIVDRGGRAGINFEHTGVDGHTVLRMTMDIYTDSIVNFAQGITRNVPKVFEDDDDDRRANRSTKQANLITIPRKLEWSVDSFILSSMHFAETRASDLISQIEFEYLDFKQFGAAHIKNQFKCSPDAFLQMCFQTAYYALYGKFETTYEPAMTKFFQNGRTEAIRTVSDQSKSFVKSFFNTAVSNPDKIKLLQEACKQHSNVTRECSMGLGQDRHLYALYCIWKKVFAKDPKVPLPQLFQDAGWSTLNTNVISTSNCGNPCLKNFGFGPVCSNGFGIGYIIRNDTLSVVVSSRHRQTARFVELMQRFLLEINRIVRNEEQSSKTSMGSLQSDNMKYLLSGYDYFDVSVTG

SEQ ID NO: 3909 - DNA, 2259 bp, Debaryomyces hansenii CBS767
  CDS (1)..(2259)
atgacgtaccagtaccaagatcaacttcaaaagttaccaataccagatttacaagaaacatgcaagaactacttgaatgttttagaaccattacaaacggaaagggagcatgagagaaccaaggaggcggtgagactgtttttgttaggaggaaacggagaatacttggataaagagcttcggaaatacagtgagggacgcagttcttatattgagcagttctggtacgattcatacttgaactatgattcgccagtggtgttgaatttaaatccattctttcttttggaagatgacccgttccataacgagtctatgagtgtcaacccacaggtcaagagagctgcatcgttgacattatcgtcgttgaagttcatccgggccttaaaaaacgaaactttgctggtggacaagacaagaaccggccaacctctttgcatgtaccagtattctaagttatttggggcgtcgagaattcccaccgacgacggttgtgtcatgcaaacagacgtcaattcgaaccatatagttgtcatgagcaagtcccaattctattggtttgacgtgttggacaagaacaacaatttgatcttgtcggagccggaattgattgtcaatttcacgtccataattcaggactcattaaatacatcgatcagcgagattgctaaatcttcatttggggtattgactaccgaaaatagaagagtttgggcaaaaataagaaacagtggtactatcaccgataacgctaataataacgaaattttgagcattattgattctgcattatttattttatgtcttgatgacttaagattagaaaacttgtcagatttggctaagaacatgttgtgtggattgtcaatattagacaagggtgtccaggttggtacctgtaccaacagatggtacgacaaattgcaaataatcgtcacccaaaacggtaaggcgggtattaacttcgagcatacaggtgttgatggtcacacagttttacggtttgtaagtgacatctatacagactccattttatcgtttgcacagtccatcaatggccatgccccttcattgtggagtgatgattcgtcgtcaaagcctgactatgaccaagagttggttacaatccccagaaaattggaatgggaattaactccagatttatcgttggcattaagattcggggaaactaggttatcggatttgattaatcaaaatgaattcaaacatttggaattcaagaattacggttcctcaactattaaaaaaatgaaatacagtcctgatgcttttgttcaaatggcatttcaagttacttattatgctttatatggtaaggttgaatgcacttatgagccagccatgacaaagaattttttccacggtagaactgaagcagttcgaactgtatctcaagaatcaaacttgtttgttcgtaagttttttgatctgactgtatcaaataaagacaaacttgcatacttaacgagtgcatgcacaaagcactctcaacagaccaaacaaagttctatgggtaaaggaattgacagacacttatatgcgcttttctgcatctggaaaagatacgtcgattctagtgactacaaagcgatagacttagagcatgacaatgctgttactcttgataatcaaagatcttccattctgacgcttgtggacgatgacaatgaaacacattcttcggacactacaattggtaataattataataactgtaagaacgatttaaccgaattgccatctatatttgctgattcgggttgggataagttgaataatacagtcttatctacttcgaactgtggtaacccagcattgaggttatttggtttcggcccagtatcggctaacggattcggtttggcatatattattaaagacgattctatttcgatatgtgctgcatcaaaacatagacaaactgaaagatttttggtcacattagagctgtacttgaacgagatttacagcatttttcaagagtctagtaaggaacaaattgaatcaccaatcgataccaagattaaaacgaccacacaattactggcccctagaccatctttggttcaaaagaagtcaacagtatctaatttattaggtggatatggttacttcgatatgggtgataatgacatgaaatcgagaggtcctagtcctgaacctcctttccttaacagaaataacagtggtttctcggttagagaaattggcaagaaattgagattatctgaatactag

SEQ ID NO: 3910 - protein, 752 aa, Debaryomyces hansenii CBS767
MTYQYQDQLQKLPIPDLQETCKNYLNVLEPLQTEREHERTKEAVRLFLLGGNGEYLDKELRKYSEGRSSYIEQFWYDSYLNYDSPVVLNLNPFFLLEDDPFHNESMSVNPQVKRAASLTLSSLKFIRALKNETLLVDKTRTGQPLCMYQYSKLFGASRIPTDDGCVMQTDVNSNHIVVMSKSQFYWFDVLDKNNNLILSEPELIVNFTSIIQDSLNTSISEIAKSSFGVLTTENRRVWAKIRNSGTITDNANNNEILSIIDSALFILCLDDLRLENLSDLAKNMLCGLSILDKGVQVGTCTNRWYDKLQIIVTQNGKAGINFEHTGVDGHTVLRFVSDIYTDSILSFAQSINGHAPSLWSDDSSSKPDYDQELVTIPRKLEWELTPDLSLALRFGETRLSDLINQNEFKHLEFKNYGSSTIKKMKYSPDAFVQMAFQVTYYALYGKVECTYEPAMTKNFFHGRTEAVRTVSQESNLFVRKFFDLTVSNKDKLAYLTSACTKHSQQTKQSSMGKGIDRHLYALFCIWKRYVDSSDYKAIDLEHDNAVTLDNQRSSILTLVDDDNETHSSDTTIGNNYNNCKNDLTELPSIFADSGWDKLNNTVLSTSNCGNPALRLFGFGPVSANGFGLAYIIKDDSISICAASKHRQTERFLVTLELYLNEIYSIFQESSKEQIESPIDTKIKTTTQLLAPRPSLVQKKSTVSNLLGGYGYFDMGDNDMKSRGPSPEPPFLNRNNSGFSVREIGKKLRLSEY

SEQ ID NO: 3911 - DNA, 2601 bp, Debaryomyces hansenii CBS767
  CDS (1)..(2601)
atgacatacacatatgaatatgaagagggtcttcctcgattaccagttcctctgttaacgaacacgtcaacccaattattgaatacattgaaaccattattgagcgtagatgaatataacgaattactccaggaatcgagtgagtttctcagtcatgaagttattaatttgattcaacgtcatttggtggcagcttctttaaatcctaataacacatgctacttaaattgtgtgaataatggaaccagcccggggatttatggcgaaataagaggagatattcttcctcgaaacccgtacttaattttagaagaagatccgtatgcgaagactgttaatccacctaaccaaagtcaaagagcagccaatttggttaattcgtctttgaaatttgtaacaagtcttcgtaatgatacattacaaccagataggacacctaaaaatggtaatcccttatcgatgaactgttataatatattatttggcacaacaagagtgcccctcacagaagacgaaaattcgtaccaaagtgcaactatacaaaagtttaatgatatcaatgattcgagacacattgttatcatttgtaacaaccagtattattgcttggaagtgttgacagagtatagcgaagaggaatacaaggaatctaagaccaagcataaaatttggttcagtgattatgaattatcaataatttttcaagggataatcaacaattctaatactattgatagagttgagtctataaacaattctattggatctttgactacgcaatcattttcaatttggaaaataagcagaagtgaattgaataagtctaacaaaaaaaacttagaattgattgataatgccttattcatagttgtattggatcctaatttgccagattccgatcaagaaaagacatcggtgatagcacatggaacctctgagttgttgaaaggaactaatatgcaagtcggttcatgtacgtctaggtggtatgataagttacagttagtcgttactaagaattcagttgcaggtgtagtctgggaatcatcatcaacagatggcacagcgattttaagattcattagtgacatctatgctgattctattttgaaattagccaaaaacatcaatggagctgagtatacattgtttgatgataatgttgggtttgtatcagcagatggatcgatcaagaagccagagtctgaaagattgataattaccagaaccccagaacttttgaatttgataaggctatcagaaacaagattagccgacttaatacaccaacatgaatacaagaccttgactcttaaattgaacacctatttggtcaataaattcgaactcagtatagactcagttttgcaagttgcatttcagattgcaaattatactttatatgggagtatggcaaatacgttagaacccattaccactagaaagttcagagactcgaggactgaattaattccagttcaaaacgatcatatttctaggttggttaaattatttattacaaactcaaattcttcattgaaatgggacttgttcagagaatgttgtagcgttcatactaagcaatatcgtaatgctatgaatggtaaaggttttgagagacattttaatgcaatcatctctgttttagggagacctcatgcagtcgagactttgaacaaattgaatgctgatgtgcctgatttggaaccgattccagatataaagaaaataaaaaacctacatattccattactctcaaatcccacgattgaaaagctttcctctcctgaattattgatttctaattgtggtaatccagcattacacatgtttggtattccacctgcagcggaccaaggttttgggattggttacgttatccatggtgataaaatcatcattactgttagttcaaagttcagacaaacagagaggtttttgcgtacttttaaaggagtcatgaaggaattcttatcgattattaagcaaaaatcgaatttcttgattaatataaatgattcagaatctagaaaactggagttacaaagacttagaattgagcatgagcttaagaatattaacaaatccctccctctgacaaaacatcctatcgaattgactgttgaaaaaacacgcattccaatagaaaatgttagcattgaaggaaatggggatagtgtgcaatcccgctctagtagatctaactctttatcggacgattataaagaagattacgatattttagggggatatgggtacttcaattttggtgacttagatatgagatcggatgaattatcaagagaagagtcgttcttaaacagtactccacctagcttatcgagcttgaattcgaaacaacattcttcgacaaatcttcataaagcagcaatgactaataacaatagtcctagtgatatcaagcaaaagtttaatttgtctgctgagatcagagacagattgctgttacaagatgattattcgtcgacatcctctgttgcaggaagcatggaggatgcatcatcagaaggttcaaatgaaaattctagtaagccaaagaaattaataggcagagagttggatatttcagatgttcattag

SEQ ID NO: 3912 - protein, 866 aa, Debaryomyces hansenii CBS767
MTYTYEYEEGLPRLPVPLLTNTSTQLLNTLKPLLSVDEYNELLQESSEFLSHEVINLIQRHLVAASLNPNNTCYLNCVNNGTSPGIYGEIRGDILPRNPYLILEEDPYAKTVNPPNQSQRAANLVNSSLKFVTSLRNDTLQPDRTPKNGNPLSMNCYNILFGTTRVPLTEDENSYQSATIQKFNDINDSRHIVIICNNQYYCLEVLTEYSEEEYKESKTKHKIWFSDYELSIIFQGIINNSNTIDRVESINNSIGSLTTQSFSIWKISRSELNKSNKKNLELIDNALFIVVLDPNLPDSDQEKTSVIAHGTSELLKGTNMQVGSCTSRWYDKLQLVVTKNSVAGVVWESSSTDGTAILRFISDIYADSILKLAKNINGAEYTLFDDNVGFVSADGSIKKPESERLIITRTPELLNLIRLSETRLADLIHQHEYKTLTLKLNTYLVNKFELSIDSVLQVAFQIANYTLYGSMANTLEPITTRKFRDSRTELIPVQNDHISRLVKLFITNSNSSLKWDLFRECCSVHTKQYRNAMNGKGFERHFNAIISVLGRPHAVETLNKLNADVPDLEPIPDIKKIKNLHIPLLSNPTIEKLSSPELLISNCGNPALHMFGIPPAADQGFGIGYVIHGDKIIITVSSKFRQTERFLRTFKGVMKEFLSIIKQKSNFLININDSESRKLELQRLRIEHELKNINKSLPLTKHPIELTVEKTRIPIENVSIEGNGDSVQSRSSRSNSLSDDYKEDYDILGGYGYFNFGDLDMRSDELSREESFLNSTPPSLSSLNSKQHSSTNLHKAAMTNNNSPSDIKQKFNLSAEIRDRLLLQDDYSSTSSVAGSMEDASSEGSNENSSKPKKLIGRELDISDVH

SEQ ID NO: 3913 - DNA, 2244 bp, Yarrowia lipolytica CLIB122
  CDS (1)..(2244)
atgagcgacagcacctttgctcaccaggagtcgctgcccaagctgcccattcccgacctcaaagacacatgtgacaattatctggaggcactgcgaccgctgcaaacggcccacgagcatgaacgaacagaaagagctgtccacgagtttctcaacaccagcggacccattctccaggaggagctcaagcagtacggaaagccccgatcgtcatacattgagcagttttggtacgattcgtatctcaactatgactcccccctcgttctcaacctcaaccccttcttcctcattgaagatgaccccaccccggttcaacagagccaggtcgatcgagcagctacattaaccacatcttctctgcggttcatccgagccctccgacgagaggagctgcccccagataacgtccgaggcacaaagctctgcatgtaccagtactcgcgactgtttgccagtgcccgaatcccctctgcaaatggctgtgtcatgcagtctgactccacctccaagcatattgttgtgctctgccgatcgcagttctactggtttgacgtgttggacgacaacaacgacctcatcatggtggaaaaggatatcgcgctcaactttgagactatcatccaggacgcagagggtactcctatcactgagattgcaaagggagccgtcggagtgctcaccacagaaaaccgacgtgtctgggcttctatcagagaccagatgaaccgtgccaccgactcttccaactacgagtgtctcaaactcattgactctgctctgtttgtcgtctgtttggatcacgcagcccccgagtctctttcagatctcacccgaaacgccctttgtggtctttcagagctccagaagggtgtccaggtcggaacatgcacgaacagatggtacgataagctgcaaattatcgtcactcagaatgcaaaggccggggtgactttcgagcatactggtgtcgatggtcacaccgtgctgcggtttgtgtccgacatttacaccgactccattctgcggtttgctaacaccatttctggagctgctccttctctttggaagacagtttctcctgacccagcgaagcgagatccagcttcgttcggtaacgtgtctaccactcctcgaaagctcgagtggtccattggccccgagctccaaactgctctacgttttgccgagacccggaactccgatctcatccaccagaacgagtttgagtgtctttctttcaaccactacggaaagaaagccatctgtgagatgggctgttctcctgacgcctttgttcagatggtcttccaggctgcctactacgttctttacggacgtgtggaatgcacttacgagcccgctatgaccaaaacctttttgcatggccgaaccgagtccattcggtcagtaacaaaggagtcgtctgagttctgccgaaagttctgcgaggaccttcctgctgaaaccaagctggagtacctacgaaaggcttgccagcagcacaccaagaatactaagaagtcctctcaaggtcttggacaggatcgtcatctttacgctcttctgtgcatctggagacgatatcttgaggagtctgatgacaacgactcaaccacctctcagacctccattggttctcagactgcagttgatattggagacgagatgactcccatcactggtctaggagacgtgcatcttcccaaggctggtggatccattcccagcatcttctctgatcccggatgggacaagctgaacaacaccattctgtcgacttccaactgtggtaaccctgctctcaagctgttcggattcggtcccacttctcccgatggatacggtcttggttacatcatcaaggatgactccatcaccatctgtgcatcttctaagcatcgacagactgctcgtttcctcgagactctgtccactgtcatgatggagatccgtctcctgtttcgagaggtcgccaaggccaaggcccagcgacctgctggtgcttctcgagctcggtcttgtgaacgagttcctcaggtacataccaccaagcaagttcactttggccgaactcttccccggtccaggaagccctccgagacagagatctacgacgaggagatgtcttatcttcttggaggttacggatactttgacatggcggactttgagaacgcggctgataccgagcggctgggacgcaaggagattggtagaaagctcagactggctgagtattaa

SEQ ID NO: 3914 - protein, 747 aa, Yarrowia lipolytica CLIB122
MSDSTFAHQESLPKLPIPDLKDTCDNYLEALRPLQTAHEHERTERAVHEFLNTSGPILQEELKQYGKPRSSYIEQFWYDSYLNYDSPLVLNLNPFFLIEDDPTPVQQSQVDRAATLTTSSLRFIRALRREELPPDNVRGTKLCMYQYSRLFASARIPSANGCVMQSDSTSKHIVVLCRSQFYWFDVLDDNNDLIMVEKDIALNFETIIQDAEGTPITEIAKGAVGVLTTENRRVWASIRDQMNRATDSSNYECLKLIDSALFVVCLDHAAPESLSDLTRNALCGLSELQKGVQVGTCTNRWYDKLQIIVTQNAKAGVTFEHTGVDGHTVLRFVSDIYTDSILRFANTISGAAPSLWKTVSPDPAKRDPASFGNVSTTPRKLEWSIGPELQTALRFAETRNSDLIHQNEFECLSFNHYGKKAICEMGCSPDAFVQMVFQAAYYVLYGRVECTYEPAMTKTFLHGRTESIRSVTKESSEFCRKFCEDLPAETKLEYLRKACQQHTKNTKKSSQGLGQDRHLYALLCIWRRYLEESDDNDSTTSQTSIGSQTAVDIGDEMTPITGLGDVHLPKAGGSIPSIFSDPGWDKLNNTILSTSNCGNPALKLFGFGPTSPDGYGLGYIIKDDSITICASSKHRQTARFLETLSTVMMEIRLLFREVAKAKAQRPAGASRARSCERVPQVHTTKQVHFGRTLPRSRKPSETEIYDEEMSYLLGGYGYFDMADFENAADTERLGRKEIGRKLRLAEY

SEQ ID NO: 3915 - DNA, 2415 bp, Aspergillus nidulans FGSC A4
  CDS (1)..(2415)
atggaagctccccgctcacatccggctcctgagccgaagataaagcctaccacagtggatggaggcttgacggatcaggttaagaccaagagtggtgggatcacattcgcacaccaagactctctgccgaagttacctatcccggatcttgagagcacatgcaagaaatatctcgacgctctgtcgccgctgcagactcctaaagagcaagaagagaccaaggctgctgtacgggagttcctcaaaggcgagggtcccggccttcaagagcggctgcagaaatatgccacatcgcaaacgagttatattgaacaattctggtacgactcctatctgaattacgacagtcctgtcgttctcaacctcaaccccttcttcttgctggaggacgatccaacacctgcgagaaacaaccagctgactagagcggcatcgctggttgtttcggccttatcatttgtgcgcgctgtcagacgggaggagttgcctcccgataccgttcgaggtacgccattgtgcatgtatcaatattcccggctatttggtactgcacgtgttcctactgagaatggctgcgttatcagccaagatcccaagtcaaagcatatcgttgttatgtgccgtggtcagttctactggtttgacgtcctcgacgagaatcatgaccaaatcatgacagaaaaggatatcgcaatgaaccttgaggttattctcgctgatgcagaacaaaccccaattcaagaggcggcgaagggcgcccttggagtcctcagtactgaaaaccgcaaggtgtggtcgggattgagggatatcctaaccaaagatgagcattcaattaacgctgagggcttaaacattgtggatactgccctatttgtcctctgcctggatgacaccgagcctcataacatgtccgagctttgcgcgaacatgctctgtggtacgaacgtggtggaaaagggcgttcaagtgggtacttgcacgaaccggtggtacgacaagctgcagatcatcgtgtgtaagaatgggagtgctggaatcaattttgagcacactggtgttgacggacatactgttcttcgcttcgcgagtgacgtctacacggacacgattcttcgctttgcacgaaccatcaacggccaggctcccagcttgtgggcaaccactagccctgacccgtccaaacgacaccctcgaagcttcggtgacgttagcccgacccccagaaaattagaatgggacatgttgcctgagcttagcattgctatccggtttgccgaatcgcatctcgcagatcttcttcagcagcatgaattccaagtgcttgatttcaagggattcggaaagaactttattacctcaatgggattctcaccggacgcattcgtccagatggcgttccaggcggcttactacgggctttacggacaagtggtaaatacctatgaaccagcaatgaccaaggctttcctgcatggacggaccgaagccattcgatctgtcaccaatgaagccctcgacttcgtgaagacattttgggctgaaaaccctgctgaggataaggtgaatgcccttcgaaaggctactgagaagcactcggcaatcacgaaggaatgctccaagggacaaggacaggaccgccacctctatgctctttacaccctgtggcagcgacaattcgacgaagcccctagctcccggaacaacagcgtcgatgaagcgtcgaacgggtacacgagtcctgctgagatcgactccatcgctgggtctcctctatccccgtcctctgtatctgaggtggatgggttgtcatccactggcagctatggccgggctatgcgtaatttgcctcccactcccgccatcttcagcgaccccggctgggacaagatcaacaacacaattctttccacttcaaactgtggcaacccctgcttgcggcatttcggcttcggcccaacatctgcagacggattcggcattggctacattatcaaggacgactcaatctcaatttgcgcctcatctaagcaccgccaaaccgcgcgtctcatgcagacacttgagttgtacctgcttgagatccgcaagttgctgcgcgcgactgtccacaagccgtccagcccgcggaccagccgcgctcgtgaaatggagatgattgccgagcgggtccagcgtgatcaacgccggggtcgtattgtccgcacagacgcgggccatctgcgggccggtaccgagacgcccacgacggacagcggggacatggacgatgatggcatgggcggatatggtttctttgatgcagggatgctcctgcatgcgctcaaggggctcaacgtggatcgcgagcggggtggcgacaagacccctcgacgacggttcgttggcaagaagctacggttgaatgaatattga

SEQ ID NO: 3916 - protein, 804 aa, Aspergillus nidulans FGSC A4
MEAPRSHPAPEPKIKPTTVDGGLTDQVKTKSGGITFAHQDSLPKLPIPDLESTCKKYLDALSPLQTPKEQEETKAAVREFLKGEGPGLQERLQKYATSQTSYIEQFWYDSYLNYDSPVVLNLNPFFLLEDDPTPARNNQLTRAASLVVSALSFVRAVRREELPPDTVRGTPLCMYQYSRLFGTARVPTENGCVISQDPKSKHIVVMCRGQFYWFDVLDENHDQIMTEKDIAMNLEVILADAEQTPIQEAAKGALGVLSTENRKVWSGLRDILTKDEHSINAEGLNIVDTALFVLCLDDTEPHNMSELCANMLCGTNVVEKGVQVGTCTNRWYDKLQIIVCKNGSAGINFEHTGVDGHTVLRFASDVYTDTILRFARTINGQAPSLWATTSPDPSKRHPRSFGDVSPTPRKLEWDMLPELSIAIRFAESHLADLLQQHEFQVLDFKGFGKNFITSMGFSPDAFVQMAFQAAYYGLYGQVVNTYEPAMTKAFLHGRTEAIRSVTNEALDFVKTFWAENPAEDKVNALRKATEKHSAITKECSKGQGQDRHLYALYTLWQRQFDEAPSSRNNSVDEASNGYTSPAEIDSIAGSPLSPSSVSEVDGLSSTGSYGRAMRNLPPTPAIFSDPGWDKINNTILSTSNCGNPCLRHFGFGPTSADGFGIGYIIKDDSISICASSKHRQTARLMQTLELYLLEIRKLLRATVHKPSSPRTSRAREMEMIAERVQRDQRRGRIVRTDAGHLRAGTETPTTDSGDMDDDGMGGYGFFDAGMLLHALKGLNVDRERGGDKTPRRRFVGKKLRLNEY

SEQ ID NO: 3917 - DNA, 1833 bp, Aspergillus nidulans FGSC A4
  CDS (1)..(1833)
atggctccgcggcgcaaggcttcgtctgtccccgagggatacaaagaagatctctccaagggaaacatgctccgatttgaagattcgctaccgcgtctaccagtcccatcattggaggagaccggtcgtcggtacctaaagtctgtgcacgcagtcgtgtctgaggccgagtacgagaacaccaagaaggccgtggaggagttcattcgccctggcggcgcaggtcagactttgcaggaacggctgcttgctcgcgctgcagaccccaagcacaagaactggctcactgagtggtggaacaatgccgcctacctgggttaccgggaccccgtgatcccctatgtctcctacttctactcataccgtgatgaccgcgcccgccgggacccggttaagcgtgctgctgctatcactactgcggcgcttgagttcaagagtcaagtcgacaacggctccattgagcctgagtacctccgcaagatccctcaggccatgagctcgtaccagtacatgttcaactgctgccgaattcctgccgagcctgccgactaccctcagaagtaccctgctgaggagaaccagcatattgtggtggtgcgcaagaaccagttcttcaaggtacctgtggtcattgatggtcgcccgctcaacgtgtcagagctggaacagcaattcgagcgcatctacaagatcgcgaagaaggcgccccctgttggtgttcttactgttgcaaaccgcgaccactggactgccgctcgcaagaagctcctggaagctcaccccaacaacgccaatgctctgcgggatattgagtctagtggcttcgttgtctgtctagacgatgcgagccccgtgaccctcgaggagcgtgcggagcaatactggcatggtgatggccacaaccgctggtttgacaagcccctccagtttatcgtcaacgagaacggtactgcaggctttatgggagagcacagcatgatggatggcagcccaacccaccgtctcaacgaccacctcaatgcccttatcttcaacaacaagattgatctctcagcgaagcctgtgcgatccaacctgcccgatccccggcccatcgacttccacctaaatgaagaagttcaggaagcgattgacgttgcggccaaggaacaccgccagcagattgccgcccacgaactgcgcgtccaagcttaccagggctacggcaagggcctgatcaagaagttcaagtgcagtcccgacgcgtacgtgcagatgatcatccaacttgcctacttcaagatgtatggcaagaaccgcccaacctacgagtctgcctccacccgcaagtttgccgagggtcgcacagagaccatccgcactgtctctgacgagagcgttgccttctgcaaggcaatcaccaactcctctgttccccgtgaggaagctgtccgtcttttcaggactgctctcgccgctcactccaagtacactgccgaagccagcgacggcaagggtgttgaccgccacctcttcggtctcaagaagcttgttcgtgagggcgagcccctgcctgctatcttctccgacccagcctattcctacagcagctcctggtacctgtctacctcccagcttagctctgagtacttcaacggctatggatggagtcaggttatcgatgatgggtttggaattgcgtacatgatcaacgaaaacagccttaacttcaacatcgtctgcaagcgcatcggcgccgagcgcatgagctactatctcaacgaggcggcaggcgatatccgtgacatgctgatgccggatcttgccgccgaggccgagaaagccaagctgtag

SEQ ID NO: 3918 - protein, 610 aa, Aspergillus nidulans FGSC A4
MAPRRKASSVPEGYKEDLSKGNMLRFEDSLPRLPVPSLEETGRRYLKSVHAVVSEAEYENTKKAVEEFIRPGGAGQTLQERLLARAADPKHKNWLTEWWNNAAYLGYRDPVIPYVSYFYSYRDDRARRDPVKRAAAITTAALEFKSQVDNGSIEPEYLRKIPQAMSSYQYMFNCCRIPAEPADYPQKYPAEENQHIVVVRKNQFFKVPVVIDGRPLNVSELEQQFERIYKIAKKAPPVGVLTVANRDHWTAARKKLLEAHPNNANALRDIESSGFVVCLDDASPVTLEERAEQYWHGDGHNRWFDKPLQFIVNENGTAGFMGEHSMMDGSPTHRLNDHLNALIFNNKIDLSAKPVRSNLPDPRPIDFHLNEEVQEAIDVAAKEHRQQIAAHELRVQAYQGYGKGLIKKFKCSPDAYVQMIIQLAYFKMYGKNRPTYESASTRKFAEGRTETIRTVSDESVAFCKAITNSSVPREEAVRLFRTALAAHSKYTAEASDGKGVDRHLFGLKKLVREGEPLPAIFSDPAYSYSSSWYLSTSQLSSEYFNGYGWSQVIDDGFGIAYMINENSLNFNIVCKRIGAERMSYYLNEAAGDIRDMLMPDLAAEAEKAKL

SEQ ID NO: 3919 - DNA, 2679 bp, Candida albicans SC5314
  CDS (1)..(2679): transl_table=12
atgacacaggaacaattttacacttttgaaaacgaagctagcttacccaaattgccagtacccctgttagtttctacaacacaacaattgttggcttcattaaaacctttattaccacagaatgaatatgccactgttgttgatgaggcaacagagtttgttggaaatgatattattaatttaattcaaaaacatcttgttgccatttctgaaaatgaaaactacaccaactacttaaattttgttaatgacgataaaaccccatcaatatatggagagattagaggtgatatattacctagaaacccttaccttgtattggaagaagacccctattcgaaaacaatcaatcctccaaatcaagcccaacgtgcagcaaatttggtcaattcaagtttgaagtttgcgattacgttgagaaacgagactttgaaacctgatgtgaccccgaagaatggaaacgcattaactatgaaatgctatatggatttgttcggtactacaagagaacctgagcaagacgatcgtggctttgatattagaattaaaaaataccaacacattaacgattcgagacacattttaatcatttcaaataatcagttttatacacttgaggtgctcactgaatttgatgaaaatgagtaccaacaaaccaattcaaaacataatatctggttcaacgattcagaactttcaaaaattttgcaacacataattgacgagtcaaacaaagttgatgcagtaaacgcaattagaaactccgttgggtcaatcactacccagactttgaagtattggaagtttgctcgattagagttggaacaatcaaataccgaaaatttgaaactaattgatgatgccttgtttgtattgattttggactccaatactccggtcactgacggtgaaaagactcaggtcatatcccatggtacgtcggttttatccctggacaatgtgcaaattggtacttgtacatcacgttggtatgataagttgcaaattgtcgtgactaaaaactctgttgctgggattgtttgggaatcaatgaccatggatagcacagcaattttacgatttatcagtgacatttatacagactcagtgttgaaaatggccaagaacatcaatggttctgaatataccttatttgatcctaacattacttttgcctcaattggtaaagatggtaatggtgtggtgaaacctgaaccaaaactacttgaatttaacaagaccaaggcattacaacatgtcattcatctttccgaaaccaggttggccgacttgctcgatcaacacgagtatatgactcataccatcaaacttgattcatatttgacaaccaaattcaatctttcggttgattccattatgcaagtctgttttcagattgcctattactctttgtatggtcgaattgttaatacattggaaccaatcactacaagaaagtttcgtgacgcaagaactgaattagtggccgttcaaaatcaatcacttgccaatttggttaaactttacatcaccaatgctagtccactggagaaatttgaggcattcaagaaatgttgtgctttgcataaaacacagtatcatgatgccatgctgggtaaagggttcgaaagacacttgatgacaattgtccaagtggttaagaaaccaaaagtaatagctcgtttaaatcaagttaatactcatttaccaccaatcccagaagatttatgtcaagctggaatcaatttgccattattgttaaatccatcaattgataaattactgagtcctgaattgttggtttcaaattgtggcaatccggcattacgattatttggaataacccctgctattgatcaaggatttggtattgggtatattatccaccgtgataaagttttaattactgtctgctccaaacatagacagacagcaagatatttggatactttccatcgagtggttcatgatataaaaatccgcttacgtgccagtagcaactttttattatcaatcagtgattccgaacgaagaaaaaatgaacttcaaagattaagaattgaacatgaattgagtaatgtttctttggatatccccacaatgaaacacccaattccgttgacaattggtaaaagtgaaatttcgattgataatattgctcttaaaacagcccgtactggccgtgccacgagatcagaagagaagagtttaggaaacaatgccactgatgacagtaatgttggtgttggtggtgacgaagacgaggacgaggacgattccaaatttgagttgatgggaggttatggatattttgattttggtgaattggaattgagatcagatgaagtttcgagaaatgaatcctatttgaacagtcaagttcaatcgaatctttccagtgccatgtcttcaagacgtcactcctttaccaatttgcagaagattgctagtaggtcacatgatagccacttaccgcaacagttacaacaacaacaacaacaacaaaaatatgatatcaaagagaaacaatcgctttcagaaagaattagagataaattgtcacacagtcaagatactttatcttcagtacagtctgttttggaagaagatgttcagaaaaatgaacctacgaagaagagttcaattggtaggtcattagacatgtcaaaactttcatga

SEQ ID NO: 3920 - protein, 892 aa, Candida albicans SC5314
MTQEQFYTFENEASLPKLPVPSLVSTTQQLLASLKPLLPQNEYATVVDEATEFVGNDIINLIQKHLVAISENENYTNYLNFVNDDKTPSIYGEIRGDILPRNPYLVLEEDPYSKTINPPNQAQRAANLVNSSLKFAITLRNETLKPDVTPKNGNALTMKCYMDLFGTTREPEQDDRGFDIRIKKYQHINDSRHILIISNNQFYTLEVLTEFDENEYQQTNSKHNIWFNDSELSKILQHIIDESNKVDAVNAIRNSVGSITTQTLKYWKFARLELEQSNTENLKLIDDALFVLILDSNTPVTDGEKTQVISHGTSVLSSDNVQIGTCTSRWYDKLQIVVTKNSVAGIVWESMTMDSTAILRFISDIYTDSVLKMAKNINGSEYTLFDPNITFASIGKDGNGVVKPEPKLLEFNKTKALQHVIHLSETRLADLLDQHEYMTHTIKLDSYLTTKFNLSVDSIMQVCFQIAYYSLYGRIVNTLEPITTRKFRDARTELVAVQNQSLANLVKLYITNASPSEKFEAFKKCCALHKTQYHDAMSGKGFERHLMTIVQVVKKPKVIARLNQVNTHLPPIPEDLCQAGINLPLLLNPSIDKLSSPELLVSNCGNPALRLFGITPAIDQGFGIGYIIHRDKVLITVCSKHRQTARYLDTFHRVVHDIKIRLRASSNFLLSISDSERRKNELQRLRIEHELSNVSLDIPTMKHPIPLTIGKSEISIDNIALKTARTGRATRSEEKSLGNNATDDSNVGVGGDEDEDEDDSKFELMGGYGYFDFGELELRSDEVSRNESYLNSQVQSNLSSAMSSRRHSFTNLQKIASRSHDSHLPQQLQQQQQQQKYDIKEKQSLSERIRDKLSHSQDTLSSVQSVLEEDVQKNEPTKKSSIGRSLDMSKLS

SEQ ID NO: 3921 - DNA, 2388 bp, Candida albicans SC5314
  CDS (1)..(2388): transl_table=12
atgtcaacttatagatttcaagaaacattggaaaaacttcctattcctgatttagttcaaacttgtaatgcatatctcgaggcattaaaacctttgcaaactgaacaagaacatgaaaataccaaaattgccgtggacaaatttctcaatggtagcaattccaaaaccactaataatggagtggttacaggaagtggtattggtcattatttagatcgagaattgcgtcaatatgctaaaactagacctagttatatcgaacaattttggtatgattcatatttgaattatgattcccccgttgtattaaatttaaatccattttttcttttagaagatgatccatttactaatgaatcaagtagtattaatcctcaagttaaacgtgccaccaatttaactttatcatcattaaaattcattcaagcattgaaaaatgaaactttaagcgttgatacattgaaaaatgggaaaccgttatgtatgtatcaatatactaaattatttggtgcttcaagaattccatctcaagaaggatgtatgatgcaatctgatccattatcgaatcatattgttgttatgtcaaagtcgcaattttattggtttgatgtattggattctcataataatttgatattaaatgaagcagaattgaatattaattttaattcaatcattcgtgattctttaaatactccttcagatgaaattgctaaatcgtcgtttggggtattgactacggaaaatagacgtgtttgggctaatgtcagaaacaatttgattggtaataataccattaatcgtgaggtgttatcgattattgattcagcattatttattttatgttttgatgatattgccattgatgatttatcagaattgtcgaaaaatatgctttgtggattatctatattagataatggtatccaagttggtacttgtactaatcgttggtatgataaattacaaattattgttaccaagaatgctaaagcagggattaattttgaacatactggtgttgatggtcatactgttttacgatttgtaagtgatatttatactgattcaattttatcctttgctaattccattaacaacaatgctccttcattatggaaatccactaccaaaaatgatgttcccgattatgaattggaagaagaattaattactattccacgtaaattggaatgggatttaacacctgatttatcattggttttaagatttggtgaaactagattgtcggatttaatcaatcaaaatgaattccgtcatttagaatttaaaaattatggttcttctcaaattaaaaaaatgaaattttcaccagatgcttttgttcaaatggcgttccaagcaacttattatgctctttatggtaaagttgaatgtacttatgagccagccatgaccaaacaatattatcatggtcgtactgaagccattcgtacagtttcccaagaatcaaatttatttgttcgaaaattttttgattcaacagtatcaatgaaggaaaaattacaatatttatctgatgcttgtaagaaacattctgaaaagacaagaatgagttctatgggtcaaggtgttgatcgttacttatatgcaatgttttgtatttggaaaagatatttacaagattatgaagaagagcaacaacaacaacaacacccagttgaagaaggaagtggtggtgaacaacagatggaagcagtagggttatctagagatgataccatagttgttcaaatggatggtgaacatgacgatgatgattcaacaactgttgttggaaccaatggtggtaaaaaccttcatgcatctggatctcatggtaataacgatatctatgataattttgatttattaaaaacagtaccagaattatttgctgattcaggttgggataaattaaacagcacaattatttctacatccaattgtggtaatccatcgttaagattgtttggatttggtccagtttctgctaatgggtttggtattggttatattcttaaagatgattcaatttcaatttgtgctagttccaaacatcgtcaaactcaaagatttttggtgacattgaattcgtatttattggaaattcaaagtatttggaaacaagtggaaaccatgaataaattgcaggatgaattggcattgaagattgatattagtaaaaaacaaaaagaaacagaagaggaacaagctagaccaaaacacaatattaatgcattattgggaggttatggatattttgatatgggcgaagaagatattaaaagtagaggacaatctcctgaaccaccatttttaaaccgagcaaattcaagttttagtgttcgtgaaattggtaaaaaattacgattaagtgaatattaa

SEQ ID NO: 3922 - protein, 795 aa, Candida albicans SC5314
MSTYRFQETLEKLPIPDLVQTCNAYLEALKPLQTEQEHENTKIAVDKFLNGSNSKTTNNGVVTGSGIGHYLDRELRQYAKTRPSYIEQFWYDSYLNYDSPVVLNLNPFFLLEDDPFTNESSSINPQVKRATNLTLSSLKFIQALKNETLSVDTLKNGKPLCMYQYTKLFGASRIPSQEGCMMQSDPLSNHIVVMSKSQFYWFDVLDSHNNLILNEAELNINFNSIIRDSLNTPSDEIAKSSFGVLTTENRRVWANVRNNLIGNNTINREVLSIIDSALFILCFDDIAIDDLSELSKNMLCGLSILDNGIQVGTCTNRWYDKLQIIVTKNAKAGINFEHTGVDGHTVLRFVSDIYTDSILSFANSINNNAPSLWKSTTKNDVPDYELEEELITIPRKLEWDLTPDLSLVLRFGETRLSDLINQNEFRHLEFKNYGSSQIKKMKFSPDAFVQMAFQATYYALYGKVECTYEPAMTKQYYHGRTEAIRTVSQESNLFVRKFFDSTVSMKEKLQYLSDACKKHSEKTRMSSMGQGVDRYLYAMFCIWKRYLQDYEEEQQQQQHPVEEGSGGEQQMEAVGLSRDDTIVVQMDGEHDDDDSTTVVGTNGGKNLHASGSHGNNDIYDNFDLLKTVPELFADSGWDKLNSTIISTSNCGNPSLRLFGFGPVSANGFGIGYILKDDSISICASSKHRQTQRFLVTLNSYLLEIQSIWKQVETMNKLQDELALKIDISKKQKETEEEQARPKHNINALLGGYGYFDMGEEDIKSRGQSPEPPFLNRANSSFSVREIGKKLRLSEY

SEQ ID NO: 3923 - DNA, 1947 bp, Ustilago maydis 521
  CDS (1)..(1947)
atgacactcatcggcttgggtcgttcacaagcacgctcgtctgctacccgattcgctttctctgcctcttcccttacatctgctgcttcgggcaatcctcttgccgctgccgtcgccatgtcacgctactcttccacctcgaccaagagcgatgctcttggcaatggtcccatgtacgagggtcagagcgccatgcctcacctgcccgtaccggctctcgagcagaccctgaaaaagtacctccgcagcactgtgccgcatcagaccagcgagtcgctcgccaagaccgaagctgccgttgaatcggcactgacgggagccgatgccaagctcgtccagacgctccagcagcgtcttgaggaccgagccaccaaggaaggccgcgagagctggctcagcgagtggtggaacgacgctgcctacatggcgtatcgtgatccggttgttccctacgttagctacttttacgcccacaaggatgacaagacgcgccgcaccggtcccaagcgtgccgctggtttgctcaaggccttcctcgcctttcgccgattgcttgagactgagcagctcgctcccgaaaagggcaagactggtcctctctgcatgaggtcgtacaaatggatgtttaactcgaaccgcattcccgaaaagccgtctgatacggcagtcaagtacgattggcaggccaacaaccacctcgtcgtgcttcgcaatggtcacttttacgagtttgaccttgttcacaacggacaggagctcagcgaggccgaaatcgagtcgcagctacaaaaaattctctccgactctgcctcgagccagcccgctcgccagcccatcggtgctctttcgtccaacaatcgtgacaagtggaccgactcgcgcaaggcgctcgctgcgctccctggcaaccaagaggcgttggagcgtatcgacagctcggttattgtggtctgtctcgacgagatcgcgcctcatagccttgagtcgaccgcatggggtctgtggtgcggtgacggcaagaaccgcttctatgacaagcagcagattatcacatttgccaacggcaagtccggtttcatgggtgagcactcgatgatggatggcacgcccacgctgcgtctcaacgactttgccctccaagcgctgcaagctggcaaaatcgacctcggcagctcgaaccgcactgacctgcctgcgcctaagcagatccagttcaagacggacaagaccgtcgaggcaaagattgaagagagcatcaaggagtttaacgacctcatgggacgtcacgaccttgcaatcctcgacttccaaggctacggtaaaggcgccatcaagaaattcaagtgctcacctgacgcctgggtgcagatggtgatccagctggcttatttcaagatgttcggcaagccttgtcctacgtacgaatcagcgcagacgcgaaagttcaagtggggacgtaccgagaccatccgttcggccagtgtcgagtcgttggctttctgcaaagccatggaatcgcacagcgcttcggatgccgaacgatttgaaaaattccaggcggctgtcaagcagcacctctcctacgctaccgccgctgctgatggtcaaggtgtcgaccgtcacctgtttggtctcaagaagctgctcaagcaaggtgaaaaggtgcctgctatctacgaggaccccgcatacggtttgagcgcaacgtggaagttgtccacctcgcagatttcatccgaggtgttcgcctcctggggcttcggcgaggttacaccggaaggcttcggatgtgcttatgccatcaaggagaactcgttgactttcaccctcacttcgctcaagctgggggcggctgacctgcgacactacatcaacgaggctgccctggagctgcgcgaccttcacttgagactccagcagaacgaggctcctaaaagcaaggcttag

SEQ ID NO: 3924 - protein, 648 aa, Ustilago maydis 521
MTLIGLGRSQARSSATRFAFSASSLTSAASGNPLAAAVAMSRYSSTSTKSDALGNGPMYEGQSAMPHLPVPALEQTLKKYLRSTVPHQTSESLAKTEAAVESALTGADAKLVQTLQQRLEDRATKEGRESWLSEWWNDAAYMAYRDPVVPYVSYFYAHKDDKTRRTGPKRAAGLLKAFLAFRRLLETEQLAPEKGKTGPLCMRSYKWMFNSNRIPEKPSDTAVKYDWQANNHLVVLRNGHFYEFDLVHNGQELSEAEIESQLQKILSDSASSQPARQPIGALSSNNRDKWTDSRKALAALPGNQEALERIDSSVIVVCLDEIAPHSLESTAWGLWCGDGKNRFYDKQQIITFANGKSGFMGEHSMMDGTPTLRLNDFALQALQAGKIDLGSSNRTDLPAPKQIQFKTDKTVEAKIEESIKEFNDLMGRHDLAILDFQGYGKGAIKKFKCSPDAWVQMVIQLAYFKMFGKPCPTYESAQTRKFKWGRTETIRSASVESLAFCKAMESHSASDAERFEKFQAAVKQHLSYATAAADGQGVDRHLFGLKKLLKQGEKVPAIYEDPAYGLSATWKLSTSQISSEVFASWGFGEVTPEGFGCAYAIKENSLTFTLTSLKLGAADLRHYINEAALELRDLHLRLQQNEAPKSKA

SEQ ID NO: 3925 - DNA, 2181 bp, Ustilago maydis 521
  CDS (1)..(2181)
atgctcaagctgtgtttcaatgttgctcgctcgctgacccacttctacttgaacgttcgcgtcctttccgctgcgcaccgcatgctcccagcttctttcaactggccgcttctgttcctctcgttcgctactcctcctcgttccttgcacacgtcgtcgccagccatgtttgctctcactccctggcgcggatcgccgggcacccagccaaaaaccttcagccagcagaagaacttgccgcgtcttccagtgccgaagctcgagcagacgtttgacaaatacctcaagtctctgtcgcctttcttgcgacagctcgaagagcagggcaagctcgaaggcagcaccgcacaagaggagatcgccaagcgcaagcagtgggtccacaacttcctcgccaaaggcggtctcggtgccaagctgcagcagaggctcattgacgtcgaccgcaccaccgacaataactggctcgacgaccgttggtggctccaaaaggcctaccacgagtggcgcgtgccgctcatgatcaatagcaactggtggctcatgtttacgcacgacgaaaacatgcccaccgatcttggcgagcaccgcggtcacgatgcctatcccatcgctggccttggctctcagaactgggacgagtctgcatggggtgttcgccgtgccgcttggctcacttcgcgtttcttgcagttcaagaagcgtctcgacgacgaggatatcatgcctgactcttctcgtgccggtccgttctgcatgcaccaatacactcgcctctacggaatcacacgaatccccgccatcccgcacgactggaacacggcgacaccgcaccctgctgttgcacgccacatcaccgtaatcgcgcgtgacaactactacgagctcgaagtgatccgcaaggatggcaccttgctcggcgtcgactcgattgaaaaggcgttctgggacattgtcgctgatgccaagaagggcgatggtgccggtgtcggcgtgctgagctccgacaaccgcgacacttggacaaagacccgcgagcatttgctgagcgtggcgcctgtcaaccgcaagtccatcaattcaatcgaagatagcattctgtgtgtctcgctcgactcgagtgtactcgcgctttccccggaacaccctgccccagcccacgaggcgacacccatctgggtcgacgcattggctcgcaactgcagcggcgccggacgaggtggacacaaccgctggttcgacaaggctctcacaatcgtggtcgagccgaacggacgcgcaggaatcatgggcgagcactcgccctgtgatgcgcttatccccagtattctttgcgactacgccgctgctgagccatgtcctcctccaggctctggcttccctgccgaactgagctcgcccaacgagtcggccagctggaaaaagctcgaatgggctgtcgacgactcgaccaagcagtcgatcgagcaatcggagcaggccgccctgcaggctgccaaggagtcggacattcgcacgctgtggtacaacgagtacggagccgactggatcaaaaaggtgggcaagcacagtcccgacgcttacctgcagatggcactccagcttgcttacgccaaggttcatggacagcagacatccacttacgagacagcgtccaccaggctgttcaagcacggccgtaccgatgtcatccgctccttcagcgacgaagcgtacgattttgtacgtggcgttcgcgagggtaaggatgctaagacgctctacacgctcctgacggcggcgaccaagtcgcacaacacgcaaacgcgcgagagctcgacaggcaagggtatcgaccgacacatgactggtttgcgcctactgctgcgtgccgaggatggcgagacgccggccatattctcggacccgctctttggcgagtcgcagtcgtggcgtctgagcacgagtggtctcagtgccggagaccgattcgcaggtaccggttttggtactggctacccgaccgaatcgtacgggatcaattaccttgcaggtgcgcaactgctcaagtttggcatcgagtccaagaacaacgcgacgactcaattcgccaagagtttggttgaggcactcagagatatgcgacgcatctgcgaacagggtggtcctcccccacaggcgaccgaggcatccaagctttag

SEQ ID NO: 3926 - protein, 726 aa, Ustilago maydis 521
MLKLCFNVARSLTHFYLNVRVLSAAHRMLPASFNWPLLFLSFATPPRSLHTSSPAMFALTPWRGSPGTQPKTFSQQKNLPRLPVPKLEQTFDKYLKSLSPFLRQLEEQGKLEGSTAQEEIAKRKQWVHNFLAKGGLGAKLQQRLIDVDRTTDNNWLDDRWWLQKAYHEWRVPLMINSNWWLMFTHDENMPTDLGEHRGHDAYPIAGLGSQNWDESAWGVRRAAWLTSRFLQFKKRLDDEDIMPDSSRAGPFCMHQYTRLYGITRIPAIPHDWNTATPHPAVARHITVIARDNYYELEVIRKDGTLLGVDSIEKAFWDIVADAKKGDGAGVGVLSSDNRDTWTKTREHLLSVAPVNRKSINSIEDSILCVSLDSSVLALSPEHPAPAHEATPIWVDALARNCSGAGRGGHNRWFDKALTIVVEPNGRAGIMGEHSPCDALIPSILCDYAAAEPCPPPGSGFPAELSSPNESASWKKLEWAVDDSTKQSIEQSEQAALQAAKESDIRTLWYNEYGADWIKKVGKHSPDAYLQMALQLAYAKVHGQQTSTYETASTRLFKHGRTDVIRSFSDEAYDFVRGVREGKDAKTLYTLLTAATKSHNTQTRESSTGKGIDRHMTGLRLLLRAEDGETPAIFSDPLFGESQSWRLSTSGLSAGDRFAGTGFGTGYPTESYGINYLAGAQLLKFGIESKNNATTQFAKSLVEALRDMRRICEQGGPPPQATEASKL

SEQ ID NO: 3927 - DNA, 2295 bp, Ustilago maydis 521
  CDS (1)..(2295)
atgacgccaggcctcatgtcgtcgtctgaggacaaaaccgtcttgaatgcacaggctgtcgaagcaaagtcggccgctctcgccgacggaggcgccaaagaaggcatcggagctggcaagacttttcaaggtcaatccaagctccctcaccttcccatccccacgctccaagagacgtgccagcgttacctttctagtcttcagcctctccaaactgccgagcagcacgctaccaccaaatccgtcgtcgaggactttctcaagaacgacggacctgtccttcagaagcagctgcaagattatgctagcacaagggccagctacattgaagagttttgggacgagagctacctgcaagcttccgactcagtcgtgcttaacctcaaccctttcttcatcttggaggacgatccgacgccaacacgtggtaaccagttgatgagaaccgccaaccttatcctcgccagtttggccttcatccacgatctgcgcaccggcgtgctcgaaccagacagtgttaggggcactccgttggatatgttccagtacacacgtttgtttgctacctcgcgtattcccactgccaacggctgccgaatgcaagtcgagcctgaatcgcgtcacattgtggtaatgcgcaaaggtcagatctattggttcgaagcgttggacgaagaacatcgtccgttgttcaccgaacgcgccatgctcggcaacctgcaagctatcgtacgtgatgccgaccaaaccaagctcgaagatgtcgcaaagggctccataggaatcttgaccactgaaaagcgacctatctggtctatgtatcgcgagcacctccgccaagacgctcacaaccgcaagtgtctcgaggtggtcgatagcgctctctttgtggtttgcatggacgactcggaacctgccgacgccgccgagctaagcaacaacatgctgtgcggcacttacaagcttcaacgcggcattcagactggaacatgcaccaaccgatggtacgataagcttcagatcatcgtctgtgccaacggagctgcaggtatcaactttgagcacactggcgttgatggtcacacggtgttgcgctacgccgccgatgtttacaccgaactcatcatgcgtttcgccaaatccatcaattcagccaccaagagcctgttcaaagccaagaccagcgcgttcgcaaaaggtgcaggtcaaaaagctaatggcaccacttcggacgccgacgcgcaacgtacacaggatgtcaaccaagccaccgctcccaagaaactcgaatggaatctaaccgccaaactcgccgacggcatccgttatggcgagacgcgactgtccgacctgatctgtcaaaatgaatgcgaggtgttggagttcgaccggtacggcaaaaactttatcactcgtcatcgattctcgcccgacgccttcgtacagatggcgttccaagccgcctactacaccctctacggacgttgcgagacgacttacgagccagccatgaccaaagctttcttgcatgggcgtacggaagcgatccgaactgtacagccgcactcggccaaatttgtggaaacgtttatcgatgcggatgccaaggttgaggacaagatcgatgcgttgagaaaggcgtgtgatgggcattccaagttgagccgagcgtgcgcgtcgggtcaaggtcacgatcgacacttgtatgctctgtacaacttgtggaaaaagcatcagggaactggatccgccacggcgccggccatctttacggatgcaggatatgtcaagctcaatcacacggtcgtgtccacttcgaattgtggaaatccagcgttgcgaatgtttggtttcggaccggtggtcccagatgggtttggtattggatacattatcaaagacgacggtatcacggtttgtgcttccagcaagcatttgcagacgaaacgcttcttggatacgctcgaggcgtacctgcttcagacgcagcgaatgattatcgagctgtacaaggcggctaatgtacgcagcaagtccacgtacatcgaccatgccggtgtcgagtgtgatgttcgaaccggcctgccgatcggtagcaagagcaacggttacactcaggactacgaagagggtacaagcaacagccagatcggacagagtggatactctttctggggcgacgatgctaaagcagcagccgccaatactcaggaccaacacgtgcacgacgcgcgcgtcaggaggagcagaattgctagcgtcggcaagaccatcttgtatgacgagtataattga

SEQ ID NO: 3928 - protein, 764 aa, Ustilago maydis 521
MTPGLMSSSEDKTVLNAQAVEAKSAALADGGAKEGIGAGKTFQGQSKLPHLPIPTLQETCQRYLSSLQPLQTAEQHATTKSVVEDFLKNDGPVLQKQLQDYASTRASYIEEFWDESYLQASDSVVLNLNPFFILEDDPTPTRGNQLMRTANLILASLAFIHDLRTGVLEPDSVRGTPLDMFQYTRLFATSRIPTANGCRMQVEPESRHIVVMRKGQIYWFEALDEEHRPLFTERAMLGNLQAIVRDADQTKLEDVAKGSIGILTTEKRPIWSMYREHLRQDAHNRKCLEVVDSALFVVCMDDSEPADAAELSNNMLCGTYKLQRGIQTGTCTNRWYDKLQIIVCANGAAGINFEHTGVDGHTVLRYAADVYTELIMRFAKSINSATKSLFKAKTSAFAKGAGQKANGTTSDADAQRTQDVNQATAPKKLEWNLTAKLADGIRYGETRLSDLICQNECEVLEFDRYGKNFITRHRFSPDAFVQMAFQAAYYTLYGRCETTYEPAMTKAFLHGRTEAIRTVQPHSAKFVETFIDADAKVEDKIDALRKACDGHSKLSRACASGQGHDRHLYALYNLWKKHQGTGSATAPAIFTDAGYVKLNHTVVSTSNCGNPALRMFGFGPVVPDGFGIGYIIKDDGITVCASSKHLQTKRFLDTLEAYLLQTQRMIIELYKAANVRSKSTYIDHAGVECDVRTGLPIGSKSNGYTQDYEEGTSNSQIGQSGYSFWGDDAKAAAANTQDQHVHDARVRRSRIASVGKTILYDEYN

SEQ ID NO: 3929 - DNA, 1875 bp, Frankia sp. CcI3
  CDS (1)..(1875): transl_table=11
atgaatgcgatcagtagctcccagcaatccaccggaaccttcgcgaacgacgatctgctgccccgggtgccattgcccacgctggcggagagctgcgaacgtttccttgcctggtccgcgccgctgctgaccccggccgagcaggcgacgaccgaggcagccgtcgcggccttccaggcaccgggcggccccggccccaccctgcacgcggcgctggagcgctacgacgccaccgagggcgtacacagctggctggacggcttctgggactcccgctacctcggccggcgcgaccgcatcgcgctcaacgcgaactacatcttcctgttcaaggacgccgagggtctgtccgccgagcagccgcaggtggagcgggccgccgggctcgtggcggcagccgtcgactacaagctgcgcctcgacgatgagcgggtcgagccgatcgtccagcgcggccagacgctgtcgatggcgcagaacacgttcctgttctccacgacccggatcccgggaacggtccaggacaccgtgcgcaccccgtacagcgagcagtggcccgggccgtcccaggcccgccacatcgtcgtcttccaccggggaaacatcgtccggctggacgtcgtcgggccggacggtcacccgtacaccctggacgacctcgcggcgggcctgcgcgccgtggtgaaggccgccgcgtcgcggattccggcggacgccgccgtcggccagctcaccaccaaggcccgggctgactgggccgcgagccgccagacgctgctcgctctggaccccgccaacgcggccgcgctcgacacgatcgagaccgcgctgttcgccctgtgcctggaagacttcacccccaaggacaacctggccgcgtgtgaccacctgctccacggcgacagcgccaaccggtggttcgacaaggcggtgtcactgatcgttttcgccgacggccgggcgggcatcaacgtcgagcactgcgggctggacgggacgacgatcctcagcttcgtcgacgacctgctgggtacctcgcccgcggagcactcggcgagctctggcgcccggccccaggggctacccgtcatcgagcccgtcgagttcgtcctcgacgccagcctgcgggcggatgtggccgccgccggcgcgtcgttcgcggagttcgccgcggcgaccgcctcaacggtgttgtccttcaccgacttcgggcaaaaccgggccaaggcactgaagacgtcaccggacgcattcgtgcagctcgcctaccagctggcgcacagccgggccaaggggcacatcggcgccacctacgaatcgatcgccacccggcactggcggcgcggccgcacggaagcgatgcgggtcgtcaccccggagatccagcggttcgtgaccgtactcaacgacccggacaccgacaccgccacccgccggaccgcgttccgcgccgccgccgacgcgcacgtgcggcgcgcgaaggactgccaggccgggcgggcccccgagcagcacctgtgggagctgcagttcatcgcccgcagccaaggcgagcggctgggggtgaccgagccgatcgcgctctacgaggccccgggctggctcaaggcgcgcgacgactacctgagcaccagctccgcgccgtccaccaacgtcgagttcttcggcttcgggtctaccagcagccagtgcatcggcatcgcctacgtgctgctgccggaccggttcaacctctacctgagcacgccgcgtgcggtcgcggacgggatgtacgcgttcgccgaccagctccagcaggtcgtcaccgagctgcaggacctgctcgccaccgatgagacgggcgacgggccattcaaggcgggctattccaggtaa

SEQ ID NO: 3930 - protein, 624 aa, Frankia sp. CcI3
MNAISSSQQSTGTFANDDLLPRVPLPTLAESCERFLAWSAPLLTPAEQATTEAAVAAFQAPGGPGPTLHAALERYDATEGVHSWLDGFWDSRYLGRRDRIALNANYIFLFKDAEGLSAEQPQVERAAGLVAAAVDYKLRLDDERVEPIVQRGQTLSMAQNTFLFSTTRIPGTVQDTVRTPYSEQWPGPSQARHIVVFHRGNIVRLDVVGPDGHPYTLDDLAAGLRAVVKAAASRIPADAAVGQLTTKARADWAASRQTLLALDPANAAALDTIETALFALCLEDFTPKDNLAACDHLLHGDSANRWFDKAVSLIVFADGRAGINVEHCGLDGTTILSFVDDLLGTSPAEHSASSGARPQGLPVIEPVEFVLDASLRADVAAAGASFAEFAAATASTVLSFTDFGQNRAKALKTSPDAFVQLAYQLAHSRAKGHIGATYESIATRHWRRGRTEAMRVVTPEIQRFVTVLNDPDTDTATRRTAFRAAADAHVRRAKDCQAGRAPEQHLWELQFIARSQGERLGVTEPIALYEAPGWLKARDDYLSTSSAPSTNVEFFGFGSTSSQCIGIAYVLLPDRFNLYLSTPRAVADGMYAFADQLQQVVTELQDLLATDETGDGPFKAGYSR

SEQ ID NO: 3931 - DNA, 2415 bp, Emericella nidulans
  CDS (1)..(2415)
atggaagctccccgctcacatccggctcctgagccgaagataaggcctaccacagtggatggaggcttgcccgatcaggttaagaccaagagtggtgggatcacattcgcacaccaagactctctgccgaagttacctatcccggatcttgagagcacatgcaagaaatatctcgacgctctgtcgccgctgcagactcctaaagagcaagaagagaccaaggctgctgtacgggagttcctcaaaggcgagggtcccggccttcaagagcggctgcagaaatatgccacatcgcaaacgagttatattgaacaattctggtacgactcctatctgaattacgacagtcctgtcgttctcaacctcaaccccttcttcttgctggaggacgatccaacacctgcgagaaacaaccagctgactagagcggcatcgctggttgtttcggccttatcatttgtgcgcgctgtcagacgggaggagttgcctcccgataccgttcgaggtacgccattgtgcatgtatcaatattcccggctatttggtactgcacgtgttcctactgagaatggctgcgttatcagccaagatcccaagtcaaagcatatcgttgttatgtgccgtggtcagttctactggtttgacgtcctcgacgagaatcatgaccaaatcatgacagaaaaggatatcgcaatgaaccttgaggttattctcgctgatgcagaacaaaccccaattcaagaggcggcgaagggcgcccttggagtcctcagtactgaaaaccgcaaggtgtggtcgggattgagggatatcctaaccaaagatgagcattcaattaacgctgagggcttaaacattgtggatactgccctatttgtcctctgcctggatgacaccgagcctcataacatgtccgagctttgcgcgaacatgctctgtggtacgaacgtggtggaaaagggcgttcaagtgggtacttgcacgaaccggtggtacgacaagctgcagatcatcgtgtgtaagaatgggagtgctggaatcaattttgagcacactggtgttgacggacatactgttcttcgcttcgcgagtgacgtctacacggacacgattcttcgctttgcacgaaccatcaacggccaggctcccagcttgtgggcaaccactagccctgacccgtccaaacgacaccctcgaagcttcggtgacgttagcccgacccccagaaaattagaatgggacatgttgcctgagcttagcattgctatccggtttgccgaatcgcatctcgcagatcttcttcagcagcatgaattccaagtgcttgatttcaagggattcggaaagaactttattacctcaatgggattctcaccggacgcattcgtccagatggcgttccaggcggcttactacgggctttacggacaagtggtaaatacctatgaaccagcaatgaccaaggctttcctgcatggacggaccgaagccattcgatctgtcaccaatgaagccctcgacttcgtgaagacattttgggctgaaaaccctgctgaggataaggtgaatgcccttcgaaaggctactgagaagcactcggcaatcacgaaggaatgctccaagggacaaggacaggaccgtcacctctatgctctttacaccctgtggcagcgacaattcgacgaagcccctagctcccggaacaacagcgtcgatgaagcgtcgaacgggtacacgagtcctgctgagatcgactccatcgctgggtctcctctatccccgtcctctgtatctgaggtggatgggttgtcatccactggcagctatggccgggctatgcgtaatttgcctcccactcccgccatcttcagcgaccccggctgggacaagatcaacaacacaattctttccacttcaaactgtggcaacccctgcttgcggcatttcggcttcggcccaacatctgcagacggattcggcattggctacattatcaaggacgactcaatctcaatttgcgcctcatctaagcaccgccaaaccgcgcgtctcatgcagacacttgagttgtacctgcttgagatccgcaagttgctgcgcgcgactgtccacaagccgtccagcccgcggaccagccgcgctcgtgaaatggagatgattgccgagcgggtccagcgtgatcaacgccggggtcgtattgtccgcacagacgcgggccatctgcgggccggtaccgagacgcccacgacggacagcggggacatggacgatgatggcatgggcggatatggtttctttgatgcagggatgctcctgcatgcgctcaaggggctcaacgtggatcgcgagcggggtggcgacaagacccctcgacgacggttcgttggcaagaagctacggttgaatgaatattga

SEQ ID NO: 3932 - protein, 804 aa, Emericella nidulans
MEAPRSHPAPEPKIRPTTVDGGLPDQVKTKSGGITFAHQDSLPKLPIPDLESTCKKYLDALSPLQTPKEQEETKAAVREFLKGEGPGLQERLQKYATSQTSYIEQFWYDSYLNYDSPVVLNLNPFFLLEDDPTPARNNQLTRAASLVVSALSFVRAVRREELPPDTVRGTPLCMYQYSRLFGTARVPTENGCVISQDPKSKHIVVMCRGQFYWFDVLDENHDQIMTEKDIAMNLEVILADAEQTPIQEAAKGALGVLSTENRKVWSGLRDILTKDEHSINAEGLNIVDTALFVLCLDDTEPHNMSELCANMLCGTNVVEKGVQVGTCTNRWYDKLQIIVCKNGSAGINFEHTGVDGHTVLRFASDVYTDTILRFARTINGQAPSLWATTSPDPSKRHPRSFGDVSPTPRKLEWDMLPELSIAIRFAESHLADLLQQHEFQVLDFKGFGKNFITSMGFSPDAFVQMAFQAAYYGLYGQVVNTYEPAMTKAFLHGRTEAIRSVTNEALDFVKTFWAENPAEDKVNALRKATEKHSAITKECSKGQGQDRHLYALYTLWQRQFDEAPSSRNNSVDEASNGYTSPAEIDSIAGSPLSPSSVSEVDGLSSTGSYGRAMRNLPPTPAIFSDPGWDKINNTILSTSNCGNPCLRHFGFGPTSADGFGIGYIIKDDSISICASSKHRQTARLMQTLELYLLEIRKLLRATVHKPSSPRTSRAREMEMIAERVQRDQRRGRIVRTDAGHLRAGTETPTTDSGDMDDDGMGGYGFFDAGMLLHALKGLNVDRERGGDKTPRRRFVGKKLRLNEY

SEQ ID NO: 3933 - DNA, 1833 bp, Aspergillus oryzae
  CDS (1)..(1833)
atggctcctcggcgtaaggcttcgtctgtcccggagggctacgtagaagacctctctaagggcaagatgctcagatttgaagattcccttcctcgcttgcccgtccccactcttgaagaaaccgcccgccgctacctgaaatcggtccatgcggtggtttccgaagccgaatatgagaacaccaagaaggccgtggaagccttcgttcgccctggtggcgagggtcaaactctgcaggaaagacttctggcccgtgctgcggaccccaaaaataagaactggcttactgaatggtggaaccacgccgcatacctgggttatcgcgacccggtggttccctacgtttcctacttctactcatacaaggacgaccgcgctcgtcggaaccccgccaagcgtgccgcatctgtcgcgaccgcggctctcgagttcaaacgccaggtggacgatggctccctggagccagaatacatgcgcgccgcgcccatcgcgatgagctcgttcgagtacatgttcaattgctgccgcattcccgccgacggtgcggattatcctcagaagttccccgctaaggagaaccagcacattgtggttgtgcgcaagaaccagttcttcaaggtgcctctggtcgtagacggtaagccgttgaacgtgtcggagctggagaagcagttcgagcgcatctaccagattgcccagaagtcgcccgccgtcggtacattgaccgcggcgaaccgtgacctctggacggatgcccggaagaagttgcttgcggcccacccggccaacgagcaggccctgcgtgacattgagtctagcggcttcctgatctgtcttgacgatgccacccccgtcaccctggaggagcgggctcgccagtactggcacggcgatggcgccaaccgctggtacgacaagcctttgcagttcattatcaacgacaacggtaccgctggtttcatgggtgaacacagcatgatggatggcagccccaccagccgtctcaacgaccacctgaacaatctcatcttcaacaacaaaatcgacctttcggagcagcccgtccgctctggcctgtccgatccccgtcccatcaacttccacttgaatgacgaggtgttggaggcgattgacgccgccaccaaggagcaccgccagcagattagtgcacacgagctgaaggtgcaggcctaccagggctacggcaagggtctcatcaagaagttcaagtgcagcccggatgcgtatgtgcagatgatcatccagcttgcctacttcaagatgtacggcaagaaccgcccgacctacgaatctgcttcgactcgtaagttccaggagggccgtaccgagactatccgtagcgtttccgacgacagtgtggccttctgcaaggcccagagcgacccctcagtgccccgggaggaggttgtgcgcctcttccgcaccgccctggcctcccactccaagtacaccgcggaggctagtgatggtcgcggtgtcgaccgccacctgtttggtttaaagaaggtgctcaaggagggtgagaagctgccggccttgtacgaggacccggcatacagctacagcagctcgtggtacctctcgaccagccagctgagttcggaattcttcaacggatacggatggagtcaggtgatcgacgatggattcggtattgcatacatgatcaacgagaacagcctcaacttcaacatcgtctgcaagcgcatcggcgctgagcgcatgagctactacttgaacgaggctgcctcagacctgcgggatctgctgatgcccgacctggccgcccagaccgagaaggccaagctttaa

SEQ ID NO: 3934 - protein, 610 aa, Aspergillus oryzae
MAPRRKASSVPEGYVEDLSKGKMLRFEDSLPRLPVPTLEETARRYLKSVHAVVSEAEYENTKKAVEAFVRPGGEGQTLQERLLARAADPKNKNWLTEWWNHAAYLGYRDPVVPYVSYFYSYKDDRARRNPAKRAASVATAALEFKRQVDDGSLEPEYMRAAPIAMSSFEYMFNCCRIPADGADYPQKFPAKENQHIVVVRKNQFFKVPLVVDGKPLNVSELEKQFERIYQIAQKSPAVGTLTAANRDLWTDARKKLLAAHPANEQALRDIESSGFLICLDDATPVTLEERARQYWHGDGANRWYDKPLQFIINDNGTAGFMGEHSMMDGSPTSRLNDHLNNLIFNNKIDLSEQPVRSGLSDPRPINFHLNDEVLEAIDAATKEHRQQISAHELKVQAYQGYGKGLIKKFKCSPDAYVQMIIQLAYFKMYGKNRPTYESASTRKFQEGRTETIRSVSDDSVAFCKAQSDPSVPREEVVRLFRTALASHSKYTAEASDGRGVDRHLFGLKKVLKEGEKLPALYEDPAYSYSSSWYLSTSQLSSEFFNGYGWSQVIDDGFGIAYMINENSLNFNIVCKRIGAERMSYYLNEAASDLRDLLMPDLAAQTEKAKL

SEQ ID NO: 3935 - DNA, 2418 bp, Aspergillus oryzae
  CDS (1)..(2418)
atggccacccctcgctctcagcctaccatggagactaagatcaagcctacttccgtggacggcgtgaacggccaaggcgtcgcgtcagaacagccgaagaagaaagggtccacgttcgctaaccaagactctctcccgaaacttcctatcccggatttagagagcacatgcaagaaatacattgaggccctgtctgcattacaaacgccgagggaacaggaagaaacaaaggcctctgtacaagattttctcaagtcggacggccctattcttcaagagaagttaaagaactatgcgtcttcgaagaccagctatattgagcaattttggtatgattcttacctgaactacgacagcccggtcgttttgaatctcaacccattcttcttgctggaggatgaccccacacctgccaggaatcaccaggttactagagcagcatcgcttgttgtatcggccctcagctttgtccgagcggtgaggagggaagaactcgagcccgacaccgttagagggacgccactatgcatgtatcaatattctcgactattcggaacagcacgtctgcccaccgaaaatggatgcgttatcagtcaggacccccacgccaagcacattgttgtcatgtgccggggccagttctactggtttgatgtcctcgacgagaacaatgatctgattatgactgagaaggacattgcccttaacctgcaggtgatcattggggatgcggaacagaccccaatccaggatgctgccaagggagctttgggtgtcctcagtacggaaaaccgcaaagtgtggtctgggctacgggatatcttaacgaaggacgaaggctcaaacaacgcagaatgtctgaacattgttgatacagcgctctttgttctctgtctagattatactgagccgagcaatacgtctgatctctgtgccaatatgctatgcggtacaagtgaagtggtgaaaggtgtgcaggtcggaacttgtaccaatcggtggtatgacaagctccagatcattgtgtgccagaacggcagcgccggtatcaactttgagcataccggtgtggacggccatacggtgctgcgttttgccagtgacgtctacacagatacgatacttcgcttcgcaaaaactatcaatggacaagcgcccactctgtgggcaagcaacagccccgatccggccaagcgtgatccccgaagctttggcaatgtcagcacgacgccccgcaagctagagtgggacatgcttcctgaactgagtattgccctgcggttcgccgaatcccatctcgccgaccttctcaagcagcacgagttccgcgtgcttgaattcgaagggtttggtaagaatttcatcacgtcgatggggttctcgccagatgcgttcgtgcagatggcatttcaagctgcgtactacgggctgtatggccgtctggagaacacctacgagccagcgatgaccaaattcttcttgcacggtcggacggaggcgatacggacggtcaccaacgaatgcgccaattttgtacagacattctggggagagaatccagcagagcagaaggtagaggctttgaagaaggcgaccgaaaaacacaccgctactacaaaagagtgctccaagggacagggacaggatcgacatctctatgcattatattgcctctggcagcggtcgtttgaggaaggctcttcctcctccggcaatagtgttgtaagcagttccaacggctattctagccctgttgagaatggctctaccattgactcacccaagtctccgttgtcggatgacggcgtttcctccacgaccagctatggcttgcgtgcgattcgcccagcgccacccacgccagcactcttcagtgaccccggttgggacaagatcaacaatactatactgtcaacctcaaactgcggaaatccatgtctgcggcattttggcttcggtccaacgtctgcggatggcttcggaattggctatatcatcaaagatgactcgatctcgttctgcgcctcgtccaagcaccgtcagaccgctcgatttttgtacacactcgaatcgtatttgtttgaaatccgaaagctgctacgcgccaccaaccgtacgacggccagtccgcgaaccagtcgggctcgggaaatggagatcatcgccgagcggctccaaggggatcaccgtcggggccggctcgtccggggagatcctggggcagtgcgccggggtgccgatacgccaacgaccgacagcggagaaatagaagacgacggcatgggtggatacgggttcttcgatgccggaatgctattgcatgcactcaaaggcttgaatacagaccgagagcgtaacggagagaaacccgaacgacgtcggtttgttggcaagaaactacgtctaaatgagtactga

SEQ ID NO: 3936 - protein, 805 aa, Aspergillus oryzae
MATPRSQPTMETKIKPTSVDGVNGQGVASEQPKKKGSTFANQDSLPKLPIPDLESTCKKYIEALSALQTPREQEETKASVQDFLKSDGPILQEKLKNYASSKTSYIEQFWYDSYLNYDSPVVLNLNPFFLLEDDPTPARNHQVTRAASLVVSALSFVRAVRREELEPDTVRGTPLCMYQYSRLFGTARLPTENGCVISQDPHAKHIVVMCRGQFYWFDVLDENNDLIMTEKDIALNLQVIIGDAEQTPIQDAAKGALGVLSTENRKVWSGLRDILTKDEGSNNAECLNIVDTALFVLCLDYTEPSNTSDLCANMLCGTSEVVKGVQVGTCTNRWYDKLQIIVCQNGSAGINFEHTGVDGHTVLRFASDVYTDTILRFAKTINGQAPTLWASNSPDPAKRDPRSFGNVSTTPRKLEWDMLPELSIALRFAESHLADLLKQHEFRVLEFEGFGKNFITSMGFSPDAFVQMAFQAAYYGLYGRLENTYEPAMTKFFLHGRTEAIRTVTNECANFVQTFWGENPAEQKVEALKKATEKHTATTKECSKGQGQDRHLYALYCLWQRSFEEGSSSSGNSVVSSSNGYSSPVENGSTIDSPKSPLSDDGVSSTTSYGLRAIRPAPPTPALFSDPGWDKINNTILSTSNCGNPCLRHFGFGPTSADGFGIGYIIKDDSISFCASSKHRQTARFLYTLESYLFEIRKLLRATNRTTASPRTSRAREMEIIAERLQGDHRRGRLVRGDPGAVRRGADTPTTDSGEIEDDGMGGYGFFDAGMLLHALKGLNTDRERNGEKPERRRFVGKKLRLNEY

SEQ ID NO: 3937 - DNA, 2478 bp, Aspergillus fumigatus
  CDS (61)..(2478)
atgtcttactcatccatggcagtccgttacttcacagctccaaagccactgggaggcgtcatggaagccccccggtctcaaccaagcgtcgatgctagggttaatgcctccaacccaacatcagtgaacggcggatcagccccggctcagtcccgtgagaaaaagggcttgacatttgccaaccaggactcactgccaaagttgcctattcctgaccttgagagcacatgcaagaaatacttagaagcactatcagctttgcaaaccccacgagagcaggaagaaacaaaggctgctgttcaggagttcctcaaaacagacggccctattcttcaggagaagttgaagaattatgcctcgtccaaaacgagttacattgaacagttctggtacgactcttacttgaactatgacaatcctgttgtcttgaatcttaatccgttctttttgctggaagacgaccccacgcctgccaggaacaatcaggtgactcgggccgcgtctcttgtcgtatctgctctctcctttgtccgggctgtcagaagggaggaactaccacctgacacggtccgaggcacaccactatgcatgtaccagtactctcgactattcggaactgcgcgtctacccacggacaatgggtgtatcatcagccaggacccgcacgcaaagcacatcgtggttttgtgccggggtcagttctactggtttgatgttcttgacgataacaacgacttgatcatgagcgagaaggatatcgccgtcaatctgcaggtgataattggcgatgccgaacagaccccagtacaggaggccgcaaagggtgcccttggtgttctcagcaccgagaatcggaaagtatggtcgggtctgagagatatactaaccaaggacgaggggtctaacaactcggagtgcctaaacattgtcgacacagcattgtttgtcctctgtctggacgacacagaaccggaaaatacgtcgcagctttgcgccaacatgctctgtggtacgagcgaggtcgtcagaggtgtccaggttggtacctgtaccaaccggtggtacgacaaactgcagattattgtgtgcaagaacggaagtgctgggatcaactttgaacacactggtgtcgacggccacacggttctgcgcttcgctagcgacgtttacacagatacgatccttcgtttcgctaaaaccatcaacggtcaagccccgtcgctctgggcaactgccagccctgatccttcaaagcgggaccccaagagctttggcaatgtcagcacgacaccgcgaaagctcgagtgggacatggttcctgagttgagcattgccttgcggtttgccgagtctcatcttgccgatctccttcaacagcatgaattcgctgttcttgactttgaaggatatggcaaaaatttcatcacttcgatgggcttctctccggatgcctttgtgcagatggcatttcaagccgcttattatgggttgtatggtcgcgtcgaaaacacctacgagccggcaatgaccaaattcttcttgcatgggcggacagaagccatccgaacggtcaccaatgagtgtgttgactttgtgaagaccttttggggcgacaaccctgcggagcagaaggtcaacgctcttcgtaaggcgactgaaaagcacaccgccatcaccaaggaatgctccaagggccggggtcaggatcgccacttgtacgccctgtattgtctttggcaaagatcatttgacgaggacagtccgtcagcgggcaatagcgttgaaaatggatccaacggatactcgagccccgttgagaacggatcggcgatcggttctcccaaaacgtcgtcctccatgtctgaggatggcctctcctcgaacggctatagctaccgcggtatccgcacactgcagcccactccggccatcttcagtgaccccggctgggacaaaatcaacaacacgatcttgtcaacatccaactgcggcaacccgagtctgaggcatttcggtttcggaccgacatccgcagatggatttggtatcggttacatcatcaaagacgattctatctcgatctgtgcctcgtccaagcaccggcagaccgcccggttgatgcaaacactggagtcgtatttgtacgagattcggaagctgctccgagccaccaacagtaaggcggtcagccctcgcacaagcagggcacgcgagatggagatggttgccgaacggttccaaaatgatcatcgtcggggccggctagtgcgtggcgactctggtttggtgcgacggggcacggatacgccaactacggacagtggcgatatcgaggatgatggcatgggtggatatggcttctttgactcgggcatgctgcttcatgctctaaaaggattgagtgtcgaccgagagcgggccgataagcctgcaaaacgtcggttcatcggaaagaagctgcggttaaacgaaatctga

SEQ ID NO: 3938 - protein, 805 aa, Aspergillus fumigatus
MEAPRSQPSVDARVNASNPTSVNGGSAPAQSREKKGLTFANQDSLPKLPIPDLESTCKKYLEALSALQTPREQEETKAAVQEFLKTDGPILQEKLKNYASSKTSYIEQFWYDSYLNYDNPVVLNLNPFFLLEDDPTPARNNQVTRAASLVVSALSFVRAVRREELPPDTVRGTPLCMYQYSRLFGTARLPTDNGCIISQDPHAKHIVVLCRGQFYWFDVLDDNNDLIMSEKDIAVNLQVIIGDAEQTPVQEAAKGALGVLSTENRKVWSGLRDILTKDEGSNNSECLNIVDTALFVLCLDDTEPENTSQLCANMLCGTSEVVRGVQVGTCTNRWYDKLQIIVCKNGSAGINFEHTGVDGHTVLRFASDVYTDTILRFAKTINGQAPSLWATASPDPSKRDPKSFGNVSTTPRKLEWDMVPELSIALRFAESHLADLLQQHEFAVLDFEGYGKNFITSMGFSPDAFVQMAFQAAYYGLYGRVENTYEPAMTKFFLHGRTEAIRTVTNECVDFVKTFWGDNPAEQKVNALRKATEKHTAITKECSKGRGQDRHLYALYCLWQRSFDEDSPSAGNSVENGSNGYSSPVENGSAIGSPKTSSSMSEDGLSSNGYSYRGIRTLQPTPAIFSDPGWDKINNTILSTSNCGNPSLRHFGFGPTSADGFGIGYIIKDDSISICASSKHRQTARLMQTLESYLYEIRKLLRATNSKAVSPRTSRAREMEMVAERFQNDHRRGRLVRGDSGLVRRGTDTPTTDSGDIEDDGMGGYGFFDSGMLLHALKGLSVDRERADKPAKRRFIGKKLRLNEI

SEQ ID NO: 3939 - DNA, 2013 bp, Saccharomyces cerevisiae
  CDS (1)..(2013)
atgaggatctgtcattcgagaactctctcaaacttaaaggatcttccgataacgtcaaggagagcaatgcattcggccattgtcaattactccacccaaaaggcccaatttcccgtagagacaaataatggggaacactattgggcggaaaagccgaacaaattctaccagaacaaaaggcccaattttcaaggcattacctttgctaaacaacaagacttaccatcattacccgtgcccgaattgaagtctacacttgacaagtatttgcaaaccatccgcccattttgcaatgatgtagaaacttttgaaagacagcagctgttatgtaaggacttctcggagcacatggggcctatcttacaagaccgattgaaagagtatgccaacgataaaagaaactggatggccaagttttgggatgaacaatcctatttacaatacaacgatcctattgttccatacgtctcttatttttattctcatatgccattaccgaatcatttatcgaagatcgataatgatcctttgattaaggctactgcgattatctcaaccgtggttaaattcatcgaagctattaaagatgaatctttacccgtagaaattatcaaaggtatgccattttgtatgaatagtttttcattgatgtttaacacttcgagattgcctggtaagccagaggataaccaagatacaaatattttttattcagtttatgagaacaactttgtaactatcgcttataaagggaagttttacaaactgatgacccatgacgggaatgacaaaccgctttccgaaaacgaaatctggaggcaactgtactctgtggtattccaaggatcgcagtccgatcccaaactaggtggcattggttctctcacctctttacctcgtgatcaatggcgtgaagtacatctggagcttatgaaggatcctatttctcaggattcactagaaacaatccataagtcttcctttatgctatgtttggatcttgaccaatcccctgtcactttggaagaaaagtcaagaaattgctggcacggtgatggtattaacagattctacgataagtctttacagttcctggtcaccggtaatggttcatcaggtttcttagctgaacactcgaagatggatggtacgccaacattgtttttaaataactacgtttgtcagcagttgaataaactagatgtggatgacttcatgagaaaagtaattacgccatcatctacggtggcaatgaaacctatggaactgcccttcattatcacaccgaagattcataaagcaatcgaatctgcccaactacaatttaaggaaacaattggtgagcatgacctacgtgtttggcactacaacaaatacggaaaaacgtttataaaacgccatggcatgtcacctgatgcatttattcaacaagttatccaactggcggttttcaaatatctgaaacgacaactaccaacttacgaggctgcttccacgagaaaatacttcaaaggccgtactgaaactggtagatctgtgtccaccgcctccttagaatttgtttctaaatggcaaaatggcgatgttcctattgcagaaaagattcaggctttgaaacattctgcaaaagagcattctacgtacctgaaaaatgctgcaaatggtaatggtgtcgatcgtcatttcttcggtctaaagaatatgctaaaatctaatgatgaccaaattccgccccttttcaaagatcccttatttaattattcttcaacttggttgatctccacatctcaactatcttcggaatattttgacggttatggttggtctcaagtaaatgacaacgggtttggactggcatacatgttgaataacgagtggctgcatatcaatattgtcaacaaaccagccaagagtggagccagtgttaacagattacactattatttatctcaagctgctgatgaaatttttgacgccttggaaaatgagaataaacgaaaagcaaagttatga

SEQ ID NO: 3940 - protein, 670 aa, Saccharomyces cerevisiae
MRICHSRTLSNLKDLPITSRRAMHSAIVNYSTQKAQFPVETNNGEHYWAEKPNKFYQNKRPNFQGITFAKQQDLPSLPVPELKSTLDKYLQTIRPFCNDVETFERQQLLCKDFSEHMGPILQDRLKEYANDKRNWMAKFWDEQSYLQYNDPIVPYVSYFYSHMPLPNHLSKIDNDPLIKATAIISTVVKFIEAIKDESLPVEIIKGMPFCMNSFSLMFNTSRLPGKPEDNQDTNIFYSVYENNFVTIAYKGKFYKLMTHDGNDKPLSENEIWRQLYSVVFQGSQSDPKLGGIGSLTSLPRDQWREVHLELMKDPISQDSLETIHKSSFMLCLDLDQSPVTLEEKSRNCWHGDGINRFYDKSLQFLVTGNGSSGFLAEHSKMDGTPTLFLNNYVCQQLNKLDVDDFMRKVITPSSTVAMKPMELPFIITPKIHKAIESAQLQFKETIGEHDLRVWHYNKYGKTFIKRHGMSPDAFIQQVIQLAVFKYLKRQLPTYEAASTRKYFKGRTETGRSVSTASLEFVSKWQNGDVPIAEKIQALKHSAKEHSTYLKNAANGNGVDRHFFGLKNMLKSNDDQIPPLFKDPLFNYSSTWLISTSQLSSEYFDGYGWSQVNDNGFGLAYMLNNEWLHINIVNKPAKSGASVNRLHYYLSQAADEIFDALENENKRKAKL

SEQ ID NO: 3941 - DNA, 25 bp, Artificial sequence
  primer
atgccaaacttaaagagactaccca

SEQ ID NO: 3942 - DNA, 21 bp, Artificial sequence
  primer
tcaaccggacacgctcacgtc

SEQ ID NO: 3943 - protein, 781 aa, Artificial sequence
  consensus sequence
  Variant (2)..(3): Xaa in position 2 to 3 is any amino acid
  Variant (6)..(6): Xaa in position 6 is any amino acid
  Variant (8)..(8): Xaa in position 8 is any amino acid
  Variant (10)..(11): Xaa in position 10 to 11 is any amino acid
  Variant (13)..(15): Xaa in position 13 to 15 is any amino acid
  Variant (18)..(21): Xaa in position 18 to 21 is any amino acid
  Variant (23)..(31): Xaa in position 23 to 31 is any amino acid
  Variant (32)..(44): Xaa in position 32 to 44 is any or no amino acid
  Variant (46)..(48): Xaa in position 46 to 48 is any amino acid
  Variant (50)..(58): Xaa in position 50 to 58 is any amino acid
  Variant (59)..(74): Xaa in position 59 to 74 is any or no amino acid
  Variant (76)..(78): Xaa in position 76 to 78 is any amino acid
  Variant (80)..(93): Xaa in position 80 to 93 is any amino acid
  Variant (94)..(99): Xaa in position 94 to 99 is any or no amino acid
  Variant (101)..(103): Xaa in position 101 to 103 is any amino acid
  Variant (104)..(104): Xaa in position 104 is any or no amino acid
  Variant (107)..(116): Xaa in position 107 to 116 is any amino acid
  Variant (118)..(133): Xaa in position 118 to 133 is any amino acid
  Variant (134)..(159): Xaa in position 134 to 159 is any or no amino acid
  Variant (163)..(163): Xaa in position 163 is any amino acid
  Variant (165)..(168): Xaa in position 165 to 168 is any amino acid
  Variant (170)..(170): Xaa in position 170 is any amino acid
  Variant (172)..(179): Xaa in position 172 to 179 is any amino acid
  Variant (181)..(188): Xaa in position 181 to 188 is any amino acid
  Variant (189)..(190): Xaa in position 189 to 190 is any or no amino acid
  Variant (192)..(193): Xaa in position 192 to 193 is any amino acid
  Variant (195)..(196): Xaa in position 195 to 196 is any amino acid
  Variant (198)..(199): Xaa in position 198 to 199 is any amino acid
  Variant (202)..(204): Xaa in position 202 to 204 is any amino acid
  Variant (206)..(206): Xaa in position 206 is any amino acid
  Variant (208)..(221): Xaa in position 208 to 221 is any amino acid
  Variant (222)..(230): Xaa in position 222 to 230 is any or no amino acid
  Variant (234)..(240): Xaa in position 234 to 240 is any amino acid
  Variant (242)..(263): Xaa in position 242 to 263 is any amino acid
  Variant (264)..(276): Xaa in position 264 to 276 is any or no amino acid
  Variant (278)..(287): Xaa in position 278 to 287 is any amino acid
  Variant (288)..(302): Xaa in position 288 to 302 is any or no amino acid
  Variant (304)..(304): Xaa in position 304 is any amino acid
  Variant (306)..(309): Xaa in position 306 to 309 is any amino acid
  Variant (311)..(312): Xaa in position 311 to 312 is any amino acid
  Variant (314)..(315): Xaa in position 314 to 315 is any amino acid
  Variant (316)..(316): Xaa in position 316 is any or no amino acid
  Variant (318)..(324): Xaa in position 318 to 324 is any amino acid
  Variant (325)..(327): Xaa in position 325 to 327 is any or no amino acid
  Variant (329)..(331): Xaa in position 329 to 331 is any amino acid
  Variant (333)..(339): Xaa in position 333 to 339 is any amino acid
  Variant (341)..(342): Xaa in position 341 to 342 is any amino acid
  Variant (346)..(361): Xaa in position 346 to 361 is any amino acid
  Variant (362)..(388): Xaa in position 362 to 388 is any or no amino acid
  Variant (390)..(392): Xaa in position 390 to 392 is any amino acid
  Variant (396)..(396): Xaa in position 396 is any amino acid
  Variant (399)..(399): Xaa in position 399 is any amino acid
  Variant (402)..(402): Xaa in position 402 is any amino acid
  Variant (405)..(406): Xaa in position 405 to 406 is any amino acid
  Variant (409)..(409): Xaa in position 409 is any amino acid
  Variant (412)..(414): Xaa in position 412 to 414 is any amino acid
  Variant (417)..(419): Xaa in position 417 to 419 is any amino acid
  Variant (422)..(424): Xaa in position 422 to 424 is any amino acid
  Variant (427)..(452): Xaa in position 427 to 452 is any amino acid
  Variant (453)..(486): Xaa in position 453 to 486 is any or no amino acid
  Variant (488)..(489): Xaa in position 488 to 489 is any amino acid
  Variant (491)..(516): Xaa in position 491 to 516 is any amino acid
  Variant (518)..(520): Xaa in position 518 to 520 is any amino acid
  Variant (522)..(526): Xaa in position 522 to 526 is any amino acid
  Variant (528)..(529): Xaa in position 528 to 529 is any amino acid
  Variant (530)..(530): Xaa in position 530 is any or no amino acid
  Variant (532)..(536): Xaa in position 532 to 536 is any amino acid
  Variant (537)..(537): Xaa in position 537 is any or no amino acid
  Variant (542)..(543): Xaa in position 542 to 543 is any amino acid
  Variant (545)..(547): Xaa in position 545 to 547 is any amino acid
  Variant (549)..(549): Xaa in position 549 is any amino acid
  Variant (552)..(554): Xaa in position 552 to 554 is any amino acid
  Variant (557)..(560): Xaa in position 557 to 560 is any amino acid
  Variant (564)..(564): Xaa in position 564 is any amino acid
  Variant (566)..(566): Xaa in position 566 is any amino acid
  Variant (568)..(569): Xaa in position 568 to 569 is any amino acid
  Variant (571)..(572): Xaa in position 571 to 572 is any amino acid
  Variant (577)..(578): Xaa in position 577 to 578 is any amino acid
  Variant (580)..(580): Xaa in position 580 is any amino acid
  Variant (582)..(587): Xaa in position 582 to 587 is any amino acid
  Variant (589)..(607): Xaa in position 589 to 607 is any amino acid
  Variant (608)..(608): Xaa in position 608 is any or no amino acid
  Variant (610)..(612): Xaa in position 610 to 612 is any amino acid
  Variant (614)..(622): Xaa in position 614 to 622 is any amino acid
  Variant (624)..(624): Xaa in position 624 is any amino acid
  Variant (626)..(626): Xaa in position 626 is any amino acid
  Variant (631)..(632): Xaa in position 631 to 632 is any amino acid
  Variant (634)..(648): Xaa in position 634 to 648 is any amino acid
  Variant (649)..(727): Xaa in position 649 to 727 is any or no amino acid
  Variant (729)..(739): Xaa in position 729 to 739 is any amino acid
  Variant (743)..(752): Xaa in position 743 to 752 is any amino acid
  Variant (753)..(753): Xaa in position 753 is any or no amino acid
  Variant (755)..(761): Xaa in position 755 to 761 is any amino acid
  Variant (762)..(762): Xaa in position 762 is any or no amino acid
  Variant (767)..(767): Xaa in position 767 is any amino acid
  Variant (769)..(769): Xaa in position 769 is any amino acid
  Variant (771)..(780): Xaa in position 771 to 780 is any amino acid
LXXLPXPXLXXTXXXYLXXXXPXXXXXXXXXXXXXXXXXXXXXXTXXXVXXXXXXXXXXXXXXXXXXXXXXXXXLXXXLXXXXXXXXXXXXXXXXXXXXWXXXXYLXXXXXXXXXXNXXXXXXXXXXXXXXXXXXXXXXXXXXXXXXXXXXXXXXXXXXRAAXLXXXXLXFXXXXXXXXLXXXXXXXXXXPXXMXXYXXLFXXXRXPXXXXXXXXXXXXXXXXXXXXXXXHIVXXXXXXXYXXXXXXXXXXXXXXXXXXXXXXXXXXXXXXXXXXXIXXXXXXXXXXXXXXXXXXXXXXXXXGXLXXXXRXXWXXXRXXXXXXXXXXNXXXLXXXXXXXFXXCLDXXXXXXXXXXXXXXXXXXXXXXXXXXXXXXXXXXXXXXXXXXXGXXXNRWXDKXLQXIVXXNGXAGXXXEHXXXDGXXXLRXXXXXXXXXXXXXXXXXXXXXXXXXXXXXXXXXXXXXXXXXXXXXXXXXXXXXXXXXXXXPXXLXXXXXXXXXXXXXXXXXXXXXXXXXXEXXXLXXXXXGXXXIXXXXXXSPDAXXQXXXQXAYXXXYGXXXXTYEXAXTXXFXXGRTEXXRXVXXXXXXFXXXXXXXXXXXXXXXXXXXXAXXXHXXXXXXXXXGXGXDRHLXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXXXXXXXXXSTSXXXXXXXXXXXGXXXXXXXXGFGIXYXIXXXXXXXXXXS

SEQ ID NO: 3944 - protein, 42 aa, Artificial sequence
  protein pattern
  Variant (5)..(5): Xaa in position 5 is Phe, Trp or Tyr
  Variant (6)..(6): Xaa in position 6 is any amino acid
  Variant (8)..(10): Xaa in position 8 to 10 is any amino acid
  Variant (12)..(12): Xaa in position 12 is any amino acid
  Variant (13)..(13): Xaa in position 13 is Ala or Thr
  Variant (14)..(14): Xaa in position 14 is any amino acid
  Variant (15)..(15): Xaa in position 15 is Phe or Tyr
  Variant (16)..(24): Xaa in position 16 to 24 is any amino acid
  Variant (27)..(27): Xaa in position 27 is Ala, Pro or Ser
  Variant (29)..(29): Xaa in position 29 is any amino acid
  Variant (31)..(31): Xaa in position 31 is any or no amino acid
  Variant (33)..(35): Xaa in position 33 to 35 is any amino acid
  Variant (36)..(36): Xaa in position 36 is any or no amino acid
  Variant (41)..(41): Xaa in position 41 is Ala, Ser or Thr
  Variant (42)..(42): Xaa in position 42 is Gly, Ile or Val
SPDAXXQXXXQXXXXXXXXXXXXXYEXAXTXKXXXXGRTEXX

SEQ ID NO: 3945 - protein, 30 aa, Artificial sequence
  protein pattern
  Variant (2)..(2): Xaa in position 2 is Phe, Ile or Leu
  Variant (3)..(3): Xaa in position 3 is Ile or Leu
  Variant (4)..(6): Xaa in position 4 to 6 is any amino acid
  Variant (7)..(7): Xaa in position 7 is Cys, Asp, Gly or Asn
  Variant (8)..(8): Xaa in position 8 is Ala or Gly
  Variant (9)..(9): Xaa in position 9 is any amino acid
  Variant (10)..(10): Xaa in position 10 is Ala or Ser
  Variant (12)..(13): Xaa in position 12 to 13 is any or no amino acid
  Variant (15)..(16): Xaa in position 15 to 16 is any or no amino acid
  Variant (19)..(19): Xaa in position 19 is Ser or Thr
  Variant (20)..(20): Xaa in position 20 is any amino acid
  Variant (21)..(21): Xaa in position 21 is Met or Val
  Variant (24)..(24): Xaa in position 24 is any amino acid
  Variant (25)..(25): Xaa in position 25 is Pro or Thr
  Variant (26)..(26): Xaa in position 26 is Thr or Val
  Variant (27)..(29): Xaa in position 27 to 29 is any amino acid
  Variant (30)..(30): Xaa in position 30 is Ala, Asn, Thr or Val
QXXXXXXXXXGXXFXXEHXXXDGXXXXXXX

SEQ ID NO: 3946 - protein, 45 aa, Artificial sequence
  protein pattern
  Variant (4)..(4): Xaa in position 4 is Asn or Gln
  Variant (5)..(5): Xaa in position 5 is any amino acid
  Variant (6)..(6): Xaa in position 6 is Gly or Ser
  Variant (7)..(7): Xaa in position 7 is Asn or Ser
  Variant (8)..(8): Xaa in position 8 is Glu or Pro
  Variant (9)..(9): Xaa in position 9 is any amino acid
  Variant (10)..(10): Xaa in position 10 is Phe or Leu
  Variant (11)..(12): Xaa in position 11 to 12 is any amino acid
  Variant (13)..(13): Xaa in position 13 is Phe, Trp or Tyr
  Variant (15)..(15): Xaa in position 15 is Phe or Trp
  Variant (16)..(16): Xaa in position 16 is Gly or Ser
  Variant (17)..(17): Xaa in position 17 is Glu, Pro or Gln
  Variant (18)..(18): Xaa in position 18 is Thr or Val
  Variant (19)..(20): Xaa in position 19 to 20 is any amino acid
  Variant (21)..(21): Xaa in position 21 is Asp, Glu or Asn
  Variant (23)..(23): Xaa in position 23 is Phe or Tyr
  Variant (25)..(25): Xaa in position 25 is any amino acid
  Variant (26)..(26): Xaa in position 26 is Ala or Gly
  Variant (28)..(28): Xaa in position 28 is any amino acid
  Variant (29)..(29): Xaa in position 29 is Ile or Leu
  Variant (30)..(30): Xaa in position 30 is any amino acid
  Variant (31)..(31): Xaa in position 31 is Asp, Glu or Asn
  Variant (32)..(33): Xaa in position 32 to 33 is any amino acid
  Variant (34)..(34): Xaa in position 34 is Ile, Leu or Val
  Variant (35)..(35): Xaa in position 35 is any amino acid
  Variant (36)..(36): Xaa in position 36 is Phe, Ile, Met or Val
  Variant (37)..(37): Xaa in position 37 is Cys, Asn, Thr or Val
  Variant (38)..(38): Xaa in position 38 is Ala, Ile, Leu or Val
  Variant (39)..(39): Xaa in position 39 is Ala, Ser, Thr or Val
  Variant (40)..(40): Xaa in position 40 is Cys, Asn or Ser
  Variant (41)..(44): Xaa in position 41 to 44 is any amino acid
  Variant (45)..(45): Xaa in position 45 is Ala, Ser or Thr
STSXXXXXXXXXXGXXXXXXXGXGXXYXXXXXXXXXXXXXXXXXX

SEQ ID NO: 3947 - protein, 32 aa, Artificial sequence
  protein pattern
  Variant (2)..(3): Xaa in position 2 to 3 is any amino acid
  Variant (4)..(4): Xaa in position 4 is any or no amino acid
  Variant (6)..(7): Xaa in position 6 to 7 is any amino acid
  Variant (8)..(8): Xaa in position 8 is any or no amino acid
  Variant (10)..(10): Xaa in position 10 is Ala, Asn, Ser, Thr or Val
  Variant (11)..(15): Xaa in position 11 to 15 is any amino acid
  Variant (16)..(16): Xaa in position 16 is Ala, Cys or Ser
  Variant (17)..(17): Xaa in position 17 is Ala or Ser
  Variant (18)..(18): Xaa in position 18 is any amino acid
  Variant (19)..(19): Xaa in position 19 is Ala or Gly
  Variant (20)..(20): Xaa in position 20 is any amino acid
  Variant (22)..(22): Xaa in position 22 is any amino acid
  Variant (25)..(25): Xaa in position 25 is His or Tyr
  Variant (26)..(26): Xaa in position 26 is Phe, Leu or Met
  Variant (27)..(27): Xaa in position 27 is any amino acid
  Variant (28)..(28): Xaa in position 28 is Ala or Gly
  Variant (29)..(29): Xaa in position 29 is Leu or Met
  Variant (30)..(31): Xaa in position 30 to 31 is any amino acid
  Variant (32)..(32): Xaa in position 32 is Ile, Leu, Met or Val
LXXXAXXXHXXXXXXXXXXXGXDRXXXXXXXX

SEQ ID NO: 3948 - protein, 16 aa, Artificial sequence
  protein pattern
  Variant (2)..(2): Xaa in position 2 is Ile, Leu or Val
  Variant (4)..(4): Xaa in position 4 is Ala, Ile or Val
  Variant (5)..(5): Xaa in position 5 is Phe, Ile, Leu, Met or Val
  Variant (6)..(7): Xaa in position 6 to 7 is any amino acid
  Variant (8)..(8): Xaa in position 8 is Gly, Asn or Ser
  Variant (9)..(12): Xaa in position 9 to 12 is any amino acid
  Variant (13)..(13): Xaa in position 13 is Phe, Leu or Val
  Variant (14)..(14): Xaa in position 14 is Asp, Glu or Pro
  Variant (15)..(15): Xaa in position 15 is Ala, Leu or Val
  Variant (16)..(16): Xaa in position 16 is Leu or Val
HXVXXXXXXXXXXXXX

SEQ ID NO: 3949 - protein, 17 aa, Artificial sequence
  protein pattern
  Variant (2)..(2): Xaa in position 2 is any amino acid
  Variant (3)..(3): Xaa in position 3 is Ala, Cys, Asp or Ser
  Variant (5)..(6): Xaa in position 5 to 6 is any amino acid
  Variant (7)..(7): Xaa in position 7 is Phe or Tyr
  Variant (8)..(9): Xaa in position 8 to 9 is any amino acid
  Variant (10)..(10): Xaa in position 10 is Leu or Met
  Variant (11)..(11): Xaa in position 11 is Phe or Tyr
  Variant (12)..(12): Xaa in position 12 is Ala, Gly or Asn
  Variant (13)..(13): Xaa in position 13 is any amino acid
  Variant (14)..(14): Xaa in position 14 is Ala, Cys, Asn, Ser or Thr
  Variant (16)..(16): Xaa in position 16 is Ile, Leu or Val
PXXMXXXXXXXXXXRXP

SEQ ID NO: 3950 - protein, 10 aa, Artificial sequence
  protein pattern
  Variant (2)..(2): Xaa in position 2 is Asp or Thr
  Variant (3)..(3): Xaa in position 3 is Cys, Gly or Ser
  Variant (4)..(4): Xaa in position 4 is any amino acid
  Variant (7)..(7): Xaa in position 7 is Phe or Trp
  Variant (8)..(8): Xaa in position 8 is Phe or Tyr
GXXXNRXXDK

SEQ ID NO: 3951 - protein, 13 aa, Artificial sequence
  protein pattern
  Variant (3)..(3): Xaa in position 3 is Ile or Val
  Variant (5)..(5): Xaa in position 5 is any amino acid
  Variant (7)..(8): Xaa in position 7 to 8 is any amino acid
  Variant (10)..(12): Xaa in position 10 to 12 is any amino acid
LPXPXLXXTXXXY

SEQ ID NO: 3952 - protein, 15 aa, Artificial sequence
  protein pattern
  Variant (2)..(2): Xaa in position 2 is any amino acid
  Variant (3)..(3): Xaa in position 3 is Phe or Leu
  Variant (4)..(4): Xaa in position 4 is Ser or Thr
  Variant (5)..(5): Xaa in position 5 is Ser, Thr or Val
  Variant (6)..(7): Xaa in position 6 to 7 is any amino acid
  Variant (9)..(10): Xaa in position 9 to 10 is any amino acid
  Variant (12)..(12): Xaa in position 12 is Ala, Ser or Thr
  Variant (13)..(14): Xaa in position 13 to 14 is any amino acid
GXXXXXXRXXWXXXR

SEQ ID NO: 3953 - DNA, 435 bp, Saccharomyces cerevisiae
  CDS (1)..(435)
atgaataccaacgagtccgaacatgttagcacaagcccagaggatactcaggagaacggtggaaacgctagctccagcggcagtttgcagcaaatttccacgctaagagagcaggacagatggctacccatcaacaatgtagcgcgactcatgaagaatactctcccaccgagtgctaaggtatcgaaagatgcgaaagagtgcatgcaggagtgtgtcagtgagctcatttcttttgtgactagcgaggccagcgatcgatgcgctgctgacaaaagaaagacgataaacggggaagacattctcatatcattgcacgccttaggattcgagaactatgcagaggtgttgaaaatctacttggctaaatacaggcaacaacaggcgctgaagaatcaactaatgtatgagcaggacgacgaagaggtgccttga

SEQ ID NO: 3954 - protein, 144 aa, Saccharomyces cerevisiae [sequence omitted]

SEQ ID NO: 3955 - DNA, 375 bp, Oryza sativa (japonica cultivar-group)
  CDS (1)..(375)
atgatgatgatggatctagggtttttggagggcggcgcggggatggcggacgcggggcacgacgagagcgggagcccgccgaggagcggcggggtgagggagcaggacaggttcctgcccatcgccaacatcagccgcatcatgaagaaggccgtcccggcgaacggcaagatcgccaaggacgccaaggagaccctgcaggagtgcgtctcggagttcatctccttcgtcaccagcgaggcgagcgacaaatgtcagaaggagaagcgcaagaccatcaacggggaagatctcctctttgcgatgggtacgcttggctttgaggagtacgttgatccgttgaagatctatttacacaagtacagagaggtgtag

SEQ ID NO: 3956 - protein, 124 aa, Oryza sativa (japonica cultivar-group)
MMMMDLGFLEGGAGMADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREV

SEQ ID NO: 3957 - DNA, 765 bp, Oryza sativa (japonica cultivar-group)
  CDS (1)..(765)
atggaggccggctacccgggcacggcggcgaacggcgctgccgccgacgggaacggtggcgcgcagcaggcggcggccgcgccggctatacgtgagcaggaccggctgatgccgatcgcgaacgtgatccgcatcatgcgccgcgtgctcccggcgcacgccaagatctcggacgacgccaaggagacgatccaggagtgcgtgtcggagtacatcagcttcatcaccggggaggccaacgagcggtgccagcgcgagcagcgcaagaccatcaccgccgaggacgtgctctgggccatgagccgcctcggcttcgacgactacgtcgagcccctcggcgtctacctccaccgctaccgcgagttcgagggggagtcccgcggcgtcggcgtcggcgtcggcgccgcgcgcggcgaccaccaccatggtcacgtcggtgggatgctcaagtcccgcgcgcagggctccatggtgacgcaccacgacatgcagatgcacgccgccatgtacggtggcggcgcggtgccgccgccgccgcatcctcctccgcaccaccacgcgttccaccagctcatgccgccgcaccacggccagtacgcgccgccgtacgacatgtacggcggcgagcacgggatggcggcgtactacggcgggatgtacgcgcccggcagcggcggcgacgggagcggcagcagcggcagcggtggcgccggcacgccgcagaccgtcaacttcgagcaccagcatccgttcggatacaagtag

SEQ ID NO: 3958 - protein, 254 aa, Oryza sativa (japonica cultivar-group)
MEAGYPGTAANGAAADGNGGAQQAAAAPAIREQDRLMPIANVIRIMRRVLPAHAKISDDAKETIQECVSEYISFITGEANERCQREQRKTITAEDVLWAMSRLGFDDYVEPLGVYLHRYREFEGESRGVGVGVGAARGDHHHGHVGGMLKSRAQGSMVTHHDMQMHAAMYGGGAVPPPPHPPPHHHAFHQLMPPHHGQYAPPYDMYGGEHGMAAYYGGMYAPGSGGDGSGSSGSGGAGTPQTVNFEHQHPFGYK

SEQ ID NO: 3959 - DNA, 660 bp, Oryza sativa (japonica cultivar-group)
  CDS (1)..(660)
atgccggactcggacaacgactccggcgggccgagcaactacgcgggaggggagctgtcgtcgccgcgggagcaggacaggttcctgccgatcgcgaacgtgagcaggatcatgaagaaggcgctgccggcgaacgccaagatcagcaaggacgccaaggagacggtgcaggagtgcgtctccgagttcatctccttcatcaccggcgaggcctccgacaagtgccagcgcgagaagcgcaagaccatcaacggcgacgacctgctctgggccatgaccaccctcggcttcgaggactacgtcgaccccctcaagcactacctccacaagttccgcgagatcgagggcgagcgcgccgccgcctccaccaccggcgccggcaccagcgccgcctccaccacgccgccgcagcagcagcacaccgccaatgccgccggcggctacgccgggtacgccgccccgggagccggccccggcggcatgatgatgatgatggggcagcccatgtacggctcgccgccaccgccgccacagcagcagcagcagcaacaccaccacatggcaatgggaggaagaggcggcttcggtcatcatcccggcggcggcggcggcgggtcgtcgtcgtcgtcggggcacggtcggcaaaacaggggcgcttga

SEQ ID NO: 3960 - protein, 219 aa, Oryza sativa (japonica cultivar-group)
MPDSDNDSGGPSNYAGGELSSPREQDRFLPIANVSRIMKKALPANAKISKDAKETVQECVSEFISFITGEASDKCQREKRKTINGDDLLWAMTTLGFEDYVDPLKHYLHKFREIEGERAAASTTGAGTSAASTTPPQQQHTANAAGGYAGYAAPGAGPGGMMMMMGQPMYGSPPPPPQQQQQQHHHMAMGGRGGFGHHPGGGGGGSSSSSGHGRQNRGA

SEQ ID NO: 3961 - DNA, 390 bp, Oryza sativa (japonica cultivar-group)
  CDS (1)..(390)
atggcggatgggccggggagcccggggggaggaggggggagccacgagagcgggagcccgagggggggagggggaggagggggaggtgggggtgggggtgggggggtgagggagcaggacaggttcctccccatcgccaacatcagccgcatcatgaagaaggccatcccggccaacgggaagatcgccaaggacgccaaggagaccgtgcaggagtgcgtctccgagttcatctccttcatcaccagcgaggcgagcgataaatgccagagggagaagcgcaagaccatcaacggcgacgacttgctgtgggcgatggccacgctgggcttcgaggactacatcgagcccctcaaggtctacctgcagaagtacagagaggtgcggtga

SEQ ID NO: 3962 - protein, 129 aa, Oryza sativa (japonica cultivar-group)
MADGPGSPGGGGGSHESGSPRGGGGGGGGGGGGGGVREQDRFLPIANISRIMKKAIPANGKIAKDAKETVQECVSEFISFITSEASDKCQREKRKTINGDDLLWAMATLGFEDYIEPLKVYLQKYREVR

SEQ ID NO: 3963 - DNA, 753 bp, Oryza sativa (japonica cultivar-group)
  CDS (1)..(753)
atggagcccgcatttcccaacggaggtgcggctgctccaccaccgcccatggcggcggagcagctgccgccggcggcggcggtggtccgggagcaggaccgcctgatgccgatcgcgaacgtgatccgcatcatgcggcgcgtgctcccgccgcacgccaagatctccgacgacgccaaggaggtgatccaggagtgcgtgtcggagttcatcagcttcgtcaccggcgaggccaacgaccggtgccaccgcgagcaccgcaagacggtcaccgccgaggacctcgtctgggccatggaccgcctcggcttcgacgactacgtcccgccgctcaccgcctacctccgccgcatgcgcgagtacgagggcggcggatcaggtggtggtggtggtggtggccgtggcgccgccgccgcccccgccgtcgtgccgccgccgccgccgccgcctcccgaggacgcgttccgctacgtgcaggtccatcatcccgtgtacgcggcgccaggtgagccggtgcaggggtacggttaccccgtggccatgtcgtctgctctgccggcgccgcacgtgcacgtcggcgtccgcggcggcgggcagcacgaggtgttcggtggcgggccggcgcccctggctgtctactacggaggagcgccgtacggcgaggccagcagccgcggcggctgctctgccgccgacgaggggagctcgtcgtcgagcgcctcgccggcgccggtcggccccaactatgagtaa

SEQ ID NO: 3964 - protein, 250 aa, Oryza sativa (japonica cultivar-group)
MEPAFPNGGAAAPPPPMAAEQLPPAAAVVREQDRLMPIANVIRIMRRVLPPHAKISDDAKEVIQECVSEFISFVTGEANDRCHREHRKTVTAEDLVWAMDRLGFDDYVPPLTAYLRRMREYEGGGSGGGGGGGRGAAAAPAVVPPPPPPPPEDAFRYVQVHHPVYAAPGEPVQGYGYPVAMSSALPAPHVHVGVRGGGQHEVFGGGPAPLAVYYGGAPYGEASSRGGCSAADEGSSSSSASPAPVGPNYE

SEQ ID NO: 3965 - DNA, 675 bp, Oryza sativa (japonica cultivar-group)
  CDS (1)..(675)
atgccggattcggacaacgagtcaggggggccgagcaacgcgggggagtacgcgtcggcgagggagcaggacaggttcctgccgatcgcgaacgtgagcaggatcatgaagagggcgctcccggcgaacgccaagatcagcaaggacgccaaggagacggtgcaggagtgcgtctcggagttcatctccttcatcaccggcgaggcctccgacaagtgccagcgggagaagcgcaagaccatcaacggcgacgacctcctctgggcgatgaccacgctcggcttcgaggactacatcgacccgctcaagctctacctccacaagttccgcgagctcgagggcgagaaggccatcggcgccgccggcagcggcggcggtggcgccgcctcctccggcggctccggctccggctccggctcgcaccaccaccaggatgcttcccggaacaatggcggatacggcatgtacggcggcggcggcggcatgatcatgatgatgggacagcctatgtacggctcgccgccggcgtcgtcagctgggtacgcgcagccgccgccgccccaccaccaccaccaccagatggtgatgggagggaaaggtgcgtatggccatggcggcggcggcggcggcgggccctccccgtcgtcgggatacggccggcaagacaggctatga

SEQ ID NO: 3966 - protein, 224 aa, Oryza sativa (japonica cultivar-group)
MPDSDNESGGPSNAGEYASAREQDRFLPIANVSRIMKRALPANAKISKDAKETVQECVSEFISFITGEASDKCQREKRKTINGDDLLWAMTTLGFEDYIDPLKLYLHKFRELEGEKAIGAAGSGGGGAASSGGSGSGSGSHHHQDASRNNGGYGMYGGGGGMIMMMGQPMYGSPPASSAGYAQPPPPHHHHHQMVMGGKGAYGHGGGGGGGPSPSSGYGRQDRL

SEQ ID NO: 3967 - DNA, 618 bp, Arabidopsis thaliana
  CDS (1)..(618)
atggcagagggcagtatgcgtcctccagaattcaaccagcctaacaaaaccagtaatggtggtgaggaggagtgcacggtgagggagcaagacaggttcatgcctattgccaacgtgatacggatcatgcggaggatcttacctgctcacgccaagatctcagatgactccaaggagacgatccaagagtgtgtttcggagtacatcagcttcataacaggggaggctaatgagcggtgccagcgggaacagcgcaagaccatcactgctgaggacgtcttgtgggcaatgagcaagctcggttttgatgactacatcgaacccctcacgttgtacctccaccgctacagagagttggaaggtgaaagaggggttagctgcagtgctgggtccgttagtatgaccaacggcttggtggtcaagaggcctaatgggaccatgaccgagtatggagcctacgggcctgtgccagggattcacatggcgcagtaccattatcgtcatcagaacgggtttgttttcagtggtaacgaacctaattctaagatgagtggttcatcttcaggagcaagtggcgccagagttgaagtatttccgactcaacaacataagtactga

SEQ ID NO: 3968 - protein, 205 aa, Arabidopsis thaliana
MAEGSMRPPEFNQPNKTSNGGEEECTVREQDRFMPIANVIRIMRRILPAHAKISDDSKETIQECVSEYISFITGEANERCQREQRKTITAEDVLWAMSKLGFDDYIEPLTLYLHRYRELEGERGVSCSAGSVSMTNGLVVKRPNGTMTEYGAYGPVPGIHMAQYHYRHQNGFVFSGNEPNSKMSGSSSGASGARVEVFPTQQHKY

SEQ ID NO: 3969 - DNA, 687 bp, Arabidopsis thaliana
  CDS (1)..(687)
atggccgaatcgcaaaccggtggtggtggtggtggaagccatgagagtggcggtgatcagagcccgaggtctttgaatgttcgtgagcaggacaggtttcttccgattgctaacataagccgtatcatgaagagaggtttacctctaaatggcaaaatcgctaaagatgctaaagagactatgcaggaatgtgtctctgaattcatcagcttcgtcaccagcgaggctagtgataagtgccaaagagagaaaaggaagaccatcaatggagatgatttgctttgggctatggccactttaggattcgaagattacatcgatcccctcaaggtttacctgatgcgatatagagagatggagggtgacactaaaggatcaggaaaaggcggggaatcgagtgcaaagagagatggtcaaccaagccaagtgtctcagttctcgcaggttcctcaacaaggctcattctcacagggtccttatggaaactctcaatctctgaggttcggcaatagcatcgagcatcttgaagtgttaatgagtagtactaggacactattcatcacaatcttccgagactcgactatgcctgttgtgtctgagaatctgagtgatccactttccatagatatggattgtgaagctatttatcaccacttcattggcctgttgattctttcatgcaagtga

SEQ ID NO: 3970 - protein, 228 aa, Arabidopsis thaliana
MAESQTGGGGGGSHESGGDQSPRSLNVREQDRFLPIANISRIMKRGLPLNGKIAKDAKETMQECVSEFISFVTSEASDKCQREKRKTINGDDLLWAMATLGFEDYIDPLKVYLMRYREMEGDTKGSGKGGESSAKRDGQPSQVSQFSQVPQQGSFSQGPYGNSQSLRFGNSIEHLEVLMSSTRTLFITIFRDSTMPVVSENLSDPLSIDMDCEAIYHHFIGLLILSCK

SEQ ID NO: 3971 - DNA, 339 bp, Arabidopsis thaliana
  CDS (1)..(339)
atggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggaggtatggtga

SEQ ID NO: 3972 - protein, 112 aa, Arabidopsis thaliana
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYREVW

SEQ ID NO: 3973 - DNA, 585 bp, Magnaporthe grisea 70-15
  CDS (1)..(585)
atgtcggactcaccccaatccaatcccaaggagatcgaaggagcacacactcccgacgaggaagcacagatgaacgatcctcaggacccacagtctgccggcctcggctacgagtttgaggtcaaggagcaagatcgttggctgccaattgcaaatgtggcccgtattatgaaaaatgcactgcctgacaatgcaaagattgcaaaagaggccaaggaatgcatgcaagaatgtgtcagcgagtttatctcgtttattacaagtgaagcctccgagaaatgtcaccaagagaagcgaaagacggtgaatggagaggatatcttgttcgcaatgacgtctctcggctttgagaactacagtgaggctttgaagatctatcttgccaagtaccgtgagggccagcaaaacagacctagtagtcaaggctatggcgcgccgcctggcgccgcacctgggaccaacgctacagcaggttttcccggcggagagctcgggcaacagggaaccgaagctcctggagatgcctccggatatctctacagcacacaacctggacacaatggtgccaccgcgggtgaatactga

SEQ ID NO: 3974 - protein, 194 aa, Magnaporthe grisea 70-15
MSDSPQSNPKEIEGAHTPDEEAQMNDPQDPQSAGLGYEFEVKEQDRWLPIANVARIMKNALPDNAKIAKEAKECMQECVSEFISFITSEASEKCHQEKRKTVNGEDILFAMTSLGFENYSEALKIYLAKYREGQQNRPSSQGYGAPPGAAPGTNATAGFPGGELGQQGTEAPGDASGYLYSTQPGHNGATAGEY

SEQ ID NO: 3975 - DNA, 357 bp, Candida glabrata CBS 138
  CDS (1)..(357)
atggggaacactacagaggacgatatcgacaagcagatagaattgagggagcaagacaggtggttacccatcaataatgttgcgcgtttgatgaagaacacactaccagagactgcgaaagtttccaagagtgcgaaggagtgtatgcaagaatgtgtgagcgagttcatttcatttgtaacaagtgaggccagtgataggtgtgcgcaggatcgcaggaagaccatcaatggtgaggatattcttatatccttgcatgcattaggatttgaaaactatgctgaagtgcttaagatatacttggctaaatacaggcagcagcaagctctaaagaacaactacgaagaggactcataa

SEQ ID NO: 3976 - protein, 118 aa, Candida glabrata CBS 138
MGNTTEDDIDKQIELREQDRWLPINNVARLMKNTLPETAKVSKSAKECMQECVSEFISFVTSEASDRCAQDRRKTINGEDILISLHALGFENYAEVLKIYLAKYRQQQALKNNYEEDS

SEQ ID NO: 3977 - DNA, 660 bp, Aspergillus nidulans FGSC A4
  CDS (1)..(660)
atgtcgtcgacctctccctccaaggagcccgaggtggaacaggaacctcaatcgggtgaagaacacgagcaaatggacaaggaacaagataaccaaacgcaaggtcagggagagttcgaggtgaaggaacaagacagatggctaccaatcgcaaatgttgcgcgcatcatgaaattagcattgccagagaatgcaaagattgcaaaagaagctaaagaatgcatgcaagaatgcgtgagcgaattcatctcttttattactagcgaggcttccgaaaaatgtcaacaggaaaaacgcaagacagtcaatggagaggacatcctgtttgctatgacctcgcttggctttgaaaactatgctgaggccctcaaaatctatttgtcgaaatatcgagagactcagtctgccaggggagagcatcagaatcggccgccaagtagtgggtatgccgggggcggacccgtcggcggagctgccagcggcccttcagtcgtgcgtgccgggggtgctgcagctggaggcgccttccccgaagcctctgataatgcaggcagcattatgaatcagggcttggacccatctgagcaggacgcctcagcttatggataccctcccatggttggccaaggtcataacggagctggtggcgaatcttattag

SEQ ID NO: 3978 - protein, 219 aa, Aspergillus nidulans FGSC A4
MSSTSPSKEPEVEQEPQSGEEHEQMDKEQDNQTQGQGEFEVKEQDRWLPIANVARIMKLALPENAKIAKEAKECMQECVSEFISFITSEASEKCQQEKRKTVNGEDILFAMTSLGFENYAEALKIYLSKYRETQSARGEHQNRPPSSGYAGGGPVGGAASGPSVVRAGGAAAGGAFPEASDNAGSIMNQGLDPSEQDASAYGYPPMVGQGHNGAGGESY

SEQ ID NO: 3979 - DNA, 576 bp, Cryptococcus neoformans var. neoformans B-3501A
  CDS (1)..(576)
atgtcagaacatacaaacctcaaaagccttgccccgctaggcaaccaacccgagccctccgctaattcggcaggagtaggcccctcgaagccatttacagaggctcaggttgaggagtttcgagaacaagatcgttggctgccgattgcgaacgtggcgcgaatcatgaagtcttcattaccaacttcagccaaagtgtcgaaggaagccaaggaatgtgtccaagaatgtgtgtcggaatttatctcttttatcacatcagaagcggctgaaaaatgtctgaatgaaaagaggaagacgttaaacggggaggatatacttacatccatgcgcgcgttggggttcgacaattatgagggtgttttgagagtgtacctggcgaaatatcgcgattcacatcattccataccaaaacgcaacgcgcaacacgaagacgacgacgaggaagttcaagatgggcgaaaaaagcgcggacgggggaggcaaccagctggcggcaccatttcgaccaacggccatgcagaggggacaaagtctaaacgaaaaagaagtgatgacgggaaaggtgtacgatag

SEQ ID NO: 3980 - protein, 191 aa, Cryptococcus neoformans var. neoformans B-3501A
MSEHTNLKSLAPLGNQPEPSANSAGVGPSKPFTEAQVEEFREQDRWLPIANVARIMKSSLPTSAKVSKEAKECVQECVSEFISFITSEAAEKCLNEKRKTLNGEDILTSMRALGFDNYEGVLRVYLAKYRDSHHSIPKRNAQHEDDDEEVQDGRKKRGRGRQPAGGTISTNGHAEGTKSKRKRSDDGKGVR

SEQ ID NO: 3981 - DNA, 642 bp, Theobroma cacao
  CDS (1)..(642)
atggaacgtggaggcttccatggctaccgcaagctccccaacaacactacttccggactgaaggtaccagagatgaacatgagaatggctgaagtcaaccatacaaacaaccactcaaactctgatgacaatgagtgcactgtgagagaacaagaccgcttcatgccaattgcaaacgttatcaggatcatgcgcaagatcctccccccacacgccaaaatctctgacgacgccaaggaaacaatccaagaatgtgtgtccgagtacatcagcttcatcactggcgaagccaatgagcgctgccaacgtgagcagcgcaagactaccactgctgaggatgtgctttgggcgatgagcaagctaggcttcgatgactacatcgaacctctgacagtataccttcaccgctaccgcgagctggagggtgaacgtggttcgatcagaggtgagccactggggaagagagcagttgattatggagctttgagtgttgctgcttttgcaccggcgttccacatggggcatcaccatgggttctttgggggtggaggagccatgggaggatatctcaaggatgcatccaatgcagggtcatcacaggctgcagtggcaaacggcgaaccattcgggcaccataaatga

SEQ ID NO: 3982 - protein, 213 aa, Theobroma cacao
MERGGFHGYRKLPNNTTSGLKVPEMNMRMAEVNHTNNHSNSDDNECTVREQDRFMPIANVIRIMRKILPPHAKISDDAKETIQECVSEYISFITGEANERCQREQRKTTTAEDVLWAMSKLGFDDYIEPLTVYLHRYRELEGERGSIRGEPLGKRAVDYGALSVAAFAPAFHMGHHHGFFGGGGAMGGYLKDASNAGSSQAAVANGEPFGHHK

SEQ ID NO: 3983 - DNA, 555 bp, Medicago truncatula
  CDS (1)..(555)
atggctgattcagacaatgaatccggaggagcaccgaacgccggcaacagcgagttatcaccacgagaacaagaccgatttttaccaatagcaaacgtgagcagaataatgaagaaggcgttaccagcaaacgcgaagatctcgaaagatgctaaggaaacggtgcaggaatgtgtatcggagttcatcagcttcatcaccggtgaagcttccgataagtgtcagagagagaaacgaaagacgatcaacggcgacgatctactttgggcgatgactacgttaggatttgaagagtacgttgaaccgttgaagatttatcttcaacgattcagagagatcgaaggtgagaaaaccgttgctgcacgtgataaagatggtgttgctccatcttcttcttcgtcttcagtttttgattatggtgctcctcctcctcaagttggattgatcatgcatcatcagcatcagggacacgtgtacggttctggtggttttcatcaagtgcctggtgggcctgtttatcctaatgctggatctaatgcgggtagacccaggtag

SEQ ID NO: 3984 - protein, 184 aa, Medicago truncatula
MADSDNESGGAPNAGNSELSPREQDRFLPIANVSRIMKKALPANAKISKDAKETVQECVSEFISFITGEASDKCQREKRKTINGDDLLWAMTTLGFEEYVEPLKIYLQRFREIEGEKTVAARDKDGVAPSSSSSSVFDYGAPPPQVGLIMHHQHQGHVYGSGGFHQVPGGPVYPNAGSNAGRPR

SEQ ID NO: 3985 - DNA, 817 bp, Salvia miltiorrhiza
  CDS (135)..(737)
cacgaggtctctctctcctctctcagatttctccctcttcgcccaatcattcttctccctttttctccccttcccagcgcgccaaatacaaatcctccagggtttttttttcatcatctcttttttgaggaagaatggcggacagtcccggtggccatggcagccacgacaacggcggtggcggagatcacagcccgcagtctagcgttcgggagcaggaccgttttcttccgattgcgaacatcgggcgcataatgaagaaagggctaccgcagaatggaaagattgctaaggatgctaaagacaccgttcaggaatgtgtttcggagtttattagcttcgttaccagcgaagctagcgataaatgccagaaagagaaaagaaagacaataaacggggatgatttgttgtgggctatggcgacattaggttttgaggattacattgctccactgaaggtctacttggctaggtacagagagttagagggtgacaccaagggatctgctaggggtgcagatggagctcctaagagagatacagtcggaactcagctaggttccgatgcaagtttgctcatcaaggctcttttgctcaaggcttcggctactctaactcccaaatcgaatattaagaagcataatgttgtttggctctctacagctcatttttggctgagtctgtctcaggatacaatgttcagttgctatagcttcaaatggctgggatttctataggaaatatatacgtaatccaagtatagtttgtgcaattatccttagctatttctgatattgtatatctctgaatgctactg

SEQ ID NO: 3986 - protein, 200 aa, Salvia miltiorrhiza
MADSPGGHGSHDNGGGGDHSPQSSVREQDRFLPIANIGRIMKKGLPQNGKIAKDAKDTVQECVSEFISFVTSEASDKCQKEKRKTINGDDLLWAMATLGFEDYIAPLKVYLARYRELEGDTKGSARGADGAPKRDTVGTQLGSDASLLIKALLLKASATLTPKSNIKKHNVVWLSTAHFWLSLSQDTMFSCYSFKWLGFL

SEQ ID NO: 3987 - DNA, 558 bp, Brassica oleracea
  CDS (1)..(558)
atgggggattccgacaaggactccggtggagggcaaaacggacagtctccgttgtctcccagagagcaagacaggttcctaccgatcgctaacgtgagcaggatcatgaagaaggccttgccagcgaacgccaagatatccaaagatgctaaagagacgatgcaggagtgcgtctctgagtttataagcttcgtcacgggagaggcgtcggataagtgccagaaggagaagaggaagacgatcaacggcgatgatttgctatgggctatgaccactctagggtttgaggattacgttgagccgctgaaggtttacttgcagaggtttagggagatcgaaggggagagggctggagtggggaggccacagacaggtggtgaaggtggagagcatcagagagatgcaggtgtgggcgatggcggtggattctacggtggtgggatgcagtatcaccagcatcatcagtttcttcaccaacagaaccatatgtatggttccacaggcggtggtgggggtgacggtggaggaggagctggctccggtaggactagaacttaa

SEQ ID NO: 3988 - protein, 185 aa, Brassica oleracea
MGDSDKDSGGGQNGQSPLSPREQDRFLPIANVSRIMKKALPANAKISKDAKETMQECVSEFISFVTGEASDKCQKEKRKTINGDDLLWAMTTLGFEDYVEPLKVYLQRFREIEGERAGVGRPQTGGEGGEHQRDAGVGDGGGFYGGGMQYHQHHQFLHQQNHMYGSTGGGGGDGGGGAGSGRTRT

SEQ ID NO: 3989 - DNA, 693 bp, Brassica oleracea
  CDS (1)..(693)
atgggagacgagaaagaatcctcggttacatcgactgtggctgaacaagttgtggaggctgtgggcatttacatctttttatacatccacaaacctaaactcgtgactttgaagaaggatatggaacgtggaggcttccatggctacggcaagttctccctcaacaacaccaatccttctgaaccagccaagtttttgatggcagcgggcagcatgcagctatcagtattcaacaagcctaacaaaaccgctaatggtggcgaagaggagtgcacggtgagagagcaagacagatctcagtcctcagacgactccaaggagacgatccaagagtgtgtctctgagtacatcagcttcgtaacaagggaggccaatgagcgttgccagcgggagcagcgcaagaccgtcactgcggaggatgtgttgtgggcaatgagcaagatcggttttgatgattacattgtacctccaccgctacagagagttggaggtatgaccaacggcttggtggtgaagaggcctaatggtaccatggccgagtatggagctgtggcaggaattcacatggcgccataccattatcatcatcagaacgggtttgttttcagtgctaatgaacctaattctaaaatgggtggttcatcaagtggggccagtgttgaagtatatccgactcagcaacataagtactga

SEQ ID NO: 3990 - protein, 230 aa, Brassica oleracea
MGDEKESSVTSTVAEQVVEAVGIYIFLYIHKPKLVTLKKDMERGGFHGYGKFSLNNTNPSEPAKFLMAAGSMQLSVFNKPNKTANGGEEECTVREQDRSQSSDDSKETIQECVSEYISFVTREANERCQREQRKTVTAEDVLWAMSKIGFDDYIVPPPLQRVGGMTNGLVVKRPNGTMAEYGAVAGIHMAPYHYHHQNGFVFSANEPNSKMGGSSSGASVEVYPTQQHKY

SEQ ID NO: 3991 - DNA, 645 bp, Helianthus annuus
  CDS (1)..(645)
atggaacgtggaggaggtttccatggctaccacaggctccccatccaccctacatctgggatgcaacagccggatatgaagcagaagcaaccagacacaaccaacaccacatttacagaagacaatgagtgcattgttagagagcaagaccgctttatgccgatagcaaacgtgatcaggatcatgcgaaagatcttgccacctcacgcgaagatctctgacgacgcaaaagaaacgatccaagaatgtgtttccgagtacattagttttgtgacaggtgaagcgaatgaccgttgccaacgcgagcagagaaagactatcacagctgaagatgtgttgtgggctatgagcaaactcgggtttgatgactatatcgaaccgttgactgtgtatcttcatcgctacagggagtttgatgggggtgagcgtgggtcgataaggggtgagccgcttgtcaagagggctgcggctactgctgaccctggtccgtttggtatgggtccgtttgtgcctggttttcacatgggtcatcataatgggttctttggtcctgctagcattgctggtttctttaaggacccgtcgagtgcggctggccagtctgggcctgctggtttcgagccgtatgctcagtgtaaagactaa

SEQ ID NO: 3992 - protein, 214 aa, Helianthus annuus
MERGGGFHGYHRLPIHPTSGMQQPDMKQKQPDTTNTTFTEDNECIVREQDRFMPIANVIRIMRKILPPHAKISDDAKETIQECVSEYISFVTGEANDRCQREQRKTITAEDVLWAMSKLGFDDYIEPLTVYLHRYREFDGGERGSIRGEPLVKRAAATADPGPFGMGPFVPGFHMGHHNGFFGPASIAGFFKDPSSAAGQSGPAGFEPYAQCKD

SEQ ID NO: 3993 - DNA, 765 bp, Oryza sativa subsp
  CDS (1)..(765)
atggaggcggctacccgggcgcggcggcggaacggcgctgccgccgacgggaacggtggcgcgcaacaggcggcggccgcgccggctatacgtgagcaggaccggctgatgccgatcgcgaacgtgatccgcatcatgcgccgcgtgctcccggcgcacgccaagatctcggacgacgccaaggagacgatccaggagtgcgtgtcggagtacatcagcttcatcaccggggaggccaacgagcggtgccagcgcgagcagcgcaagaccatcaccgccgaggacgtgctctgggccatgagccgcctcggcttcgacgactacgtcgagcccctcggcgtctacctccaccgctaccgcgagttcgagggggagtcccgcggcgtcggcgtcggcgtcggcgccgcgcgcggcgaccaccaccatggtcacgtcggtgggatgctcaagtcccgcgcgcagggctccatggtgacgcaccacgacatgcagatgcacgcggccatgtacggtggcggcgcggtgccgccgccgccgcatcctcctccgcaccaccacgcgttccaccagctcatgccgccgcaccacggccagtacgcgccgccgtacgacatgtacggcggcgagcacgggatggcggcgtactacggcgggatgtacgcgcccggcagcggcggcgacgggagcggcagcagcggcagcggtggcgccggcacgccgcagaccgtcaacttcgagcaccagcatccgttcggatacaagtag

SEQ ID NO: 3994 - protein, 254 aa, Oryza sativa subsp
MEAATRARRRNGAAADGNGGAQQAAAAPAIREQDRLMPIANVIRIMRRVLPAHAKISDDAKETIQECVSEYISFITGEANERCQREQRKTITAEDVLWAMSRLGFDDYVEPLGVYLHRYREFEGESRGVGVGVGAARGDHHHGHVGGMLKSRAQGSMVTHHDMQMHAAMYGGGAVPPPPHPPPHHHAFHQLMPPHHGQYAPPYDMYGGEHGMAAYYGGMYAPGSGGDGSGSSGSGGAGTPQTVNFEHQHPFGYK

SEQ ID NO: 3995 - DNA, 624 bp, Daucus carota
  CDS (1)..(624)
atggagagagcagatcaacaggcaagaggctttcaggggtaccgaaagattcatcagcagcaacagttgcctgcttctgggacggcaagtacagggactgacaataatccagcggctggtgatcaagattgccttgtgagagaacaagataggttcatgccgattgccaatgtgatacgccttatgcggaaaagcatcccttcccatgcaaagatctctgatgatgccaaagaactggtgcaagaaagtgtgtctgagttcatcagctttgtaacaagtgaagcaaactacaggtgccagaaggagcagcggaagaccatcactgcagaagatgtgctctgggcaatgagcagtctggggtttgatgactacgtcgagccactcaccttctacctggaccgctttcgtgaggctgatgggggtgagcgcagcgcactgaggggtgagccactggtgaggaggtcaggggagcacggggcaccggggattcctccaacatttgcaccagggtactatatggggccgcataatgcgcttctaggggctgtgacaatggggagctttgtgaatgatgttcacaatgctggaccgtctggtgctggagttaatacccttgatccataa

SEQ ID NO: 3996 - protein, 207 aa, Daucus carota
MERADQQARGFQGYRKIHQQQQLPASGTASTGTDNNPAAGDQDCLVREQDRFMPIANVIRLMRKSIPSHAKISDDAKELVQESVSEFISFVTSEANYRCQKEQRKTITAEDVLWAMSSLGFDDYVEPLTFYLDRFREADGGERSALRGEPLVRRSGEHGAPGIPPTFAPGYYMGPHNALLGAVTMGSFVNDVHNAGPSGAGVNTLDP

SEQ ID NO: 3997 - DNA, 657 bp, Aspergillus niger
  CDS (1)..(657)
atgtcgtcgacctctccctcgaaggaaccggaggtggaacccgaagttcaatcgggtgaagaccaggaacaaatggataaggaacaacaagacactcaggcgcagggtcagggagagttcgaggtgaaggagcaggatagatggctaccaattgcaaatgtggcccgcatcatgaagctggctttgcctgaaaatgccaaaatcgcaaaggaggccaaggagtgtatgcaagagtgtgtgagcgagtttatctcattcatcactagcgaagcctccgagaaatgccagcaagaaaagcgcaagaccgttaacggggaggacattctattcgccatgacctccctcggctttgaaaactatgcagaggcccttaagatttacctgtccaagtatcgcgagacccaatccgccagaggcgagcaccagaaccgtccaacaagcagtggatatggtgctggcgcgcccgtaggggccccgggacctgccggtcctggtggccgtccaatggcaccaggtgcagggtttcctgatactgctgacagcgccaacaatatcatgaaccaaagcttggacccgtctgagcaggacacttccacttatggctaccccccgatggtcggccagccgcacaacggcaccgctggtgaatcttattag

SEQ ID NO: 3998 - protein, 218 aa, Aspergillus niger
MSSTSPSKEPEVEPEVQSGEDQEQMDKEQQDTQAQGQGEFEVKEQDRWLPIANVARIMKLALPENAKIAKEAKECMQECVSEFISFITSEASEKCQQEKRKTVNGEDILFAMTSLGFENYAEALKIYLSKYRETQSARGEHQNRPTSSGYGAGAPVGAPGPAGPGGRPMAPGAGFPDTADSANNIMNQSLDPSEQDTSTYGYPPMVGQPHNGTAGESY

SEQ ID NO: 3999 - DNA, 837 bp, Zea mays
  CDS (1)..(837)
atggactccagcagcttcctccctgccgccggcgcggagaatggctcggcggcgggcggcgccaacaatggcggcgctgctcagcagcatgcggcgccggcgatccgcgagcaggaccggctgatgccgatcgcgaacgtgatccgcatcatgcggcgcgtgctgccggcgcacgccaagatctcggacgacgccaaggagacgatccaggagtgcgtgtcggagtacatcagcttcatcacgggggaggccaacgagcggtgccagcgggagcagcgcaagaccatcaccgccgaggacgtgctgtgggccatgagccgcctcggcttcgacgactacgtcgagccgctcggcgcctacctccaccgctaccgcgagttcgagggcgacgcgcgcggcgtcgggctcgtcccgggggccgccccatcgcgcggcggcgaccaccacccgcactccatgtcgccagcggcgatgctcaagtcccgcgggccagtctccggagccgccatgctaccgcaccaccaccaccaccacgacatgcagatgcacgccgccatgtacgggggaacggccgtgcccccgccggccgggcctcctcaccacggcgggttcctcatgccacacccacagggtagtagccactacctgccttacgcgtacgagcccacgtacggcggtgagcacgccatggctgcatactatggaggcgccgcgtacgcgcccggcaacggcgggagcggcgacggcagtggcagtggcggcggtggcgggagcgcgtcgcacacaccgcagggcagcggcggcttggagcacccgcacccgttcgcgtacaagtag

SEQ ID NO: 4000 - protein, 278 aa, Zea mays
MDSSSFLPAAGAENGSAAGGANNGGAAQQHAAPAIREQDRLMPIANVIRIMRRVLPAHAKISDDAKETIQECVSEYISFITGEANERCQREQRKTITAEDVLWAMSRLGFDDYVEPLGAYLHRYREFEGDARGVGLVPGAAPSRGGDHHPHSMSPAAMLKSRGPVSGAAMLPHHHHHHDMQMHAAMYGGTAVPPPAGPPHHGGFLMPHPQGSSHYLPYAYEPTYGGEHAMAAYYGGAAYAPGNGGSGDGSGSGGGGGSASHTPQGSGGLEHPHPFAYK

SEQ ID NO: 4001 - DNA, 618 bp, Kluyveromyces lactis
  CDS (1)..(618)
atggatacagagacagaagctgagaagcaagagaggcataataactatcttaacgaactagcggagcaagatcgatggcttccgattaacaacgtcgcaagactaatgaaaaacacgttgccagcgaccacaaaggtatctaaagatgcgaaggaatgtatgcaagagtgcgtaagcgaattcatatcgtttgtcactagcgaggcctgtgatagatgtaccagtgggaagcgtaagactattaacggtgaagatattcttctatcgctacatgcattgggattcgagaactatgccgaagtgctcaagatttacctagcaaaatacagacaacaacaggcaataaagaatcagatgatgtaccctaaggaggatgtggaaggttcatacacagaagaagaatcaagggcagaagacgcagatcacgtgacacaggaaaggcagcaacctcttcatcctgtgccttcttcagcttccacgacgacaagcacagaggtatcggcatcagaacatgtacagtcgtcttcaaaaagcactcataatccagcacaagctcaaccacggattgtcgtccaacagccactgggatcgcgccattctactgcggatcacttgtaa

SEQ ID NO: 4002 - protein, 205 aa, Kluyveromyces lactis
MDTETEAEKQERHNNYLNELAEQDRWLPINNVARLMKNTLPATTKVSKDAKECMQECVSEFISFVTSEACDRCTSGKRKTINGEDILLSLHALGFENYAEVLKIYLAKYRQQQAIKNQMMYPKEDVEGSYTEEESRAEDADHVTQERQQPLHPVPSSASTTTSTEVSASEHVQSSSKSTHNPAQAQPRIVVQQPLGSRHSTADHL

SEQ ID NO: 4003 - DNA, 457 bp, Arabidopsis thaliana
  CDS (1)..(426)
atggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatc

SEQ ID NO: 4004 - protein, 141 aa, Arabidopsis thaliana
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYRELEGDNKGSGKSGDGSNRDAGGGVSGEEMPSW

SEQ ID NO: 4005 - DNA, 573 bp, Arabidopsis thaliana
  CDS (1)..(573)
atgggggattccgacagggattccggtggagggcaaaacgggaacaaccagaacggacagtcctccttgtctccaagagagcaagacaggttcttgccgatcgctaacgtcagccggatcatgaagaaggccttgcccgccaacgccaagatctctaaagatgccaaagagacgatgcaggagtgtgtctccgagttcatcagcttcgtcaccggagaagcatctgataagtgtcagaaggagaagaggaagacgatcaacggagacgatttgctctgggctatgactactctaggttttgaggattatgttgagccattgaaagtttacttgcagaggtttagggagatcgaaggggagaggactggactagggaggccacagactggtggtgaggtcggagagcatcagagagatgctgtcggagatggcggtgggttctacggtggtggtggtgggatgcagtatcaccaacatcatcagtttcttcaccagcagaaccatatgtatggagccacaggtggcggtagcgacagtggaggtggagctgcctccggtaggacaaggacttaa

SEQ ID NO: 4006 - protein, 190 aa, Arabidopsis thaliana
MGDSDRDSGGGQNGNNQNGQSSLSPREQDRFLPIANVSRIMKKALPANAKISKDAKETMQECVSEFISFVTGEASDKCQKEKRKTINGDDLLWAMTTLGFEDYVEPLKVYLQRFREIEGERTGLGRPQTGGEVGEHQRDAVGDGGGFYGGGGGMQYHQHHQFLHQQNHMYGATGGGSDSGGGAASGRTRT

SEQ ID NO: 4007 - DNA, 486 bp, Arabidopsis thaliana
  CDS (1)..(486)
atggcggattcggacaacgattcaggaggacacaaagacggtggaaatgcttcgacacgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttcttaa

SEQ ID NO: 4008 - protein, 161 aa, Arabidopsis thaliana
MADSDNDSGGHKDGGNASTREQDRFLPIANVSRIMKKALPANAKISKDAKETVQECVSEFISFITGEASDKCQREKRKTINGDDLLWAMTTLGFEDYVEPLKVYLQKYREVEGEKTTTAGRQGDKEGGGGGGGAGSGSGGAPMYGGGMVTTMGHQFSHHFS

SEQ ID NO: 4009 - DNA, 432 bp, Oryza sativa subsp
  CDS (1)..(432)
atgtcggaggggttcgacgggacggagaacggcggcggcggcggcggaggcggagtagggaaggagcaggaccggttcctgccgatcgccaacatcggccgcatcatgcgccgggccgtgccggagaacggcaagatcgccaaggactccaaggagtccgtccaggagtgcgtctccgagttcatcagcttcatcaccagcgaagcaagcgacaagtgcctcaaggagaagcgcaagaccatcaatggggacgacctgatctggtcaatgggcacgctcggattcgaggactatgtcgagcctctcaagctctacctcaggctctaccgggagacggagggtgacacaaagggttcaagagcttctgaactgccagtaaagaaagatgttgtacttaatggagatcctggatcatcgtttgaaggcatgtag

SEQ ID NO: 4010 - protein, 143 aa, Oryza sativa subsp
MSEGFDGTENGGGGGGGGVGKEQDRFLPIANIGRIMRRAVPENGKIAKDSKESVQECVSEFISFITSEASDKCLKEKRKTINGDDLIWSMGTLGFEDYVEPLKLYLRLYRETEGDTKGSRASELPVKKDVVLNGDPGSSFEGM

SEQ ID NO: 4011 - DNA, 483 bp, Arabidopsis thaliana
  CDS (1)..(483)
atggcggggaattatcattcgttccaaaatccaatccctcgataccagaattacaacttcgggagcagctcatctaatcatcaacatgaacatgatgggttagtggtggtggtggaggatcaacagcaagaagaaagcatgatggtaaaagaacaagacaggctacttccgatagcaaacgtaggaaggatcatgaagaacatcctcccagcaaacgcaaaggtctctaaagaagccaaagagactatgcaagaatgtgtgtccgagttcattagcttcgtcacgggagaagcatccgataaatgccacaaggagaagcgaaagaccgttaatggagacgatatctgttgggctatggctaatctagggtttgatgattacgccgcccagctcaagaagtacttacatcgttaccgagttctcgaaggtgagaaacctaatcatcacggcaaaggaggacctaaatcctcgccagataattaa

SEQ ID NO: 4012 - protein, 160 aa, Arabidopsis thaliana
MAGNYHSFQNPIPRYQNYNFGSSSSNHQHEHDGLVVVVEDQQQEESMMVKEQDRLLPIANVGRIMKNILPANAKVSKEAKETMQECVSEFISFVTGEASDKCHKEKRKTVNGDDICWAMANLGFDDYAAQLKKYLHRYRVLEGEKPNHHGKGGPKSSPDN

SEQ ID NO: 4013 - DNA, 522 bp, Arabidopsis thaliana
  CDS (1)..(522)
atggcggagtcgcaggccaagagtcccggaggctgtggaagccatgagagtggtggagatcaaagtcccaggtcgttacatgttcgtgagcaagataggtttcttccgattgctaacataagccgtatcatgaaaagaggtcttcctgctaatgggaaaatcgctaaagatgctaaggagattgtgcaggaatgtgtctctgaattcatcagtttcgtcaccagcgaagcgagtgataaatgtcaaagagagaaaaggaagactattaatggagatgatttgctttgggcaatggctactttaggatttgaagactacatggaacctctcaaggtttacctgatgagatatagagagatggagggtgacacaaagggatcagcaaaaggtggggatccaaatgcaaagaaagatgggcaatcaagccaaaatggccagttctcgcagcttgctcaccaaggtccttatgggaactctcaagctcagcagcatatgatggttccaatgccgggaacagactag

SEQ ID NO: 4014 - protein, 173 aa, Arabidopsis thaliana
MAESQAKSPGGCGSHESGGDQSPRSLHVREQDRFLPIANISRIMKRGLPANGKIAKDAKEIVQECVSEFISFVTSEASDKCQREKRKTINGDDLLWAMATLGFEDYMEPLKVYLMRYREMEGDTKGSAKGGDPNAKKDGQSSQNGQFSQLAHQGPYGNSQAQQHMMVPMPGTD

SEQ ID NO: 4015 - DNA, 612 bp, Oryza sativa
  CDS (1)..(612)
atgatgatgatggatctagggtttttggagggcggcgcggggatggcggacgcggggcacgacgagagcgggagcccgccgaggagcggcggggtgagggagcaggacaggttcctgcccatcgccaacatcagccgcatcatgaagaaggccgtcccggcgaacggcaagatcgccaaggacgccaaggagaccctgcaggagtgcgtctcggagttcatctccttcgtcaccagcgaggcgagcgacaaatgtcagaaggagaagcgcaagaccatcaacggggaagatctcctctttgcgatgggtacgcttggctttgaggagtacgttgatccgttgaagatctatttacacaagtacagagaggtaattggtgatagtaagctgtcctcaaaggctggtgatggttcagtaaagaaggatacaattggtccgcacagtggcgctagtagctcaagtgcgcaagggatggttggggcttacacccaagggatgggttatatgcaacctcagagcaattttcacatattggtagttctgcaatcttttgcattcccatacatgtatcaggtggcacaaatctattgcaagtaccctagcattgaataa

SEQ ID NO: 4016 - protein, 203 aa, Oryza sativa
MMMMDLGFLEGGAGMADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREVIGDSKLSSKAGDGSVKKDTIGPHSGASSSSAQGMVGAYTQGMGYMQPQSNFHILVVLQSFAFPYMYQVAQIYCKYPSIE

SEQ ID NO: 4017 - DNA, 537 bp, Oryza sativa
  CDS (1)..(537)
atgatgatgatggatctagggtttttggagggcggcgcggggatggcggacgcggggcacgacgagagcgggagcccgccgaggagcggcggggtgagggagcaggacaggttcctgcccatcgccaacatcagccgcatcatgaagaaggccgtcccggcgaacggcaagatcgccaaggacgccaaggagaccctgcaggagtgcgtctcggagttcatctccttcgtcaccagcgaggcgagcgacaaatgtcagaaggagaagcgcaagaccatcaacggggaagatctcctctttgcgatgggtacgcttggctttgaggagtacgttgatccgttgaagatctatttacacaagtacagagaggtaattggtgatagtaagctgtcctcaaaggctggtgatggttcagtaaagaaggatacaattggtccgcacagtggcgctagtagctcaagtgcgcaagggatggttggggcttacacccaagggatgggttatatgcaacctcagtatcataatggggacacctaa

SEQ ID NO: 4018 - protein, 178 aa, Oryza sativa
MMMMDLGFLEGGAGMADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREVIGDSKLSSKAGDGSVKKDTIGPHSGASSSSAQGMVGAYTQGMGYMQPQYHNGDT

SEQ ID NO: 4019 - DNA, 495 bp, Oryza sativa
  CDS (1)..(495)
atggcggacgcggggcacgacgagagcgggagcccgccgaggagcggcggggtgagggagcaggacaggttcctgcccatcgccaacatcagccgcatcatgaagaaggccgtcccggcgaacggcaagatcgccaaggacgccaaggagaccctgcaggagtgcgtctcggagttcatctccttcgtcaccagcgaggcgagcgacaaatgtcagaaggagaagcgcaagaccatcaacggggaagatctcctctttgcgatgggtacgcttggctttgaggagtacgttgatccgttgaagatctatttacacaagtacagagaggtaattggtgatagtaagctgtcctcaaaggctggtgatggttcagtaaagaaggatacaattggtccgcacagtggcgctagtagctcaagtgcgcaagggatggttggggcttacacccaagggatgggttatatgcaacctcagtatcataatggggacacctaa

SEQ ID NO: 4020 - protein, 164 aa, Oryza sativa
MADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREVIGDSKLSSKAGDGSVKKDTIGPHSGASSSSAQGMVGAYTQGMGYMQPQYHNGDT

SEQ ID NO: 4021 - DNA, 435 bp, Oryza sativa
  CDS (1)..(435)
atgacgaacgggcaggacaacctgctgccgatcgccaacgtgggccggatcatgaaggacgggctgccgccgcaggcgaagatatcgaagcgggccaaggagacgatccaggagtgcgcgacggagttcatcagcttcgtcaccggcgaggcgtcggagcggtgccggcgggagcggcggaagacggtgaacggcgacgacgtctgccacgccatgaggagcctcggcctcgaccactacgccgacgccatgcacaggtacctgcagaggtaccgcgagggcgaggagctcgccgcgtcgctcaacagcagcagcagcgccgccgccgccgccgccgccgccggcagcaggggcggtggcgccatacagatcgacgtgagagctgagctctccatcttcagatcaggcaacaaccaaggtcgtccaaacaattaa

SEQ ID NO: 4022 - protein, 144 aa, Oryza sativa
MTNGQDNLLPIANVGRIMKDGLPPQAKISKRAKETIQECATEFISFVTGEASERCRRERRKTVNGDDVCHAMRSLGLDHYADAMHRYLQRYREGEELAASLNSSSSAAAAAAAAGSRGGGAIQIDVRAELSIFRSGNNQGRPNN

SEQ ID NO: 4023 - DNA, 432 bp, Oryza sativa
  CDS (1)..(432)
atggcggatgggccggggagcccggggggaggaggggggagccacgagagcgggagcccgagggggggagggggaggagggggaggtgggggtgggggtgggggggtgagggagcaggacaggttcctccccatcgccaacatcagccgcatcatgaagaaggccatcccggccaacgggaagatcgccaaggacgccaaggagaccgtgcaggagtgcgtctccgagttcatctccttcatcaccagcgaggcgagcgataaatgccagagggagaagcgcaagaccatcaacggcgacgacttgctgtgggcgatggccacgctgggcttcgaggactacatcgagcccctcaaggtctacctgcagaagtacagagaggtgcgtactgatgtggatgtttggaattggggtgattctctgttgatttaa

SEQ ID NO: 4024 - protein, 143 aa, Oryza sativa
MADGPGSPGGGGGSHESGSPRGGGGGGGGGGGGGGVREQDRFLPIANISRIMKKAIPANGKIAKDAKETVQECVSEFISFITSEASDKCQREKRKTINGDDLLWAMATLGFEDYIEPLKVYLQKYREVRTDVDVWNWGDSLLI

SEQ ID NO: 4025 - DNA, 378 bp, Oryza sativa
  CDS (1)..(378)
atgtcggaggggttcgacgggacggagaacggcggcggcggcggcggaggcggagtagggaaggagcaggaccggttcctgccgatcgccaacatcggccgcatcatgcgccgggccgtgccggagaacggcaagatcgccaaggactccaaggagtccgtccaggagtgcgtctccgagttcatcagcttcatcaccagcgaagcaagcgacaagtgcctcaaggagaagcgcaagaccatcaatggggacgacctgatctggtcaatgggcacgctcggattcgaggactatgtcgagcctctcaagctctacctcaggctctaccgggaggtattggtgacacaaagggttcaagagcttctgaactgccagtaa

SEQ ID NO: 4026 - protein, 125 aa, Oryza sativa
MSEGFDGTENGGGGGGGGVGKEQDRFLPIANIGRIMRRAVPENGKIAKDSKESVQECVSEFISFITSEASDKCLKEKRKTINGDDLIWSMGTLGFEDYVEPLKLYLRLYREVLVTQRVQELLNCQ

SEQ ID NO: 4027 - DNA, 894 bp, Oryza sativa
  CDS (1)..(894)
atgaagagtaggaagagctatgggcacttgctgagcccggtgggcagcccgccgttggacaacgagtccggcgaggcggcggcggcggctgcggctggcggcggcggctgcgggagcagcgccgggtatgtcgtctacggcggcggcggcggtggggactcgccggcgaaggagcaggacaggttcctgccgatcgcgaacgtgagccgcatcatgaagcggtcgctgccggcgaacgccaagatctccaaggagtcgaaggagacggtgcaggagtgcgtgtcggagttcatcagcttcgttacaggcgaggcctccgacaagtgccagcgcgagaagcggaagaccatcaacggcgacgacctcctctgggccatgaccacgctggggttcgaggcctacgtcggcccgctcaagtcctacctcaaccgctaccgcgaggccgagggcgagaaggccgacgtgctcggcggcgccggcggcgccgccgcggcgcgccacggcgagggcggttgctgcggcggcggcggcggcggcgccgatggcgtcgtcatcgacgggcattacccgctcgccggcggcctgtcacactcacaccatggtcatcagcagcaggacggcggcggcgacgtcgggctcatgatgggcggcggcgacgccggcgtcgggtacaacgccggggccgggtcgacgacgacggcgttctacgcgccggcggcgacggcggcgtcagggaacaaggcgtactgcggcggcgacgggtcgagggtgatggagttcgagggcatcggcggcgaggaggagagcggaggcggcggcggcggcggcgagagggggttcgccggccacctccatggcgtgcaatggtttagactaaagaggaatactaattag

SEQ ID NO: 4028 - protein, 297 aa, Oryza sativa
MKSRKSYGHLLSPVGSPPLDNESGEAAAAAAAGGGGCGSSAGYVVYGGGGGGDSPAKEQDRFLPIANVSRIMKRSLPANAKISKESKETVQECVSEFISFVTGEASDKCQREKRKTINGDDLLWAMTTLGFEAYVGPLKSYLNRYREAEGEKADVLGGAGGAAAARHGEGGCCGGGGGGADGVVIDGHYPLAGGLSHSHHGHQQQDGGGDVGLMMGGGDAGVGYNAGAGSTTTAFYAPAATAASGNKAYCGGDGSRVMEFEGIGGEEESGGGGGGGERGFAGHLHGVQWFRLKRNTN

SEQ ID NO: 4029 - DNA, 504 bp, Oryza sativa
  CDS (1)..(504)
atggctggggagacgggggaaggtgggggatcccattcccaacctgagaagcagccgggccaagcggcggcggcggcgtccatggcggaggcggaggtggaggagctgcccaaggccatcgtgcggcgcctagtgaaggagaagctcgcccaggtcgccgccggaggggccgaggtcatcgtcaacaaggacgccatgtccgccttcgccgagagcgcccgcatcttcatccactacctctccgccactgccaatgacatgtgcaaagaatcaaagaggcagacgatcaacgctgatgatgtcctcaaggcactcgatgaaatggagttccctgagtttgtagagccccttaatacttctttgcaagaatttaggaacaaaaatgccgcccggagatcagaaacaacccaaaagaaagctgaaaagagaaggaaaatagataaggagtcactgccacaagaacaaaacgatgcagctgatcatggcaagactgatgaggattaa

SEQ ID NO: 4030 - protein, 167 aa, Oryza sativa
MAGETGEGGGSHSQPEKQPGQAAAAASMAEAEVEELPKAIVRRLVKEKLAQVAAGGAEVIVNKDAMSAFAESARIFIHYLSATANDMCKESKRQTINADDVLKALDEMEFPEFVEPLNTSLQEFRNKNAARRSETTQKKAEKRRKIDKESLPQEQNDAADHGKTDED

SEQ ID NO: 4031 - DNA, 513 bp, Brassica napus
  CDS (1)..(513)
atggcggactccgacaacgattctggcggccacaaggacggaggcggcgcgtcgtcgcgtgagcaggataggtttctgccgatcgcgaacgtgagccggatcatgaagaaagcattgcctgggaacgcgaagatctccaaggacgcgaaggagaccgtgcaggagtgcgtatcggagttcatcagtttcgtcaccggcgaggcgtcggacaagtgtcagagagagaagaggaagacgatcaacggcgacgatcttctctgggcgatgacgacgctggggttcgaggattacgtggagccgttgaaggtgtacctgcagaagtacagggaggtggaaggggagaggatgacgacggggagacagggggataaggaaggtggcggcggaggaggaaatggaagctccgggggatccggtggaggatacaatggaggaggagggatgtacggtgggattgtgacgatggggcatcctcatcaaggacacgtgtacggtggaagtgggataaattag

SEQ ID NO: 4032 - protein, 170 aa, Brassica napus
MADSDNDSGGHKDGGGASSREQDRFLPIANVSRIMKKALPGNAKISKDAKETVQECVSEFISFVTGEASDKCQREKRKTINGDDLLWAMTTLGFEDYVEPLKVYLQKYREVEGERMTTGRQGDKEGGGGGGNGSSGGSGGGYNGGGGMYGGIVTMGHPHQGHVYGGSGIN

SEQ ID NO: 4033 - DNA, 471 bp, Brassica napus
  CDS (1)..(471)
atggctgggaactatcattcgttcgaaaacccaatccatagattcaaaaattacaactttgggagcagctcatctcatcatcaaaatcatgatggtttattggtggaggatcaacaacaagaggaaaacatgatgataaaagaacaagacagactacttccgatagcaaacgtaggaaggatcatgaagaacattctcccaccaaacgcaaagatctctaaagaagcaaaagagactatgcaagaatgtgtgtccgagttcataagcttcgtcaccggagaagcctccgataaatgccacaaggagaagagaaagaccgtcaatggagacgatatctgttgggctatggcaaatctagggtttgatgattacgccgagcaactcaggaagtacttaaatcgttaccgagttattgaaggtgagagagccaatcatggcagaggagctaagttatcctcaccggataattaa

SEQ ID NO: 4034 - protein, 156 aa, Brassica napus
MAGNYHSFENPIHRFKNYNFGSSSSHHQNHDGLLVEDQQQEENMMIKEQDRLLPIANVGRIMKNILPPNAKISKEAKETMQECVSEFISFVTGEASDKCHKEKRKTVNGDDICWAMANLGFDDYAEQLRKYLNRYRVIEGERANHGRGAKLSSPDN

SEQ ID NO: 4035 - DNA, 693 bp, Brassica napus
  CDS (1)..(693)
atggaacgtggagctcctctctctcactatcagctacccaaatctaactctggactgaacttggaccagcacaacaactcaatcccgacaatgaccggctccatcggtgcatgcgacgacaagaacaagactatcttgccgcagcaacaaccaagcatgcctcgtgagcaagaccaatacatgccaatcgcaaacgtgataaggatcatgcgtaaaatcttaccgccacacgccaaaatctctgacgacgcaaaagaaacgattcaagaatgcgtctccgagtacatcagcttcgtgaccggtgaagctaacgagcgttgccaacgtgagcaacgtaagacaataactgctgaagatatcctttgggcaatgagcaaacttgggttcgatgattacgttggaccactcaacgtgttcattaaccggtaccgtgagttcgagaccgatcgtgggtgttcacttagaggtgagtcatcatttaaaccggtctacggaggaagtggtatggggtttcacggcccacctccaccgggttcttatggttatggtatgttggatcagtctatggtcatgggtggtggtcggtactaccataacggatcgggtccggatggatcagtaggtggtggcggtggatcttcctcttctatgaatggaatgccggtttatgaccagtatggtcagtataagtga

SEQ ID NO: 4036 - protein, 230 aa, Brassica napus
MERGAPLSHYQLPKSNSGLNLDQHNNSIPTMTGSIGACDDKNKTILPQQQPSMPREQDQYMPIANVIRIMRKILPPHAKISDDAKETIQECVSEYISFVTGEANERCQREQRKTITAEDILWAMSKLGFDDYVGPLNVFINRYREFETDRGCSLRGESSFKPVYGGSGMGFHGPPPPGSYGYGMLDQSMVMGGGRYYHNGSGPDGSVGGGGGSSSSMNGMPVYDQYGQYK

SEQ ID NO: 4037 - DNA, 516 bp, Glycine max
  CDS (1)..(516)
atggccgacggtccggctagcccaggcggcggcagccacgagagcggcgaccacagccctcgctctaacgtgcgcgagcaggacaggtacctccctatcgctaacataagccgcatcatgaagaaggcacttcctgccaacggtaaaatcgcaaaggacgccaaagagaccgttcaggaatgcgtctccgagttcatcagcttcatcaccagcgaggcctctgataagtgtcagagagaaaagagaaagactattaacggcgatgatttgctctgggcgatggccactctcggtttcgaggattatatggatcctcttaaaatttacctcactagataccgagagatggagggtgatacgaagggctctgccaagggtggagactcatctgctaagagagatgttcagccaagtcctaatgctcagcttgctcatcaaggttctttctcacaaaatgttacttacccgaattctcagggtcaacatatgatggttccaatgcaaggcccggagtag

SEQ ID NO: 4038 - protein, 171 aa, Glycine max
MADGPASPGGGSHESGDHSPRSNVREQDRYLPIANISRIMKKALPANGKIAKDAKETVQECVSEFISFITSEASDKCQREKRKTINGDDLLWAMATLGFEDYMDPLKIYLTRYREMEGDTKGSAKGGDSSAKRDVQPSPNAQLAHQGSFSQNVTYPNSQGQHMMVPMQGPE

SEQ ID NO: 4039 - DNA, 444 bp, Glycine max
  CDS (1)..(444)
atgggtgacaacaacataggcaaagtcttagagagagaaggctttaagtacaacttcacggcagctgcaagtgacacctctgcacaagatgaggtgattaaagagcaagatcggttgcttccaatagcaaatgtggggcgcatcatgaagcaaatccttcctcctaacgccaagatctcaaaggaagctaaagaaaccatgcaagaatgtgtgtccgagttcattagctttgtcactggggaagcttctgacaagtgtcacaaggagaagcgcaagaccgtgaatggcgacgatatttgctgggcccttgctaccctagggtttgatgactactctgagccacttaaaaggtacttgcataagtatagggagttcgaaggggagagagcaaatcaaaataagggtaacaacaacacttatgaaaacaacattgcaaacatataa

SEQ ID NO: 4040 - protein, 147 aa, Glycine max
MGDNNIGKVLEREGFKYNFTAAASDTSAQDEVIKEQDRLLPIANVGRIMKQILPPNAKISKEAKETMQECVSEFISFVTGEASDKCHKEKRKTVNGDDICWALATLGFDDYSEPLKRYLHKYREFEGERANQNKGNNNTYENNIANI

SEQ ID NO: 4041 - DNA, 741 bp, Linum usitatissimum
  CDS (1)..(741)
atggcggaacatgcagcaacagtcgctggtggctttcatggctatcggagcagcagcactaggcccaggccttcctccccaactgcaacagctacagggaagttgccggcagggagggtgcaagcggaggccaacaacaacactaacatgaatatgagcaagtcaattgaggcggaggagtgcacggtgagggagcaagatcggttcatgcccatcgcgaatgtgataaggataatgaggaagatactgcctccgcacgctaagatatccgacgacgccaaggagacgatacaggaatgcgtgtcagagtacataagctttataaccagtgaggccaatgagcgttgtcagcgtgagcagcgcaaaaccattaccgcagaggatattctctttgccatgagcaagcttggttttgacgactacatcgagccactcaccctttacctccaccgttttcgtgatcttgaaggagcagctgcatcctcctccagtagtactgtgcgcgtggctgatcagcacctgcgctctctcaagaggaacaccattaatggtggtctcatgctcgactatttggcctctaattcctccggctcatttcatcaccaccaccaccatggtgttggtgggctttatggagctagtgagtcccatatttccaaccgtatgccacgcggtaatggcaccagtagtaacgggaaccatgaccatccaaattttggtcaccagcagcagcataagtga

SEQ ID NO: 4042 - protein, 246 aa, Linum usitatissimum
MAEHAATVAGGFHGYRSSSTRPRPSSPTATATGKLPAGRVQAEANNNTNMNMSKSIEAEECTVREQDRFMPIANVIRIMRKILPPHAKISDDAKETIQECVSEYISFITSEANERCQREQRKTITAEDILFAMSKLGFDDYIEPLTLYLHRFRDLEGAAASSSSSTVRVADQHLRSLKRNTINGGLMLDYLASNSSGSFHHHHHHGVGGLYGASESHISNRMPRGNGTSSNGNHDHPNFGHQQQHK

SEQ ID NO: 4043 - DNA, 522 bp, Hordeum vulgare
  CDS (1)..(522)
atgccggactcggacaacgactccagtgggccgagcaacgcgggcggggagctgtcgtcgccgcgggagcaggaccgcttcctgcccatcgccaacgtcagccggatcatgaagaaggcgctcccggccaacgccaagatcagcaaggacgccaaggagacggtgcaggagtgcgtctccgagttcatctccttcatcaccggcgaggcctccgacaagtgccagcgcgagaagcgcaagaccatcaacggcgacgacctgctctgggcaatgaccaccctcggcttcgaggactacgtcgagccgcttaagtactacctccacaagttccgcgagatcgagggcgagagggcggctccctccaccaccaccaccaccgcatcaaccacgccgccgcacctgcccgagatgccaaggagcaacaatgccggcggttacgccgagtacggcagcggagccaccgtccccgccccgggaggcatgatgatgatgggccttcccacggcacgccgccagctgtaa

SEQ ID NO: 4044 - protein, 173 aa, Hordeum vulgare
MPDSDNDSSGPSNAGGELSSPREQDRFLPIANVSRIMKKALPANAKISKDAKETVQECVSEFISFITGEASDKCQREKRKTINGDDLLWAMTTLGFEDYVEPLKYYLHKFREIEGERAAPSTTTTTASTTPPHLPEMPRSNNAGGYAEYGSGATVPAPGGMMMMGLPTARRQL

SEQ ID NO: 4045 - DNA, 528 bp, Brassica napus
  CDS (1)..(528)
atggccgagtcgcagaccaagagtcccggagaccacgtgagcggcggagaccagagcccgaggtcgtcgtcgcacgtccgcgagcaagacaggtttctcccgatagcgaacataagccgaataatgaaaagagggctccctgctaatggtaagatcgctaaagacgccaaggagattctccaggagtgcgtctccgagttcatcagcttcatcaccagcgaagcgagtgataagtgccaaagagagaaacggaagaccattaatggagatgatttgctttgggctatggccactttaggatttgaagactacattgatcccctcaaggtttacctcactcgatatagagagatggagggtgacacaaagggatcagcaaagggcggggatgcgaatgcaaagaaagatgggcaatcaagccaaaatggccagttctcgcagcttgctcaccaaggctctttctcacaaggtccttacggcagctctcaaggtcagcatatgatggttccaatgccgggcacagactag

SEQ ID NO: 4046 - protein, 175 aa, Brassica napus
MAESQTKSPGDHVSGGDQSPRSSSHVREQDRFLPIANISRIMKRGLPANGKIAKDAKEILQECVSEFISFITSEASDKCQREKRKTINGDDLLWAMATLGFEDYIDPLKVYLTRYREMEGDTKGSAKGGDANAKKDGQSSQNGQFSQLAHQGSFSQGPYGSSQGQHMMVPMPGTD

SEQ ID NO: 4047 - DNA, 585 bp, Brassica napus
  CDS (1)..(585)
atgggagattccgacagagattccggcggaggacaaaccgggaacaaccaaaacggacagtcttccctgtctccgcgagagcaagacaggttcctcccgatcgctaacgtgagccggatcatgaagaaagctttgccagcaaacgccaagatctccaaagacgctaaagagacgatgcaggagtgcgtctccgagtttataagcttcgtcaccggagaggcctcggataagtgtcagaaggagaagaggaagacgatcaacggcgacgatctgctctgggcgatgaccacgctagggttcgaggattacgtggagccgctgaaggtttaccttcagaagtacagggaggtggaaggcgagaggatgactccaggagggagacagggcgataaagagggcggcggcggaagtggaggagggatgtacggtgggattgtgacgatggggacatcatcatcaaggacacgtgtacggtggaagtgggatgaattagagaatgagaaacgtctctgctctctccttgcggcagctctgacttggttaactcgaaatggctctcacaggagaatactatatgcaatgtaa

SEQ ID NO: 4048 - protein, 194 aa, Brassica napus
MGDSDRDSGGGQTGNNQNGQSSLSPREQDRFLPIANVSRIMKKALPANAKISKDAKETMQECVSEFISFVTGEASDKCQKEKRKTINGDDLLWAMTTLGFEDYVEPLKVYLQKYREVEGERMTPGGRQGDKEGGGGSGGGMYGGIVTMGTSSSRTRVRWKWDELENEKRLCSLLAAALTWLTRNGSHRRILYAM

SEQ ID NO: 4049 - DNA, 528 bp, Brassica napus
  CDS (1)..(528)
atggcggagtcgcaggccaagagtcccggaggcggtgagagcggcggagaccagagccccaggtcgtcgtcgcacgtccgcgagcaagacaggtttcttccgattgcgaacataagccgaatcatgaaaagaggtctccctgctaatgggaagatcgctaaggacgccaaggagattgtccaggagtgcgtctccgagttcatcagcttcatcaccagcgaagcgagtgataagtgccaaagagagaagcggaagaccattaatggagatgatttgctttgggctatggccactttaggttttgaagactacattgatcccctcaaggtttacctcactcgatatagagagatggagggtgacacaaagggatcagcaaagggcggggatgcgaatgcaaagaaagatgggcaatcaagccaaaatggccagttctcgcagcttgctcaccaaggctctttctcacaaggtccttacggcagctctcaaggtcagcatatgatggttccaatgccgggcacagactag

SEQ ID NO: 4050 - protein, 175 aa, Brassica napus
MAESQAKSPGGGESGGDQSPRSSSHVREQDRFLPIANISRIMKRGLPANGKIAKDAKEIVQECVSEFISFITSEASDKCQREKRKTINGDDLLWAMATLGFEDYIDPLKVYLTRYREMEGDTKGSAKGGDANAKKDGQSSQNGQFSQLAHQGSFSQGPYGSSQGQHMMVPMPGTD

SEQ ID NO: 4051 - DNA, 567 bp, Brassica napus
  CDS (1)..(567)
atggcggattccgataacgattcaggcggtcacaaggacggaggcggcgcgtcgtctcgcgagcaggacaggttcctcccgatcgcgaacgtgagccggatcatgaagaaggcgctcccggcgaacgcgaagatctcaaaggacgcgaaggagacggtgcaggagtgcgtgtcggagttcataagcttcgtcacgggggaggcgtcggacaagtgccagagagagaagaggaagacgatcaacggcgacgatcttctctgggcgatgacgacgctggggttcgaggattacgtggagccgttgaaggtttaccttcagaagtacagggaggtggaaggcgagaggatgactccaggagggagacagggcgataaagagggcggcggcggaagtggaggagggatgtacggtgggattgtgacgatggggacatcatcatcaaggacacgtgtacggtggaagtgggatgaattagagaatgagaaacgtctctgctctctccttgcggcagctctgacttggttaactcgaaatggctctcacaggagaatactatatgcaatgtaa

SEQ ID NO: 4052 - protein, 188 aa, Brassica napus
MADSDNDSGGHKDGGGASSREQDRFLPIANVSRIMKKALPANAKISKDAKETVQECVSEFISFVTGEASDKCQREKRKTINGDDLLWAMTTLGFEDYVEPLKVYLQKYREVEGERMTPGGRQGDKEGGGGSGGGMYGGIVTMGTSSSRTRVRWKWDELENEKRLCSLLAAALTWLTRNGSHRRILYAM

SEQ ID NO: 4053 - DNA, 432 bp, Brassica napus
  CDS (1)..(432)
atggcggatacgccttcgagtccagccggagacggcggagaaagcggcggcggatcggttagggagcaggaccggtacctacctatagctaatataagcaggatcatgaagaaggcgttgcctccaaacggcaagatcgggaaagatgctaaagacactgttcaggaatgcgtctctgagttcatcagcttcatcaccagcgaggcaagtgataagtgccagaaagagaagaggaaaactgtgaatggtgaggatttgctgtgggcaatggcaacgttggggtttgaggattaccttgaacccttgaaggtataccttgcgaggtacagggagttggagggagataacaaggggtcaggaaagagcggagatggatctaatagagatgcagctgctgggggtgttccgaatgaagatatgccgagctggtga

SEQ ID NO: 4054 - protein, 143 aa, Brassica napus
MADTPSSPAGDGGESGGGSVREQDRYLPIANISRIMKKALPPNGKIGKDAKDTVQECVSEFISFITSEASDKCQKEKRKTVNGEDLLWAMATLGFEDYLEPLKVYLARYRELEGDNKGSGKSGDGSNRDAAAGGVPNEDMPSW

SEQ ID NO: 4055 - DNA, 498 bp, Brassica napus
  CDS (1)..(498)
atggcggattccgacaacgattcaggcggccacaaggacggaggcggcgcgtcgtcgcgtgagcaggataggtttctgccgatcgcgaacgtgagccggatcatgaagaaagcattgccggggaacgcgaagatctccaaggacgcgaaggagaccgtgcaggagtgcgtatcggagttcatcagcttcgtcaccggcgaggcgtcggacaagtgtcagagagagaagaggaagacgatcaacggcgacgatcttctctgggcgatgacgacgctagggttcgaggattacgtggagccgttgaaggtgtacctgcagaagtacagggaggtggaaggggagaggatgacgacggggagacagggggataaggaaggtggcggcggaggaggaaatggaagctccgggggatccggaggaggagggatgtacggtgggattgtgacgatggggcatcctcatcaaggacacgtgtacggtggaagtgggataaattag

SEQ ID NO: 4056 - protein, 165 aa, Brassica napus
MADSDNDSGGHKDGGGASSREQDRFLPIANVSRIMKKALPGNAKISKDAKETVQECVSEFISFVTGEASDKCQREKRKTINGDDLLWAMTTLGFEDYVEPLKVYLQKYREVEGERMTTGRQGDKEGGGGGGNGSSGGSGGGGMYGGIVTMGHPHQGHVYGGSGIN

SEQ ID NO: 4057 - DNA, 543 bp, Brassica napus
  CDS (1)..(543)
atggcggattcacaggcaaagtcgtcggggatgagtcccggagtaggaggcggtggaagccacgagagcggcggagatcagagcccgaggtcgatgaatgttcgtgagcaggataggtttctcccgatcgctaacataagccgaatcatgaagaggggtttgcctgcaaacggcaagattgctaaagacgctaaagagactatgcaggaatgcgtctctgagttcatcagcttcgtcaccagcgaagcgagtgataagtgccagagagagaagaggaagactatcaacggagatgatttgctttgggctatgaccactttaggatttgaagagtacgttgaacctctcaagttttacctgacgagatacagagagatggagggtgacaacaagggatcaggaaaaggcggggaatcaagtgctaagagagatggtcaaccaggccaatttctgcagcagggccagcaaggctctttctcacaaggtccttatggaaacgctcaaggttcgcatatgatggttcaaatgccgaacgcagagtag

SEQ ID NO: 4058 - protein, 180 aa, Brassica napus
MADSQAKSSGMSPGVGGGGSHESGGDQSPRSMNVREQDRFLPIANISRIMKRGLPANGKIAKDAKETMQECVSEFISFVTSEASDKCQREKRKTINGDDLLWAMTTLGFEEYVEPLKFYLTRYREMEGDNKGSGKGGESSAKRDGQPGQFLQQGQQGSFSQGPYGNAQGSHMMVQMPNAE

SEQ ID NO: 4059 - DNA, 498 bp, Brassica napus
  CDS (1)..(498)
atggcggattccgacaacgattcaggcggccacaaggacggaggcggcgcgtcgtcgcgtgagcaggataggtttctgccgatcgcgaacgtgagccggatcatgaagaaagcattgccgggaaacgcgaagatctccaaggacgcgaaggagaccgtgcaggagtgcgtatcggagttcatcagcttcgtcaccggcgaggcgtccgacaagtgtcagagagagaagaggaagacgatcaacggcgacgatcttctctgggcgatgacgacgctagggttcgaggattacgtggagccgttgaaggtctacctgcagaagtacagggagttggaaggggagaggatgacgacggggagacagggggataaggaaggtggcggcggcggaggaaatggaagctccgggggatccggaggaggagggatgtacggtgggattgtgacgatggggcatcatcatcaaggacacgtgtacggtggaagtgggataaattag

SEQ ID NO: 4060 - protein, 165 aa, Brassica napus
MADSDNDSGGHKDGGGASSREQDRFLPIANVSRIMKKALPGNAKISKDAKETVQECVSEFISFVTGEASDKCQREKRKTINGDDLLWAMTTLGFEDYVEPLKVYLQKYRELEGERMTTGRQGDKEGGGGGGNGSSGGSGGGGMYGGIVTMGHHHQGHVYGGSGIN

SEQ ID NO: 4061 - DNA, 498 bp, Glycine max
  CDS (1)..(498)
atggctgagtcggacaacgactcgggaggggcgcagaacgcgggaaacagtggaaacttgagcgagttgtcgcctcgggaacaggaccggtttctccccatagcgaacgtgagcaggatcatgaagaaggccttgccggcgaacgcgaagatctcgaaggacgcgaaggagacggtgcaggaatgcgtgtcggagttcatcagcttcataacgggtgaggcgtcggacaagtgccagagggagaagcgcaagaccatcaacggcgacgatcttctctgggccatgacaaccctgggattcgaagagtacgtggagcctctgaagatttacctccagcgcttccgcgagatggagggagagaagaccgtggccgcccgcgactcttctaaggactcggcctccgcctcctcctatcatcagggacacgtgtacggctcccctgcctaccatcatcaagtgcctgggcccacttatcctgcccctggtagacccagatga

SEQ ID NO: 4062 - protein, 165 aa, Glycine max
MAESDNDSGGAQNAGNSGNLSELSPREQDRFLPIANVSRIMKKALPANAKISKDAKETVQECVSEFISFITGEASDKCQREKRKTINGDDLLWAMTTLGFEEYVEPLKIYLQRFREMEGEKTVAARDSSKDSASASSYHQGHVYGSPAYHHQVPGPTYPAPGRPR

SEQ ID NO: 4063 - DNA, 567 bp, Glycine max
  CDS (1)..(567)
atggcggactcggacaacgactccggcggcgcgcacaacgccgggaaggggagcgagatgtcgccgcgggagcaggaccggttcctgccgatcgcgaacgtgagccgcatcatgaagaaggcgctgccggcgaacgcgaagatctcgaaggacgcgaaggagacggtgcaggagtgcgtgtcggagttcatcagcttcatcaccggcgaggcctccgacaagtgccagcgggagaagcgcaagacgatcaacggcgacgacctgctctgggcgatgaccactctcggcttcgaggactacgtcgagcctctcaagggctacctccagcgcttccgagaaatggaaggagagaagacagtggcggcgcgtgacaaggacgcgcctcctcctaccaatgctaccaacagtgcctacgagagtcctagttatgctgctgctcctggtggaatcatgatgcatcagggacacgtgtacggttctgccggcttccatcaagtggctggtggtgctataaagggtgggcctgtttatcccgggcctggatccaatgccggtaggcccagataa

SEQ ID NO: 4064 - protein, 188 aa, Glycine max
MADSDNDSGGAHNAGKGSEMSPREQDRFLPIANVSRIMKKALPANAKISKDAKETVQECVSEFISFITGEASDKCQREKRKTINGDDLLWAMTTLGFEDYVEPLKGYLQRFREMEGEKTVAARDKDAPPPTNATNSAYESPSYAAAPGGIMMHQGHVYGSAGFHQVAGGAIKGGPVYPGPGSNAGRPR

SEQ ID NO: 4065 - DNA, 522 bp, Glycine max
  CDS (1)..(522)
atgtcggatgcgccaccgagcccgactcatgagagtgggggcgagcagagcccgcgcggttcgtcgtccggcgcgagggagcaggaccggtacctcccgattgccaacatcagccgcattatgaagaaggctctgcctcccaacggcaagattgcaaaggatgccaaagacaccatgcaggaatgcgtttctgagttcatcagcttcattaccagcgaggcgagtgagaaatgccagaaggagaagagaaagacaatcaatggagacgatttgctatgggccatggccactttaggatttgaagactacatagagccgcttaaggtgtacctggctaggtacagagaggcggagggtgacactaaaggatctgctagaagtggtgatggatctgctacaccagatcaagttggccttgcaggtcaaaattctcagcttgttcatcagggttcgctgaactatattggtttgcaggtgcaaccacaacatctggttatgccttcaatgcaaagccatgaatag

SEQ ID NO: 4066 - protein, 173 aa, Glycine max
MSDAPPSPTHESGGEQSPRGSSSGAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSATPDQVGLAGQNSQLVHQGSLNYIGLQVQPQHLVMPSMQSHE

SEQ ID NO: 4067 - DNA, 516 bp, Glycine max
  CDS (1)..(516)
atggctgagtcggacaacgagtccggaggtcacacggggaacgcaagcggaagcaacgaattctccggttgcagggagcaagacaggttccttccgatagcgaacgtgagcaggatcatgaagaaggcgttgccggcgaacgcgaagatctcgaaggaggcgaaggagacggtgcaggagtgcgtgtcggagttcatcagcttcataacaggagaagcgtccgataagtgccagaaggagaagaggaagacgatcaacggcgatgatctgctgtgggccatgaccacgctggggttcgaggagtacgtggagcctctcaaggtttatctgcataagtatagggagctggaaggggagaaaactgctatgatgggaaggccacatgagagggatgagggttatggtcatgcaactcctatgatgatcatgatggggcatcagcagcagcagcatcagggacacgtgtatggatctggaactactactggatcagcatcttctgcaagaactagataa

SEQ ID NO: 4068 - protein, 171 aa, Glycine max
MAESDNESGGHTGNASGSNEFSGCREQDRFLPIANVSRIMKKALPANAKISKEAKETVQECVSEFISFITGEASDKCQKEKRKTINGDDLLWAMTTLGFEEYVEPLKVYLHKYRELEGEKTAMMGRPHERDEGYGHATPMMIMMGHQQQQHQGHVYGSGTTTGSASSARTR

SEQ ID NO: 4069 - DNA, 681 bp, Glycine max
  CDS (1)..(681)
atggaaactggaggctttcacggctaccgcaagctccccaacaccaccgctgggttgaagctgtcagtgtcagacatgaacatgaggcagcaggtagcatcatcagatcacagtgcagccacaggagaggagaacgaatgcacggtgagggagcaagacaggttcatgccaatcgccaacgtgattaggatcatgcgcaagattctccctccacacgcaaaaatctcggacgatgcaaaagaaacaatccaagagtgcgtgtctgagtacatcagcttcatcacaggtgaggcgaacgagcgttgccagagggagcagcggaagaccataaccgcagaggacgtgctttgggccatgagcaagcttggattcgacgactacatcgaaccgttgaccatgtaccttcaccgctaccgtgaacttgagggtgaccgcacctctatgaggggtgaaccactcgggaagaggactgtggaatacgccacgcttggtgttgctactgcttttgtccctccaccctatcatcaccacaatgggtactttggtgctgccatgcccatggggacttacgttagggaagcgccaccaaatacagcctcctcccatcaccaccaccaccaccaccaccaccatgctcgtggaatctccaatgctcatgaaccaaatgctcgctccatataa

SEQ ID NO: 4070 - protein, 226 aa, Glycine max
METGGFHGYRKLPNTTAGLKLSVSDMNMRQQVASSDHSAATGEENECTVREQDRFMPIANVIRIMRKILPPHAKISDDAKETIQECVSEYISFITGEANERCQREQRKTITAEDVLWAMSKLGFDDYIEPLTMYLHRYRELEGDRTSMRGEPLGKRTVEYATLGVATAFVPPPYHHHNGYFGAAMPMGTYVREAPPNTASSHHHHHHHHHHARGISNAHEPNARSI

SEQ ID NO: 4071 - DNA, 657 bp, Glycine max
  CDS (1)..(657)
atggaaactggaggctttcacggctaccgcaagctccccaacaccaccgctgggttgaagctgtcagtgtcagacatgaacatgaggcagcaggtagcatcatcagatcacagtgcagccacaggagaggagaacgaatgcacggtgagggagcaagacaggttcatgccaatcgccaacgtgattaggatcatgcgcaagattctccctccacacgcaaaaatctcggacgatgcaaaagaaacaatccaagagtgcgtgtctgagtacatcagcttcatcacaggtgaggcgaacgagcgttgccagagggagcagcggaagaccataaccgcagaggacgtgctttgggccatgagcaagcttggattcgacgactacatcgaaccgttgaccatgtaccttcaccgctaccgtgaacttgagggtgaccgcacctctatgaggggtgaaccactcgggaagaggactgtggaatacgccacgcttggtgttgctactgcttttgtgcctccaccctatcatcaccacaatgggtactttggtgctgccatgcccatggggacttacgttagggaagcgccaccaaatgctgcgtcatctcatcaccatcatggaatctccaatgctcatgaaccaaatgctcgctccatataa

SEQ ID NO: 4072 - protein, 218 aa, Glycine max
METGGFHGYRKLPNTTAGLKLSVSDMNMRQQVASSDHSAATGEENECTVREQDRFMPIANVIRIMRKILPPHAKISDDAKETIQECVSEYISFITGEANERCQREQRKTITAEDVLWAMSKLGFDDYIEPLTMYLHRYRELEGDRTSMRGEPLGKRTVEYATLGVATAFVPPPYHHHNGYFGAAMPMGTYVREAPPNAASSHHHHGISNAHEPNARSI

SEQ ID NO: 4073 - DNA, 525 bp, Glycine max
  CDS (1)..(525)
atgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcagcttgttcatcagggttcgctgaactatattggtttgcaggtgcaaccacaacatctggttatgccttcaatgcaaggccatgaatag

SEQ ID NO: 4074 - protein, 174 aa, Glycine max
MSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSARPDQVGLAGQNAQLVHQGSLNYIGLQVQPQHLVMPSMQGHE

SEQ ID NO: 4075 - DNA, 522 bp, Glycine max
  CDS (1)..(522)
atgtcggatgcgccaccgagcccgactcatgagagtgggggcgagcagagcccgcgcggttcgtcgtccggcgcgagggagcaggaccggtacctcccgattgccaacatcagccgcattatgaagaaggctctgcctcccaacggcaagattgcaaaggatgccaaagacaccatgcaggaatgcgtttctgagttcatcagcttcattaccagcgaggcgagtgagaaatgccagaaggagaagagaaagacaatcaatggagacgatttgctatgggccatggccactttaggatttgaagactacatagagccgcttaaggtgtacctggctaggtacagagaggcggagggtgacactaaacgatctgctagaagcggtgatggatctgctacaccagatcaagttggccttgcaggtcaaaattctcagcttgttcatcagggttcgctgaactatattggtttgcaggtgcaaccacaacatctggttatgccttcaatgcaaagccatgaatag

SEQ ID NO: 4076 - protein, 173 aa, Glycine max
MSDAPPSPTHESGGEQSPRGSSSGAREQDRYLPIANISRIMKKALPPNGKIAKDAKDTMQECVSEFISFITSEASEKCQKEKRKTINGDDLLWAMATLGFEDYIEPLKVYLARYREAEGDTKRSARSGDGSATPDQVGLAGQNSQLVHQGSLNYIGLQVQPQHLVMPSMQSHE

SEQ ID NO: 4077 - DNA, 516 bp, Glycine max
  CDS (1)..(516)
atggccgacggtccggcgagtccaggcggcggtagccacgagagcggcgagcacagccctcgctctaacgtgcgcgagcaggacaggtacctccctatcgctaacataagccgcatcatgaagaaggcacttcctgcgaacggtaaaatcgcaaaggacgccaaagagaccgttcaggaatgcgtatccgagttcatcagcttcatcaccagcgaggcctctgataagtgtcagagagaaaagagaaagactattaacggcgatgatttgctctgggcgatggccactctcggtttcgaggattatatggatcctcttaaaatttacctcactagataccgagagatggagggtgatacgaagggctctgccaagggtggagactcatctgctaagagagatgttcagccaagtcctaatgctcagcttgctcatcaaggttctttctcacaaaatgttacttacccgaattctcagggtcaacatatgatggttccaatgcaaggcccggagtag

SEQ ID NO: 4078 - protein, 171 aa, Glycine max
MADGPASPGGGSHESGEHSPRSNVREQDRYLPIANISRIMKKALPANGKIAKDAKETVQECVSEFISFITSEASDKCQREKRKTINGDDLLWAMATLGFEDYMDPLKIYLTRYREMEGDTKGSAKGGDSSAKRDVQPSPNAQLAHQGSFSQNVTYPNSQGQHMMVPMQGPE

SEQ ID NO: 4079 - DNA, 525 bp, Glycine max
  CDS (1)..(525)
atgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaattctcagcttgttcatcagggttcgctgaactatattggtttgcaggtgcaaccacaacatctggttatgccttcaatgcaaagccatgaatag

SEQ ID NO: 4080 - protein, 174 aa, Glycine max
MSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSARPDQVGLAGQNSQLVHQGSLNYIGLQVQPQHLVMPSMQSHE

SEQ ID NO: 4081 - DNA, 483 bp, Helianthus annuus
  CDS (1)..(483)
atggcggagggtccagctagtccaggtggcggtggaagccacgagagtgggggcgacctgagcccgaggtcgtcaaatgttcgagaacaggatcggtttttgccgattgcgaatatcagtcggattatgaagaaagggttgccggctaatggcaaaatgtcaaaggatgcaaaggagactgttcaggagtgtgtttctgagtttatcagctttgtcactagtgaggcgagtgataagtgtcaaagggaaaagaggaaaactatcaacggtgatgatcttctatgggcaatggctactttagggtttgaagattatatcgaaccactcaagttatacttgactagatacagagagatggagggtgacaccaagggatctgggaagggtcatgaagggtcttccaagaaagatggagtgcatcccaatcatagtgcacaggcccaacctcaacatatgatggtccccatgcaacgcacagagtag

SEQ ID NO: 4082 - protein, 160 aa, Helianthus annuus
MAEGPASPGGGGSHESGGDLSPRSSNVREQDRFLPIANISRIMKKGLPANGKMSKDAKETVQECVSEFISFVTSEASDKCQREKRKTINGDDLLWAMATLGFEDYIEPLKLYLTRYREMEGDTKGSGKGHEGSSKKDGVHPNHSAQAQPQHMMVPMQRTE

SEQ ID NO: 4083 - DNA, 645 bp, Helianthus annuus
  CDS (1)..(645)
atggaacgtggaggaggtttccatggctaccacaggctccccatccaccctacatctgggatgcaacagccggatatgaagcagaagcaaccagacacaaccaacaccacatctacagaagacaatgagtgcattgttagagagcaagaccgctttatgccgatagcaaacgtgatcaggatcatgcgaaagatcttgccacctcacgcgaagatctctgacgacgcaaaagaaacgatccaagaatgtgtttccgagtacattagttttgtgacaggtgaagcgaatgaccgttgccaacgcgagcagagaaagactatcacagctgaagatgtgttgtgggctatgagcaaactcgggtttgatgactatatcgaaccgttgactgtgtatcttcatcgctacagggagtttgatgggggtgagcgtgggtcgataaggggtgagccgcttgtcaagagggctgcggctactgctgaccctggtccgtttggtatgggtccgtttgtgcctggttttcacatgggtcatcataatgggttctttggtcctgctagcattgctggtttctttaaggacccgtcgagtgcggctggccagtctgggcctgctggtttcgagccgtatgctcagtgtaaagactaa

SEQ ID NO: 4084 - protein, 214 aa, Helianthus annuus
MERGGGFHGYHRLPIHPTSGMQQPDMKQKQPDTTNTTSTEDNECIVREQDRFMPIANVIRIMRKILPPHAKISDDAKETIQECVSEYISFVTGEANDRCQREQRKTITAEDVLWAMSKLGFDDYIEPLTVYLHRYREFDGGERGSIRGEPLVKRAAATADPGPFGMGPFVPGFHMGHHNGFFGPASIAGFFKDPSSAAGQSGPAGFEPYAQCKD

SEQ ID NO: 4085 - DNA, 561 bp, Brassica napus
  CDS (1)..(561)
atggcggattccgacaacgattcaggcggccacaaggacggaggcagcgcatcgtcgcgtgagcaggataggtttctcccgatcgcgaacgtgagtcggatcatgaagaaagcgttgccggcgaacgccaaaatctccaaggacgcgaaggagacggtgcaggagtgcgtatccgagttcataagcttcgtcaccggagaggcatccgacaagtgtcagagagagaagaggaagacgatcaacggcgacgatcttctatgggcgatgacgacgctagggttcgaggattacgtggagccgttgaaggtttacctgcagaagtacagggaggtggaaggggagaggacgaccacggggaaacaggtggataaggaaggtggagctggaggaaatgggaactctagtggcggcggaggaggaggatacaatggtggaggacgtgcgacggcgggaggagggatgtacggtgggattgtgacgatggggaatcatcatcaaggacacgtgtacggtggagggatgcatcccacgcagcaaagcgggtccgcacgtgctgattag

SEQ ID NO: 4086 - protein, 186 aa, Brassica napus
MADSDNDSGGHKDGGSASSREQDRFLPIANVSRIMKKALPANAKISKDAKETVQECVSEFISFVTGEASDKCQREKRKTINGDDLLWAMTTLGFEDYVEPLKVYLQKYREVEGERTTTGKQVDKEGGAGGNGNSSGGGGGGYNGGGRATAGGGMYGGIVTMGNHHQGHVYGGGMHPTQQSGSARAD

SEQ ID NO: 4087 - DNA, 672 bp, Zea mays
  CDS (1)..(672)
atgccggactccgacaacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgcagcctcagccgccacagcagcagcagcagcaacatcaacagcatcacatggcaatgggaggcagaggaggattcggccaacaaggcggcggcggtggctcctcgtcgtcgtcagggcttggccggcaagacagggcgtga

SEQ ID NO: 4088 - protein, 223 aa, Zea mays
MPDSDNDSGGPSNAGGELSSPREQDRFLPIANVSRIMKKALPANAKISKDAKETVQECVSEFISFITGEASDKCQREKRKTINGDDLLWAMTTLGFEDYVEPLKHYLHKFREIEGERAAASAGASGSQQQQQQGELPRGAANAAGYAGYGAPGSGGMMMMMMGQPMYGGSQPQQQPPQPQPPQQQQQQHQQHHMAMGGRGGFGQQGGGGGSSSSSGLGRQDRA

SEQ ID NO: 4089 - DNA, 789 bp, Zea mays
  CDS (1)..(789)
atgaataatccccaaaaccctaaagccagtgctccttgcaccttgccatcggagcttcccaaagaagcagtggcgaccgacgaagcaccgccgccaatgggcaacaacaacaacacggaatcggcgacggcgacgatggtccgggagcaggaccggctgatgcccgtggccaacgtgtcccgcatcatgcgccaagtgctgcctccgtacgccaagatctccgacgacgccaaggaggtgatccaggagtgcgtgtcggagttcatcagcttcgtcactggcgaggcgaacgagcggtgccacaccgagcgccgcaagaccgtcacctccgaggacatcgtgtgggccatgagccgcctcggcttcgacgactacgtcgcgcccctcggcgccttcctccagcgcatgcgcgacgacagcgaccacggcggtgaagagcgcggcggccctgcagggcgtggtggctcgcgccgcggctcgtcgtccttgccgctccactgcccgcagcagatgcaccacctgcacccagccgtctgccggcgtccgcaccagagcgtgtcgcctgctgcaggatacgccgtccggcccgttccccgcccgatgccagccagtgggtaccgcatgcagggcggagaccaccgcagcgtgggcggcgtggctccctgcagctacggaggggcgctcgtccaggccggtggaacccaacacgttgttggattccacgacgacgaggcaagctcttcgagtgaaaatccgccgccggaggggcgtgccgctggctcgaactag

SEQ ID NO: 4090 - protein, 262 aa, Zea mays
MNNPQNPKASAPCTLPSELPKEAVATDEAPPPMGNNNNTESATATMVREQDRLMPVANVSRIMRQVLPPYAKISDDAKEVIQECVSEFISFVTGEANERCHTERRKTVTSEDIVWAMSRLGFDDYVAPLGAFLQRMRDDSDHGGEERGGPAGRGGSRRGSSSLPLHCPQQMHHLHPAVCRRPHQSVSPAAGYAVRPVPRPMPASGYRMQGGDHRSVGGVAPCSYGGALVQAGGTQHVVGFHDDEASSSSENPPPEGRAAGSN

SEQ ID NO: 4091 - DNA, 492 bp, Triticum aestivum
  CDS (1)..(492)
atggccgacgacgacagcgggagcccccggggcggcggcggggtcagggagcaggaccgcttcctccccatcgccaacatcagccgcatcatgaagaaggccgtgccggccaacggcaagatcgccaaggacgccaaggagaccctccaggagtgcgtctccgagttcatctccttcgtcaccagcgaggccagcgacaagtgccagaaggagaagcgcaagaccatcaacggggacgatctgctctgggccatggccacgctcggattcgaggagtacgtagaccccctcaagatctacctgcaaaagtacagagatatggagggtgatagtaaattgacctcaaaatctggtgaaggatccgtgaagaaagatataattggtgctcatagtggtgcgactagctcaaacgcccaagcgatggttcagcatggagcttacgcccaagggatgggttatatgcaaccccagtaccataatggggacacctga

SEQ ID NO: 4092 - protein, 163 aa, Triticum aestivum
MADDDSGSPRGGGGVREQDRFLPIANISRIMKKAVPANGKIAKDAKETLQECVSEFISFVTSEASDKCQKEKRKTINGDDLLWAMATLGFEEYVDPLKIYLQKYRDMEGDSKLTSKSGEGSVKKDIIGAHSGATSSNAQAMVQHGAYAQGMGYMQPQYHNGDT

SEQ ID NO: 4093 - DNA, 495 bp, Zea mays
  CDS (1)..(495)
atggcggacgacggcgggagccacaaggccaacggcggcggcgaaggcgtccgggagcaggaccggttcttgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaagaagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagcccccatggtggcaccagtagctcaagtaatcagttggttcagcatggagtctacaaccaagggatgggctatatgcagccacagtaccacaatggggaaacctaa

SEQ ID NO: 4094 - protein, 164 aa, Zea mays
MADDGGSHKANGGGEGVREQDRFLPIANISRIMKKAVPANGKIAKDAKETLQECVSEFISFVTSEASDKCQKKKRKTINGDDLLWAMATLGFEEYVEPLKIYLQKYKEMEGDSKLSTKAGEGSVKKDAISPHGGTSSSSNQLVQHGVYNQGMGYMQPQYHNGET

SEQ ID NO: 4095 - DNA, 495 bp, Zea mays
  CDS (1)..(495)
atggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctaa

SEQ ID NO: 4096 - protein, 164 aa, Zea mays
MADDGGSHEGSGGGGGVREQDRFLPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQYHNGET

SEQ ID NO: 4097 - DNA, 789 bp, Zea mays
  CDS (1)..(789)
atgaataatccccaaaaccctaaagccagtgctccttgcaccttgccaccggagcttcccaaagaagcagtggcgaccgacgaagcaccgccgccaatgggcaacaacaacaacacggaatcggcgacggcgacgatggtccgggagcaggaccggctgatgcccgtggccaacgtgtcccgcatcatgcgccaagtgctgcctccgtacgccaagatctccgacgacgccaaggaggtgatccaggagtgcgtgtcggagttcatcagcttcgtcactggcgaggcgaacgagcggtgccacaccgagcgccgcaagaccgtcacctccgaggacatcgtgtgggccatgagccgcctcggcttcgacgactacgtcgcgcccctcggcgccttcctccagcgcatgcgcgacgacagcgaccacggcggtgaagagcgcggcggccctgcagggcgtggtggctcgcgccgcggctcgtcgtccttgccgctccactgcccgcagcagatgcaccacctgcacccagccgtctgccggcgtccgcaccagagcgtgtcgcctgctgcaggatacgccgtccggcccgttccccgcccgatgccagccagtgggtaccgcatgcagggcggagaccaccgcagcgtgggcggcgtggctccctgcagctacggaggggcgctcgtccaggccggtggaacccaacacgttgttggattccacgacgacgaggcaagctcttcgagtgaaaatccgccgccggaggggcgtgccgctggctcgaactag

SEQ ID NO: 4098 - protein, 262 aa, Zea mays
MNNPQNPKASAPCTLPPELPKEAVATDEAPPPMGNNNNTESATATMVREQDRLMPVANVSRIMRQVLPPYAKISDDAKEVIQECVSEFISFVTGEANERCHTERRKTVTSEDIVWAMSRLGFDDYVAPLGAFLQRMRDDSDHGGEERGGPAGRGGSRRGSSSLPLHCPQQMHHLHPAVCRRPHQSVSPAAGYAVRPVPRPMPASGYRMQGGDHRSVGGVAPCSYGGALVQAGGTQHVVGFHDDEASSSSENPPPEGRAAGSN

SEQ ID NO: 4099 - DNA, 537 bp, Zea mays
  CDS (1)..(537)
atggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaa

SEQ ID NO: 4100 - protein, 178 aa, Zea mays
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDISN

SEQ ID NO: 4101 - DNA, 543 bp, Zea mays
  CDS (1)..(543)
atggcggacgctccggcgagccctgggggcggaggcgggagccacgagagcgggagccccaggggcggcggaggtggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctcggagttcatctccttcatcactagcgaggcgagtgacaagtgccagagggagaagcggaagaccatcaatggcgacgacctgctgtgggccatggccacgctggggtttgaggactatattgaacccctcaaggtgtacctgcagaagtacagagagatggagggtgatagtaagttaacttcaaaatccagcgatggctccattaaaaaggatgcccttggtcatgtgggagcaagtagctcagctgtacaagggatgggtcagcaaggaacatacaaccaaggaatgggttatatgcaacctcagtaccataacggagatatctcgaactaa

SEQ ID NO: 4102 - protein, 180 aa, Zea mays
MADAPASPGGGGGSHESGSPRGGGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTSKSSDGSIKKDALGHVGASSSAVQGMGQQGTYNQGMGYMQPQYHNGDISN

SEQ ID NO: 4103 - DNA, 786 bp, Zea mays
  CDS (1)..(786)
atgaataatccccaaaaccctaaagccagtgctccttgcaccttgccaccggagcttcccaaagaagcagtggcgaccgacgaagcaccgccgccaatgggcaacaacaacaacacggaatcggcgacggcgacgatggtccgggagcaggaccggctgatgcccgtggccaacgtgtcccgcatcatgcgccaagtgctgcctccgtacgccaagatctccgacgacgccaaggaggtgatccaggagtgcgtgtcggagttcatcagcttcgtcactggcgaggcgaacgagcggtgccacaccgagcgccgcaagaccgtcacctccgaggacatcgtgtgggccatgagccgcctcggcttcgacgactacgtcgcgcccctcggcgccttcctccagcgcatgcgcgacagcgaccacggcggtgaagagcgcggcggccctgcagggcgtggtggctcgcgccgcggctcgtcgtccttgccgctccactgcccgcagcagatgcaccacctgcacccagccgtctgccggcgtccgcaccagagcgtgtcgcctgctgcaggatacgccgtccggcccgttccccgcccgatgccagccagtgggtaccgcatgcagggcggagaccaccgcagcgtgggcggcgtggctccctgcagctacggaggggcgctcgtccaggccggtggaacccaacacgttgttggattccacgacgacgaggcaagctcttcgagtgaaaatccgccgccggaggggcgtgccgctggctcgaactag

SEQ ID NO: 4104 - protein, 261 aa, Zea mays
MNNPQNPKASAPCTLPPELPKEAVATDEAPPPMGNNNNTESATATMVREQDRLMPVANVSRIMRQVLPPYAKISDDAKEVIQECVSEFISFVTGEANERCHTERRKTVTSEDIVWAMSRLGFDDYVAPLGAFLQRMRDSDHGGEERGGPAGRGGSRRGSSSLPLHCPQQMHHLHPAVCRRPHQSVSPAAGYAVRPVPRPMPASGYRMQGGDHRSVGGVAPCSYGGALVQAGGTQHVVGFHDDEASSSSENPPPEGRAAGSN

SEQ ID NO: 4105 - DNA, 669 bp, Zea mays
  CDS (1)..(669)
atgccggactcggacaacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgccgcctcagccgccacagcagcagcagcaacatcaacagcatcacatggcaataggaggcagaggaggattcggccaacaaggcggcggcggcggctcctcgtcgtcgtcagggcttggccggcaagacagggcgtga

SEQ ID NO: 4106 - protein, 222 aa, Zea mays
MPDSDNDSGGPSNAGGELSSPREQDRFLPIANVSRIMKKALPANAKISKDAKETVQECVSEFISFITGEASDKCQREKRKTINGDDLLWAMTTLGFEDYVEPLKHYLHKFREIEGERAAASAGASGSQQQQQQGELPRGAANAAGYAGYGAPGSGGMMMMMMGQPMYGGSQPQQQPPPPQPPQQQQQHQQHHMAIGGRGGFGQQGGGGGSSSSSGLGRQDRA

SEQ ID NO: 4107 - DNA, 24 bp, Artificial sequence
  primer
atgaataccaacgagtccgaacat

SEQ ID NO: 4108 - DNA, 22 bp, Artificial sequence
  primer
tcaaggcacctcttcgtcgtcc

SEQ ID NO: 4109 - protein, 173 aa, Artificial sequence
  consensus sequence
  Variant (2)..(15): Xaa in position 2 to 15 is any amino acid
  Variant (16)..(76): Xaa in position 16 to 76 is any or no amino acid
  Variant (82)..(83): Xaa in position 82 to 83 is any amino acid
  Variant (88)..(89): Xaa in position 88 to 89 is any amino acid
  Variant (93)..(95): Xaa in position 93 to 95 is any amino acid
  Variant (98)..(98): Xaa in position 98 is any amino acid
  Variant (99)..(100): Xaa in position 99 to 100 is any or no amino acid
  Variant (102)..(107): Xaa in position 102 to 107 is any amino acid
  Variant (109)..(110): Xaa in position 109 to 110 is any amino acid
  Variant (115)..(116): Xaa in position 115 to 116 is any amino acid
  Variant (127)..(127): Xaa in position 127 is any amino acid
  Variant (129)..(129): Xaa in position 129 is any amino acid
  Variant (132)..(134): Xaa in position 132 to 134 is any amino acid
  Variant (136)..(137): Xaa in position 136 to 137 is any amino acid
  Variant (139)..(139): Xaa in position 139 is any amino acid
  Variant (143)..(146): Xaa in position 143 to 146 is any amino acid
  Variant (148)..(148): Xaa in position 148 is any amino acid
  Variant (153)..(154): Xaa in position 153 to 154 is any amino acid
  Variant (158)..(159): Xaa in position 158 to 159 is any amino acid
  Variant (161)..(162): Xaa in position 161 to 162 is any amino acid
  Variant (165)..(166): Xaa in position 165 to 166 is any amino acid
  Variant (169)..(171): Xaa in position 169 to 171 is any amino acid
MXXXXXXXXXXXXXXXXXXXXXXXXXXXXXXXXXXXXXXXXXXXXXXXXXXXXXXXXXXXXXXXXXXXXXXXXXXXREQDRXXPIANXXRIMXXXLPXXXKXXXXXXIXXDAKEXXQECVSEFISFXTXEAXXXCXXEXRKTXXXXDXLWAMXXLGFXXYXXPLXXYLXXXRE

SEQ ID NO: 4110 - protein, 29 aa, Artificial sequence
  protein pattern
  Variant (6)..(6): Xaa in position 6 is any amino acid
  Variant (7)..(7): Xaa in position 7 is Leu or Met
  Variant (9)..(9): Xaa in position 9 is Ile or Val
  Variant (10)..(10): Xaa in position 10 is Ala or Asn
  Variant (12)..(12): Xaa in position 12 is Ile or Val
  Variant (13)..(13): Xaa in position 13 is any amino acid
  Variant (15)..(15): Xaa in position 15 is Ile or Leu
  Variant (17)..(17): Xaa in position 17 is Lys or Arg
  Variant (18)..(19): Xaa in position 18 to 19 is any amino acid
  Variant (20)..(20): Xaa in position 20 is Ile, Leu or Val
  Variant (22)..(23): Xaa in position 22 to 23 is any amino acid
  Variant (24)..(24): Xaa in position 24 is Ala or Gly
  Variant (26)..(26): Xaa in position 26 is Ile or Val
  Variant (27)..(27): Xaa in position 27 is Ala, Gly or Ser
  Variant (28)..(28): Xaa in position 28 is Asp or Lys
  Variant (29)..(29): Xaa in position 29 is Asp, Glu or Ser
REQDRXXPXXNXXRXMXXXXPXXXKXXXX

SEQ ID NO: 4111 - DNA, 2700 bp, Saccharomyces cerevisiae
  CDS (1)..(2700)
atggagaggccatcttttttggatcaagaaccacctgcaggttacgtaccaggtattggtcgtggagccactggattttcaacaaaagaaaagcaagtggttagtaatgatgacaaaggaagaagaataccgaaaaggtaccgtgaaaatttgaacaaccatcttcaaagccaaccgaaagatgatgaagatgatgaagctgcaaatgtattcaaaacgcttgaattgaaattagcacaaaagaaaaagaaaagagctaatgaaaaggatgatgacaattcagttgattcttcaaacgtgaaacggcaatttgccgatttgaaagaatcattagctgctgtaacggagagtgagtggatggatattccggatgccacagattttacaagaagaaacaagagaaatagaattcaagagcaattaaacagaaaaacttatgctgcaccggattcgctaatacctgggaatgttgatttaaataaattaacggaagaacgagaaaaattattgcaatctcaaatagatgagaatcttgcacaattaacgaagaatgcaagtaaccctatacaggttaataaaccgaacgctgctaccgatgccctaagttacttaaaggacttagaaaacgatagagtaaattctctctcagacgcaacgttagaagatttacagaaaatgcgcacaattttaaagtcatacagaaaggccgatccaacaaatccacagggttggatagcttctgccagattagaagaaaaggcaagaaaattttcagtagcaaaaaaaataatagaaaatggttgccaagagtgccctcgaagctccgatatttggctagaaaacattagactacacgaatctgatgttcactactgtaaaacattagtggcaacggcaataaattttaatccaacgtctccgcttctttggttcaaagctattgatttggaaagcacaacggttaacaaatatagagtagtgagaaaagcactgcaagagattcctcgagatgagggcctatggaagctagctgtcagttttgaagctgacaaagcgcaagttataaaaatgttagagaaagccacacaatttattccacaaagtatggatctcttgactgcatatactaatttgcaaagctatcataatgctaaaatgactttgaattccttcagaaaaatccttccgcaagaaccggaaatttggattatctctacactcttggaagaacgaaataacccagatatacctgtagataaactagttagtttgctcaaggagggtttattggaactctctaaaaatgggtacaaagcgaccttgtcagcatggttgaaacgtgcagaggctctaaatgatgcgcccaattcaaatttaacctgtcaagccatcgtttacgctatattagaatggttaagagaaagtggcgagtatgagtctgagttgaataatgttgatcagatattagaaaaaatgccacactcaaaggtacaaattgctgtcttaaaaaagcttattcagtgggatccttgtgatacagttctttggtctagactgaaaatggccactgaaagctaccataaaattgaagagttattagcatttttccaggagctgctatttcagaccaagaatagtgatgatatacgagcaaatatgagggagaaaagccctggcttgttaatgatgtatgtaagcgaatattggaaggcccaaaaaggggatactaggcaaacactagttttgattgaccagattatagatttcgccccgcataatttggatttacgctttttcaagataaagttattaggtcgttcactacaacttgatgaattacgagatttttttcagcaaactttctcctctttagaggattttaagatcagtggcacggaaagattatattataaatacgtaaactttctgcggtaccaagatctgaatgaagaggctataaaattcttgaatgagagatgtttgaaatcatttcccatctgccacaaattttttttacagctgggtcaaatttatcattccatgggcaatattgaaatgagtagagaaacctatttgtctggtacaaggttagtgcccaattgccctttattatgggtttccctatcaaagattgacgagattgatctaaaaaatccagtaagggcaagatcaattttagatagaggattgttaaaaaatcctgacgatgtattattttacattgctaaaatccaaatggaaataagacttggtaacttagatcaggcggagttactcgtcacacaggcattgcaaaagtttccaagcaatgctttactttgggtggagcaaatcaagctgtttaagcatggaaacaaaagttcgttaaaaaaaacaatttttcaagatgctttaagaaggacacaaaacgatcatcgcgttcttttggagattggagtatccttttatgcagaagcgcaatatgaaacatcattaaaatggttagaaagagctctgaaaaagtgctcgcgttacggagatacatgggtttggctatttaggacatatgcaaggttaggcaaggatactgttgatctctacaatatgttcgatcaatgtgagcctacttacggacccgaatggatagccgcctccaagaacgtaaaaatgcaatactgcacacctagagagattttattgcgcttgatgaatgacaaataa

SEQ ID NO: 4112 - protein, 899 aa, Saccharomyces cerevisiae
MERPSFLDQEPPAGYVPGIGRGATGFSTKEKQVVSNDDKGRRIPKRYRENLNNHLQSQPKDDEDDEAANVFKTLELKLAQKKKKRANEKDDDNSVDSSNVKRQFADLKESLAAVTESEWMDIPDATDFTRRNKRNRIQEQLNRKTYAAPDSLIPGNVDLNKLTEEREKLLQSQIDENLAQLTKNASNPIQVNKPNAATDALSYLKDLENDRVNSLSDATLEDLQKMRTILKSYRKADPTNPQGWIASARLEEKARKFSVAKKIIENGCQECPRSSDIWLENIRLHESDVHYCKTLVATAINFNPTSPLLWFKAIDLESTTVNKYRVVRKALQEIPRDEGLWKLAVSFEADKAQVIKMLEKATQFIPQSMDLLTAYTNLQSYHNAKMTLNSFRKILPQEPEIWIISTLLEERNNPDIPVDKLVSLLKEGLLELSKNGYKATLSAWLKRAEALNDAPNSNLTCQAIVYAILEWLRESGEYESELNNVDQILEKMPHSKVQIAVLKKLIQWDPCDTVLWSRLKMATESYHKIEELLAFFQELLFQTKNSDDIRANMREKSPGLLMMYVSEYWKAQKGDTRQTLVLIDQIIDFAPHNLDLRFFKIKLLGRSLQLDELRDFFQQTFSSLEDFKISGTERLYYKYVNFLRYQDLNEEAIKFLNERCLKSFPICHKFFLQLGQIYHSMGNIEMSRETYLSGTRLVPNCPLLWVSLSKIDEIDLKNPVRARSILDRGLLKNPDDVLFYIAKIQMEIRLGNLDQAELLVTQALQKFPSNALLWVEQIKLFKHGNKSSLKKTIFQDALRRTQNDHRVLLEIGVSFYAEAQYETSLKWLERALKKCSRYGDTWVWLFRTYARLGKDTVDLYNMFDQCEPTYGPEWIAASKNVKMQYCTPREILLRLMNDK

SEQ ID NO: 4113 - DNA, 3090 bp, Arabidopsis thaliana
  CDS (1)..(3090)
atggtgtttctctcgattccaaacgggaagactttatcgatcgacgtgaaccctaattcaaccaccatctccgccttcgaacaattggcccaccaacgtagtgatgttccacaatctttccttcgttactctctccgtatgcgaaaccctagccgcgtgtttgtagattcaaaggattccgattcgatcttattgtccgatctcggtgtttctcgtttctctactgtgattatccatgtcctgcttttgggtggtatgcaagcggctccgccgaagcctcgtcttgatttcctcaattctaagcctccgtcaaattatgtagcgggtttgggtcgtggtgctactgggtttactactcgatctgatattggtcctgctcgtgctgctccggatcttcctgatcggtctgctttggctacagcggctgctccaggagtaggtcgtggagcagggaagccaagtgaagcggaagcggaggacgatgaagaagctgaggagaaaaggtacgatgagaatcagacgtttgatgagtttgaagggaatgatgttggtttgttcgctaatgctgagtacgatgaggatgataaagaggctgatgccatctgggagtctattgatcagaggatggattcgaggaggaaagatcggagagaagcgaagctgaaggaagaaatcgagaaataccgagcctcgaaccctaagattactgagcagtttgcggatttgaagaggaaattacacactttgtctgcggatgagtgggatagtattcctgagattggggattactcgctgaggaacaagaagaagaagtttgagagctttgtgcctattcctgatacgcttttggagaaggcgaagaaagaaaaggagcttgtcatggccttagacccaaagagcagagccgctggtgggtcggagacaccatgggggcagacgccggtgacagacttgactgctgtcggtgagggaagaggtacggtgttgtctctgaagcttgataacctatcagattcagtttcggggcaaactgtagtggatcctaaaggctacttaactgacctgaagagtatgaaaagaaccactgatgaagagatatacgatcgcaatagagctagattgttatacaagagtctgacccagtcgaatccaaagaatccaaatggctggattgctgctgctagagtggaggaggtggatgggaagattaaagcagctaggtttcagattcagaggggctgcgaagagtgcccgaaaaatgaggatgtttggcttgaagcttgtaggttagctaatccagaagatgccaagggggttattgcgaagggagttaagctgatacccaattcagtgaagctatggttggaggctgcaaagctggagcatgatgtggagaacaagagtagggtgttgagaaagggactggaacatattccagactctgtaagactatggaaggctgttgttgagttggctaatgaggaggatgcaaggattttgcttcacagggctgtggagtgctgccctttgcatctggagctatgggtggcacttgcgaggctcgaaacatatgctgaatcaaagaaggtgttgaacaaagcgagagagaagctcccaaaggagcctgcaatttggatcaccgctgctaagttagaagaagctaatgggaagctagatgaagctaatgataacacggctatggtgggaaagattattgataggggtataaagactctccagagagaaggggttgttattgaccgagaaaattggatgagtgaggctgaggcatgtgagagagttggatctgtcgctacatgccaggccattattaagaacacaataggtattggagtggaagaagaggatagaaagagaacttgggttgctgatgcagatgagtgcaagaagaggggttccattgagaccgcaagagcaatatacgcccatgctcttagtgtattcttgaccaagaaaagtatctggcttaaagcggcgcagcttgagaagagccatgggagtcgggagtcccttgatgccttgttgcgtaaggctgtaacatatgtcccgcaagctgaggttctctggctcatgggtgccaaagagaagtggctcgctggagatgttccagcagcccgtgctattctacaagaggcttatgctgcaattcccaactctgaggaaatctggcttgctgctttcaagcttgagtttgagaacaaggagccggagagggcaagaatgctgcttgcaaaagcaagggaaagaggagggactgaaagggtctggatgaaatcagccattgttgagagagaacttggcaacgtagaggaggagaggagattgcttaatgaaggtttgaagcaattcccaacattcttcaagctttggttaatgcttgggcagctcgaggaacggttcaagcatctagaacaggccaggaaagcttatgacactggtttgaagcactgtccccactgcataccactgtggctctcactcgctgatcttgaagagaaagtgaatgggctaaacaaagctcgggctattctcaccacggccaggaagaagaatcctgggggggctgagctatggttagctgctattcgcgctgaactgaggcatgacaacaagagagaagcagagcacttgatgtcaaaggctctgcaagactgtcccaagagtggtatcctctgggctgcggacattgagatggcgccacgtcctcgacggaaaacaaagagtattgatgctatgaagaagtgtgatcgcgaccctcatgtcaccatagctgttgccaagctcttttggcaagacaagaaggtggagaaagccagagcatggtttgaacgtgctgttaccgttggcccagatattggcgatttctgggcgttgttctacaaatttgaacttcaacatggctctgatgaggacaggaaggaagttgtggcgaagtgtgtagcttgtgagccgaagcatggcgagaaatggcaagccatctccaaagcggttgaaaatgctcaccagcctattgaagttatcttgaagagagttgtgaatgcgttgagcaaggaagagaattctgcttga

SEQ ID NO: 4114 - protein, 1029 aa, Arabidopsis thaliana
MVFLSIPNGKTLSIDVNPNSTTISAFEQLAHQRSDVPQSFLRYSLRMRNPSRVFVDSKDSDSILLSDLGVSRFSTVIIHVLLLGGMQAAPPKPRLDFLNSKPPSNYVAGLGRGATGFTTRSDIGPARAAPDLPDRSALATAAAPGVGRGAGKPSEAEAEDDEEAEEKRYDENQTFDEFEGNDVGLFANAEYDEDDKEADAIWESIDQRMDSRRKDRREAKLKEEIEKYRASNPKITEQFADLKRKLHTLSADEWDSIPEIGDYSLRNKKKKFESFVPIPDTLLEKAKKEKELVMALDPKSRAAGGSETPWGQTPVTDLTAVGEGRGTVLSLKLDNLSDSVSGQTVVDPKGYLTDLKSMKRTTDEEIYDRNRARLLYKSLTQSNPKNPNGWIAAARVEEVDGKIKAARFQIQRGCEECPKNEDVWLEACRLANPEDAKGVIAKGVKLIPNSVKLWLEAAKLEHDVENKSRVLRKGLEHIPDSVRLWKAVVELANEEDARILLHRAVECCPLHLELWVALARLETYAESKKVLNKAREKLPKEPAIWITAAKLEEANGKLDEANDNTAMVGKIIDRGIKTLQREGVVIDRENWMSEAEACERVGSVATCQAIIKNTIGIGVEEEDRKRTWVADADECKKRGSIETARAIYAHALSVFLTKKSIWLKAAQLEKSHGSRESLDALLRKAVTYVPQAEVLWLMGAKEKWLAGDVPAARAILQEAYAAIPNSEEIWLAAFKLEFENKEPERARMLLAKARERGGTERVWMKSAIVERELGNVEEERRLLNEGLKQFPTFFKLWLMLGQLEERFKHLEQARKAYDTGLKHCPHCIPLWLSLADLEEKVNGLNKARAILTTARKKNPGGAELWLAAIRAELRHDNKREAEHLMSKALQDCPKSGILWAADIEMAPRPRRKTKSIDAMKKCDRDPHVTIAVAKLFWQDKKVEKARAWFERAVTVGPDIGDFWALFYKFELQHGSDEDRKEVVAKCVACEPKHGEKWQAISKAVENAHQPIEVILKRVVNALSKEENSA

SEQ ID NO: 4115 - DNA, 2796 bp, Gibberella zeae PH-1
  CDS (1)..(2796)
atgtccgggcgacgcgactttctcaaccaggcagcgcccgagaactacgtcgctggtcttggtcgtggcgcgacaggttttacgacaagatccgatcttggtcccgctagagacggccccagtgaggatcagattaaggaagcgctcgcgaaacgagctgctcaacttggtcttgcgccagacaagaagggcaaagacaaggaggaggatgaaggaaacaacgatgaagaacgataccaagatcccgataacgaagtcggactctttgccggcggcgtctacgacaaggacgatgaggaagccgacaagatttgggaatgggtagatgagagaatggaccgaagaaaaaagcagcgagaagcgcgcgagcaggccgagcaggacgaatacgaacgaaacaaccccaagattcagcaacagttttccgacttgaagcgagcacttgccaccgttacagacgacgaatgggcgaaccttccagaagtcggagatttgacaggaaagaaccggcgtagcaagaaggcactgcgggagagaatgtatgctgtccctgacagcgctcttgcggcagcgcgcgatgcgggtcagatgggaacaactgttatggacgaggacatggcaccgagtgccggcggcggcgatgcagcagatggcaccatgaccaactttgccaagatcggagcagctcgcgacaaagtgcttaagtccagactggaacaggctggtagcgattcggttgctccaggcacctcgaccagtatcgatccacaaggctatctgacgagcctcgataaaaataaagcagctacaggcaatccagaaggcaacgtcggagatgtcaatcgtgtgcgcgaactcttgcagtcagttgtcaagaccaacccttcaaatgctttgggttggatcgcagcggcacgactggaggagttggcaggcaagactgtgacagcacggaagaccatcgacaagggttgtgcacagtgcccaaaaagcgaagatgcatggctggagaacattcgactcaacgagggctcacccaatgccaagatcatcgcgcgaagagctattgaagccaacaacagctcagtcagactatgggtagaagccatgagactggaggtgatcccaagcaacaagaagcgagttattcgacaggcgcttgaccatattccggagtcggaagctctgtggaaggaggctgtgaatctggaagagagcgtcgatgacgccaagcttctcttggccaaggcgacagagcttattcccctttctattgatttatggctggcattggcacgtctcgagacacccgagaacgcccaaaaggtcctcaacagggcgcgaaaggcttgtcctacttctcacgagatttggattgcagctgcacgtctacaagaacagcttgggcaaggaaccaaggtcaacgttatcaagcgtggtgtccaggttctggctaaggaatctgccatgcccaagcgtgaagaatggattgccgaggctgaacgctgtgaagatgaaggcgctatcatcacttgtcagaacattatccgtgaaactctgggctggagtttggacgaggacgacgatcgcaaagacatatggatggaggatgcaaggtctagtatcaaccgaggcaaatacgagacagcaaaggcaatctacgcctacgccctccgagtgttcgtcaacagtaggacgatgtggatggcagcagcagacctggagaggaaccacggtacccgagactctctctggcaggtattggagaaggccgtcgatgcatgccccaagagtgaggatctgtggatgatgctggccaaggagaagtggagggctggagagttggacggtgctcgtctcgttctcaagcgcgcctttaaccaaaaccccaataacgaagatatttggctctctgctgttaagcttgagtctgagagcggtaacgaggagcaggcgcgcaaacttctggagattgctcgtgaacaagcccccacagatcgtgtgtggatgaagagtattgtatacgagcgagtgctgggcaatatcgaggcagcacttgaccttgtcctccaggcactccagttgttccctgcatcgccaaagctctggatgctcaagggccagatctacgaggatctaggcaagattggcccggcgagagaggcctatgcaactggtgtcaaggctgtaccgaaatcagtagccctgtggcttttgtattccaagttggaggaggaaagcggccttaccgtcaaggctcgatctgtgcttgaccgtgctcgactggcggtaccaaataatgcgctgctgtggcgtgagtcagtgcgacttgaacgacgagctggtaacatggcgcaggccaaggcgatgatggccagagcgcaccgagaagttcccaagagtgatgtcctctgggcagaacaggtctggcatctggaagcacgcacacagcgcaaggctcgtattcttgaggctatcaagactgtggatggtagtcctatcatctttgttgtcgcggcgcgcatcttctggggcgatcgcaagctagaacaggcgcagaagtggttcgaaaaggccattgtgcgcgatagcgactacggagacgcatgggcttggtactacaagttcctatgccagcacggcacagaggagaagcaagctgatgttgtgaccaagtgtgttctcaatgagcctcgacatggcgacatatggccagctgtcgccaagaagcctgcgaatgctgggaagagctgtgaagagattctgaagctggttgctgaagagctggaacaatag

SEQ ID NO: 4116 - protein, 931 aa, Gibberella zeae PH-1
MSGRRDFLNQAAPENYVAGLGRGATGFTTRSDLGPARDGPSEDQIKEALAKRAAQLGLAPDKKGKDKEEDEGNNDEERYQDPDNEVGLFAGGVYDKDDEEADKIWEWVDERMDRRKKQREAREQAEQDEYERNNPKIQQQFSDLKRALATVTDDEWANLPEVGDLTGKNRRSKKALRERMYAVPDSALAAARDAGQMGTTVMDEDMAPSAGGGDAADGTMTNFAKIGAARDKVLKSRLEQAGSDSVAPGTSTSIDPQGYLTSLDKNKAATGNPEGNVGDVNRVRELLQSVVKTNPSNALGWIAAARLEELAGKTVTARKTIDKGCAQCPKSEDAWLENIRLNEGSPNAKIIARRAIEANNSSVRLWVEAMRLEVIPSNKKRVIRQALDHIPESEALWKEAVNLEESVDDAKLLLAKATELIPLSIDLWLALARLETPENAQKVLNRARKACPTSHEIWIAAARLQEQLGQGTKVNVIKRGVQVLAKESAMPKREEWIAEAERCEDEGAIITCQNIIRETLGWSLDEDDDRKDIWMEDARSSINRGKYETAKAIYAYALRVFVNSRTMWMAAADLERNHGTRDSLWQVLEKAVDACPKSEDLWMMLAKEKWRAGELDGARLVLKRAFNQNPNNEDIWLSAVKLESESGNEEQARKLLEIAREQAPTDRVWMKSIVYERVLGNIEAALDLVLQALQLFPASPKLWMLKGQIYEDLGKIGPAREAYATGVKAVPKSVALWLLYSKLEEESGLTVKARSVLDRARLAVPNNALLWRESVRLERRAGNMAQAKAMMARAHREVPKSDVLWAEQVWHLEARTQRKARILEAIKTVDGSPIIFVVAARIFWGDRKLEQAQKWFEKAIVRDSDYGDAWAWYYKFLCQHGTEEKQADVVTKCVLNEPRHGDIWPAVAKKPANAGKSCEEILKLVAEELEQ

SEQ ID NO: 4117 - DNA, 2586 bp, Candida glabrata CBS 138
  CDS (1)..(2586)
atgtcagggtataggccagcgtttttggatcaaaagccacctccagggtatattgctggtgtaggtagaggcgcgtttggttttgcaactaggggtcagaaaaacgaaactcctagagtaccgaaacggtataccaaggagagcaatgacgatgacgatgaagatgtatttgcatcgattgaagaaaagagagcccgaaaaagggctcccaagccggaagagagatcaaaggctgattttataccgctaaaacggaaactcgctaatgtgacagaagaccaatggcttaatctaccagaagctaccgatatgacccggagaaatcgcagaattaggttggaagaacagatgaataggaaaacatatgcagcacctgactctttactagattccaatagtgttgatttggtgaaattaacagaggaaagggagaagcttcttgcaagacagttagacactgacttttttgcaaagaatgagcctaatgatcaagagatgaaaactttgaagtatatagcggacattgacaaagactctgtaaatattgtgagaagaggcgatgacgaagaggtacaaaagcagcggttggtcttgaagtcatacagacgggcagaacccaaagatcctacaagttggattgcttcggctaaactagaggaaaattgtggtaattacgaacttgcaagggaactgattcagcaagggtgtttacaatgtccattagatgagataatatggttagaaaacttacggttgaatgtatccaacaatgaaaagaagaaaattattgttgctaatgcaattcgctttcaacctaaatcggtcgcattgtggttggagggaatcaagtatgaggaacaacctgccaataagtttagagttatacaaaaagcattaagagaaatacctgctgaagaagaaatctggaaactagcagtcaaatataacccaaacgattatgatagtttgagaatatgtaaaaaggctttagaattcatcccaacaagtttttatttctgggctatattaatgaaagaaccctacgaggacgttatgaatacattagaaaaggtcataactcaaaatcccaaacagatagatttgaaggtttacaagttaatgaatgaagaaatacataagaaaattgactctgtcagtcaatgtaagagtgtgatcattaaagagcttggtataaatatgaaagacatggataagtccgtagtgactaaatggctagataaagtcgaaatatggaataagagcattgctgttgatataactactgcttctctttgtgaggtaatttttgatagcataggtgagaagattgttaaagaatatggattgaattaccttgataatatatcaaatgttaaaatacagatcatatttttaaaatcatatctgaagttcgagcctactaaaataagtgtttggcaaaaattgaaaaatatctgtgtgaaatcgtataatatagacaagttttttcaagtatttgaagagctgctttttgatcgtgacacccagaatagttatgaaatggtgaaaatacatcccaatctagtgttgctttatgtgaaagagttatggaaacacgacgggaatccagataaggccctagaaatcttgagtaaaaccttgaatgaaattccaaactttatagagggttggctagcgaaaataaagatattgttgcagaccggtcgtctagattgtgttgcttctatatttgataaactattgaactctttggaaactgctaattatgatgatcataacaaggaaagattactctatcgtcatgtttcattcttacgttttatggacgagaatgagaaagctgttagttatattgaaaacaaatatctgctgttatttccacagtcagtaaaattaaaattgcaactggtccagatttatgaagatatgggtatgaatagtatatgttcaaggttatatgatgattatactaagagattgccatcgcatgcagttttctggatcgaatatgctaatttcattcaaagaacatctggaaacacatccagggctagatcaattttggacaaaggcattgtccataacccaagcaatgtttctttaattgttgctaaagttaaattggaggaaacggtgggaaactttgcacaagaagaacttttaatatcgcaaggcttacagacttttgcaaaggatgcagaattatgggcctgtaggatgaggctaagtaagtcaaagaaatctagcctgaagaagacgctgtttcaagatgctttaaaagctacaaacaactcatatcttattctgtttgaggttggtaggtctttctacaatgacaatcaatataaggtggcaatgaaatggtttgatagagctgtcaccaagcaacctcggtttggtgatgggtgggcatacatttataattgtaagcaaaaactgaatgacgatttggataagttgttggaaaaggttgcggagctcgatcctgcatatggtgaagaatggatcaaagtttccaaaaatgtgaaaatgcaatatctgtcttcacctgtaatactcaagaaagttgcagagcgttgtaaatga

SEQ ID NO: 4118 - protein, 861 aa, Candida glabrata CBS 138
MSGYRPAFLDQKPPPGYIAGVGRGAFGFATRGQKNETPRVPKRYTKESNDDDDEDVFASIEEKRARKRAPKPEERSKADFIPLKRKLANVTEDQWLNLPEATDMTRRNRRIRLEEQMNRKTYAAPDSLLDSNSVDLVKLTEEREKLLARQLDTDFFAKNEPNDQEMKTLKYIADIDKDSVNIVRRGDDEEVQKQRLVLKSYRRAEPKDPTSWIASAKLEENCGNYELARELIQQGCLQCPLDEIIWLENLRLNVSNNEKKKIIVANAIRFQPKSVALWLEGIKYEEQPANKFRVIQKALREIPAEEEIWKLAVKYNPNDYDSLRICKKALEFIPTSFYFWAILMKEPYEDVMNTLEKVITQNPKQIDLKVYKLMNEEIHKKIDSVSQCKSVIIKELGINMKDMDKSVVTKWLDKVEIWNKSIAVDITTASLCEVIFDSIGEKIVKEYGLNYLDNISNVKIQIIFLKSYLKFEPTKISVWQKLKNICVKSYNIDKFFQVFEELLFDRDTQNSYEMVKIHPNLVLLYVKELWKHDGNPDKALEILSKTLNEIPNFIEGWLAKIKILLQTGRLDCVASIFDKLLNSLETANYDDHNKERLLYRHVSFLRFMDENEKAVSYIENKYLLLFPQSVKLKLQLVQIYEDMGMNSICSRLYDDYTKRLPSHAVFWIEYANFIQRTSGNTSRARSILDKGIVHNPSNVSLIVAKVKLEETVGNFAQEELLISQGLQTFAKDAELWACRMRLSKSKKSSLKKTLFQDALKATNNSYLILFEVGRSFYNDNQYKVAMKWFDRAVTKQPRFGDGWAYIYNCKQKLNDDLDKLLEKVAELDPAYGEEWIKVSKNVKMQYLSSPVILKKVAERCK

SEQ ID NO: 4119 - DNA, 2658 bp, Kluyveromyces lactis NRRL Y-1140
  CDS (1)..(2658)
atggagactcccagtttcctaaaacaatctccaccacctggttacatcgctggtataggtcgtggagcggttggcttttccaccagaggaagtaaagatgataaaagagttcctgctagattgaatagatatgggcgagatgcaccagatacttctgtaacaaagaatccaaatagatacagatcagcagtttcgaatgaatcatcggagaaacaggttaaagatgaagacgaacaagagatgagagtgtacgaaaagatcgaacagcgacttaagaataaaaaaattatcgacaatgaaacaagcctaaagacgaagccagatgatgaaccagacaagctatcttctaaatttgtagatttgaagcgtaatttagcaactctttctgagcaagactggctggatatccctgacgcatctgatatgaccagacgaaacaaaaggaatcgaatagaggaacaacttgaaaggaaaacattcgctgctcctgacactttgttccaggttaatgtcaacttatccaagttaactgaagagagggaaaagttacttgctgtccagatagataagagttttgattacagcaaaagtcaacttacggatgatgctgaatacttgaatagaatgaaccaagatgacaacactatttcatctacggatttggaagacattaggaaaaacagatccctattagccgcgtatcgtaaatcccatccaagaaatccagaaaactggatttcttcagcaagaatcgaagaaagagccaatcagttcaatcgagccaaaagtttgctagcggaaggttgtaaactgtgccctaaaagtgaagctatctggttagaatcgatacgcatgaacgcatccgataaagaatattgcaagaggttggttacagttgccttaaggctcaacgagtttagtgagcagttgtggttgaaggcaatcgccctcgaacaacacaatactgataaaattaaagtcactcgaaaggctctaattaaactaccactaagctctatattatgggaagtggcggtaaatcttgaaacttccactcttgaaaagctgaaaattttgaagaaagcagttgaattagtgccgaaggattcgcagttatggttgaagttgataaggttacaatcagtcgaatctgcagtggacaccttgaaatctgctgaagaacatattaaaaaagacatcacatactggcttctcaaatgtcaactcgaagaaaaaagaacgaccgcaaatctcgatacgttggtaaatatcatttctagcgcaataaaggatcttcatgaactggaagttaatccaactattactgagtggttcgaaaatgcagtcgctatatcaacagaaggattgtatccattaacagcgaaagcaatcatcacagctaccatcaataacttatttgaagacgcatcctcaaatttccaaagtctctcgaagctgttggtaaacgacaccacacttcagtgtaccttgttttcctccttcctaatcaaatatccaacaaagtactctatttggaaggagttcaccaatttcgccgaagacttttcgcggaaattagagctacacgaaacattcaggaagatcctctttacagattctcaagcggtaaagaaataccctgtcttggttttaatgtatgcgaaagacgtttgggattggggttctggttccactgaagcgttgtcgattttagataaagctctggtgacaaattcggcgtatcctgagttttggttggctaaactcaaaattttgaacagagatggcaaattggatgagattataaattcctttgaagaagccgaatcacacttggtagaatgcattgataaattagttcctttttacgttaagtgtttgcaatctaaaggcagtttggaaatagctcattctactgttgatatagctttggcacgtgaaccaaacgacaaacatttactaatcttgaaagcacagctatacaggcaacaaagggacctttcatcagcgaagcgtgtgctacagagggctacggatatttctaatcatgatccagaagtgtgcttggagttctccagactggtaatggaaacacaagattggggcaaagcgcgttcaatactcagcgtttctctactaaagaatccaaaatccgatacactctacgaggctctcattacattggaactgcaagtgaaagataacaaacaagtaacgtacctcatcgctcagggtctcaaagcgtgtccacacagctggaggctctggtgtctaaacatcagaacccttcctaaaaaatcactacgtaaaaccacattccaagatgctctcgaagctacaaaagagcatccaatggtgataactgagatcggaaaagtgttccaaaaggaacaccaatacgcgaaggcatataaatggttcataagagcctcggaaaataatcttcaatttggggacccatgggtatggctctacatctgcgagtcgtgcatgaatccagttgatttgcaaataaatgaagaaaaaacgttaaagaaattgaaagaaaatgaacccaggtacggtatactatgggagcccgcagtaaactcatacctacacatatcaaactctccgattgatattttgcacagcattatcaacaatttacaccaataa

SEQ ID NO: 4120 - protein, 885 aa, Kluyveromyces lactis NRRL Y-1140
METPSFLKQSPPPGYIAGIGRGAVGFSTRGSKDDKRVPARLNRYGRDAPDTSVTKNPNRYRSAVSNESSEKQVKDEDEQEMRVYEKIEQRLKNKKIIDNETSLKTKPDDEPDKLSSKFVDLKRNLATLSEQDWLDIPDASDMTRRNKRNRIEEQLERKTFAAPDTLFQVNVNLSKLTEEREKLLAVQIDKSFDYSKSQLTDDAEYLNRMNQDDNTISSTDLEDIRKNRSLLAAYRKSHPRNPENWISSARIEERANQFNRAKSLLAEGCKLCPKSEAIWLESIRMNASDKEYCKRLVTVALRLNEFSEQLWLKAIALEQHNTDKIKVTRKALIKLPLSSILWEVAVNLETSTLEKLKILKKAVELVPKDSQLWLKLIRLQSVESAVDTLKSAEEHIKKDITYWLLKCQLEEKRTTANLDTLVNIISSAIKDLHELEVNPTITEWFENAVAISTEGLYPLTAKAIITATINNLFEDASSNFQSLSKLLVNDTTLQCTLFSSFLIKYPTKYSIWKEFTNFAEDFSRKLELHETFRKILFTDSQAVKKYPVLVLMYAKDVWDWGSGSTEALSILDKALVTNSAYPEFWLAKLKILNRDGKLDEIINSFEEAESHLVECIDKLVPFYVKCLQSKGSLEIAHSTVDIALAREPNDKHLLILKAQLYRQQRDLSSAKRVLQRATDISNHDPEVCLEFSRLVMETQDWGKARSILSVSLLKNPKSDTLYEALITLELQVKDNKQVTYLIAQGLKACPHSWRLWCLNIRTLPKKSLRKTTFQDALEATKEHPMVITEIGKVFQKEHQYAKAYKWFIRASENNLQFGDPWVWLYICESCMNPVDLQINEEKTLKKLKENEPRYGILWEPAVNSYLHISNSPIDILHSIINNLHQ

SEQ ID NO: 4121 - DNA, 2751 bp, Debaryomyces hansenii CBS767
  CDS (1)..(2751)
atggacaggaaagcattccttgatcaagagcctccgccagggtatgttgctggtataggtagaggtgctaccggatttacgacgagcgctgatgcaggatcggtcagaatccagccaggtgttgtagtcctggataatgaagaggaagacataaatggcaatgcagaagacgaaaatgacgacggtttgctaggcaaaaagctgaatagggaccaggatgatgaagaggcggataagatatatgaagaaattgatagaagaatgaagagaaagcgcaaagatacgccggacgatgaaacgagtttggaagctgtcaatcacacaaaagagcaatttgctgatttaaagagagcgctttctagtgtcagtgatgagcaatgggaatctttgcctgaagttggtgatttgacaagaagaaataagagggcaaggcttttggagcagcaacaacaaaggttttatgcgatgccagacagtgttatcgcgggagctgggtctgttggagctgggtctattggaggcggcgcaatgaataaacatgatattacagactttcagacgatttctggggccaaagacaagttgttgagtaagcagcttgatagtttggttccgcagagtgctaatgctacgacagaggacttacaaaatgatataatcatggaagaggaatcaaataaccaagtggcagatataaagaagggccggttgattttatcgtccttgaggaaaaccaacccttataaggccaattcctggattgcatctgctaggttggaagaacaagcaaaaaactatacagcggccaagaactttgttgttgaaggttgtagaaaggttcctcataacgaagatatatggcttgagagtattcatgttcatcaaaagtctacagaaggaaccaaaatgtgcaaaataattgttacggaagcgctcaaattcaataatacatcagaaaagttatggataaaagcatttgaactagagaatgcatccgacgttgtatcaagacgccgtgtattaatgaaagctcttgaatttctacctcagaatgtaaaattatgggaaaaactaatagatttagaggaagatcctaaggatgttgcaaaattactacgtaaagctattgaattatgtccaaccgagtggaacttctggattgctttgataaatttatctacttatgatgaatcaaaaagtttacttaataaagctaggaaatccatgagtgataaccataaagtatggatttctgctgctaaattagaagaacgtgaacatgagaatatttcggtacagaaattaagcacgttaatggaaaagggaatcaaaaaactagagagtaatattagtgataagtccaaattattatctagacgggaatggctagaagaagctgcacaaacagagcttgagggcttcaacaaaacttgccaggctattgttaataatgttttgaatattgacattccgtcagatcctaaagaaaagttaactatctggtttcaagaagccggtcattttgcaaaccaatcaaggtttgaaacatcaaattgcatttatcaatatattattgaacaatttccaaataattcagaatgttggatgaggctattcagatctctcaaacaaatttccgatttgaaattagatagattgtttaattactatgaacaagctatcgagttaaatccacagtatgaattattttcattgatgtacgctaaggataagtggattttagccaatgatgtggatggagcaagggaaatattaagaaccgccattgaagccattccagaaagtgaagccattttattggcccaagtaaaattagaaattaagacttcaaattataaatccgcagagaatatatctactcaaattattgaatcaattcctaattcttcgcctcgagtttggtacaaacatattcatcttaaaagagtgttaaatatgaaaaaccccgatagcacatatcagaaatcgatattgtcattatgtaacgaatctcttgaaaaatttccagattccgataagctttatttacagaaaggacaggtacttcatcatgacttaaagaatatacagaacgcaagggagacttattctattggcgtaaagaaatgtcccaagtcgattgatttgtggctttcactcgtgcgaattgatgaaagagaattattgattagagcaagatcaacgttagatatggccattctaaataatccgacgagcgaagagctctggaatgaaaaaataggaatagagagacgaaataatgataacataacagcaagacaaatatgcaataaagcacttaaggatttacccaattcaccacttctttggattcaaaacttacagatgataccaaagatgtcccagagaaaaaacgcgttcctagatgctttaaagcagacagataattcaccattagttttgcttcatattgggatatttttttggttagatggaaaattcatgaaagctaaatcatggtttgaaagaaccttgaatagtgacaaaaataatggtgattgttggggatggttattcaactttatagaaaaacacggctctgattcagagaaacatgcgctattagaaaattttgaaaagtgttatgaagagataaatgaaggaacgacttggaattcgataaccaagaaggtggaaaatttcgagaagacccctactgaactacttctgcttttagcaaaacaattaattactgcatcgactgtatag

SEQ ID NO: 4122 - protein, 916 aa, Debaryomyces hansenii CBS767
MDRKAFLDQEPPPGYVAGIGRGATGFTTSADAGSVRIQPGVVVLDNEEEDINGNAEDENDDGLLGKKLNRDQDDEEADKIYEEIDRRMKRKRKDTPDDETSLEAVNHTKEQFADLKRALSSVSDEQWESLPEVGDLTRRNKRARLLEQQQQRFYAMPDSVIAGAGSVGAGSIGGGAMNKHDITDFQTISGAKDKLLSKQLDSLVPQSANATTEDLQNDIIMEEESNNQVADIKKGRLILSSLRKTNPYKANSWIASARLEEQAKNYTAAKNFVVEGCRKVPHNEDIWLESIHVHQKSTEGTKMCKIIVTEALKFNNTSEKLWIKAFELENASDVVSRRRVLMKALEFLPQNVKLWEKLIDLEEDPKDVAKLLRKAIELCPTEWNFWIALINLSTYDESKSLLNKARKSMSDNHKVWISAAKLEEREHENISVQKLSTLMEKGIKKLESNISDKSKLLSRREWLEEAAQTELEGFNKTCQAIVNNVLNIDIPSDPKEKLTIWFQEAGHFANQSRFETSNCIYQYIIEQFPNNSECWMRLFRSLKQISDLKLDRLFNYYEQAIELNPQYELFSLMYAKDKWILANDVDGAREILRTAIEAIPESEAILLAQVKLEIKTSNYKSAENISTQIIESIPNSSPRVWYKHIHLKRVLNMKNPDSTYQKSILSLCNESLEKFPDSDKLYLQKGQVLHHDLKNIQNARETYSIGVKKCPKSIDLWLSLVRIDERELLIRARSTLDMAILNNPTSEELWNEKIGIERRNNDNITARQICNKALKDLPNSPLLWIQNLQMIPKMSQRKNAFLDALKQTDNSPLVLLHIGIFFWLDGKFMKAKSWFERTLNSDKNNGDCWGWLFNFIEKHGSDSEKHALLENFEKCYEEINEGTTWNSITKKVENFEKTPTELLLLLAKQLITASTV

SEQ ID NO: 4123 - DNA, 2652 bp, Yarrowia lipolytica CLIB122
  CDS (1)..(2652)
atgccgcctaaactgtcctttctggacatgcctgcgccggccgggtacgttcccggtcttggacgaggcgccacaggattttctacgcgtgctgatctcggttcagcccaccgagcgacagataccgatatcccagatgatcctgagcggttcagagaccctgatgatgccggtattttgggcagagagagcgcggatgccgacgacgaactcgccgacgaaatttacgcccagatcgatgctcgaatggaggaacgaaacaagaaacggcgcgaaatcagagaggagaaggagcgccaggaggaagagaaacaggccacaattggagggatgtttgcggacgcgaaacgggcgctgtcagaggtgagtcacgacgagtggctgaatctgcctgagagtggtgaccagactcgaaagaacaaacgagctagaatcgaagcgagggaagggcttagaagctacaacatgagtgattcagtactggaaggactgagaggacgagcggagattggcgctcatgtgactgaaacagacgatggaagcgttactcatatcaaggcgatctcagatgctcgtgacaagattttggatctcaagctgagtggaagagaaacatctaccagcattgatccgagtggatacctcacatctctgaactcggagaactcgcagtcaacttcagagctggcagatataaaaaagatgacaccgtttgttgaatcgctcattcgaagtaaccccaaaaacgctgctggatggattgcaggtgtgagattagcagagctcaaaaagaagccttctcaggcaattcaacttgctgctcaaggatgtgagaactgtcccactaacgaggatgtctggctggaaagtattcgagtcaatgatatggtgaatgctcgtatcattgctgcacaagctgtcaaacgtctccccgaatcggtgcgtatctgggaggctgcagctgacttggaaactactgaggaggccaagaaacgagtacttcgaaaagctctcacatccgtaccgcaatctgtgcagctgtggaagcaactggtcaacttggaggacgaggaacatgccagattgcttcttagacaagctgtggtgagtgttcctctcagcgtggacctgtggctggctttggctcgtttggaggaccacaaggctgctgaaaaggtgctcaatcgcgccagaaaggctgttagaactgctcctgaaatatggattgcagcagctcgtctgagagaacaggtcaatggagcacaaaaggaggtggacaaaatcatgaagaagggggtttcggagctggagtatcatggacgagtgctgtcccgtgaagagtggctcactcaagctcatatatgtgagaaagaggatgctccgttggcatgcggagctatcattcgcgctactgtggcccagggaattgataaggagccagaacatgttcagattgacacattattggaaagttcacgcgatcttagctaccccgttactagcagatcggtcttggaattggcaactgaaatgttccctttttccgaaaagatttggctcacctggactgccctggagaggcgtctcaacagtggcgatcagctgtggagtgttctcgagaaggcagtgaccagctgcaaaaagtctactcaactctggctctactatattcgggaaaagtggcaccatggcaagttcaaggagtcacgtgagattgtgtcacgtgcttttgaggaggttggccatgcgcaggagatttggctggaggcagtccaactggaacttgaagtcgggcagccagacagagctagagatctgctagagaaggcacgtgacgttggtgtcgcacgcgagacattatgggtccgggctgttcgtctagagcgagagcttggaaaagcacctgccgccatttctttggctgagaaggctttggaggagtttgttgaatgcgatggattgtggattgagctcggcaaggctaaaaccgaatcatcaggtgtgccggaagcacgtgatacgtacatccagggcaccaagaactgtcccaaatctgtggccctgtggatcttgcttgctgctgctgaagaatcccgtggtgttcaaatccgagctcggtctgtgcttgaacaggctgctctgatcaacccttacaatgaagagctctggctggcgcgtgttagactggaattgcgagctggaaatattgcgcaggttaaggtcctcctctctcgagctttgcaggagtgtccccaaagtggacgtctcatagtggagagcattggactcgaacctcggtctcaccgaaagtccaaacttgtcgaggcagtcagcaagaatgagaacgacggctatattctcgtgctcctggccaaatctctctggttgcgtaaccagttcgacaaggcatccaagtggcttaccacggctctggagatggattctaacaatggagatgtctggctatgggcctacaagttcttctctgagcgtggagaaggcgtggatgaggtgattgagggtttcaaacaagccgagccaaccgaaggagaagtttggagtagtctcaaagatgatattggcaactttggtaagacagaagtggatcttctgaaggagggaagttccaagcttgaccttggaagtaagtaa

SEQ ID NO: 4124 - protein, 883 aa, Yarrowia lipolytica CLIB122
MPPKLSFLDMPAPAGYVPGLGRGATGFSTRADLGSAHRATDTDIPDDPERFRDPDDAGILGRESADADDELADEIYAQIDARMEERNKKRREIREEKERQEEEKQATIGGMFADAKRALSEVSHDEWLNLPESGDQTRKNKRARIEAREGLRSYNMSDSVLEGLRGRAEIGAHVTETDDGSVTHIKAISDARDKILDLKLSGRETSTSIDPSGYLTSLNSENSQSTSELADIKKMTPFVESLIRSNPKNAAGWIAGVRLAELKKKPSQAIQLAAQGCENCPTNEDVWLESIRVNDMVNARIIAAQAVKRLPESVRIWEAAADLETTEEAKKRVLRKALTSVPQSVQLWKQLVNLEDEEHARLLLRQAVVSVPLSVDLWLALARLEDHKAAEKVLNRARKAVRTAPEIWIAAARLREQVNGAQKEVDKIMKKGVSELEYHGRVLSREEWLTQAHICEKEDAPLACGAIIRATVAQGIDKEPEHVQIDTLLESSRDLSYPVTSRSVLELATEMFPFSEKIWLTWTALERRLNSGDQLWSVLEKAVTSCKKSTQLWLYYIREKWHHGKFKESREIVSRAFEEVGHAQEIWLEAVQLELEVGQPDRARDLLEKARDVGVARETLWVRAVRLERELGKAPAAISLAEKALEEFVECDGLWIELGKAKTESSGVPEARDTYIQGTKNCPKSVALWILLAAAEESRGVQIRARSVLEQAALINPYNEELWLARVRLELRAGNIAQVKVLLSRALQECPQSGRLIVESIGLEPRSHRKSKLVEAVSKNENDGYILVLLAKSLWLRNQFDKASKWLTTALEMDSNNGDVWLWAYKFFSERGEGVDEVIEGFKQAEPTEGEVWSSLKDDIGNFGKTEVDLLKEGSSKLDLGSK

SEQ ID NO: 4125 - DNA, 2826 bp, Aspergillus nidulans FGSC A4
  CDS (1)..(2826)
atggcgtctggacgaaaagatttcctcagtcaacccgcccccgagaattacgttgctggtctaggtcgaggagcgaccggcttcaccacccgctcagatctaggtcctgctcgagagggtccaacgccggagcagatccaagctgcgcttgcgaaaagagcacagttacttggagcagcacctcccacggcttatggggctacaagagaaaagggtaaaggagaggaaaagccggccgaggaagaagatgatgaacggttccaggaccccgacaatgaagttgggctctttgcctacggccagtttgatcaagaagatgatgaggcggatcgcatctacagagaggtagatgagaagatggatagacggcgcaaagcacgaagggaagctcgagagcgtcaggagcgggaagagtatgaacggaagaatcccaaaattcaacagcaattcgtcgatttgaagcggtctcttgcgtcggtctcggaagacgaatgggcaaacctccccgaagtcggtgaccttacgggtaggaatagacgaacgaagcagaacttacgtatgcaacaacgtttttacgcggtccccgatagtgtgctcgcgagtgcaagagattcatctcagttcgatacaaccgttgcggacgatggaacagcaacagatgctggtgctaacggggcggacggaatgataacgaactttgccaacattagtgctgctcgtgacaaagtattacaggttaagcttgatcaggcggcaatggggtcctctggggacgcggcatctggaagtgcgactagcatcgatccaaagggctacctcacaagtcttacgcaatcagagctgaaggcaggtgaaatcgaagtgggagacgtcaaacgtgtgcgcgtcttgctggaatctgtaacaaggacgaatcccaagcatgctccggggtggattgcgctggcgcgcctggaagagctggcgggcaggatagtcaccgctcggaatgtgattgcaaaaggatgtgagctctgcccaaagagtgaagatgcgtggcttgagaacattcgacttaacgaaggtcacaatgccaaagtcattgctgcaaacgcaatcaaaaacaatgaccactccactcggctttggatcgaagctatgcgattggaaacagagccacgtgcaaaaaagaacgtgttgagacaagctattctgcatattccgcaatccgtcacaatctggaaggaggcggttaacctggaagaggaccccgcagacgcacgccttttactggctaaagcagttgaactgataccgctctcggttgagttatggctggcgctcgctcgtcttgagacacctgaaaacgcccaaaaagttttgaacgcggcgcgaaaggccgtgcctaccagccatgagatctggattgctgcttctcgacttcaggagcaaatgggaaccttcaacaaagtgaatgttatgaagcgagctgttcaatcgttggcgagagaaaatgctatgcttaaacgggaggaatggatagcggaggcagagaagtgtgaggaggaaggggctgtcctcacttgcggtgcgatcattcgggagacgctcggatgggggctggatgaagatgacgatcggaaagacatctggatggatgacgcaaaggcgagtatttccagagggaaatatgagacggcaagggctatctatgcgtatgccttgcgtgtcttcgtcaatcgccgatccatatgggttgcagcagcggaccttgaacgcaaccacggcaccaaggaagcgttatggcaggtacttgaaaaagcagttgaggcttgccctcaaagcgaagagctatggctacagcttgcgaaggagaagtggcagtcaggagagattgacgatgccagacgagtgctcggacgtgcatttaaccagaaccctaataacgaggatatctggcttgctgctgtcaagctggaggcggatgctcagcagacggaccaagcccgagagcttcttgcaacagctcgacgcgaagcaggaacagatcgcgtatggataaagagcgtcgccttcgagcggcaactgggtaatgttgacgatgcgctcgaccttgtcaatcaaggtcttcagttgtatcccaaggccgataaactctggatgatgaagggccagatatacgagtcacagaataagctccctcaggcccgcgaagcatatggcactggtactcgagcatgtccgaaatctgtcgctctatggctattggcgtcacgactggaagaaaaggccggggcagtggtcagagcccgatctgttcttgatagggctcgtctagcagtaccaaacagccccgaactgtggacagagagtgtccgagttgaacggcgggcaaataacatccctcaggcgaaggttctgatggccagagcattacaggaggtcccatcatccggccttctgtggagcgaaagcatttggcacctcgaaccgcgctcgcagcggaaggctcgcagtctggaagctatcaagaaggttgacaatgatccaatcctcttcatcacagtagcgcgaatcttctggggcgaacgtcgacttgagaaggcgatgacatggtttgaaaaggcgatcatatcaaacagtgatttcggcgacgcgtgggcctggtactacaagttcctgctgcagcatggtacagatgaaaaacgagccgacgtcatttcgaaatgtgtactttctgagcctaagcacggtgaagtctggcagtccatagcgaaaaatcccgctaatgcctataaatcaaccgaggatatcctaaagttagttgcggacagtcttgtccaataa

SEQ ID NO: 4126 - protein, 941 aa, Aspergillus nidulans FGSC A4
MASGRKDFLSQPAPENYVAGLGRGATGFTTRSDLGPAREGPTPEQIQAALAKRAQLLGAAPPTAYGATREKGKGEEKPAEEEDDERFQDPDNEVGLFAYGQFDQEDDEADRIYREVDEKMDRRRKARREARERQEREEYERKNPKIQQQFVDLKRSLASVSEDEWANLPEVGDLTGRNRRTKQNLRMQQRFYAVPDSVLASARDSSQFDTTVADDGTATDAGANGADGMITNFANISAARDKVLQVKLDQAAMGSSGDAASGSATSIDPKGYLTSLTQSELKAGEIEVGDVKRVRVLLESVTRTNPKHAPGWIALARLEELAGRIVTARNVIAKGCELCPKSEDAWLENIRLNEGHNAKVIAANAIKNNDHSTRLWIEAMRLETEPRAKKNVLRQAILHIPQSVTIWKEAVNLEEDPADARLLLAKAVELIPLSVELWLALARLETPENAQKVLNAARKAVPTSHEIWIAASRLQEQMGTFNKVNVMKRAVQSLARENAMLKREEWIAEAEKCEEEGAVLTCGAIIRETLGWGLDEDDDRKDIWMDDAKASISRGKYETARAIYAYALRVFVNRRSIWVAAADLERNHGTKEALWQVLEKAVEACPQSEELWLQLAKEKWQSGEIDDARRVLGRAFNQNPNNEDIWLAAVKLEADAQQTDQARELLATARREAGTDRVWIKSVAFERQLGNVDDALDLVNQGLQLYPKADKLWMMKGQIYESQNKLPQAREAYGTGTRACPKSVALWLLASRLEEKAGAVVRARSVLDRARLAVPNSPELWTESVRVERRANNIPQAKVLMARALQEVPSSGLLWSESIWHLEPRSQRKARSLEAIKKVDNDPILFITVARIFWGERRLEKAMTWFEKAIISNSDFGDAWAWYYKFLLQHGTDEKRADVISKCVLSEPKHGEVWQSIAKNPANAYKSTEDILKLVADSLVQ

SEQ ID NO: 4127 - DNA, 2736 bp, Candida albicans SC5314
  CDS (1)..(2736): transl_table=12
atggaaaggaaatcatttttagatcaagaagcacctgaaggatatgttgcaggtctggcaagaggtgctgttggatttagaaccagtacatctccagatagtttcaatcgaggaattgccattgtacaaaatgaagaagaagaagaggatgaagacaacaataataaaaccacaacccaattgaatgaaaatgggattctatctacaaaaaaacgaggtaaagaagatgaagatgatgaagaagccgatcgaatatataatgaaattgaaaaaaaactacaatccaaaaaaaggaaatccccaaataataaaaatgacagagccaagccgacagtcaccaccaccaatgacaattcttctactcagttttctgatttgaaacgacaattggcaaatttaaccgaagatgattggttaaatctacctgaacctggtgatatgacaaggaaaaataaacgaacaagattattagaacaacaacaacaaagaatgtattctgctcctgatacattaatatccacttctagttcagccactggtaccaacacaacaaatttcaaatcattatctgaatcaagagataaattattagggtctcaattggataatttattacctgcatatgttaaaaccaatggacaatcgataaacaattccagtagtgttagtgaagaattacaacaaagcatattgaatatgacaggagttgaacaagattcaaaatatgctaatcttcaaaaaaatcgagttattttatcatcattacgtaaatctgaaccttataaaccaagttcatggattctgtcagcaagattagaagaacaagatgggaagaatttaaaacttgctaaacaatatattttagaaggttgtaaaaaatgtcctagaaatgatgaaatttggttagaaaatattcgattgaatcaatctgatattaaattatgtaaacaattaattactaatgccttgaattataatcctaaatcagaaaaattatggttaaaagctactgatttggaaactaacaacataaacaaacgtaaagtattaatgaaaggtttagaaaaaatacctaataatgatcaattatgggagaaattaattgaattagaaaatgatcctaatatggtgaagaaattattattaaaagcagttcaattatgttctcaaaattgggaattttggtcagctttattaaatatatccaactatgaagaaagtaaaaaaatcttgaatcaagctagaaaatctataaaaggcgttaaaaatatattaaaagtttggataactgcttgtcaattagaagaaagagaatatggtgaagaaacaattgatattaataaattaattaaacttatggataaagccatgaaagaaatttcaatttatcaaatgacaaaggatgattggtataaattagcttgtgattctgaaagagaaaatttcaaagtcactactaaggccataattattagttatttgaagtttaaggggttagatcaatcatcaatatttgaagatgttgataaatttttcaatgatggatatattattgttgctaaatcaatattagattatattgttactaattcatctaatgatattaataaatggaaaaaagtctttagtgtgattaaaaaattcaatcaagaattaccattattgttttcatattatgataaggcaatttctttaaatcctcaagtaccattattctatttgatgtatgctaaagataaatggcaattatctaaagatatcccacaagctagatcaattttaaattcaggtgaattggcaaatccaactgatttatcaataaaatttgccattattaaattagaacttataacaggtaatttactaaatgctgaaaaatatattaaacacataattgataccaaaccaatggaatcagagaaattttggtataaatatattcatattctaagatgtcttaatagtgatataaccgtattaaaagatgtgatacagaaggcattgaaactattcccgaattgttggaaattatatcttcaaaatattcaaattttagaagatattgatgaattggaacaagcaagagaaaatgctttagtgggtgttaaaaaatgtcctcaatgtatatatttatggataaaattatctcaaattgatgaaaaagctcaaatcataattcgagctcgttcaatattagatcaagcaatattgcaaaaccccaataatccagaaatttgggtttataaaatacaatttgaaaaacgaattggtaatttatcatcattacaaaatttaactaataaagcccttaaacaatttcctactgatccttggttatggattattaatttatcattaatcccgaaaatgtctcaacgtaaaacaattttcttggatgctttaaaggcaactaataattcaaatttaatattattgatcagtggggtatttttttggtttgatgggaaatattccaaaagtaaaaattggtttgaaagaagtttacaactggataatactaatggtgatatctggagttggatgtataattatttgaaaaaatttggtaccctgaaagaactaaactcatttttaattgattatgaatcaaaatatgattcaattaataaaggtcattttttcaacaagatcaataaagatattaaaaattataacaaatctcctaaagaaattttagatattgtcgctatagaagttttaaactatatcaaatga

SEQ ID NO: 4128 - protein, 911 aa, Candida albicans SC5314
MERKSFLDQEAPEGYVAGSARGAVGFRTSTSPDSFNRGIAIVQNEEEEEDEDNNNKTTTQLNENGILSTKKRGKEDEDDEEADRIYNEIEKKLQSKKRKSPNNKNDRAKPTVTTTNDNSSTQFSDLKRQLANLTEDDWLNLPEPGDMTRKNKRTRLLEQQQQRMYSAPDTLISTSSSATGTNTTNFKSLSESRDKLLGSQLDNLLPAYVKTNGQSINNSSSVSEELQQSILNMTGVEQDSKYANLQKNRVILSSLRKSEPYKPSSWISSARLEEQDGKNLKLAKQYILEGCKKCPRNDEIWLENIRLNQSDIKLCKQLITNALNYNPKSEKLWLKATDLETNNINKRKVLMKGLEKIPNNDQLWEKLIELENDPNMVKKLLLKAVQLCSQNWEFWSALLNISNYEESKKILNQARKSIKGVKNILKVWITACQLEEREYGEETIDINKLIKLMDKAMKEISIYQMTKDDWYKLACDSERENFKVTTKAIIISYLKFKGLDQSSIFEDVDKFFNDGYIIVAKSILDYIVTNSSNDINKWKKVFSVIKKFNQELPLLFSYYDKAISLNPQVPLFYLMYAKDKWQLSKDIPQARSILNSGELANPTDLSIKFAIIKLELITGNLLNAEKYIKHIIDTKPMESEKFWYKYIHILRCLNSDITVLKDVIQKALKLFPNCWKLYLQNIQILEDIDELEQARENALVGVKKCPQCIYLWIKLSQIDEKAQIIIRARSILDQAILQNPNNPEIWVYKIQFEKRIGNLSSLQNLTNKALKQFPTDPWLWIINLSLIPKMSQRKTIFLDALKATNNSNLILLISGVFFWFDGKYSKSKNWFERSLQSDNTNGDIWSWMYNYLKKFGTSKELNSFLIDYESKYDSINKGHFFNKINKDIKNYNKSPKEILDIVAIEVLNYIK

SEQ ID NO: 4129 - DNA, 2781 bp, Ustilago maydis 521
  CDS (1)..(2781)
atgtcggacaagcccaacaaactcgcgtttctgtccatgcaggcacccgccggctacgtcgcgggtctcggacgtggtgcttcgggattcacgacacgagcggatatcggacctgctcgtctgaccgcttcctcgtccgagcacaggtcgaacggcaatgcggacgacgccgatgaccccgacgatgatggaccgggtgacgaagagcaggcacgcttccaggatccagagaacgaaactggcttgttcgccggcgccgtgtacgaaaaggacgaccaagaggcggatcggatttgggaagctgtcgatgcaaagatggactcacgccgcaagaagttcagagaagctcgccagaaggaagagagagacagggcgagagcagaaaagccactgatcagcgcccagttcgccgatctcaaacgtgggcttagtagtgtcacagaagaccagtgggctgcgctcaccgaatccggaagcgtcacgggcaagcggcgcaaggcagcagcgaaacgagaagcgcgcaatacgcgctcgtttgccatctcggatacgatcctggtcggaaatcgcgataggaacgccgtagtgtcggcgctcactccggaccagatgcaagatgctgaccaggacgccggaggaacgattacttcgctcaccgaaattggtgaagcaagaaacaagatcttgtcacatcagctagatcaagcctcggcctctggcacagctacctcgatcgatccgaaaggatacctcaccgaactttcgtccacagtgatcaagagcgatgccgagatcggagacatcaagaaagcgcgcagcctgctagattccgtgatcaaaaccaacccttctcacgcgcctggctggattgcagccgcgcgagtcgaagaagtggcaggcaaaatgtcaaatgcacgcaagatcattcagcagggatgcgatcactgcccacgatcacaagatatttggctcgaagcggcgcggctcaatacaaaagacaacgctaaagtaatcctcgctcgctcgatcgcacacgtctctcaatcggtccccatctggctcaaagcggtcgagctggaaaccgatagcgaaagcaaaaaacgcgtcctccgaaaaagtctggaatacatccctgccagtgtgaagctatggaaggagctggtcaatttggaggagaacccagaggatgcgaggattctcctcagtggagcggtggcggctgtgccgctgagcgtcgagctgtggctagcgttagcgaggctaagcgcaccggaggaggccaagaaggtattgaacgaggcgaggaagacgatcccgacttctcacgagatctggatagcagcggcgaggttgatcgaagagaccgaggcggatgaggtcaaggtggaaaagaccgtggtcgctgccgtcagagcgttgaggaaggctggggtggagttgtcgcgcgatcagtggatggcagaagcggagcaggtggagaggcaaggtagtccgatggtgtgtggagcgattgtcaaggcaaccatcgagctggatgtcgacgaggaggatcgacgcgccgtgtgggtgggggatgcagcaacagcgttagagaaagggtgcgtcgaggtggcgaggagtatcctggcgtatacgttacgcgtcttccccgaccgaccagcgatctggacacaagctgtagcgttggagcagcagcacggtagccaagaaaacgtaattgcgctattggaacgcgcagtgacatcgtgtgccaaagccgaagatctatggcttgccttggcgactgtccaccgcgacgcgggcgacacggccgcggcgaggcaaacgctcatccgcgcgtttgacgccaacatcgggagcgagaagatctcgctcgctgcggcacagctcgaatcgagccagggacagctggtagctgccaggcggctgcttgaacgcgcgcgtgtcgaggtgggttcagcacgcgtatggatgaagagcgcacaattcgagcgcgatcacggatatacctctactgctctgtcgttgatcgatgaggcgctggtgcaattccctcaattcgccaagctgtacatgatgggagcgcagctctctcagcacctcttctctggcgaagagagcgtcaagaaagcacgagaatatctgggccgaggaatacgttggtctcccaactgtgatgcgctatggatcctcgctgctcgactggaagcatgcgctggtctcaccattcgctcgcgcgcgctgctcgaacgtgcgcgcctctcgaatccctcgtcaccgctcatctggtacgaatccatcaccatagagctctcttcttctcctccgaatcctacgcaagcccgaacgctcctctctcgcgcacttcaagtcctccctgattccggcctgctctgggttctcgccatcgccctcgaaccgcgcgcaggtcgcaagaccaaaatgaccgacgctctacgaaaaaccgctgatgacagctacgtactcgccaccgtagcccaacagttctggctagagggcaaacccgctcaggctcgcaaatggttccaacgcgcaacccacgccgctccaaacattggcgaccattacgctatctggtacaaattcgaacaacaacacggcacacagcatcacatcgacacacttcataccctcgtcctcgacgctaagccaaaatacggcctactctggcctcagatacgaaaagatccaaagtacaaagatcgcaccaatgtagacgtgctcaagttggtagcagacaagattgttccgctcaagtga

SEQ ID NO: 4130 - protein, 926 aa, Ustilago maydis 521
MSDKPNKLAFLSMQAPAGYVAGLGRGASGFTTRADIGPARLTASSSEHRSNGNADDADDPDDDGPGDEEQARFQDPENETGLFAGAVYEKDDQEADRIWEAVDAKMDSRRKKFREARQKEERDRARAEKPLISAQFADLKRGLSSVTEDQWAALTESGSVTGKRRKAAAKREARNTRSFAISDTILVGNRDRNAVVSALTPDQMQDADQDAGGTITSLTEIGEARNKILSHQLDQASASGTATSIDPKGYLTELSSTVIKSDAEIGDIKKARSLLDSVIKTNPSHAPGWIAAARVEEVAGKMSNARKIIQQGCDHCPRSQDIWLEAARLNTKDNAKVILARSIAHVSQSVPIWLKAVELETDSESKKRVLRKSLEYIPASVKLWKELVNLEENPEDARILLSGAVAAVPLSVELWLALARLSAPEEAKKVLNEARKTIPTSHEIWIAAARLIEETEADEVKVEKTVVAAVRALRKAGVELSRDQWMAEAEQVERQGSPMVCGAIVKATIELDVDEEDRRAVWVGDAATALEKGCVEVARSILAYTLRVFPDRPAIWTQAVALEQQHGSQENVIALLERAVTSCAKAEDLWLALATVHRDAGDTAAARQTLIRAFDANIGSEKISLAAAQLESSQGQLVAARRLLERARVEVGSARVWMKSAQFERDHGYTSTALSLIDEALVQFPQFAKLYMMGAQLSQHLFSGEESVKKAREYLGRGIRWSPNCDALWILAARLEACAGLTIRSRALLERARLSNPSSPLIWYESITIELSSSPPNPTQARTLLSRALQVLPDSGLLWVLAIALEPRAGRKTKMTDALRKTADDSYVLATVAQQFWLEGKPAQARKWFQRATHAAPNIGDHYAIWYKFEQQHGTQHHIDTLHTLVLDAKPKYGLLWPQIRKDPKYKDRTNVDVLKLVADKIVPLK

SEQ ID NO: 4131 - DNA, 2688 bp, Medicago truncatula
  CDS (1)..(2688)
atgaattttctaaattcgaaaccgcctcccaactacgtcgccggacttggtcgtggcgccaccggcttcaccacccgctccgacatcggtcccgcacgcgccaccacaataggcaatcccgaatactttagaggaaaagaacccgcaaacgacgaagacgatgaagatcatacacaatacgacgagtttgaaggttacaacaacgctggattattcaattcggatgattacgattttgatgataaagaagccgatgaaatttgggattcaattgataagagaatgagtaggtctaagagaaacgatcgcgttctaacagaggaaaattcaaaacctaaatttactgaacaattttctggtttgaaacggaatttgtatacgctatctatgaaggattgggagagtcttgatgaatttcagagtggtattcattcattaaggaataagaagaaaactaggtttgagagttttgttcctgttcctgatactcttcttgagaaagtaatgaaagagaagcaacatgtgtcagtaattggtggaaatgatttgaatgctgttggtgagggtagaggaaatgttttgtcattgaaattggataggttatcggattcggtttcggggatgactaatgttgatccaaaggggtatcttagtgttctttgtaacaatgttattgctagtgatactgaggtttcagattttaataaggcgaggttgttgttaaagagtgttactcgaacgaatccgaagtatgcttgtggatggattgcggctgccaggttggaggagttggcggggaaggttaaggaagcaaggttattgattaagaaaggatgtgaagaatgtccgaagaatgaggatgtttggttggaggcttgtaggctggtgaatccagatgaaacgaagggtgtgatagcgaaaggtgttaagtttattccgaattctgttaagttgtggatgcgggcttcggatttggaagatgatgatgtgaataagagtagggttttgaggaaagggttggagtgtgttccgaattcggttaggctttggaaggcggttgtggagcttgcgaatgaggaagatgctaggcttttacttcatagagccgtggagtgttgtcctttacatgcggaattgtggcttgcactggccaggttggaaacttatgacaatgctaagattgttctcaataaggcactttctaggttgccaaaggaggcgactatatggatagcgatggccaagttggaagaagctaatgggaatacagacaaggttggcaagagaattcagaaggctttggaggaaggaggtgtggtgatcaatagagaaacttggatgaaggaagcagaggtggcagaacgaggtggttcgattgaaacttgccgagcaataataaaaaatacaattggaattggagttgaagaagaagataggaagagaacatgggtagcagatgctgaggaatgcgagaaaagagattctattgagactgccagagctatatatgatcatgccttgaatgtcttcttaactaagaagagcatttggatcaaagcagcacaacttgaaagaagtcacggtacaagggaatcttttgatggtttacttcgtagagcggtcacctacataccacaggttgaagttctttggcttatgcttgccaaggaaaaatggcttgccggagatgtgcctgcagctcgagcacttctccaagaagcttatgctgccataccaaattcagaggaattatggcttgcggcttttaagctcgaatttgaaaatcacgaacctgaaagagctagaatgttgttggctaaagcaagagatcagataggaggtacagagagagtctggatgaagtcagctatagttgagagagaactcggaaacgttgaagaggaaaggagaatgttaaatgaaggattgaagcaattcccttcgttttataaattgtggttgatgcttggccagcttgaggaacggcttgctaagactacaaagcgacaagatcagcctgagaagcggcattctcacatgatgacagccaagaaggtctatgaatctggacagaaaaactgtcctaattctgtgccgctttggctctctcttgctaatcttgaagaggagatgaatgggctgagtaaagttcgtgtaattttcacaatggctcgcaagaagaatcctcaaaaccccgaactctggctagcagctattagagcagaattaaagcatggatacaagaaagaagctgatacgttgatggcaaaagcattgcaggagtgtcccaacagtggaattctatgggcagcttcaatcgagatggcccctcatccccagcgtaaaaccaaaagcaaggatgcactaaagaaatgtaacagtgatccccatgttatagctggtacggccaaattattatggcaccacaggaaggtggagaaagccaggactttgctgaatacggctgtgacacttgctcctgacatcggtgatttttgggtcttgtgctacaaatttgaactgcagcatggaactgaggagaatcagaaggatgtattgaagagatgtgttgctgctgaaccgaaacacggggagaaatggcaagcagtctcgaaggcattggagaacgctcaccaaccaacagagtccatcttgaagaaagttgtgaagtacacttcagaaggatga

SEQ ID NO: 4132 - protein, 895 aa, Medicago truncatula
MNFLNSKPPPNYVAGLGRGATGFTTRSDIGPARATTIGNPEYFRGKEPANDEDDEDHTQYDEFEGYNNAGLFNSDDYDFDDKEADEIWDSIDKRMSRSKRNDRVLTEENSKPKFTEQFSGLKRNLYTLSMKDWESLDEFQSGIHSLRNKKKTRFESFVPVPDTLLEKVMKEKQHVSVIGGNDLNAVGEGRGNVLSLKLDRLSDSVSGMTNVDPKGYLSVLCNNVIASDTEVSDFNKARLLLKSVTRTNPKYACGWIAAARLEELAGKVKEARLLIKKGCEECPKNEDVWLEACRLVNPDETKGVIAKGVKFIPNSVKLWMRASDLEDDDVNKSRVLRKGLECVPNSVRLWKAVVELANEEDARLLLHRAVECCPLHAELWLALARLETYDNAKIVLNKALSRLPKEATIWIAMAKLEEANGNTDKVGKRIQKALEEGGVVINRETWMKEAEVAERGGSIETCRAIIKNTIGIGVEEEDRKRTWVADAEECEKRDSIETARAIYDHALNVFLTKKSIWIKAAQLERSHGTRESFDGLLRRAVTYIPQVEVLWLMLAKEKWLAGDVPAARALLQEAYAAIPNSEELWLAAFKLEFENHEPERARMLLAKARDQIGGTERVWMKSAIVERELGNVEEERRMLNEGLKQFPSFYKLWLMLGQLEERLAKTTKRQDQPEKRHSHMMTAKKVYESGQKNCPNSVPLWLSLANLEEEMNGLSKVRVIFTMARKKNPQNPELWLAAIRAELKHGYKKEADTLMAKALQECPNSGILWAASIEMAPHPQRKTKSKDALKKCNSDPHVIAGTAKLLWHHRKVEKARTLLNTAVTLAPDIGDFWVLCYKFELQHGTEENQKDVLKRCVAAEPKHGEKWQAVSKALENAHQPTESILKKVVKYTSEG

SEQ ID NO: 4133 - DNA, 2817 bp, Aspergillus oryzae
  CDS (1)..(2817)
atggcctccgggcggaaggactttttgagccagccggcccccgaaaactatgttgcaggtctaggtagaggtgcgactggcttcaccactcgttcggacctagggcctgcgcgtgaaggtcccacgccggagcagattcaagcagcgctcgcaaagagggcacagctgcttggtgcagcgcctccgacagcatatggcgcagggcgtgagaaaggtggcaaagaagacaaggctgaggaagaagaggacgatgaacgtttccaggatccggacaatgaagttgggcttttcgcatacggacagttcgatcaagaagatgacgaagcagaccggatatacagagaggtagatgagaagatggacaagcgccggaaagcaagaagggaaatccgggaacgtcaagaacgagaagactacgaacggaaaaacccgaaaatccaacaacagttcgccgatttaaagcgctcattggcctccgtctccgaagacgactgggccaatctccctgaagttggagatcttacaggcaagaatagaagagcgaaacagaacctccgacaacgattttacgcagtaccggatagtgttctcgccagtgcaagagactctacccaattcgagactactgttacagatgacggtgctcataccgacattcagggggaaggagtggacgggacaatcaccaattttgcggatatcagtgctgctcgtgacaaggcccttaaagtcaagcttgaccaagcagctataagttcatctggggattcggcttctggaagtgccactagcattgacccaaagggttatctcacgagtctcacgcagtccgagctaaaagctggtgaagtggagataggcgatatcaaacgagttcgcgttttgctagaatctgtgacgaggactaatccaaagcacgcacctgggtggattgcacttgctcgtctggaggagcttgctggtagaattgtggctgctagaaactgcatcgccaagggatgtgagctgtgtccgaaaagtgaagacgcatggcttgagaatattcgactcaatgaaggtcataatgcgaaggtaatcgctgcaaatgccattcagaataatgatcgctctacaagactctggattgaggctatgaggttggaatctgagcctcgtgcaaagaaaaacgttctgagacaggccattctccacattcctcaatcagttgtcatttggaaagaagctgtcaacttggaagaagaccctgtagatgcacgcctccttctcgcaaaggcagttgaaatgataccattgtctgtggagttgtggcttgcccttgcccggcttgagacacctgagaacgcccaaaaggtcttgaacgctgctaggaaagctgtccctacgagctacgagatatggattgctgcttcacgactgcaggagcagatggggacattcaataaggtgaatgtgatgaagagggctgtacagtccctcgccagagagaacgctatgcttaagagggaggagtggatagcagaagctgagaattgtgaagaggagggagctattcttacttgcggggcgattatccgggagactttaggatggggtctggatgaagacgatgataggaaagacatctggatggatgatgcaaaggccagtattgccaggggcaaatacgagactgcgagagccatctatgcctatgcgttgcgcgtgtttgtgaaccgcagatctatttggcttgcagctgcagaccttgaacgtaatcatggtacgaaggaagcgttatggcaagtccttgagaaggctgtggaagcttgcccacagagtgaagagctatggctgctccttgcgaaagagaaatggcaaactggagaaatcgatgaggccagacgagtactgggacgcgcttttaaccagaatcccaataacgaggatatttggcttgctgctgttaagctcgaggccgacgcccggcaaacagaccaggctagagagctccttgcgactgctcgtcgggaagccggaacagaccgtgtttgggtgaaaagtgtcgcctttgagcgacaactgggtaatgcaaatgaggcgctagacctagtaaatcagggccttcaactatacccgaaggcggacaagctttggatgatgaagggtcaaatctatgaatcccagaataagtacccgcaagcccgggaggtgtatggaacaggtactcgtgcgtgttccagatcggttccgttgtggctgttggcttcaagactggaagaaaaggctggtgctgtcgtcaaggctcgctctgttcttgacagagctcggcttgctgttcctaagagtgctgaactgtggacagaaagtgttcgtgttgaacggcgtgcaaacaatatcgcccaagctaagatcttgatggcaaaggcattgcaggaagttccaacatctggattgttatggagtgagagtatctggcatctcgaaccgcgggcacaacgcaaggctcgcagcttggaggctatcaagaaggttgataatgacccgatattattcattacagtggctaggattttctggggagagcgtcgactggagaaagcaatgacatggtttgaaaaggcgattgtgtccgacagcgatttaggggacggttgggcttggtattacaagttcctattgcagcatggaacagaggagaagcgggcagatgtggtatcgaagtgcatctctacagagcccaaacatggcgaagtctggcaatcggtggctaaaaatcctgctaacgcgcacaagtcgaccgaggagattttgaagatggttgccgagcgacttgtgtag

SEQ ID NO: 4134 - protein, 938 aa, Aspergillus oryzae
MASGRKDFLSQPAPENYVAGLGRGATGFTTRSDLGPAREGPTPEQIQAALAKRAQLLGAAPPTAYGAGREKGGKEDKAEEEEDDERFQDPDNEVGLFAYGQFDQEDDEADRIYREVDEKMDKRRKARREIRERQEREDYERKNPKIQQQFADLKRSLASVSEDDWANLPEVGDLTGKNRRAKQNLRQRFYAVPDSVLASARDSTQFETTVTDDGAHTDIQGEGVDGTITNFADISAARDKALKVKLDQAAISSSGDSASGSATSIDPKGYLTSLTQSELKAGEVEIGDIKRVRVLLESVTRTNPKHAPGWIALARLEELAGRIVAARNCIAKGCELCPKSEDAWLENIRLNEGHNAKVIAANAIQNNDRSTRLWIEAMRLESEPRAKKNVLRQAILHIPQSVVIWKEAVNLEEDPVDARLLLAKAVEMIPLSVELWLALARLETPENAQKVLNAARKAVPTSYEIWIAASRLQEQMGTFNKVNVMKRAVQSLARENAMLKREEWIAEAENCEEEGAILTCGAIIRETLGWGLDEDDDRKDIWMDDAKASIARGKYETARAIYAYALRVFVNRRSIWLAAADLERNHGTKEALWQVLEKAVEACPQSEELWLLLAKEKWQTGEIDEARRVLGRAFNQNPNNEDIWLAAVKLEADARQTDQARELLATARREAGTDRVWVKSVAFERQLGNANEALDLVNQGLQLYPKADKLWMMKGQIYESQNKYPQAREVYGTGTRACSRSVPLWLLASRLEEKAGAVVKARSVLDRARLAVPKSAELWTESVRVERRANNIAQAKILMAKALQEVPTSGLLWSESIWHLEPRAQRKARSLEAIKKVDNDPILFITVARIFWGERRLEKAMTWFEKAIVSDSDLGDGWAWYYKFLLQHGTEEKRADVVSKCISTEPKHGEVWQSVAKNPANAHKSTEEILKMVAERLV

SEQ ID NO: 4135 - DNA, 3120 bp, Oryza sativa
  CDS (1)..(3120)
atggtgttcgtccgcgcgccggacgggaggacccaccacgtcgacctcgacccctccaccgccacgctcgccgacctcacggcctccgcctcccgcgtctgcggcggcgtcccgccggagcagctgcggctctacctcgcccaccgccgcctcctcccggccgagccgtccccgctgctgtcctccctccgggtctcggcctcctcctccctgctactccacctccccctgctcggagggatgaccggcccgacgacgacccccgcggcacccccgcccccgccgccgccgtcggcgcagccgcccgcccgccccgcgcgctacgacttcctcaactccaagccgcccccgaactacgtggccggtctggggcgtggcgccaccgggttcaccacccgttcggatatcgggccggcccgcgcggcgcccgatctgcctgaccggtccgccgccgccgccgccgcccccgccgtcgggcgcggccgtgggaagccacccggggacgacgacggcgacgacgatggcggcgacgaggagaaggggtacgacgagaaccagaagttcgacgagttcgagggcaacgacgccgggctgttctccaacgccgactacgacgacgacgaccgcgaggcggatgcggtctgggagagcatcgaccagaggatggactctcgccggaaggatcggcgggaggcgcggctgaagcaggagatcgagaagtaccgtgcttccaaccctaagatcaccgagcaattcgctgatttgaagcgtaagttggtcgatttgtcggcgcaggagtgggaaagcatacctgaaattggggactactcgctgcgcaacaagaagaagcgatttgagagcttcgttcccgtgccggacaccctgctcgagaaggctcggcaggagcaggagcatgtcacggcactggatcccaagagccgtgcagctggtggcaccgagacgccatgggcgcagactccggttaccgatctgacggctgtgggcgaaggtcgtggcaccgtgctctccttgaagctggacaggttgtcggattcggtatctggtcttactgttgttgatccaaagggttacttgacggacctgaaaagtatgaagattactagtgatgctgagatttctgacattaaaaaggcgcgattgttgcttaagtcagtgacacagacaaacccgaagcatccaccaggatggattgctgctgctaggcttgaagaggttgctggcaagcttcaggttgctcggcagcttatccagcgtggctgtgaggagtgccccacaaatgaggatgtttgggtcgaggcatgccggctggccagcccagacgaggcaaaggcagtgattgctaggggcgtgaaggcaattcccaattctgtgaagctgtggttgcaggcagcaaagttggaaactagtgatttgaataagagcagggttttgagaaaagggttggaacacattcctgattcagtcagactgtggaaagcagtagtagagcttgcaaatgaggaggatgcaagactgttgcttcacagggctgtggagtgctgcccactccatgtggaactgtggcttgccctagcaaggctggagacatatgaccaagcaaagaaggtacttaacaaggcaagagaaaagcttcctaaggaacctgccatctggattacagctgcaaagctggaggaagctaatggaaacacccagtcagtaatcaaggtgattgagagaagtataaaaactttacagagagaaggattggatattgacagggaggcatggctaaaggaagcagaagctgctgagcgtgctggatctgtattgacttgccaggctattgttaagagcactattggcattggtgttgatgaggaagacagaaaacgcacatgggttgccgatgctgaggaatgcaagaagcgtggttcaattgagacagcccgtgccatctatgcgcatgcactcagtgtcttcgtttccaagaagagtatttggctgaaagcggctcagcttgagaagagccatggaaccaaggagtctctttataatctcctcagaaaggctgttacctacaatccacgtgcagaagttttatggcttatgagtgcaaaggagaaatggctggctggagatgtcccggctgcccgagccattcttcaggaagcttatgcttctctccccaattcagaggagatctggctagctgccttcaagcttgagtttgagaacaatgaaccagagagagcaagaattcttttgtcaaaggccagggaaagaggaggcactgagagggtctggatgaaatctgcgattgttgaaagggagttagggaatgtagacgaagaaaggaagctgttggaggaaggtctgaagttattcccctcattcttcaagctgtggttaatgcttggacaaatggaagaccggcttggccatggatccaaggcaaaggaggtttacgagaatgcactgaagcactgcccgagttgcatccctctttggctctctctagctaatctagaggagaagataaatggcttgagcaagtcacgtgctgtcctcaccatggcaagaaagaagaacccagctacacctgaactctggcttgcagcagttagggctgaattgagacatgggaacaagaaggaagctgatgctctactagccaaggcattacaggaatgcccgacaagtggtattttgtgggctgcagctatagagatggtgccacgtccccagcgtaaagcaaagagctcagatgctataaaacgatgtgaccatgatccccatgtcattgcagctgtggccaaacttttctggcatgataggaaggttgataaagctagaagttggttgaatagagctgttactcttgctccagacattggagatttttgggccttgtactacaaatttgaactgcaacatggaaatgctgatacacaaaaggatgtcctacaaagatgtgttgcagcagaaccaaagcatggagagagatggcaagcaataacaaaggctgttgagaactcacatctgtcaattgaggcccttctgaagaaagctgtgttggctcttggccaggaagaaaatccaaatgctgcagatccctag

SEQ ID NO: 4136 - protein, 1039 aa, Oryza sativa
MVFVRAPDGRTHHVDLDPSTATLADLTASASRVCGGVPPEQLRLYLAHRRLLPAEPSPLLSSLRVSASSSLLLHLPLLGGMTGPTTTPAAPPPPPPPSAQPPARPARYDFLNSKPPPNYVAGLGRGATGFTTRSDIGPARAAPDLPDRSAAAAAAPAVGRGRGKPPGDDDGDDDGGDEEKGYDENQKFDEFEGNDAGLFSNADYDDDDREADAVWESIDQRMDSRRKDRREARLKQEIEKYRASNPKITEQFADLKRKLVDLSAQEWESIPEIGDYSLRNKKKRFESFVPVPDTLLEKARQEQEHVTALDPKSRAAGGTETPWAQTPVTDLTAVGEGRGTVLSLKLDRLSDSVSGLTVVDPKGYLTDLKSMKITSDAEISDIKKARLLLKSVTQTNPKHPPGWIAAARLEEVAGKLQVARQLIQRGCEECPTNEDVWVEACRLASPDEAKAVIARGVKAIPNSVKLWLQAAKLETSDLNKSRVLRKGLEHIPDSVRLWKAVVELANEEDARLLLHRAVECCPLHVELWLALARLETYDQAKKVLNKAREKLPKEPAIWITAAKLEEANGNTQSVIKVIERSIKTLQREGLDIDREAWLKEAEAAERAGSVLTCQAIVKSTIGIGVDEEDRKRTWVADAEECKKRGSIETARAIYAHALSVFVSKKSIWLKAAQLEKSHGTKESLYNLLRKAVTYNPRAEVLWLMSAKEKWLAGDVPAARAILQEAYASLPNSEEIWLAAFKLEFENNEPERARILLSKARERGGTERVWMKSAIVERELGNVDEERKLLEEGLKLFPSFFKLWLMLGQMEDRLGHGSKAKEVYENALKHCPSCIPLWLSLANLEEKINGLSKSRAVLTMARKKNPATPELWLAAVRAELRHGNKKEADALLAKALQECPTSGILWAAAIEMVPRPQRKAKSSDAIKRCDHDPHVIAAVAKLFWHDRKVDKARSWLNRAVTLAPDIGDFWALYYKFELQHGNADTQKDVLQRCVAAEPKHGERWQAITKAVENSHLSIEALLKKAVLALGQEENPNAADP

SEQ ID NO: 4137 - DNA, 2721 bp, Schizosaccharomyces pombe
  CDS (1)..(2721)
atggcaaacttttatccagattttctgaatatgcagccacctcctaactatgtagcaggtttaggacgtggtgcaacaggatttacaacgcgttcagatcttgggcctgctcaagaattgccatcccaagaatctataaaggctgcaattgaacaaaggaaatcagaaatagaggaagaagaagatatcgatcctcgttatcaggatcctgacaatgaagtagcgctgtttgctactgctccatatgatcatgaggacgaagaagctgataaaatatatcaatctgtagaggaacatttaagtaaaagaagaaaatcccaacgtgaaaaacaagaacagctacagaaagaaaaatatgaaaaagaaaaccccaaggtttcttcacaatttgcggacttaaaacgtgggttatccactttgacagatgaagactggaataatatcccagaacccggcgatctaactcgtaaaaaaaggactaaacagccgagacgtgaaagattttatgcaacaagtgattttgttcttgcaagtgctcgcaatgaaaatcaagctatctctaattttgcagtggatactcaagcaggaacagaaactccagatatgaatgggacaaaaacaaattttgttgaaattggagctgctcgtgacaaagttttaggtatcaagttagcacaagcttcgtcgaatttgacttcaccatcgactatagatccgaaggggtatttaactagtctgaatagtatggttccaaaaaatgccaatgacctgggtgatataagaaaagctagaaaattgttgcaaagtgttattgaaacgaatccaaagcacgcctctggctgggtagctgctgcgcggcttgaagaggtcgcgaataaattatctcaagcacaatctttaattttaaaaggttgcgaaaattgttctcgctctgaggatgtttggctagaagcaatacgactacacccggctgcagaagcaaaagttattattgcaaatgccgttaaaaaattaccaaagtcagtgacgttatggcttgaagccgaaaaacttgaaaatcaagctcagcacaaaaaaaggattataaaaaaagctttagaatttaacccgacttctgtaagcttatggaaagaagctgtaaatttagaagaagaagtggataatgcaaggatactattagctcgtgccgttgaattaatacccatgtccattgatttatggttagctcttgctcgacttgaaacttatgagaatgctaaaaaggtgctcaataaagccagacaaaccatccgtacttcccatgaggtttggattgctgctgctcgtttggaagaacagcaaggtaatgtatcacgggtggaaaaaataatggctcgtggtgtaagtgagttacaggctactggtggtatgttacaacgcgatcagtggctttccgaggctgaaaaatgcgaaactgaaggggcagtgattactgcacaagctataattaatacgtgcctcggtgttggattggatgaagaagatcaattcgacacctggttagatgatgctcaatcttttatagctcgtaaatgtatagattgtgcgcgtgctgtttttgctttttctttaagagtctatccaaaaagtgagaaactttggctgagagctgttgaacttgaaaagctgtatggtacaacagaaagtgtttgttctattttagaaaaagctgtagaatcatgtcctaaagccgaaattttatggttgctttatgctaaagagcgaaaaaacgttaatgatattgctggtgctcggaatattcttgggagagcttttgaatataattctaatagcgaagagatatggcttgctgctgtcagaattgaatttgtgaacaatgaaaatgaacgtgccagaaagctacttgcccgtgctcgtatcgaatcgggaactgaacgaatatggactaaatccatttcgcttgaacgaattttggacgaaaaagatcgggcgttacaacttttggaaaatgcactgaaaatttatccccattatgataagttgtacatgatgaagggtcaaatttttgaagataaagagcagattgagcttgctcgagacgcatacttggctggcacaaaagtttgtccttattccatacctttgtggcttttgctagccaaacttgaagaaaagcagtccgttatacgcgcgagagttgtgtttgatagggctaaggttaaaaatcctaagaatgaatttttatggcttgaacttataaaaatggaactccgggcggggaatatttcacaagttcgtgcagcccttgctaaggccttgcaggaatgcccatcttcgggtttgctgtggacggaggctatatggcttgaacctcgcgcacagcgtaaaactcgtgctacagatgctttaaggaaatgtgaaggcaatgcacatttactttgcaccatcgccaggatgctgtggctggaaaaaaaagcagataaggcgcgtagttggtttttaaaagctgttaaggctgaccaagataacggagatgtgtggtgttggttttataagtatagcttagaggctgggaacgaagaccaacagaaagaagtgcttacaagttttgaaaccgctgatcctcatcatggttatttttggcccagtattactaaagatatcaaaaattctcggaaaactccgcaggaactattacatcttgccataaatgtgttatga

SEQ ID NO: 4138 - protein, 906 aa, Schizosaccharomyces pombe
MANFYPDFLNMQPPPNYVAGLGRGATGFTTRSDLGPAQELPSQESIKAAIEQRKSEIEEEEDIDPRYQDPDNEVALFATAPYDHEDEEADKIYQSVEEHLSKRRKSQREKQEQLQKEKYEKENPKVSSQFADLKRGLSTLTDEDWNNIPEPGDLTRKKRTKQPRRERFYATSDFVLASARNENQAISNFAVDTQAGTETPDMNGTKTNFVEIGAARDKVLGIKLAQASSNLTSPSTIDPKGYLTSLNSMVPKNANDLGDIRKARKLLQSVIETNPKHASGWVAAARLEEVANKLSQAQSLILKGCENCSRSEDVWLEAIRLHPAAEAKVIIANAVKKLPKSVTLWLEAEKLENQAQHKKRIIKKALEFNPTSVSLWKEAVNLEEEVDNARILLARAVELIPMSIDLWLALARLETYENAKKVLNKARQTIRTSHEVWIAAARLEEQQGNVSRVEKIMARGVSELQATGGMLQRDQWLSEAEKCETEGAVITAQAIINTCLGVGLDEEDQFDTWLDDAQSFIARKCIDCARAVFAFSLRVYPKSEKLWLRAVELEKLYGTTESVCSILEKAVESCPKAEILWLLYAKERKNVNDIAGARNILGRAFEYNSNSEEIWLAAVRIEFVNNENERARKLLARARIESGTERIWTKSISLERILDEKDRALQLLENALKIYPHYDKLYMMKGQIFEDKEQIELARDAYLAGTKVCPYSIPLWLLLAKLEEKQSVIRARVVFDRAKVKNPKNEFLWLELIKMELRAGNISQVRAALAKALQECPSSGLLWTEAIWLEPRAQRKTRATDALRKCEGNAHLLCTIARMLWLEKKADKARSWFLKAVKADQDNGDVWCWFYKYSLEAGNEDQQKEVLTSFETADPHHGYFWPSITKDIKNSRKTPQELLHLAINVL

SEQ ID NO: 4139 - DNA, 2679 bp, Oryza sativa
  CDS (1)..(2679)
atggcctccccgaccgcgaccaccccctcggcgcctccgccaccaccaccgccacccgcagcctgcgccgcgcgctacgacttcctcaactccaagccgccccccaactacgtggcgagactgggacgcggcgccgccgggttcaccacccgctcggatatcgggcccgccatggggcgcggccgtgggaagccgcctggggacgacggcgacggcgatggcggtggcgacgaggaggagaaggggtacgacgagaaccagaagttcgacgagttcgagggcaacgacgccggcctcttctccaacgccggccacgacgacgacgacgacgaccgcgaggcggacgcggtctgggagggcatcgaccggaggatggactcgcgccgcaaggactggcgagaggcgcggctgaagcaggagatcgagaggtaccgcgcgtccaaccctaaaatcaccgagcaattcgccgatctgaagcggaaattggtcgatttgtcagcgcaggagtgggagagcataccggagattggggattattcgcttcgtcgcaacaagaagaggcgatttgagagctttgtcccggtgcctgacaccctgctcgagaaggcccggcaggagcaggggcatgtcaccgcattggaccccaagagccgtgcagccgccgctggcgcagagacgccatgggcgcagactccggttactgatctgacagccgtcggcgaaggccgtggcaccgtgctttctttgaagctggacaggttatccgattcggtatccggtgttactattgttgatccaaggggttacctgactaacctgaagagtatgaagattactagtgatgctgaaatttctgacataaagaaggccaggttgttgctcaagtcagtgatacagacgaacccaaagcatccaccaggatggattgctgctgctaggcttgaagaggttgccggcaagcttcaggttgctcagcagctcatccagcgtggctgcgaggagtgccccacgaatgaggatgtttggctcaaggcatgccggttggccagcccagatgaggcaaaggccgtgattgccaggggtgtgaaggaaattcccaattctgtgaagctgtggttgcaggcagcgaagttggaaactagtgacttgaataagagcagggttttgagaaaagggttggaacacattcctgattcagtcaggctgtggaaatcagtagtagagcttgcaaatgaggaggatgcaaggctgttgcttcacagggctgtggagtgctgcccattccatttggaactgtggcttgcactagcgaggctggagacgtatgaccaagcaaagaaggtacttaacaaggcaaaagaaaagctccctaaggagcctgccatctggattatggctgcaaagctggaggaagctaatggaaacaccgagtcagtaaacgaggtgattgagagaagtataaaaactttacagggaaaaggattgggtattgacagggaggcatggctaaaggaagcagaagctgctgagcatgctggatctgtgatgacttgccaggctattgtgaagaacactattggcgttggtgttgatgatgaagacagaaaacgcacatgggttgctgatgctgaggaatgcaagaagcgtggttcagttgagacagcccctgccatctatgcacatgtgctcagtgtcttcaaattcaagaagagtatttggttgaaagcggctcagcttgagaagagacatgggactgaggagtctctttatattctcctcagtaaggctacaacatacaatcgacatgcagaagtgctatggcttatgtatgcaaaggagaaatggctggctggagatgtccctgctgcccaaaccattcttcaggaagcttacgcttatcttcccaattcagaggagatctggctagctgccttcaagcttgagtttgagaacaatgaaccagagagagcaagaattcttttgtcaaaggccagggaaagaggaggcactgagagggtctggatgaaatctgccattgttgaaagggagttagggaatgtagacgaggaaagaaagctgttggaggaagaggagaagataaatggcttgaggaagtcacgtgctgttctcaccatggcaagaaagaagaacccagctacacctgaactctggcttgcagcagttcgagctgaattgaggcataggaacaagaaggaagctgatgctttactagccaaggcattgcaggagtgcccaacaagtggtatcttgtgggctgcagctatagagatggtgccacgtccccaacgtaaagcaaagagctcggatgctataaaacgatgtgaccatgatccccatgtcattgcagccgtggctaaacttttctggcatgataggaagtttgataaagctaggagttggttgaacagagctgttactcttgctccagacattggagatttttgggccttgtactacaaattcgaactacaacatggaaacgctgatacacataaggatgttgtacaacgatgtgttgcatcagaaccaaagcatggagagagatggcaagcaatagcgaaggctgttgagaactcacacctgtcgattgaggcccttctgaagaaagctgtggtggctcttggccaggatgaaaatccaaatgctgtagatccctag

SEQ ID NO: 4140 - protein, 892 aa, Oryza sativa
MASPTATTPSAPPPPPPPPAACAARYDFLNSKPPPNYVARLGRGAAGFTTRSDIGPAMGRGRGKPPGDDGDGDGGGDEEEKGYDENQKFDEFEGNDAGLFSNAGHDDDDDDREADAVWEGIDRRMDSRRKDWREARLKQEIERYRASNPKITEQFADLKRKLVDLSAQEWESIPEIGDYSLRRNKKRRFESFVPVPDTLLEKARQEQGHVTALDPKSRAAAAGAETPWAQTPVTDLTAVGEGRGTVLSLKLDRLSDSVSGVTIVDPRGYLTNLKSMKITSDAEISDIKKARLLLKSVIQTNPKHPPGWIAAARLEEVAGKLQVAQQLIQRGCEECPTNEDVWLKACRLASPDEAKAVIARGVKEIPNSVKLWLQAAKLETSDLNKSRVLRKGLEHIPDSVRLWKSVVELANEEDARLLLHRAVECCPFHLELWLALARLETYDQAKKVLNKAKEKLPKEPAIWIMAAKLEEANGNTESVNEVIERSIKTLQGKGLGIDREAWLKEAEAAEHAGSVMTCQAIVKNTIGVGVDDEDRKRTWVADAEECKKRGSVETAPAIYAHVLSVFKFKKSIWLKAAQLEKRHGTEESLYILLSKATTYNRHAEVLWLMYAKEKWLAGDVPAAQTILQEAYAYLPNSEEIWLAAFKLEFENNEPERARILLSKARERGGTERVWMKSAIVERELGNVDEERKLLEEEEKINGLRKSRAVLTMARKKNPATPELWLAAVRAELRHRNKKEADALLAKALQECPTSGILWAAAIEMVPRPQRKAKSSDAIKRCDHDPHVIAAVAKLFWHDRKFDKARSWLNRAVTLAPDIGDFWALYYKFELQHGNADTHKDVVQRCVASEPKHGERWQAIAKAVENSHLSIEALLKKAVVALGQDENPNAVDP

SEQ ID NO: 4141 - DNA, 24 bp, Artificial sequence
  primer
atggagaggccatcttttttggat

SEQ ID NO: 4142 - DNA, 26 bp, Artificial sequence
  primer
ttatttgtcattcatcaagcgcaata

SEQ ID NO: 4143 - protein, 1012 aa, Artificial sequence
  consensus sequence
  Variant (3)..(6): Xaa in position 3 to 6 is any amino acid
  Variant (8)..(9): Xaa in position 8 to 9 is any amino acid
  Variant (14)..(14): Xaa in position 14 is any amino acid
  Variant (19)..(19): Xaa in position 19 is any amino acid
  Variant (22)..(22): Xaa in position 22 is any amino acid
  Variant (25)..(45): Xaa in position 25 to 45 is any amino acid
  Variant (46)..(95): Xaa in position 46 to 95 is any or no amino acid
  Variant (97)..(97): Xaa in position 97 is any amino acid
  Variant (100)..(100): Xaa in position 100 is any amino acid
  Variant (101)..(102): Xaa in position 101 to 102 is any or no amino acid
  Variant (106)..(128): Xaa in position 106 to 128 is any amino acid
  Variant (129)..(143): Xaa in position 129 to 143 is any or no amino acid
  Variant (146)..(146): Xaa in position 146 is any amino acid
  Variant (151)..(151): Xaa in position 151 is any amino acid
  Variant (153)..(159): Xaa in position 153 to 159 is any amino acid
  Variant (161)..(163): Xaa in position 161 to 163 is any amino acid
  Variant (166)..(167): Xaa in position 166 to 167 is any amino acid
  Variant (169)..(171): Xaa in position 169 to 171 is any amino acid
  Variant (172)..(176): Xaa in position 172 to 176 is any or no amino acid
  Variant (178)..(189): Xaa in position 178 to 189 is any amino acid
  Variant (190)..(191): Xaa in position 190 to 191 is any or no amino acid
  Variant (194)..(208): Xaa in position 194 to 208 is any amino acid
  Variant (209)..(238): Xaa in position 209 to 238 is any or no amino acid
  Variant (240)..(242): Xaa in position 240 to 242 is any amino acid
  Variant (244)..(246): Xaa in position 244 to 246 is any amino acid
  Variant (249)..(255): Xaa in position 249 to 255 is any amino acid
  Variant (256)..(271): Xaa in position 256 to 271 is any or no amino acid
  Variant (273)..(275): Xaa in position 273 to 275 is any amino acid
  Variant (278)..(292): Xaa in position 278 to 292 is any amino acid
  Variant (293)..(298): Xaa in position 293 to 298 is any or no amino acid
  Variant (300)..(303): Xaa in position 300 to 303 is any amino acid
  Variant (305)..(306): Xaa in position 305 to 306 is any amino acid
  Variant (308)..(308): Xaa in position 308 is any amino acid
  Variant (310)..(314): Xaa in position 310 to 314 is any amino acid
  Variant (316)..(320): Xaa in position 316 to 320 is any amino acid
  Variant (324)..(324): Xaa in position 324 is any amino acid
  Variant (330)..(336): Xaa in position 330 to 336 is any amino acid
  Variant (337)..(337): Xaa in position 337 is any or no amino acid
  Variant (339)..(341): Xaa in position 339 to 341 is any amino acid
  Variant (343)..(344): Xaa in position 343 to 344 is any amino acid
  Variant (347)..(348): Xaa in position 347 to 348 is any amino acid
  Variant (351)..(352): Xaa in position 351 to 352 is any amino acid
  Variant (355)..(355): Xaa in position 355 is any amino acid
  Variant (359)..(360): Xaa in position 359 to 360 is any amino acid
  Variant (363)..(368): Xaa in position 363 to 368 is any amino acid
  Variant (369)..(373): Xaa in position 369 to 373 is any or no amino acid
  Variant (375)..(386): Xaa in position 375 to 386 is any amino acid
  Variant (388)..(389): Xaa in position 388 to 389 is any amino acid
  Variant (392)..(393): Xaa in position 392 to 393 is any amino acid
  Variant (395)..(396): Xaa in position 395 to 396 is any amino acid
  Variant (399)..(403): Xaa in position 399 to 403 is any amino acid
  Variant (404)..(405): Xaa in position 404 to 405 is any or no amino acid
  Variant (407)..(408): Xaa in position 407 to 408 is any amino acid
  Variant (410)..(411): Xaa in position 410 to 411 is any amino acid
  Variant (413)..(413): Xaa in position 413 is any amino acid
  Variant (415)..(417): Xaa in position 415 to 417 is any amino acid
  Variant (419)..(422): Xaa in position 419 to 422 is any amino acid
  Variant (426)..(427): Xaa in position 426 to 427 is any amino acid
  Variant (429)..(429): Xaa in position 429 is any amino acid
  Variant (431)..(438): Xaa in position 431 to 438 is any amino acid
  Variant (439)..(439): Xaa in position 439 is any or no amino acid
  Variant (442)..(443): Xaa in position 442 to 443 is any amino acid
  Variant (445)..(448): Xaa in position 445 to 448 is any amino acid
  Variant (450)..(453): Xaa in position 450 to 453 is any amino acid
  Variant (456)..(456): Xaa in position 456 is any amino acid
  Variant (459)..(460): Xaa in position 459 to 460 is any amino acid
  Variant (462)..(469): Xaa in position 462 to 469 is any amino acid
  Variant (470)..(470): Xaa in position 470 is any or no amino acid
  Variant (473)..(473): Xaa in position 473 is any amino acid
  Variant (475)..(484): Xaa in position 475 to 484 is any amino acid
  Variant (485)..(487): Xaa in position 485 to 487 is any or no amino acid
  Variant (490)..(493): Xaa in position 490 to 493 is any amino acid
  Variant (495)..(495): Xaa in position 495 is any amino acid
  Variant (497)..(511): Xaa in position 497 to 511 is any amino acid
  Variant (512)..(521): Xaa in position 512 to 521 is any or no amino acid
  Variant (523)..(531): Xaa in position 523 to 531 is any amino acid
  Variant (532)..(537): Xaa in position 532 to 537 is any or no amino acid
  Variant (539)..(541): Xaa in position 539 to 541 is any amino acid
  Variant (543)..(545): Xaa in position 543 to 545 is any amino acid
  Variant (547)..(555): Xaa in position 547 to 555 is any amino acid
  Variant (558)..(605): Xaa in position 558 to 605 is any amino acid
  Variant (606)..(610): Xaa in position 606 to 610 is any or no amino acid
  Variant (612)..(633): Xaa in position 612 to 633 is any amino acid
  Variant (634)..(635): Xaa in position 634 to 635 is any or no amino acid
  Variant (637)..(645): Xaa in position 637 to 645 is any amino acid
  Variant (646)..(656): Xaa in position 646 to 656 is any or no amino acid
  Variant (658)..(658): Xaa in position 658 is any amino acid
  Variant (660)..(661): Xaa in position 660 to 661 is any amino acid
  Variant (664)..(665): Xaa in position 664 to 665 is any amino acid
  Variant (667)..(673): Xaa in position 667 to 673 is any amino acid
  Variant (674)..(675): Xaa in position 674 to 675 is any or no amino acid
  Variant (677)..(679): Xaa in position 677 to 679 is any amino acid
  Variant (681)..(682): Xaa in position 681 to 682 is any amino acid
  Variant (684)..(694): Xaa in position 684 to 694 is any amino acid
  Variant (697)..(698): Xaa in position 697 to 698 is any amino acid
  Variant (702)..(709): Xaa in position 702 to 709 is any amino acid
  Variant (711)..(724): Xaa in position 711 to 724 is any amino acid
  Variant (725)..(728): Xaa in position 725 to 728 is any or no amino acid
  Variant (730)..(730): Xaa in position 730 is any amino acid
  Variant (732)..(736): Xaa in position 732 to 736 is any amino acid
  Variant (738)..(751): Xaa in position 738 to 751 is any amino acid
  Variant (752)..(759): Xaa in position 752 to 759 is any or no amino acid
  Variant (761)..(763): Xaa in position 761 to 763 is any amino acid
  Variant (765)..(767): Xaa in position 765 to 767 is any amino acid
  Variant (770)..(774): Xaa in position 770 to 774 is any amino acid
  Variant (776)..(785): Xaa in position 776 to 785 is any amino acid
  Variant (786)..(799): Xaa in position 786 to 799 is any or no amino acid
  Variant (801)..(811): Xaa in position 801 to 811 is any amino acid
  Variant (813)..(816): Xaa in position 813 to 816 is any amino acid
  Variant (819)..(819): Xaa in position 819 is any amino acid
  Variant (820)..(825): Xaa in position 820 to 825 is any or no amino acid
  Variant (827)..(833): Xaa in position 827 to 833 is any amino acid
  Variant (834)..(835): Xaa in position 834 to 835 is any or no amino acid
  Variant (837)..(838): Xaa in position 837 to 838 is any amino acid
  Variant (840)..(841): Xaa in position 840 to 841 is any amino acid
  Variant (843)..(845): Xaa in position 843 to 845 is any amino acid
  Variant (848)..(851): Xaa in position 848 to 851 is any amino acid
  Variant (854)..(859): Xaa in position 854 to 859 is any amino acid
  Variant (861)..(864): Xaa in position 861 to 864 is any amino acid
  Variant (865)..(866): Xaa in position 865 to 866 is any or no amino acid
  Variant (868)..(873): Xaa in position 868 to 873 is any amino acid
  Variant (875)..(877): Xaa in position 875 to 877 is any amino acid
  Variant (880)..(882): Xaa in position 880 to 882 is any amino acid
  Variant (884)..(884): Xaa in position 884 is any amino acid
  Variant (886)..(887): Xaa in position 886 to 887 is any amino acid
  Variant (890)..(900): Xaa in position 890 to 900 is any amino acid
  Variant (901)..(904): Xaa in position 901 to 904 is any or no amino acid
  Variant (907)..(911): Xaa in position 907 to 911 is any amino acid
  Variant (913)..(929): Xaa in position 913 to 929 is any amino acid
  Variant (932)..(938): Xaa in position 932 to 938 is any amino acid
  Variant (940)..(941): Xaa in position 940 to 941 is any amino acid
  Variant (943)..(945): Xaa in position 943 to 945 is any amino acid
  Variant (947)..(953): Xaa in position 947 to 953 is any amino acid
  Variant (956)..(956): Xaa in position 956 is any amino acid
  Variant (958)..(960): Xaa in position 958 to 960 is any amino acid
  Variant (962)..(967): Xaa in position 962 to 967 is any amino acid
  Variant (969)..(982): Xaa in position 969 to 982 is any amino acid
  Variant (983)..(987): Xaa in position 983 to 987 is any or no amino acid
  Variant (989)..(990): Xaa in position 989 to 990 is any amino acid
  Variant (992)..(993): Xaa in position 992 to 993 is any amino acid
  Variant (995)..(998): Xaa in position 995 to 998 is any amino acid
  Variant (1000)..(1011): Xaa in position 1000 to 1011 is any amino acid
FLXXXXPXXYVAGXGRGAXGFXTRXXXXXXXXXXXXXXXXXXXXXXXXXXXXXXXXXXXXXXXXXXXXXXXXXXXXXXXXXXXXXXXXXXXXXXXDXDDXXXEADXXXXXXXXXXXXXXXXXXXXXXXXXXXXXXXXXXXXXXQFXDLKRXLXXXXXXXWXXXPEXXDXXXXXXXXRXXXXXXXXXXXXXXPDXXXXXXXXXXXXXXXXXXXXXXXXXXXXXXXXXXXXXXXXXXXXXRXXXLXXXLDXXXXXXXXXXXXXXXXXXXXXXXDXXXYLXXXXXXXXXXXXXXXXXXXXXDXXXXRXXLXSXXXXXPXXXXXWIAXARLEEXXXXXXXXAXXXIXXGCXXCPXXEDXWLEXXRLXXXXXXXXXXXKXXXXXXXXXXXXSXXLWXXAXXLEXXXXXXXKXXVXXKXLXXXPXXXXLWKXXVXLXXXXXXXXXLLXXAXXXXPXXXXLWXALXXLXXXXXXXXXLNXAXXXXXXXXXXXXXWIXXXXLXEXXXXXXXXXXXXXXXXXXXXXXXXXLXXXXXXXXXXXXXXXWXXXAXXXEXXXXXXXXXAIXXXXXXXXXXXXXXXXXXXXXXXXXXXXXXXXXXXXXXXXXXXXXXXXXXXXXWXXXXXXXXXXXXXXXXXXXXXXXXAXXXXXXXXXXXXXXXXXXXXLXLXXAKXXWXXXXXXXXXAXXXLXXAXXXXXXXXXXXLAXXKLEXXXXXXXXAXXXXXXXXXXXXXXXXXXWXKXXXXXRXXXXXXXXXXXXXXXXXXXXXXLXXXPXXXKLXXXXXQXXXXXXXXXXXXXXXXXXXXXXXXAXXXXXXXXXXXPXXXXLWXXXXXXXEXXXXXXXXXRXXLXXAXXXNPXXXXLWXXXXXXEXXXXXXNXXXXXXLXXXALXXXPXSXXLWXXXXXXXXXXXXXXXRKXXXXXAXXXXXXXXXXXXXXXXXFWXXXXXXXAXXWXXXAXXXXXXXGDXWXXXYXXXXXXGXXXXXXXXXXXXXXXXXXXPXXGXXWXXXXKXXXXXXXXXXXXL

SEQ ID NO: 4144 - protein, 24 aa, Artificial sequence
  protein pattern
  Variant (3)..(5): Xaa in position 3 to 5 is any amino acid
  Variant (6)..(6): Xaa in position 6 is any or no amino acid
  Variant (8)..(9): Xaa in position 8 to 9 is any amino acid
  Variant (10)..(10): Xaa in position 10 is any or no amino acid
  Variant (13)..(13): Xaa in position 13 is Ala or Pro
  Variant (15)..(15): Xaa in position 15 is any amino acid
  Variant (16)..(16): Xaa in position 16 is Ala or Gly
  Variant (20)..(20): Xaa in position 20 is Ser, Thr or Val
  Variant (23)..(23): Xaa in position 23 is any or no amino acid
FLXXXXPXXXYVXGXXRGAXGFXT

SEQ ID NO: 4145 - protein, 25 aa, Artificial sequence
  protein pattern
  Variant (2)..(4): Xaa in position 2 to 4 is any amino acid
  Variant (6)..(7): Xaa in position 6 to 7 is any amino acid
  Variant (10)..(11): Xaa in position 10 to 11 is any amino acid
  Variant (13)..(13): Xaa in position 13 is Pro or Ser
  Variant (14)..(14): Xaa in position 14 is any amino acid
  Variant (15)..(15): Xaa in position 15 is Asp, Asn or Ser
  Variant (16)..(16): Xaa in position 16 is Asp, Glu, Gln or Ser
  Variant (17)..(17): Xaa in position 17 is any amino acid
  Variant (18)..(18): Xaa in position 18 is Ala, Ile or Val
  Variant (20)..(20): Xaa in position 20 is Leu or Val
  Variant (21)..(21): Xaa in position 21 is Glu or Lys
  Variant (22)..(22): Xaa in position 22 is Ala or Asn
  Variant (23)..(23): Xaa in position 23 is any amino acid
AXXXIXXGCXXCXXXXXXWXXXXRL

SEQ ID NO: 4146 - protein, 26 aa, Artificial sequence
  protein pattern
  Variant (4)..(4): Xaa in position 4 is Glu or Arg
  Variant (5)..(5): Xaa in position 5 is any amino acid
  Variant (7)..(7): Xaa in position 7 is any amino acid
  Variant (8)..(8): Xaa in position 8 is Ala, Asp, Asn, Ser or Thr
  Variant (9)..(9): Xaa in position 9 is Leu or Val
  Variant (10)..(10): Xaa in position 10 is Ser or Thr
  Variant (11)..(11): Xaa in position 11 is Ala, Asp or Glu
  Variant (12)..(12): Xaa in position 12 is Asp, Glu, Gln or Ser
  Variant (13)..(13): Xaa in position 13 is Asp, Glu or Gln
  Variant (15)..(15): Xaa in position 15 is any amino acid
  Variant (16)..(16): Xaa in position 16 is Ala, Asp, Asn or Ser
  Variant (17)..(17): Xaa in position 17 is Ile or Leu
  Variant (18)..(18): Xaa in position 18 is Pro or Thr
  Variant (19)..(19): Xaa in position 19 is Asp or Glu
  Variant (20)..(20): Xaa in position 20 is any amino acid
  Variant (21)..(21): Xaa in position 21 is Gly, Ser or Thr
  Variant (22)..(22): Xaa in position 22 is Asp or Ser
  Variant (23)..(23): Xaa in position 23 is any amino acid
  Variant (24)..(24): Xaa in position 24 is Ser or Thr
  Variant (25)..(25): Xaa in position 25 is any amino acid
  Variant (26)..(26): Xaa in position 26 is Lys or Arg
DLKXXLXXXXXXXWXXXXXXXXXXXX

SEQ ID NO: 4147 - protein, 33 aa, Artificial sequence
  protein pattern
  Variant (2)..(3): Xaa in position 2 to 3 is any amino acid
  Variant (4)..(4): Xaa in position 4 is Lys or Arg
  Variant (5)..(5): Xaa in position 5 is any amino acid
  Variant (7)..(7): Xaa in position 7 is any amino acid
  Variant (8)..(8): Xaa in position 8 is Ile or Leu
  Variant (9)..(10): Xaa in position 9 to 10 is any amino acid
  Variant (11)..(11): Xaa in position 11 is Ala or Ser
  Variant (12)..(14): Xaa in position 12 to 14 is any amino acid
  Variant (15)..(15): Xaa in position 15 is Ala, Ser or Thr
  Variant (16)..(16): Xaa in position 16 is any amino acid
  Variant (18)..(19): Xaa in position 18 to 19 is any amino acid
  Variant (20)..(20): Xaa in position 20 is Ala or Pro
  Variant (21)..(21): Xaa in position 21 is any amino acid
  Variant (22)..(22): Xaa in position 22 is Gly, Asn or Ser
  Variant (24)..(24): Xaa in position 24 is Ile or Val
  Variant (25)..(25): Xaa in position 25 is Ala or Ser
  Variant (26)..(26): Xaa in position 26 is any amino acid
  Variant (29)..(29): Xaa in position 29 is Ile, Leu or Val
  Variant (32)..(32): Xaa in position 32 is any amino acid
  Variant (33)..(33): Xaa in position 33 is Ala or Asp
DXXXXRXXXXXXXXXXPXXXXXWXXXARXEEXX

SEQ ID NO: 4148 - protein, 28 aa, Artificial sequence
  protein pattern
  Variant (2)..(2): Xaa in position 2 is any amino acid
  Variant (3)..(3): Xaa in position 3 is Asn or Arg
  Variant (4)..(4): Xaa in position 4 is Ile or Val
  Variant (5)..(5): Xaa in position 5 is Ile, Leu or Val
  Variant (6)..(7): Xaa in position 6 to 7 is any amino acid
  Variant (8)..(8): Xaa in position 8 is Ala, Gly or Ser
  Variant (9)..(9): Xaa in position 9 is Ile or Leu
  Variant (10)..(12): Xaa in position 10 to 12 is any amino acid
  Variant (14)..(14): Xaa in position 14 is any amino acid
  Variant (15)..(15): Xaa in position 15 is Asp, Glu or Ser
  Variant (16)..(17): Xaa in position 16 to 17 is any amino acid
  Variant (18)..(18): Xaa in position 18 is Ile or Leu
  Variant (21)..(21): Xaa in position 21 is any amino acid
  Variant (22)..(22): Xaa in position 22 is any or no amino acid
  Variant (24)..(25): Xaa in position 24 to 25 is any amino acid
  Variant (26)..(26): Xaa in position 26 is Ala, Glu or Asn
  Variant (27)..(27): Xaa in position 27 is any amino acid
  Variant (28)..(28): Xaa in position 28 is Asp, Glu, Asn or Ser
KXXXXXXXXXXXPXXXXXWKXXVXXXXX

SEQ ID NO: 4149 - DNA, 1035 bp, Saccharomyces cerevisiae
  CDS (1)..(1035)
atgcattgcccaatttgccaccatagagcgcatgtagtgtactgtgcacattgtatcaatacgagcccaagtctgctactgaagctaaaactagatttaattttattaaaggatgagaataaagaacttaacgggaaagtcgaacaaatattaaacgaggccatgaactatgaccagttagatatcaagaggatggagaaaaagaaagatcccctgatgaatagtctcatgaagttagatgttttacgaatgaaaaagaataataacctgattaggcacaggatagaacagctaaatgagcggatttatagtaaaaggaatcacatcagcgaattgaaagtagaaattgacaattataaatgttataaggtgggtactggtacggacaaattaagagagcaagtggaaattagtgatgcaaaaaataagctggcacaagtatcgaagatttgtgaatcggctagagattacaagctcaatctactaaataattggtttgtgatccagaagctgcaagataatttccaaatacctttcgctatagcttttcagccactaatatctttgaaaaacttccgtattttacctcttgctataacaaacgattccatcaacatcatgtggaagtatattagcttcttctcagacattcttatgattaaacttccctacacaaataaaatctgtgaacaacccatgtttgagttttccgatagcatacagacagtagtacaaaggttgatcaagcttatcataaatattttacagatatgtagacatttgaaactcgtaccttcaacacccatggatatcccatggctactggaccagtacgatgtggatgggctgttctataatatggtgaaacggaacaagatgaagtgtaggtccgtctcgctatattggacttttgggatgttgtactcgatggttttggataacatgaataatccacaaagaggacatcctgcaaggcggaccgcaccacctccaacagtcacaggacctcatgaccgatggtacgtggtaggctag

SEQ ID NO: 4150 - protein, 344 aa, Saccharomyces cerevisiae
MHCPICHHRAHVVYCAHCINTSPSLLLKLKLDLILLKDENKELNGKVEQILNEAMNYDQLDIKRMEKKKDPLMNSLMKLDVLRMKKNNNLIRHRIEQLNERIYSKRNHISELKVEIDNYKCYKVGTGTDKLREQVEISDAKNKLAQVSKICESARDYKLNLLNNWFVIQKLQDNFQIPFAIAFQPLISLKNFRILPLAITNDSINIMWKYISFFSDILMIKLPYTNKICEQPMFEFSDSIQTVVQRLIKLIINILQICRHLKLVPSTPMDIPWLLDQYDVDGLFYNMVKRNKMKCRSVSLYWTFGMLYSMVLDNMNNPQRGHPARRTAPPPTVTGPHDRWYVVG

SEQ ID NO: 4151 - DNA, 927 bp, Ashbya gossypii
  CDS (1)..(927)
atgcagtgtactatctgccacaggccatcgacagtgtggtactgcgcccactgcgtcaacacgtcgcccaagctcattttgcgatataaactagagctgacgcagatatgcgaagaagtaaccgagatgcgagacattgtgacatcgacattggaaaatgcaatcagcgaaaaggagggcctgctggggaaacatatggagcgactgcagcacctgcgactgaagcggtacaatgcccggcttagccaccgtgcaagggagctggaacagcacctggactcgaagctgagccggcgcgacggcctgcggcgcgcattgaagcagctctcgccagacgttgccgtcgtgccggcggaagacccggacgagtaccgtgagctgcggcacaagttgacgctgctgcagaatgtagtatccatgaagagcacccaaaagtttgaggaattgtgccagtggttcgtgttcacctgcagcacgacggaggacgaccactttccatacagtattcgcttcatccctgtgtgcaacatccgcaactggcgcttgctgagcacggcgcaggaatcgctgcagcacatgtgcgaatttgttatatacgcaagccgagcgctgctcgtggacatcccgttcggcagccactccgagaagctgaccactgatcacatcgctgcggtgtctcactttacggtcaacctacttaccattctgatcaagcgcaagcgtctgcaggagcgccctgacgttccagatctccttgggcgctacgatatcgatggcctactctatttgctgtgttccggcggggatgtggagagcattaccggcacatgcccgccaacctacaaagtagtacatgaatttgtacgaactgccctggaagatggtgatcaatcagaagagagaggccactggatggtcctggagtag

SEQ ID NO: 4152 - protein, 308 aa, Ashbya gossypii
MQCTICHRPSTVWYCAHCVNTSPKLILRYKLELTQICEEVTEMRDIVTSTLENAISEKEGLLGKHMERLQHLRLKRYNARLSHRARELEQHLDSKLSRRDGLRRALKQLSPDVAVVPAEDPDEYRELRHKLTLLQNVVSMKSTQKFEELCQWFVFTCSTTEDDHFPYSIRFIPVCNIRNWRLLSTAQESLQHMCEFVIYASRALLVDIPFGSHSEKLTTDHIAAVSHFTVNLLTILIKRKRLQERPDVPDLLGRYDIDGLLYLLCSGGDVESITGTCPPTYKVVHEFVRTALEDGDQSEERGHWMVLE

SEQ ID NO: 4153 - DNA, 1095 bp, Candida glabrata
  CDS (1)..(1095)
atgggaatgcaatgcccaatctgtgaaactcagtctcacgtcttttattgtgcccactgcatcaattctagtccagatttattgatcaggttaaagtttgacctctacatattagggaagataaataacgcacttagaaataaagttgaccagtatttggaagaagttgatgatgagcttaacacgaatattagaaatggcgaacagttagagagcaatataggtgttcaaatattaaaggaacgcttgggcaaagtgcaagtactgaggaaggagagacagaacaacaagattaaacacaagatctctcaacaagatcgtaggatcaaggagaaaagtcgatatattgccgagttacgatctttaattaatggcccacccaagaaccaaaacaggttcactgacccgcagaccatattgaaagcccagaaacaacttcaggataaacttgaaattgctaagaggctaagtatacaaactagatcagagaaattagctatgctaaacaaatggtattcaatccgcaaaagagactctcatgatataccattcactatatcgtatcagcccgtcatttcattgaagaactttaatcgacttcctcttcccttaatagaaggttcacttcgaaagcttatacaatatatgaacttgctagaacacatttactgtattaaatatccttctgcgatgtttgttcacgaagatgaaatgctgtctctccaaggtcacagcgctaagcttaaacgcaacgcaccagaattattacaagttttgataaaactgatacaaatgatacttgttgttatgacacgctcaaagcttatcgatgaacggaaacaaaacattgactatgcatggatccttgatcagtacgatatagatggcctgttctaccacatggcaatgtcaatacccatagacactaaaagtggggccaaaaatatccaatggagtactgaccgtttagtagatatagtgtgctcatcactgggtgctgaaaaggaagaagtattgctcaaggatcacaaaaaattagagccgcctaccgataaaaaatacgaagttagtgatagatggtatattgtaggttaa

SEQ ID NO: 4154 - protein, 364 aa, Candida glabrata
MGMQCPICETQSHVFYCAHCINSSPDLLIRLKFDLYILGKINNALRNKVDQYLEEVDDELNTNIRNGEQLESNIGVQILKERLGKVQVLRKERQNNKIKHKISQQDRRIKEKSRYIAELRSLINGPPKNQNRFTDPQTILKAQKQLQDKLEIAKRLSIQTRSEKLAMLNKWYSIRKRDSHDIPFTISYQPVISLKNFNRLPLPLIEGSLRKLIQYMNLLEHIYCIKYPSAMFVHEDEMLSLQGHSAKLKRNAPELLQVLIKLIQMILVVMTRSKLIDERKQNIDYAWILDQYDIDGLFYHMAMSIPIDTKSGAKNIQWSTDRLVDIVCSSLGAEKEEVLLKDHKKLEPPTDKKYEVSDRWYIVG

SEQ ID NO: 4155 - DNA, 924 bp, Kluyveromyces lactis
  CDS (1)..(924)
atgatacattgtgggatctgtggcagtcctaagatcccaaatgtcgaatttttatgtgctcattgtattaatggatccccatcaatacttttaagggacaaactaaagctattgttgctccgccaagaagttgaacagcttaaacatgatgtcggagaacagctagaagctggatttgccggtaatggtcagtttggcaagcagttgcagaaactagatgtgtacaacgagaaacgcagattgatcaaactgcgacaacgggtacaattagtcaaaaataagatagacgtgaaacggaaccggtaccaggaacttgaacggtacttgaaagatgaggatcatttcgataaagacaaaaaagtgtttgacgttgaagaaatagtgaatgatgaggcgttgactatgagtaagctctctcaagtcttgcaaagaaagcaaacagcgttgtttaaagagctttgtcaatggtttcgtatcgaaaaatgtgacgaggatgttaataataataataatgtttctgcttatacaatctggggggtcccaatgataaatctcaagtatagcaatgagatggaccgtgacaagcaagtgatttctatgaggtacatccaccaattcatcaacttttccttcaacatttggctgttcgaaggaatatctgacgtttccattgaaaacgaacaaaacgtaatccagaactactcacagttaatatatgacactctaagattactacaggtcagaaaacttgtgtctgaatccgtctccataagagatatattgataaggtacgatctagatggaatgatatactatctctccaaaagcaaatatctttcctcactcgacgacgcatcgaactcatacccaccaactttacagaacataaagcagcttgtagcatccatgataccctctatatag

SEQ ID NO: 4156 - protein, 307 aa, Kluyveromyces lactis
MIHCGICGSPKIPNVEFLCAHCINGSPSILLRDKLKLLLLRQEVEQLKHDVGEQLEAGFAGNGQFGKQLQKLDVYNEKRRLIKLRQRVQLVKNKIDVKRNRYQELERYLKDEDHFDKDKKVFDVEEIVNDEALTMSKLSQVLQRKQTALFKELCQWFRIEKCDEDVNNNNNVSAYTIWGVPMINLKYSNEMDRDKQVISMRYIHQFINFSFNIWLFEGISDVSIENEQNVIQNYSQLIYDTLRLLQVRKLVSESVSIRDILIRYDLDGMIYYLSKSKYLSSLDDASNSYPPTLQNIKQLVASMIPSI

SEQ ID NO: 4157 - DNA, 24 bp, Artificial sequence
  primer
atgcattgcccaatttgccaccat

SEQ ID NO: 4158 - DNA, 22 bp, Artificial sequence
  primer
ctagcctaccacgtaccatcgg

SEQ ID NO: 4159 - protein, 334 aa, Artificial sequence
  consensus sequence
  Variant (2)..(2): Xaa in position 2 is any amino acid
  Variant (5)..(12): Xaa in position 5 to 12 is any amino acid
  Variant (13)..(15): Xaa in position 13 to 15 is any or no amino acid
  Variant (20)..(20): Xaa in position 20 is any amino acid
  Variant (22)..(22): Xaa in position 22 is any amino acid
  Variant (25)..(30): Xaa in position 25 to 30 is any amino acid
  Variant (32)..(33): Xaa in position 32 to 33 is any amino acid
  Variant (35)..(47): Xaa in position 35 to 47 is any amino acid
  Variant (49)..(51): Xaa in position 49 to 51 is any amino acid
  Variant (53)..(94): Xaa in position 53 to 94 is any amino acid
  Variant (95)..(110): Xaa in position 95 to 110 is any or no amino acid
  Variant (112)..(117): Xaa in position 112 to 117 is any amino acid
  Variant (119)..(164): Xaa in position 119 to 164 is any amino acid
  Variant (165)..(167): Xaa in position 165 to 167 is any or no amino acid
  Variant (169)..(170): Xaa in position 169 to 170 is any amino acid
  Variant (172)..(185): Xaa in position 172 to 185 is any amino acid
  Variant (186)..(191): Xaa in position 186 to 191 is any or no amino acid
  Variant (193)..(195): Xaa in position 193 to 195 is any amino acid
  Variant (197)..(211): Xaa in position 197 to 211 is any amino acid
  Variant (212)..(213): Xaa in position 212 to 213 is any or no amino acid
  Variant (215)..(256): Xaa in position 215 to 256 is any amino acid
  Variant (257)..(272): Xaa in position 257 to 272 is any or no amino acid
  Variant (274)..(279): Xaa in position 274 to 279 is any amino acid
  Variant (281)..(291): Xaa in position 281 to 291 is any amino acid
  Variant (292)..(294): Xaa in position 292 to 294 is any or no amino acid
  Variant (296)..(297): Xaa in position 296 to 297 is any amino acid
  Variant (300)..(300): Xaa in position 300 is any amino acid
  Variant (303)..(304): Xaa in position 303 to 304 is any amino acid
  Variant (306)..(330): Xaa in position 306 to 330 is any amino acid
  Variant (331)..(333): Xaa in position 331 to 333 is any or no amino acid
CXICXXXXXXXXXXXCAHCXNXSPXXXXXXKXXLXXXXXXXXXXXXXVXXXLXXXXXXXXXXXXXXXXXXXXXXXXXXXXXXXXXXXXXXXXXXXXXXXXXXXXXXXXXXKXXXXXXLXXXXXXXXXXXXXXXXXXXXXXXXXXXXXXXXXXXXXXXXXXXXXXXXXLXXWXXXXXXXXXXXXXXXXXXXXIXXXPXXXXXXXXXXXXXXXXXSXXXXXXXXXXXXXXXXXXXXXXXXXXXXXXXXXXXXXXXXXXXXXXXXXXXXXXXXXXLXXXXXXKXXXXXXXXXXXXXXLXXYDXDGXXYXXXXXXXXXXXXXXXXXXXXXXXXXXXXV

SEQ ID NO: 4160 - protein, 14 aa, Artificial sequence
  protein pattern
  Variant (2)..(3): Xaa in position 2 to 3 is any amino acid
  Variant (4)..(4): Xaa in position 4 is any or no amino acid
  Variant (9)..(9): Xaa in position 9 is Ile or Val
  Variant (11)..(11): Xaa in position 11 is any or no amino acid
  Variant (13)..(13): Xaa in position 13 is any or no amino acid
VXXXCAHCXNXSXP

SEQ ID NO: 4161 - protein, 11 aa, Artificial sequence
  protein pattern
  Variant (2)..(2): Xaa in position 2 is any amino acid
  Variant (3)..(3): Xaa in position 3 is Gln or Arg
  Variant (6)..(6): Xaa in position 6 is Ile, Leu or Val
  Variant (9)..(9): Xaa in position 9 is Leu or Met
  Variant (10)..(10): Xaa in position 10 is Phe, Ile or Leu
LXXYDXDGXXY

SEQ ID NO: 4162 - DNA, 1044 bp, Saccharomyces cerevisiae
  CDS (1)..(1044)
atgacttttatgcaacagcttcaagaggctggggaaagatttaggtgtatcaatggtcttttatgggttgtttttgggcttggtgtcttaaaatgtacaacgttatcacttagatttttagctcttatttttgatctttttttactaccagcagtcaatttcgacaagtatggtgctaaaactggtaaatactgtgctatcactggtgcaagtgacggtattggtaaagaatttgctagacaaatggcgaaacgtggcttcaacttggtattgatctcgagaacgcaatctaaattggaggctttacaaaaagaactagaagatcaacatcatgtcgttgtaaagattctagccattgacattgcggaggataaagaatccaactatgaatccattaaggaattgtgtgcgcagttaccaatcaccgttttggtcaataatgttggtcaatcacactccattcctgttccatttttggaaacagaagagaaggagcttagaaatattatcactatcaataacactgctacattattaattacacaaatcattgcaccaaagattgtggaaactgtgaaagctgaaaacaagaagtcgggtactcgtggtttgatcttaaccatgggctcatttggtggtctgattcccaccccacttttggctacatacagtggttcgaaatcattcttacaaggttggtctaactctttggctggggaattatctaaagatgctatcgatgttgaattaatcatttcatatttggtcactagctcgatgtctaaaatcagaagatcatctttaatgatcccaaatccacaacagtttgtaaaatccactttaagaagcgttggcagacgctgcggctctcaagaaagatacgctactatgaccccttactgggcgcacgcagtgtatcaatttgtaattacagagacctttggcgtttactctaagattgttaactccattaattattccttccataaatctatcagaattagagccttaaaaaaagccgcaagacaggttaaaaaggaatag

SEQ ID NO: 4163 - protein, 347 aa, Saccharomyces cerevisiae
MTFMQQLQEAGERFRCINGLLWVVFGLGVLKCTTLSLRFLALIFDLFLLPAVNFDKYGAKTGKYCAITGASDGIGKEFARQMAKRGFNLVLISRTQSKLEALQKELEDQHHVVVKILAIDIAEDKESNYESIKELCAQLPITVLVNNVGQSHSIPVPFLETEEKELRNIITINNTATLLITQIIAPKIVETVKAENKKSGTRGLILTMGSFGGLIPTPLLATYSGSKSFLQGWSNSLAGELSKDAIDVELIISYLVTSSMSKIRRSSLMIPNPQQFVKSTLRSVGRRCGSQERYATMTPYWAHAVYQFVITETFGVYSKIVNSINYSFHKSIRIRALKKAARQVKKE

SEQ ID NO: 4164 - DNA, 1267 bp, Glycine max
  CDS (59)..(1054)
ccggatttaaggttaagacccacgcgtccggttagaaaatttcttggagtttgttagaatgaaaatggaggggcttgatttgttcctagtagcaacgaatcatagaggcttcatttgtgtgtgcagtgcccttatcaaatttctcaagtgggtatgggtggtgttcttgaggccaccaaagaatctcaaagagtatggttcatgggccataatcactggctccactgatggaattggcaaggccatggcttttgaattggcatctaagggacttaaccttctcttggttggtagaaaccctctaaaacttgaggcaacatccaaggaaataagagatagacttgatgttgaggttaagtttgtggtcatagacatgcaaaaagttgagggagttgaaatagtaaaaaaagtagaggaagcaatagatggattggatataggtttgctagttaatggtgcaggcttggcttacccttatgctagattctttcatgaggttgatttggagcttatggatgctattataaaagtaaacttggagggagcaacttggatcacaaaggcagtgcttcccactatgatcaagaagaaaaagggagcaatagtgaacattggctctggttccactgttgtgcttccttcatatcctctagtcaccctctatgctgctacaaaagcataccttgcaatgttctcgagatgcatcagtttggaatacaagcatcaaggaattgacatccaatgtcaggttccattatttgtatcaacaaagatgaccaaaatgaagacatcaatttttgttccaacgccggctatgtatagtaaaacatgcacaagatggattggatacgaaaaactggttgagccatacttcctccattctgtgcaggggtttctcataagggcaattcctgattcattagtggattcctatatgctgcgctattttctttattggcgtggaagaggactctccaaggactccaacattaaaacatcagcagcatctaattctgaagaagcaaacatcattaatcaagatcatacaaattaagtcctagttcctataacaacatttatggaaagttgtggctgatcatggagacccccagtgaattaattatagttttttttttctctttttcttttctttttagatttgcctttcggtaaagtcgtttacctactttccactattgttagttttatacttataagttttatctgcaattggtcagcctttacttaatctagttattctttgaac

SEQ ID NO: 4165 - protein, 331 aa, Glycine max
MKMEGLDLFLVATNHRGFICVCSALIKFLKWVWVVFLRPPKNLKEYGSWAIITGSTDGIGKAMAFELASKGLNLLLVGRNPLKLEATSKEIRDRLDVEVKFVVIDMQKVEGVEIVKKVEEAIDGLDIGLLVNGAGLAYPYARFFHEVDLELMDAIIKVNLEGATWITKAVLPTMIKKKKGAIVNIGSGSTVVLPSYPLVTLYAATKAYLAMFSRCISLEYKHQGIDIQCQVPLFVSTKMTKMKTSIFVPTPAMYSKTCTRWIGYEKLVEPYFLHSVQGFLIRAIPDSLVDSYMLRYFLYWRGRGLSKDSNIKTSAASNSEEANIINQDHTN

SEQ ID NO: 4166 - DNA, 1487 bp, Glycine max
  CDS (161)..(1123)
cccgcttaaatctggtggttttccgctcatctacctcaccccaccgtctctctctctctcataaattcaatgctctcatcgttttccctcataaaccgctttctcgtgttgtaacacactcatcactcatcatattcattcacacttcccactttccaatatggaatgctgcataatcgccaggctcaagacccaacctttatggttcgcgctgctcttcgttgtcggattgttaacgattctcaaattggctttcgttgttttcagatgggtctacgtcaatttcctccgaccaccgaagaatctcaaaaagtacggatcttgggcagtggttactggacccactgacggcattggaaagagcttcgctttcgagctcgctcgcaagggcctgaacctcgtccttgtcggaaggaaccccgacaagctcaaagacgtgtcggattcgatcgcggcgaagttcagaagaaccgaggttaagaccgtcgtggttgacttctccggggatctggacgagggcgtgaagaagattagcgaagcgattgaagggttggaagttggagtgctcgttaacaatgtgggagtttcgtatccttacgcgaggttcttccacgaagtggacgaggggcttctcaacaaccttattaaggttaacgttgttggaaccactaaggtcacgcaagctgttctgccagggatgctcaggagaaagaagggggcgattgttaacattggttctggagctgctattgttattccttctgatcctctttatgctgtttatgccgccaccaaagcgtacatcgaccagttttcgagatgtctctatgttgaatacaagaagagtgggattgacgttcagtgtcagattccattatatgtggcaaccaagatggcatcaatcaggaaatcttcattctttgttccatcaacagatggctatgccaaagcaggtgtgaaatggataggctatgagcctcgttgcacaccatactggccgcatactcttctttgggctgtggcattctcattgcccgagtttgttgttgatgcttggcgcctgtggttttgcttgggtattcgaaagaggggacagcgcaaagagtccatgaagaaggaataaaaggatgcttggttctgatgtgtaggccaatagacgctactcatctgataatatatatgcagattgttagctgattaaggattccaagtacctgctgtgttcctgattttcatcttactgttattactcttttgttagtatcagttgtgtggcatattcttttcactcacctgttttgggtgtttctgttcactgttttagtagtgtgttgaactgatatcatatattggcatatcgcttaacccggttttatctggtgtaactcctcctttctctcttattttgagcttttaggaagccctaaaaattcaagcgaaaattttgagcaggaaattaaactgaataaaagattgattagagtgtg

SEQ ID NO: 4167 - protein, 320 aa, Glycine max
MECCIIARLKTQPLWFALLFVVGLLTILKLAFVVFRWVYVNFLRPPKNLKKYGSWAVVTGPTDGIGKSFAFELARKGLNLVLVGRNPDKLKDVSDSIAAKFRRTEVKTVVVDFSGDLDEGVKKISEAIEGLEVGVLVNNVGVSYPYARFFHEVDEGLLNNLIKVNVVGTTKVTQAVLPGMLRRKKGAIVNIGSGAAIVIPSDPLYAVYAATKAYIDQFSRCLYVEYKKSGIDVQCQIPLYVATKMASIRKSSFFVPSTDGYAKAGVKWIGYEPRCTPYWPHTLLWAVAFSLPEFVVDAWRLWFCLGIRKRGQRKESMKKE

SEQ ID NO: 4168 - DNA, 1308 bp, Oryza sativa
  CDS (1)..(957)
atggacgcgctgtccgcgcagccggcgtgggcgctggcgctggccggggtgggcctcatggtggccgcgaccgcctcggcgcgcctcgcgcggtggctctacgcggcgttcctccgcccggggaagcccctgcgccgccggtacggcgagtgggcggtcgtcacgggcgccacggacggcatcggccgcgcgctcgcgttccgcttcgcgggcgccgggatgagcctcgtgctcgtgggccgcagccccgacaagctggccgcggtctccggggagatcagggggaagcaccccagggccgaggtccgcaccttcgtgctcgacttcgccgccgagggcctcgccgccaaggtggccgcgctcggggactccatccgcgggctcgacgtcggcgtgctcgtcaacagcgccggcatgtcgtacccgtacgcgcgctacttccacgaggtggacgaggagctgatgcgcaacctcatccgcctcaacgtcgaggcgctcacccgggtcacccacgccgtgctcccaggcatggtggagcgcaagcgcggcgccatcgtcaacatcggctccggcgcctcctccatcctgccgtcctacccgctctacagcgtctacgccgccaccaaggcgtatgttgatcaattctcgagatgcctctatgttgagtacaagaacaaaggcatcgatgtgcaatgccaggtacccctgtacgcggcgacgaagatggcgtccatcaagaaggcgtccttcttcgcgccgtcgccggagacgtacgcccgcgccgccgtgcgctacatcgggtacgagccgaggtgcacgccctactggccgcacgcggtgctgtggttcctcatctccgcgttcccggagcccatcgtggacaggctcctcctcaacatgtccgtcggcatccgcaagaggggcatggccaaggacgccaggaagaagacgcagtgacgaaccagcaccaaagaatctgagcgatagtactctctacttcttctcctctgcagcttccgaaacattgggcgtttgatttaccccgtatctctggattagttcttctcatgagtaaggtgatgatgagctgatggttaaacagtgtgtctggtttgatgtactaagattgaagagtttaagaccatgtgacacgaactcgatctggcctggttaataaagcgcgggaaaaaggctttgccttctgctaatataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4169 - protein, 318 aa, Oryza sativa
MDALSAQPAWALALAGVGLMVAATASARLARWLYAAFLRPGKPLRRRYGEWAVVTGATDGIGRALAFRFAGAGMSLVLVGRSPDKLAAVSGEIRGKHPRAEVRTFVLDFAAEGLAAKVAALGDSIRGLDVGVLVNSAGMSYPYARYFHEVDEELMRNLIRLNVEALTRVTHAVLPGMVERKRGAIVNIGSGASSILPSYPLYSVYAATKAYVDQFSRCLYVEYKNKGIDVQCQVPLYAATKMASIKKASFFAPSPETYARAAVRYIGYEPRCTPYWPHAVLWFLISAFPEPIVDRLLLNMSVGIRKRGMAKDARKKTQ

SEQ ID NO: 4170 - DNA, 1491 bp, Zea mays
  CDS (129)..(1109)
  misc_feature (1481)..(1481): n is a, g, c or t
  misc_feature (1484)..(1484): n is a, g, c or t
gtcatgccccttataagctcgacacaggggcaggcacaccgcacagcaccgcaccgcactgcatcggtcgccagccgagccgagccgagccctgctctctcctccagctccccaaatcacactccgccatggccggcacgtgcgctcacgtcgagttcctccgcgcgcagccggcgtgggcgctggcgctggccgcggtgggcctgctcgtggccgtgcgcgccgccgcccgcttcgcgctctgggtctacgccgcgttcctccgcccgggcaagcccctgcgccgccgctacggcgcctgggccgtcgtgacgggcgccaccgacggcatcggccgcgccgtcgccttccgcctcgccgcgtccgggctcgggctcgtcctcgtcggccgcaaccaggagaagctggccgccgtcgccgccgagatcaaggccaggcaccccaaggtccccgaggtgcggaccttcgtgctcgacttcgccggcgaggggctggccgccggcgtcgaggcgctcaaggactccatccggggcctcgacgtcggcgtgctcgtcaacaacgccggcgtgtcctacccgtacgcgcgctacttccacgaggtggacgaggagctgatgcgcaccctcatccgggtcaacgtcgagggcgtcacgcgtgtcacgcacgccgtgctgccggccatggtcgagcggaagcgcggcgccattgtcaacatcggctccggcgccgcctccgtcgtgccttctgatccgctctactccgtctacgccgctaccaaagcgtatgttgaccaattctcaagatgcctctatgttgagtacaagagcaagggtattgatgtgcaatgccaggtgcccttatacgtggcgacaaagatggcatccatcaggaagtcttccttcatggtcccatctgctgacacctatgctcgtgctgccgttcgtcacattggatacgagcctaggtgcacaccatactggccacactctgtcgtgtggttcttgatctccattcttcccgagtcccttatcgacagcgtgcgcctgggcatgtgcattaagatccgcaagaaggggctggccaaggacgccaagaagaaggcgctgtgattgatgtttcagaatgcatgttcagattcgcacatttcctcatcacctgtagtagacatgtgccttgctgtagtcactttattagctaccattacctcctgagtctgttaagaatcgagaatgtcattgttccatccgcggttatgatgatgaaaaatacgattcttcaattcaaaatgtaacactaatacgagtaatgatgcatgaaattaacttgaagaagttgtgcaactcagttgtttttctgaaccatttcacatttttgtaaaaaaaaaaaaaaaaaaaaaaaaaatcccttcttccattcaaaatgttacactaatacgagtaatgatgcatgaaattaacttgaaaaaaaaaaaaaaaaaaggncgncggccgt

SEQ ID NO: 4171 - protein, 326 aa, Zea mays
MAGTCAHVEFLRAQPAWALALAAVGLLVAVRAAARFALWVYAAFLRPGKPLRRRYGAWAVVTGATDGIGRAVAFRLAASGLGLVLVGRNQEKLAAVAAEIKARHPKVPEVRTFVLDFAGEGLAAGVEALKDSIRGLDVGVLVNNAGVSYPYARYFHEVDEELMRTLIRVNVEGVTRVTHAVLPAMVERKRGAIVNIGSGAASVVPSDPLYSVYAATKAYVDQFSRCLYVEYKSKGIDVQCQVPLYVATKMASIRKSSFMVPSADTYARAAVRHIGYEPRCTPYWPHSVVWFLISILPESLIDSVRLGMCIKIRKKGLAKDAKKKAL

SEQ ID NO: 4172 - DNA, 1105 bp, Glycine max
  CDS (13)..(969)
atctccaaaaccatggatctctgcacttacttcaaatcccagccctcatggctcctcctcctcttcgccctcggctccctccaactcctcaaattcaccctctccctcctcaactccctctacatctacttcctccgccccgccaagaacctccgccgctacggctcctgggccatcatcaccggccccaccgacggcatcggcaaagccttcgcctttcagctcgcccgcaaggggctcaacctcgtcctcgtcgcccgcaaccccgacaagctcagagacgtctccgagtccatcagatccaagcactccaacgtcgagatcaagaccgtggtgatggacttctccggagatatcgatgatggagtgaggaggatcaaggagacgatcgaagggttggaggttgggattctgattaataacgcggggatgtcgtatccttacgcgaagtactttcacgaggtggatgaggagctgcttgggaacttgcttaagatcaatgttgaggggacgacgaaggttactcaggctgtgttggggaatatgctgaagaggaagcgaggggctattgttaatatgggttctggtgctgctgcgcttatcccttcgtatcctttctactctgtttacgccggtgctaaaacgtacgtggatcagttcacgaggtgtcttcatgttgagtacaagaagagtgggattgatgttcaatgccaggttcccttgtatgttgcgacaaagatgacatcaataagaagagcatcgttcttagtggcatctccagagggatacgcaaaggcagcactgcgttttgtagggtatgaagcacgctgcacaccttactggcctcacgccctcatgggttatgttgtctctgcattgcccgagagcgtctttgaatcctttaacattaagaggtgcctccagatcaggaagaaaggtatgcttaaagactcgaggaaaaaggaatgaaaacttttcgagggtgcatgattttcttctgcagcacttggtttcttgcaagtttctgtttagacttttgcaagacttgtacgctttagtttccgatgtttccaaggttgtttccttattttgaaaattaaaaacc

SEQ ID NO: 4173 - protein, 318 aa, Glycine max
MDLCTYFKSQPSWLLLLFALGSLQLLKFTLSLLNSLYIYFLRPAKNLRRYGSWAIITGPTDGIGKAFAFQLARKGLNLVLVARNPDKLRDVSESIRSKHSNVEIKTVVMDFSGDIDDGVRRIKETIEGLEVGILINNAGMSYPYAKYFHEVDEELLGNLLKINVEGTTKVTQAVLGNMLKRKRGAIVNMGSGAAALIPSYPFYSVYAGAKTYVDQFTRCLHVEYKKSGIDVQCQVPLYVATKMTSIRRASFLVASPEGYAKAALRFVGYEARCTPYWPHALMGYVVSALPESVFESFNIKRCLQIRKKGMLKDSRKKE

SEQ ID NO: 4174 - DNA, 1479 bp, Zea mays subsp. mays
  CDS (270)..(1250)
actttgaaatttgtccgtccatacgaactctacgactacgagcctactactctactactgcctacggaggagagagagagatttcatgagttcgtgttcagttagtcttggtgcaccagttccacccaccaccggatataggtcatgccccttataagctcgacacaggggcaggcacaccgcacagcaccgcaccgcactgcatcggtcgccagccgagccgagccgagccctgctctctcctccagctccccaaatcacactccgccatggccggcacgtgcgctcacgtcgagttcctccgcgcgcagccggcgtgggcgctggcgctggccgcggtgggcctgctcgtggccgtgcgcgccgccgcccgcttcgcgctctgggtctacgccgcgttcctccgcccgggcaagcccctgcgccgccgctacggcgcctgggccgtcgtgacgggcgccaccgacggcatcggccgcgccgtcgccttccgcctcgccgcgtccgggctcgggctcgtcctcgtcggccgcaaccaggagaagctggccgccgtcgccgccgagatcaaggccaggcaccccaaggtccccgaggtgcggactttcgtgctcgacttcgccggcgaggggctggccgccgccgtcgaggcgctcaaggactccatccggggcctcgacgtcggcgtgctcgtcaacaacgccggcgtgtcctacccgtacgcgcgctacttccacgaggtggacgaggagctgatgcgcaccctcatccgggtcaacgtcgagggcgtcacgcgtgtcacgcacgccgtgctgccggccatggtcgagaggaagcgcggcgccattgtcaacatcggctccggcgccgcctccgtcgtgccttctgatccgctctactccgtctacgccgctaccaaagcgtatgttgaccaattctcaagatgcctctatgttgagtacaagagcaagggtattgatgtgcaatgccaggtgcccttatacgtggcgacaaagatggcatccatcaggaagtcttccttcatggtcccatctgctgacacctatgctcgtgctgccgttcgtcacattggatacgagcctaggtgcacaccatactggccacactctgtcgtgtggttcttgatctccattcttcccgagtcccttatcgacagcgtgcgcctgggcatgtgcattaagatccgcaagaaggggctggccaaggacgccaagaagaaggcgctgtgattgatgtttcagaatgcatgttcagattcgcacatttcctcatcacctgtagtagacacgtgccttgctgtagtcactttattagctaccattacctcctgagtctgttaagaatcgagaatgtcattgttccatccgcggttatgatgatgaaaaatacgattcttcaattcaaaatgtaacactaatacgagtaatgatgcatgaaattaacttgaagaagttgtgc

SEQ ID NO: 4175 - protein, 326 aa, Zea mays subsp. mays
MAGTCAHVEFLRAQPAWALALAAVGLLVAVRAAARFALWVYAAFLRPGKPLRRRYGAWAVVTGATDGIGRAVAFRLAASGLGLVLVGRNQEKLAAVAAEIKARHPKVPEVRTFVLDFAGEGLAAAVEALKDSIRGLDVGVLVNNAGVSYPYARYFHEVDEELMRTLIRVNVEGVTRVTHAVLPAMVERKRGAIVNIGSGAASVVPSDPLYSVYAATKAYVDQFSRCLYVEYKSKGIDVQCQVPLYVATKMASIRKSSFMVPSADTYARAAVRHIGYEPRCTPYWPHSVVWFLISILPESLIDSVRLGMCIKIRKKGLAKDAKKKAL

SEQ ID NO: 4176 - DNA, 1138 bp, Hordeum vulgare
  CDS (59)..(1036)
gaattccccgctccctaccgcggatcgagccaactcacccccaaacccagcaagcacgatggccggcacgtgcgcccacgtcgagttcctccgcgcgcagccggcgtgggcgctggccctcgcggccgtcggcctcctcgtcgccgcccgcgccgcccttcgcctcgccctctgggtctacgccgccttcctccgccccggcaagcacctgcgccgccgctacgggccctgggccgtcgtcaccggcgccaccgacggcatcggccgcgccatcgccttccgcctcgccgcctccggcctcggcctcgtgctcgtcggccgcaacccggacaagctcgccgccgtctcccaggagatcagggccaagtaccccaagaccgaggtccgcaccttcgtgctcgacttcgcctccgaggggctcgccgccggggtggaggcgctcaaggactccatccggggcctcgacgtcggcgtgctcgtcaacaacgccggggtctcgtacccgtacgcccgctacttccacgaggtggacgaggagctcatgcggagcctcatccgggtcaacgtcgagggcgtaacgcgggtcacccacgccgtgctcccgggcatggtcgacaggaagcgtggcgcaatcgtcaacatcggctccggtgctgcctctgtcgtgccgtccgatccactctactccgtctacgccgccaccaaagcgtacgttgaccagttctcaagatgcctctatgttgagtacaagggtaagggcatcgatgtacaatgccaggtgcccttgtacgtggcaacaaagatggcatcaatcaggaggtcttccttccttgtgccatccgcggacacctatgctcgtgctgctattcgccacattggctatgagccgaggtgcacaccgtactggccacactctgttctgtggttcttgatctcccttctcccagagtcgctggtggacagtacgcgcctcagcatgtgcatcaaaatccgcaagaaggggcaggctaaggatgccaagaagaaagcgcagtgatgattcattgttgagatctgccatgtttgttcgtcatgtgtaacgaatcagtatttgtagctctgttgtcggcatttcaacatcattaccttcgcggaattc

SEQ ID NO: 4177 - protein, 325 aa, Hordeum vulgare
MAGTCAHVEFLRAQPAWALALAAVGLLVAARAALRLALWVYAAFLRPGKHLRRRYGPWAVVTGATDGIGRAIAFRLAASGLGLVLVGRNPDKLAAVSQEIRAKYPKTEVRTFVLDFASEGLAAGVEALKDSIRGLDVGVLVNNAGVSYPYARYFHEVDEELMRSLIRVNVEGVTRVTHAVLPGMVDRKRGAIVNIGSGAASVVPSDPLYSVYAATKAYVDQFSRCLYVEYKGKGIDVQCQVPLYVATKMASIRRSSFLVPSADTYARAAIRHIGYEPRCTPYWPHSVLWFLISLLPESLVDSTRLSMCIKIRKKGQAKDAKKKAQ

SEQ ID NO: 4178 - DNA, 1650 bp, Medicago truncatula
  CDS (1)..(1650)
atggatttgccagatttcttcctagcagcaacaatcacattaggcttcatctccatatgtaaatctctattccattttctcaactggataaggatcatgttcttgagacctcgcaaaaaactcaaagactatggttcatgggctataatcaccggctccaccgatggaataggcaaagccatggcttttgaatttgcatcaaagggactcaacattctcttagttggtagaaaccctcttaaacttgaagcaacatcaaaagagataatagatagaaattttggaaatgttgaggtaaagtttgttgttatagacatgcaaaatattagtggagaggaaataatgaaaagagtagaagaagcaatatatggtttagatgtgggaattttagttaatagtgctggtgtggcttacccttatgctagattttttcatgaggttgatttggatttgatggatgctattatcaaagtgaatgttgaaggaacaacttggattacaaaagctgtgcttcctagtatgattaagaagagaaaaggagctattattaacattggttctggttccagtgttgtacttccttcttttcctcttgtcacaatttatgcagcatcaaaagcgtatcttgcaatgttctctgcatgcaccagtttggaatacaaacaccacgggattgacatccagtgccaggttctctcgtcgtcgcctctcttcttcaccttcatggctccaatgtttgtctcaacaaaaatgacatgtgatatgaagacatcactttttgttccaacaccagataaatacagcaaagcatgcacaaaatggattggctatgaaaaattggttgtgccttacttctttcacaatctgcagtcgtttctcataaggaaaattcctgatgtactcatggattcctatatgctacgtttttttctttaccggcgtgaaaaaggactcatcgacgactcccaaatcaaaggattagaagcatcttttcttattccctttgtcataattgaggtagtctttgtcggttataataatcttaacctcgtgggtcagttgattgaaacgaatgctcaagttttgactagggcgacgaccctccgggaagactggaggtccgcgcaactcatcagaaaagcaggtggcacgaatccagccgcacctcaacatgagccaagcacacaagaagtggttcattggaaaaaaccagcgagaggaaggtacaaatgtaatatcgatgcctcattctcctcctctcttaaccgagttggtattggcatatgtatcagagatgatgcaggtgactttgtgcttgcgaaaactgattggttttctcctttatgtgaagtcacgataggagaagcagttgggttacacacggcgctgcagtggatatcagacctccaatttgataatgttgattttgccctagattcaaagcaggacgtagattcttttcatacaggagtagatgatgataacgaacttggttgtattattacggcctgtagacagttgtttcaggatagttttcaaaactctcatgtcgagtttaataggaggcaagctaatggggtcgctcacgaattagcgagggtagccccatcatttatgatgatgtaccgtcatgtatttggcatcttttga

SEQ ID NO: 4179 - protein, 549 aa, Medicago truncatula
MDLPDFFLAATITLGFISICKSLFHFLNWIRIMFLRPRKKLKDYGSWAIITGSTDGIGKAMAFEFASKGLNILLVGRNPLKLEATSKEIIDRNFGNVEVKFVVIDMQNISGEEIMKRVEEAIYGLDVGILVNSAGVAYPYARFFHEVDLDLMDAIIKVNVEGTTWITKAVLPSMIKKRKGAIINIGSGSSVVLPSFPLVTIYAASKAYLAMFSACTSLEYKHHGIDIQCQVLSSSPLFFTFMAPMFVSTKMTCDMKTSLFVPTPDKYSKACTKWIGYEKLVVPYFFHNLQSFLIRKIPDVLMDSYMLRFFLYRREKGLIDDSQIKGLEASFLIPFVIIEVVFVGYNNLNLVGQLIETNAQVLTRATTLREDWRSAQLIRKAGGTNPAAPQHEPSTQEVVHWKKPARGRYKCNIDASFSSSLNRVGIGICIRDDAGDFVLAKTDWFSPLCEVTIGEAVGLHTALQWISDLQFDNVDFALDSKQDVDSFHTGVDDDNELGCIITACRQLFQDSFQNSHVEFNRRQANGVAHELARVAPSFMMMYRHVFGIF

SEQ ID NO: 4180 - DNA, 876 bp, Medicago truncatula
  CDS (1)..(876)
atgttcttaagaccacacaaaaaactcatagactatggttcatgggctataatcaccggctccaccgatggaataggcaaagccatggcttttgagtttgcattaaagggactcaacattctcttagttggtagaagccctcttaagcttgaggcaacatcaaaagagattatagataaaacttttggaaatgttgaagtcaaatctgttgttgtagacttgcaaaataatagtggagaggaaataatgaataaggttgaagaagctatagatggtttagatgttggaattttagttaatggtgctggtgtggcttatccttatgctagattttttcatgaggttgatttggatttgatggatactattatcaaagtgaatgttgaaggaacaacttggattactaaagctgtgcttcctagtatgattaagaacaaaaaaggagctattattaacattggttctggttccactgttgtgattccttcatatcctcttgtcacactttatgcagcttcaaaagcatatcttgcaatgttctctgcatgcactaatttggaatacaagcagctaggaatcgacatccagtgtcaggtaccattatttgtgtcaacaaaaatgacaaggatgagggcatcactttttgttccaacaccagataaatacagcaaagcatgcacaaaatggattggctatgaaaaattggttgtaccttacctctttcacaatctgcagtcatttctcataaggaaaattcctgatgtattcttggattcctacatgttgcgtaatttgctttacatgcgtaaaagagggctcatcaaggactcccaaatcaaaggatcaaaagcatctagtaattctaaaacaaattaa

SEQ ID NO: 4181 - protein, 291 aa, Medicago truncatula
MFLRPHKKLIDYGSWAIITGSTDGIGKAMAFEFALKGLNILLVGRSPLKLEATSKEIIDKTFGNVEVKSVVVDLQNNSGEEIMNKVEEAIDGLDVGILVNGAGVAYPYARFFHEVDLDLMDTIIKVNVEGTTWITKAVLPSMIKNKKGAIINIGSGSTVVIPSYPLVTLYAASKAYLAMFSACTNLEYKQLGIDIQCQVPLFVSTKMTRMRASLFVPTPDKYSKACTKWIGYEKLVVPYLFHNLQSFLIRKIPDVFLDSYMLRNLLYMRKRGLIKDSQIKGSKASSNSKTN

SEQ ID NO: 4182 - DNA, 963 bp, Medicago truncatula
  CDS (1)..(963)
atggattgttgcataatcagtaaactcaaaacccaaccattctggttcctcattctcttctccctcggtctcttcaccattctcagattcactcttcttcttctcaactggttctatgtcaattttctcagacaacccaaaaacctcaaaaactatggatcttgggccctcgttactggacccaccgatggcattggaaaatccttcgcctttgaactcgctcgcaaaggcttgaacctaatcctcgttggtcgtaaccccgaaaaactcaaagacgtttcagattccatcaaagccaaattcggtaaaaccgaggttaaaaccgttgtcgttgatttcaccggtgatctcgacgacggtgttaagaggattgttgaaacgattgatgggttggatgttggggttttgattaacaacgtggggatttcgtatccttatgcgagatttttccatgaagttgatcaagagcttttgaagaatttgattaaggttaatgttgttggaactactaaggttactcaagctgttttgcctgggatgttgaagaggaaaaagggtgctattgttaatattggttctggtgctgctattgttattccttctgatcctctttatgctgtttatgctgctacaaaagcgtacattgatcaattttctagatgtctttatgttgaatacaagaagagtgggattgatgtgcagtgtcaggttccattatatgtggcaacaaagatggcatcaatcaggagatcttcattctttgttccatcaacagacggctatgcaaaagcaggtgtgaaatggataggatatgaacctcgttgcacaccatactggccacatacccttctatgggccgtggcacgttcgctgccagagtctatagttgatacttggcgccttgggttttgtatgggtattagaaagagggggcagctcaaagattcgaagaagcaggaataa

SEQ ID NO: 4183 - protein, 320 aa, Medicago truncatula
MDCCIISKLKTQPFWFLILFSLGLFTILRFTLLLLNWFYVNFLRQPKNLKNYGSWALVTGPTDGIGKSFAFELARKGLNLILVGRNPEKLKDVSDSIKAKFGKTEVKTVVVDFTGDLDDGVKRIVETIDGLDVGVLINNVGISYPYARFFHEVDQELLKNLIKVNVVGTTKVTQAVLPGMLKRKKGAIVNIGSGAAIVIPSDPLYAVYAATKAYIDQFSRCLYVEYKKSGIDVQCQVPLYVATKMASIRRSSFFVPSTDGYAKAGVKWIGYEPRCTPYWPHTLLWAVARSLPESIVDTWRLGFCMGIRKRGQLKDSKKQE

SEQ ID NO: 4184 - DNA, 996 bp, Magnaporthe grisea 70-15
  CDS (1)..(996)
atggatagcttgacaaccgcactgggcagcgtgccacaagtcgtgcagtgggcccttgctggagtaggagctctctacatctcggccaaggtcttgagttacctgcacctggtcttgaaccttttcattcttggcggcaccaacctcagcaaatatggtaaaaagggcagttgggcggttgtcaccggcgcctcggacggtctcggtaaagagtttgcctcgcaactcgcagccaaaggcttcaacattgtccttgtctcccgcaccgaatcgaagctcaaggaacttgcgaaagagctcgaggccaagaatggcagcctgaagaccaaggttctggcgatggactacgagcaggacaacgacgatgactacgagaaactgggccaactccttagtggcctggatgtcgccatcctgatcaacaatgtcggccgcagccactcgatccccgtgccattcctccagaccccgcgcgaggagctgcagaatattgtaaccatcaactgccttggcacactcaagactacccaggttgtggctcccatcatggctcagcgcaagcggggtctgattctcaccatgggctcattcggcggctggatgcctacgccattcctggctacctacagcggcagcaaggcattcctgcagcactggagcacctcgctcgctgaggagctccgcagcagcggcgtcgacgtccacctggtcctcagctacctcatcgtgtccgccatgagcaaagtgcgccgccccagcgctatggtcccgacgcctcgagctttcgtgcgctcggccttgggcaagattggatgtgctactcagaacgtagcctacacttatactccgtggtggagccatgccattatgcagtggtgggttgagaacactatcggcattggtagcaagatcggattgcaggtcaacctgaagatgcacaaggacattcgcactcgtgcgctgaagaaggcggagagggaggcaaagaaggcttga

SEQ ID NO: 4185 - protein, 331 aa, Magnaporthe grisea 70-15
MDSLTTALGSVPQVVQWALAGVGALYISAKVLSYLHLVLNLFILGGTNLSKYGKKGSWAVVTGASDGLGKEFASQLAAKGFNIVLVSRTESKLKELAKELEAKNGSLKTKVLAMDYEQDNDDDYEKLGQLLSGLDVAILINNVGRSHSIPVPFLQTPREELQNIVTINCLGTLKTTQVVAPIMAQRKRGLILTMGSFGGWMPTPFLATYSGSKAFLQHWSTSLAEELRSSGVDVHLVLSYLIVSAMSKVRRPSAMVPTPRAFVRSALGKIGCATQNVAYTYTPWWSHAIMQWWVENTIGIGSKIGLQVNLKMHKDIRTRALKKAEREAKKA

SEQ ID NO: 4186 - DNA, 1005 bp, Gibberella zeae PH-1
  CDS (1)..(1005)
atgactgctatcgcagactttttcgaaaacgtaccgcagcctctgcaatggggtcttgctggtgttggtgctctcttcctcggctccaagattctgagctatctccaacttgtcctcagcgccttcgttctcggaggtaccaacctgcgtaagtacggaaagcctggtacttgggctgttattaccggtgcctctgatggcctcggcaaggagtatgctctgcaactcgctgccaagggcttcaatctcgtcctcgtttcccgaactctgtccaagctcgagaccctatccaccgagattcaacaaaagtactctggcaagggcctccagatcaaggtccttgatatggacttttccaagaacaacgatgccgattacgagcgcctgagcgagcttatctacggtcttgatgtcggtatcctcatcaacaacgtcggccagagccacagcattcccgttcctttcctcgagaccaccaaggaggagcttgagaacatcatcaccatcaactgcactggtactctccgagttacccagactgtcgctcctatcatgaaggcacgaaagaacggtcttattctgaccatgggatcgttcggtggatggacacctactgctctcctggccacttactctggtagcaaggctttcctccagcagtggagcaacgctcttgcagctgagcttgccgatgacaaggttgatgtctacctcgttctcagccatcttgttaccactgctatgagcaagattcgccgccccagtcttctggtccccaacgctcgcaactttgtcaaggctaccctcggcaaggttggacttggtggataccagacagcaccttatacttataccccctggtggagtcactctttcatgctgtggttcattgagaacatccctggtgccaacggccctatcactatgtctgtaaacaagaagatgcacgaggacattcgccgaagggctctccgcaaggcggccagagaggccaagaagcagtaa

SEQ ID NO: 4187 - protein, 334 aa, Gibberella zeae PH-1
MTAIADFFENVPQPLQWGLAGVGALFLGSKILSYLQLVLSAFVLGGTNLRKYGKPGTWAVITGASDGLGKEYALQLAAKGFNLVLVSRTLSKLETLSTEIQQKYSGKGLQIKVLDMDFSKNNDADYERLSELIYGLDVGILINNVGQSHSIPVPFLETTKEELENIITINCTGTLRVTQTVAPIMKARKNGLILTMGSFGGWTPTALLATYSGSKAFLQQWSNALAAELADDKVDVYLVLSHLVTTAMSKIRRPSLLVPNARNFVKATLGKVGLGGYQTAPYTYTPWWSHSFMLWFIENIPGANGPITMSVNKKMHEDIRRRALRKAAREAKKQ

SEQ ID NO: 4188 - DNA, 1059 bp, Candida glabrata CBS 138
  CDS (1)..(1059)
atgacatttgttagggaattagaggttgctagtcaaaatagcagagcatttaacgtgacactatggtttattttcatcttcggtttgttgaagcttgttccttttgcattgagatttctgtccatggtctttgatctctttgtattaccacctgtcaactatgccaagtatggttgcaaagctggtgactacgctgtggttacaggtgcttccgatggtattggtaaagaatttgcttctcaattggcaagtaaaggcttcaatctagtactaatctcaagaactgaatcaaaactagttgcattgaaggatgaactagaaggcaaattcaacattaaagccaagatcttagccattgatatctctgcggatagcaaggacaactacaacaagatttattccctttgtgatgaccttccaatctctatactagttaacaatgttggccaatctcattctattcctgttccatttttggctactgaagaagaagaaatgagaaacattataactatcaataacaccgctaccttgatgatcactcaaattattgctccaattattatcagaacagttaagaaacacagagaatctggggataaaaagttgaagtctcaacgtggtctgatcttgactatgggctcctttggtggtttgatcccaaccccattgcttgctacatacagtggctctaaggccttcttgcaaaattggtcctcctctctagctggtgaacttgcagcagacaatgtggatgttgagttggttctatcttacttggttactagcgcaatgtcaaaagttagaagaacctctatgatgattcctaatccacgtacttttgtcaagtccactctgagaaatattggcagacgctgtggtgcccaggacaggtatggaacgatcacgcctttctggagtcatgctatctaccattttgtcattgaggaattgtttggtgtctacgccagagttgtcaacgagatcaattacaaattccacaagtctatcagaattagggctgttaggaaggctgtaagagaagccaagcaaaactga

SEQ ID NO: 4189 - protein, 352 aa, Candida glabrata CBS 138
MTFVRELEVASQNSRAFNVTLWFIFIFGLLKLVPFALRFLSMVFDLFVLPPVNYAKYGCKAGDYAVVTGASDGIGKEFASQLASKGFNLVLISRTESKLVALKDELEGKFNIKAKILAIDISADSKDNYNKIYSLCDDLPISILVNNVGQSHSIPVPFLATEEEEMRNIITINNTATLMITQIIAPIIIRTVKKHRESGDKKLKSQRGLILTMGSFGGLIPTPLLATYSGSKAFLQNWSSSLAGELAADNVDVELVLSYLVTSAMSKVRRTSMMIPNPRTFVKSTLRNIGRRCGAQDRYGTITPFWSHAIYHFVIEELFGVYARVVNEINYKFHKSIRIRAVRKAVREAKQN

SEQ ID NO: 4190 - DNA, 1041 bp, Kluyveromyces lactis NRRL Y-1140
  CDS (1)..(1041)
atggtggctttaattgatcaactatacaatgttacagcattgagagaatgcagttccttaaatgttgctgcatggatagttttcgggttaggtatatcaaagatggtgtttttgaccttaaacttcagcaagatggtcttagacttgtttgttcttccaggtccagactttaagaagtacggtaaggggaaaggtgcatatgctgttgttactggtgctagtgacggtattggtaaagaatacgccaaacaattagcgaaacgcgggttcaacctaattttgatcagtagaactgaatcgaagctagttgaattgaagaaggaaatcgagactgaatgcaagattgacgttaaaattttagccattgatgtcagttctgatagcaaggagaactatactttaattagagaagttgcgtcgggtttacctgtaactgttttgatcaataatgttggtaagtctcattcgattccagtaccatttgatcaaaccgaagaatctgaattgagagatataattactatcaacaatactgcgacattaatgatcacacaaactttgttaccacaattaaaagcaagcgttaagacgttgaaatgtcgtggtctaatcttgacaatgggttcctttggtggtctgctacctaccccattcttagctacatacagtggttccaaggcatttttacaaagttggtctaacgccctagctggtgaattatctagcgattctatcgatgttgagttagtgttatcttacttagttaccagtgcaatgtctaagattagaagatcaagtgcattgatcccttctccaaaggctttcgtgagatccacattgaactccattggcaaacgctgtggtgcccaagagcgttttgcaacctccacgccgtattggtctcatgcattataccatttcattatcgagaacaccgtcggtgtgtactctaagattgctaattcaattaattattccttccacttgagtatcagaaagagagctttgaaaaaggctgaaagacaagccaagaagcaataa

SEQ ID NO: 4191 - protein, 346 aa, Kluyveromyces lactis NRRL Y-1140
MVALIDQLYNVTALRECSSLNVAAWIVFGLGISKMVFLTLNFSKMVLDLFVLPGPDFKKYGKGKGAYAVVTGASDGIGKEYAKQLAKRGFNLILISRTESKLVELKKEIETECKIDVKILAIDVSSDSKENYTLIREVASGLPVTVLINNVGKSHSIPVPFDQTEESELRDIITINNTATLMITQTLLPQLKASVKTLKCRGLILTMGSFGGLLPTPFLATYSGSKAFLQSWSNALAGELSSDSIDVELVLSYLVTSAMSKIRRSSALIPSPKAFVRSTLNSIGKRCGAQERFATSTPYWSHALYHFIIENTVGVYSKIANSINYSFHLSIRKRALKKAERQAKKQ

SEQ ID NO: 4192 - DNA, 1041 bp, Debaryomyces hansenii CBS767
  CDS (1)..(1041)
atgtcactttgtcaattcgtgtcatcaatcagtgattgtaggatcacccaagctttaatatatggtgttttgtttgttggtgtttacaaaattaccacattcactttaagtgttggttcgttattagtggatctttttgtcttgccagcagtcgattttaagaagtatggagctaaacaaggcaagtgggcggttgttactggtgcgtccgatggaattggtaaggaatatgcttatcaattggcctctagaggcttgaacgttgttttaatttcaagaactctctcgaaattggaattaattgctactgaaattgaaactaaatacaaggtaagcaccgaagtcattgcattcgatgcttccaccgataatgatgccaactacgctaagatcttgcacaccgtgtccaacttgcctgtcaccgtgttggttaataatgtcggccagtcccactccatcccagtgccattcttggaaaccgaagataaggaattgagagacatcattaccatcaataacacagtcactttgaaaatcacccaggccgtggcccctgttatcgcagacaccgtcgccaaggaaaataaaaaggtcaagggcttaatcttaaccatgggctcgttcggtgggttgttgccaaccccgtacttggctacatactccggttcaaagtccttcttacaagcctggtcctcggccttggccggtgaattgaagcctcaaggtatcgacgtccaattggtcatctcgtacttggtcacctccgccatgtccaagatcagacgctcttcggcatccattccaaacccaaagaacttcgtcacctccgtattgaacactgctggtcgtcgttgtggtgcccaagaaagatttgccaccactactccctactggacccatgcattgatgcactttgggatcgaaaatactgtgggtgtctactcaaaattcgccaactccttgaactttagcatgcataaaagtatccgtgtcagagctttgaagaaagctgctcgtgcaaacgctacaaagaccgattag

SEQ ID NO: 4193 - protein, 346 aa, Debaryomyces hansenii CBS767
MSLCQFVSSISDCRITQALIYGVLFVGVYKITTFTLSVGSLLVDLFVLPAVDFKKYGAKQGKWAVVTGASDGIGKEYAYQLASRGLNVVLISRTLSKLELIATEIETKYKVSTEVIAFDASTDNDANYAKILHTVSNLPVTVLVNNVGQSHSIPVPFLETEDKELRDIITINNTVTLKITQAVAPVIADTVAKENKKVKGLILTMGSFGGLLPTPYLATYSGSKSFLQAWSSALAGELKPQGIDVQLVISYLVTSAMSKIRRSSASIPNPKNFVTSVLNTAGRRCGAQERFATTTPYWTHALMHFGIENTVGVYSKFANSLNFSMHKSIRVRALKKAARANATKTD

SEQ ID NO: 4194 - DNA, 1170 bp, Yarrowia lipolytica CLIB122
  CDS (1)..(1170)
atggtctacgtgaacgcgaaaaactacttttgtgactcgatcatcaacaacacggaccgggtgctgtctgctctcatcaagtaccatggtctctccatcattgccgtctttctgctggcaattggcctcttccacgtggctctgaaggtggtgtcctatgtggccgttcttctcgacgtgtttgtgctgcctcccaccaactacctgccctacggctcccagcggggcgcctgggccgtggtgaccggtgcttctgacggcattggcaaggagtacgcccgacagctgggtctccgaggcttcaacgtgttcctcatttctcgaaccgagtccaagctgcgagagctggcccaggagattgccgaaaagtccaaggtcgagaccaagttcctggccatcgacgtgtccaccgactccccccagaactacaaggacatcgagaccgtgctggagaccatccccagcgtgtctatcctcatcaacaacgtcggcttgtcccactccatccccacccccttcctcgagaccccccccgccgagctgcacaacatcatcgccatcaacaacttggctactctgaagatcacccagctgattgcccccaagattgtcgagtccgtcaaggaggcccgagccaccaagaagttccagaagggtctcattcttaccatgggatcttttggcggcttgctgcccacccccctgctcgctacctactctggttccaaggccttcctccagcactggtccaacgctctggccgtggagcttgcccccgagcacgtcgatgtcgagctcgttgtctcctacctcgtcacctctgccatgtccaaggtccgaaagacctctgctctgatccccaaccccaagcagtttgtcaccgccactctgtcgtccgttggccgagccggaggagcccaggagaagtttgccacctccaccccctactggtcccacgccctgctgcactggtggatcgcccagaccgtcggcgtcttctccaagctcgttgccggcttcaactacaagatgcacgtcgacatccgaaagcgggctctcaagaagcaggcccgacaggccgctggaggcgttgccgaccccaagaacaccaccgctgctcgagagggctacgccaccgagtctctcaagaacgagactctcaagcactaa

SEQ ID NO: 4195 - protein, 389 aa, Yarrowia lipolytica CLIB122
MVYVNAKNYFCDSIINNTDRVLSALIKYHGLSIIAVFLLAIGLFHVALKVVSYVAVLLDVFVLPPTNYLPYGSQRGAWAVVTGASDGIGKEYARQLGLRGFNVFLISRTESKLRELAQEIAEKSKVETKFLAIDVSTDSPQNYKDIETVLETIPSVSILINNVGLSHSIPTPFLETPPAELHNIIAINNLATLKITQLIAPKIVESVKEARATKKFQKGLILTMGSFGGLLPTPLLATYSGSKAFLQHWSNALAVELAPEHVDVELVVSYLVTSAMSKVRKTSALIPNPKQFVTATLSSVGRAGGAQEKFATSTPYWSHALLHWWIAQTVGVFSKLVAGFNYKMHVDIRKRALKKQARQAAGGVADPKNTTAAREGYATESLKNETLKH

SEQ ID NO: 4196 - DNA, 1041 bp, Aspergillus nidulans FGSC A4
  CDS (1)..(1041)
atggaatacttgaaggatatctcgtcgtccctttcgggctgggagttcaactttgctcctggttggcagagcgtgacagcctcagtgctgctcgtggctggaggctggtttgttgtctccagggtttggaccttcctcagggtcttgaccagtctgttcgttcttcccggaaaatcgctccgctcatttggccctaagggtagctgggcaattgttacaggtgcctcggatggtttgggcaaagaattcgccctccagatcgctcgcgctggctacaacatcgtcctcgtttcacgaactgcttccaagctaaccgccttgaccgatgagattacgtctaaatacccctcggtccagaccaagatgctggcgatggattttgctcgcaacttggacgaggactacgaaaagctaaaggccctcattcaagacctagacgtagctatcttgatcaacaatgttggaaagagtcacagcatcccggttcctttcgccctgaccccggaggacgagttggcggacatcatcaccatcaactgcatgggtactttgcgggttacgcaactggttgttccaggcatgacccaacgcaagcgaggattgattctgaccatgggttcttttggtggtctcgttccatctcctctccttgctacctactccggaagcaaggctttccttcagcagtggtccacagctcttggttcagaactccagccgtacggcattactgttgagctggtgcaggcctatctcattacctccgccatgtccaagattcgcaagaccagtgccttaatccctaacccgcgtgcgtttgtcaaggcgacattgtccaagattggcaacaatggcggttccccaggctacgcatacagttcctccccatactggagtcacggattggtcgcataccttgcgacatgcgtgatcaacccgatgagcaaatggctcgcaaaccaaaacaaggctatgcacgagtcgatccgcaagcgggctctgcgcaaggcagaacgtgagaacgcgaagaagagttcttga

SEQ ID NO: 4197 - protein, 346 aa, Aspergillus nidulans FGSC A4
MEYLKDISSSLSGWEFNFAPGWQSVTASVLLVAGGWFVVSRVWTFLRVLTSLFVLPGKSLRSFGPKGSWAIVTGASDGLGKEFALQIARAGYNIVLVSRTASKLTALTDEITSKYPSVQTKMLAMDFARNLDEDYEKLKALIQDLDVAILINNVGKSHSIPVPFALTPEDELADIITINCMGTLRVTQLVVPGMTQRKRGLILTMGSFGGLVPSPLLATYSGSKAFLQQWSTALGSELQPYGITVELVQAYLITSAMSKIRKTSALIPNPRAFVKATLSKIGNNGGSPGYAYSSSPYWSHGLVAYLATCVINPMSKWLANQNKAMHESIRKRALRKAERENAKKSS

SEQ ID NO: 4198 - DNA, 1227 bp, Candida albicans SC5314
  CDS (1)..(1227): transl_table=12
atgtttttaatttcggatattttaaacgtcgtgtgtaagtttaggaccaccacccgcgcgtcttttccgcccacggagaaaaattgttggtgtttcctgaaaaaaaaaagggatggaagaaaaacacacacacataaatctccttctttcttgaaacatacaacaaacaacttaaaaatgcctttcactcaattcttggataaatattcagataatttggctattcaatatgctattatttttgcattgttattaggagttttcaaattgactgtgttttcactcaaatttgcttcattaatatacgacatatttttagcaccagcaaccgatttctccaaatacggtgctgccagtgggaaatgggctgttgttaccggtgcttccgatggtattggtaaagaatatgcttttcagttggccaaaaaggggttcagcattgtcttagtttcaagaacacaatcaaaattagagttgattgccacagaaattgaaagtaaatataaagttaacacaaaaattgttgcatttgatgcttctacagacgatgaagaaaactatttaaaattggaaaaagctgtgtttgatttacctgttaccatattgattaataatgtcgggcaatcccactctattccagttccattcttgaaaactgaaaagaaagaattgaaagatattattactattaacactactgccactttaagaatcactcaaattgttgctccaattattgtctctaccgttgaaaacccacacccaaaacaattgcgtggtttgattttaactatgggttcatttggtgggttattaccaacaccatacttggccacttattccggttcaaaatcctttttgcaagcctggtctgctgccttggctggtgaattacaagctgatcatgttgatgttgaattggtcatttcttatttagttgcttctgccatgtccaaaattaaacgtacttccttaagtattccaaaccctaaacaatttgtcacttctactttgaatggtgttggccgtcgtaatggtgctcaagaaagatttgcaacttcaactccatactggactcatgccttgatgcattttgcaatcgataatactgttggtgtttattcaaaaattgctaataaattgaacttgcaaatgcatcaatctatccgtcaaagagctctaaagaaggctgctagattggctgctgttgctgaaaagaaagattaa

SEQ ID NO: 4199 - protein, 408 aa, Candida albicans SC5314
MFLISDILNVVCKFRTTTRASFPPTEKNCWCFSKKKRDGRKTHTHKSPSFLKHTTNNLKMPFTQFLDKYSDNLAIQYAIIFALLLGVFKLTVFSLKFASLIYDIFLAPATDFSKYGAASGKWAVVTGASDGIGKEYAFQLAKKGFSIVLVSRTQSKLELIATEIESKYKVNTKIVAFDASTDDEENYLKLEKAVFDLPVTILINNVGQSHSIPVPFLKTEKKELKDIITINTTATLRITQIVAPIIVSTVENPHPKQLRGLILTMGSFGGLLPTPYLATYSGSKSFLQAWSAALAGELQADHVDVELVISYLVASAMSKIKRTSLSIPNPKQFVTSTLNGVGRRNGAQERFATSTPYWTHALMHFAIDNTVGVYSKIANKLNLQMHQSIRQRALKKAARLAAVAEKKD

SEQ ID NO: 4200 - DNA, 1041 bp, Aspergillus oryzae
  CDS (1)..(1041)
atggatttcctatcgaagcacacaacctgtctgtctaacctggagcttaatcttgctcctggatggcagactgtcagcgcgtatttccttcttgcagcaggaagcttgtttgtcgcctctagagctttgacttttgtcagagttcttctcagcctgtttgttcttcccggaaagtcgcttcgctctttcggccccaagggtagctgggccgtggtcacaggtgcatccgacggtttgggcaaagaattctcgctccaacttgctcgcgctggcttcaacatcgtccttgtctcccggactgcctcgaagctgactacgttgtccgatgaaatcacctccaagtacgcctccgtccagaccaaaaccctggctatggactttgctcgcaacgaagatagcgactatgagaagctgaaggccctggtggatgagctggacgtagccattctagtaaacaatgttggaaagagccacgacatccccactcctttcgcattgacttctcaggaggagatgacggacatcataaccatcaattgcatgggaaccctgcgtgctactcagttgatcgtgccgggaatgatgcagcgcaagcgtggtttgattctgacaatgggatcctttggtggccttctcccaactcctcttcttgccacctactctggtagcaaggccttcctgcagcagtggtcgacggctctcggctcggaacttgaggagcacggtatcaccgttgagctcgtacaggcatatctcatcacttctgctatgtcaaagattcgccgggccagcgctacgatcccggatccccggtcgttcgtcaagtcggtcttgtctaaaattggccgcaatggtggatctccatcctacgcttacagctcatcgccctactggagccatggcttgatggcctacttcttgacctgtatcgccggaaccatggggaagttcgttacttctaagaatcgaggaatgcacgagtcaattcggaagcgagctctgcgcaaggccgagcgcgaaaaggcgaagaagagcacttaa

SEQ ID NO: 4201 - protein, 346 aa, Aspergillus oryzae
MDFLSKHTTCLSNLELNLAPGWQTVSAYFLLAAGSLFVASRALTFVRVLLSLFVLPGKSLRSFGPKGSWAVVTGASDGLGKEFSLQLARAGFNIVLVSRTASKLTTLSDEITSKYASVQTKTLAMDFARNEDSDYEKLKALVDELDVAILVNNVGKSHDIPTPFALTSQEEMTDIITINCMGTLRATQLIVPGMMQRKRGLILTMGSFGGLLPTPLLATYSGSKAFLQQWSTALGSELEEHGITVELVQAYLITSAMSKIRRASATIPDPRSFVKSVLSKIGRNGGSPSYAYSSSPYWSHGLMAYFLTCIAGTMGKFVTSKNRGMHESIRKRALRKAEREKAKKST

SEQ ID NO: 4202 - DNA, 1026 bp, Schizosaccharomyces pombe
  CDS (1)..(1026)
atggacggagaagttcttgcaaacaaatcttgctgtggtgcagtagtaactgcattttcagtaattggtattgtgtttacaatccttaaatttacatcttttgccagtttcgtttataagacgttctttgccaaaggtgtcaagctgtctgtttacggagccaagaaaggttattgggcggttgttacaggtgctactgatggaatcggtaaagagtatgctactcaattagccatgtctggatttaatgtggttcttataagcagaacccaagaaaagcttgatgcattagctaaagaactcgaaactgttgctaaggtcaaaactcgcactattgcaattgattacaccaaaacgaccgccgaaacttttgagaagcttcatcaagatttagtaggaactccaattacagtacttatcaacaatgttggccaatctcattatatgcctaccagttttgcggaaacaacagtgaaggaaatggatgacattatgcatataaactgctttggtactcttcacaccactaaggccgtactttctatcatgctcagagagagacagaagaatgaaaagggtccccgttgccttattttgactatgggctccttcgctggcttacttccttctccttatttgtctacttatgccggatctaaagcctttttgtctaactggtctgcttctttgggtgaggaagttaagaaacagggtatcgacgtttggtgtttcaattcttatcttgttgtatcagcgatgtcaaaagttcgtcgacctacattaacaatccctacacccaaaaagtttgttcgcgctgctttaagtagcattggtctccagcgtggaggaaccaatccttacataagtcaaccatatcctagccatgccgtaatgagttggtctttggaacaattgttgggcagtgcaaaggggtttgtcgtttctcaagttgctgcaatgcacctcagcattcgtaaacgtgcacttcgaaaagaagcacgccttcaagctcaaaatcaagcctag

SEQ ID NO: 4203 - protein, 341 aa, Schizosaccharomyces pombe
MDGEVLANKSCCGAVVTAFSVIGIVFTILKFTSFASFVYKTFFAKGVKLSVYGAKKGYWAVVTGATDGIGKEYATQLAMSGFNVVLISRTQEKLDALAKELETVAKVKTRTIAIDYTKTTAETFEKLHQDLVGTPITVLINNVGQSHYMPTSFAETTVKEMDDIMHINCFGTLHTTKAVLSIMLRERQKNEKGPRCLILTMGSFAGLLPSPYLSTYAGSKAFLSNWSASLGEEVKKQGIDVWCFNSYLVVSAMSKVRRPTLTIPTPKKFVRAALSSIGLQRGGTNPYISQPYPSHAVMSWSLEQLLGSAKGFVVSQVAAMHLSIRKRALRKEARLQAQNQA

SEQ ID NO: 4204 - DNA, 939 bp, Arabidopsis thaliana
  CDS (1)..(939)
atgcagggagcatgcatctccgagagtcagccatggtatctccatttcgtatgcttcataggctttctctttctccttagagtactattcattcctctcctaaaatggttcaccacaagattcctcctcacacccaagcggctcaagcggtacggctcatgggctatggtcactggagccaccgaggggatcggacgcgcctttgctcacgagctggccaaacacggccttaacctcatcctagtcagcagaaacctttcgaagctcgaatctgtctctgatgatttccaacaagagtttccccacatcaagatcaagatcattccatttgacttctcctctgaaggaggatacggagcaatcgaggaagggataaaaggccttgaagttgggattttgataaacaacgttggtattacttatccacgcgccatgttcttccacgaggttgaccaacttacatggaccaaaatcctgagggttaatcttgaagccaccacttgggtcacacgatcactcatcggaccaatgcttcaccgccgccgtggagccatcgtcaatattagctccggcgctgccgttgttgtcccttctcatcccctctacgccatctacgctgccaccaaagcttatgtggatgcactatcaagatctctacatgtggaatataagcagtttggtattgatgtccagtgccaggttcccttatacgtgtcaacaaggatggtgtcagaagtggcagctatagacaaacctagcttatttgtaccgtcgcctgaagtctacgcaaaagcggcggtggcgcagatcggaattggatcacgttgctcgccgttttgggctcattctcttcagtggtttcttgttggacttgtaccggataaccttgttgatacttggcgtctctctatcggacttcgcagaagaagtttatcttaa

SEQ ID NO: 4205 - protein, 312 aa, Arabidopsis thaliana
MQGACISESQPWYLHFVCFIGFLFLLRVLFIPLLKWFTTRFLLTPKRLKRYGSWAMVTGATEGIGRAFAHELAKHGLNLILVSRNLSKLESVSDDFQQEFPHIKIKIIPFDFSSEGGYGAIEEGIKGLEVGILINNVGITYPRAMFFHEVDQLTWTKILRVNLEATTWVTRSLIGPMLHRRRGAIVNISSGAAVVVPSHPLYAIYAATKAYVDALSRSLHVEYKQFGIDVQCQVPLYVSTRMVSEVAAIDKPSLFVPSPEVYAKAAVAQIGIGSRCSPFWAHSLQWFLVGLVPDNLVDTWRLSIGLRRRSLS

SEQ ID NO: 4206 - DNA, 957 bp, Arabidopsis thaliana
  CDS (1)..(957)
atggagatctgcacttacttcaaatcacaacccacttggctcctcattctcttcgttctggggtcaatctcaatcttcaaattcatcttcaccctcctcagatctttctacatctacttcctccgaccatccaaaaacctccgccgatacggttcatgggcaatcatcaccggaccaacagacggaatcggtaaagctttcgcctttcagttagcccagaaaggtcttaaccttatactcgttgctcgtaacccagacaagctcaaagatgtctctgattccatcagatctaagtatagtcaaactcagatcttgaccgttgtgatggatttctctggagatattgatgaaggtgtgaaacggattaaggagagtattgaaggattagatgttgggattttgattaataatgctggcatgtcttatccttatgctaagtattttcatgaggttgatgaagagttgatcaataacttgattaagatcaatgttgaaggaactactaaagttactcaagctgtgttgcctaatatgcttaagaggaagaaaggtgctattattaatatgggttctggtgctgctgctcttattccttcttatcctttttactctgtttatgctggtgctaaaacgtacgtggatcagttcacaaagtgtctacatgttgagtataagaagagtgggattgatgttcaatgccaggttcccttgtatgttgcaacaaagatgacaaaaataagaagagcatccttcttagttgcatcaccagagggttacgcaaaggcagcactgcgttttgtaggctatgaagcacaatgcacaccgtactggcctcacgctctcatgggtgcagttgtctctgcattgcccgaaagcgtttttgaatcatttaacatcaagagatgcctccagatccggaagaagggtctccaaaaagactccatgaagaaagaatga

SEQ ID NO: 4207 - protein, 318 aa, Arabidopsis thaliana
MEICTYFKSQPTWLLILFVLGSISIFKFIFTLLRSFYIYFLRPSKNLRRYGSWAIITGPTDGIGKAFAFQLAQKGLNLILVARNPDKLKDVSDSIRSKYSQTQILTVVMDFSGDIDEGVKRIKESIEGLDVGILINNAGMSYPYAKYFHEVDEELINNLIKINVEGTTKVTQAVLPNMLKRKKGAIINMGSGAAALIPSYPFYSVYAGAKTYVDQFTKCLHVEYKKSGIDVQCQVPLYVATKMTKIRRASFLVASPEGYAKAALRFVGYEAQCTPYWPHALMGAVVSALPESVFESFNIKRCLQIRKKGLQKDSMKKE

SEQ ID NO: 4208 - DNA, 978 bp, Oryza sativa
  CDS (1)..(978)
atggccggcacgtgcgcgcacgccgagttcttccgcgcgcagccggcgtgggcgctggcgctggcgggcgtcggcctcctcgccgccgcccgcgccgcgctccgcctcgcgctctggctctacgccgcgttcctccgcccggggaagcccctgcgccgccgctacggcgcctgggcggtcgtcacgggcgccaccgacggcatcggccgcgccatggcgttccgcctcgccgcctcggggctcggcctcgtcctcgtcggccggagccccgacaagctggcctcggtctccgaggagatcagggggaggtaccccagggtggaggtgcggacgttcgtgctcgacttcgccgccgacggcctcgccgccggggtggaggggctcagggaggccatccgtgggctcgaggtgggcgtgctcgtcaacaacgccggtgtctcgtacccgtacgcccgctacctccacgaggtggacgaggagctcatgcgcaccctgatccgggtcaacgtcgagggcctcacgcgggtcacgcacgccgtgctcccggccatggtggagaggaagcgcggcgccatcgtcaacatcggctccggctcctcctccgtcatgccgtccgatccgctctactccgtctacgccgccaccaaagcttacgttgaccaattctcaagatgcctttatgttgagtacaagagcaagggtattgatgtgcaatgccaggtgcccttgtatgtggcaacaaagatggcctctatcaggaaatcctcgttctttgtcccatccgcggacacctacgcccgtgctgccattcgtcacataggctatgagccgaggtgcacaccgtactggccacactctgtaatgtggttcctgatctccattctccccgagtcactcattgacagcattcgcctgggaatgtgcatcaagatccgcaagaaggggcaagccaaagatgctaagaagaaagcgcagtga

SEQ ID NO: 4209 - protein, 325 aa, Oryza sativa
MAGTCAHAEFFRAQPAWALALAGVGLLAAARAALRLALWLYAAFLRPGKPLRRRYGAWAVVTGATDGIGRAMAFRLAASGLGLVLVGRSPDKLASVSEEIRGRYPRVEVRTFVLDFAADGLAAGVEGLREAIRGLEVGVLVNNAGVSYPYARYLHEVDEELMRTLIRVNVEGLTRVTHAVLPAMVERKRGAIVNIGSGSSSVMPSDPLYSVYAATKAYVDQFSRCLYVEYKSKGIDVQCQVPLYVATKMASIRKSSFFVPSADTYARAAIRHIGYEPRCTPYWPHSVMWFLISILPESLIDSIRLGMCIKIRKKGQAKDAKKKAQ

SEQ ID NO: 4210 - DNA, 987 bp, Oryza sativa
  CDS (1)..(987)
atggctggtcatgtcttcatgattcggcaagaatcggcgccgccggcgccaccgtggtggttcctctctctggtcttcctcggcgctgcctatgtcgccaccgtcaccctccgcctcctcgcctacctcgcgttctccctgcaccgtcagcccaaggacctccgcagccggtacggtgcgtgggcggtcattactgggccgacatccggcatgggccgggctatggcgctagagctcgctcgccgcggcctcaacctcgtgctcgtcggccgtgaccccgccaacctcgaggagatctccaacacggtcaggtctctccacggggtggagaccaagaccgtggtgttcgacctctcactcgtggcgactccccacggcgacgagccgctgcggcagctcagggagacggtggaggggctggatgtcggggtgttaatgaacaacgccggtgtgggggagccggctatggcgtacctacacgaggcggacgtggaggcgtgggtgagaatgatgcgggtgaacctgtgggcagtgacggaggtgacggcggcggtgctgccagggatggtggagcggggcaggggcgctgttgttaacatcggctcggcatcatcgcaggccatcccttccttccccctctgcaccatttactccgccaccaaacggcacgtacatgcaacaaacacacgggtagggattatggctgttcgtttgtaccggtacgtggctcatttctcccggagccttcacctcgagtacgcaagtgaagggatccatgtgcaatgccaggcgccgttcttcgtggcgacgaggatggtggagaacctggcggaggcgaggcgcctctcgccgttcacgccacctggagcagaggacgacgttgtctcagcaaatcagagcgtcgggggcgccggcgccgtcgtgacagcaggaagttcattcttggcgcttcgtcttgcgttcatgaacaataatagtgggcagtag

SEQ ID NO: 4211 - protein, 328 aa, Oryza sativa
MAGHVFMIRQESAPPAPPWWFLSLVFLGAAYVATVTLRLLAYLAFSLHRQPKDLRSRYGAWAVITGPTSGMGRAMALELARRGLNLVLVGRDPANLEEISNTVRSLHGVETKTVVFDLSLVATPHGDEPLRQLRETVEGLDVGVLMNNAGVGEPAMAYLHEADVEAWVRMMRVNLWAVTEVTAAVLPGMVERGRGAVVNIGSASSQAIPSFPLCTIYSATKRHVHATNTRVGIMAVRLYRYVAHFSRSLHLEYASEGIHVQCQAPFFVATRMVENLAEARRLSPFTPPGAEDDVVSANQSVGGAGAVVTAGSSFLALRLAFMNNNSGQ

SEQ ID NO: 4212 - DNA, 1020 bp, Oryza sativa
  CDS (1)..(1020)
atggagtccgtggtggtggccggagatctggccgctgcaccggcgccggcgacgccgatgtggttcgtggcgctggtcgccgtcggcctgcacgcggcggtcgtgtgggcggggacgttcctcgcgtggctccgccgcgcgttcctccggcccgggaagggcctgtgccggcggtacggcgagtgggcggtggtcaccggcgccaccgacggcatcggacgcgcggtggcgctggagctggctcgccgcgggctccacctcgtgctcgtggggcggaaccccgggaagctgtcgggcgtctgcaaggaggtccgcgcagcggcgccggcgtgcaaggtgaggaccgtggtgttcgacctcgccgccccaggggacgacgacgtcgggggcggcgagctgtcccgcggcgtggcgagggtggcggcggccgtggaggggctcgacgtggggctgctcgtgaacaacgccggcgcgacgtacccgtgcgcggcgtacttccacgaggtgcccgacgcggtctgggaggcggtgctgcgggtgaacgtggtggcggcgacgaggatcgcgcgcgccctcgtgccggccatggcggcgaaggggaggggtgccgtcgtcaacgtcggctccggctcctccgtcgtcgtgccggcgttcccgctctacgccgtgtacgcagcgaccaaagcgtatgttgaccaattgtctcgaagtctacatgttgaatacaagcatcacggagtggatgtgcaatgccagataccattatatgtcgccacaaagatgtcacctgtccagggtaactcgccgtttataccatcacccgaggagtacgccaaggctgctgtccgctgcatcggttatgagccaagatgtgtcccctactggcgccactcgatccagtggttctttgcatctctactgccagattctgttctgaatctatggcgtctccaggttggaatccggaagagaaatcagatgaaggttctgcttggtgagagcgatcatggattcagttaa

SEQ ID NO: 4213 - protein, 339 aa, Oryza sativa
MESVVVAGDLAAAPAPATPMWFVALVAVGLHAAVVWAGTFLAWLRRAFLRPGKGLCRRYGEWAVVTGATDGIGRAVALELARRGLHLVLVGRNPGKLSGVCKEVRAAAPACKVRTVVFDLAAPGDDDVGGGELSRGVARVAAAVEGLDVGLLVNNAGATYPCAAYFHEVPDAVWEAVLRVNVVAATRIARALVPAMAAKGRGAVVNVGSGSSVVVPAFPLYAVYAATKAYVDQLSRSLHVEYKHHGVDVQCQIPLYVATKMSPVQGNSPFIPSPEEYAKAAVRCIGYEPRCVPYWRHSIQWFFASLLPDSVLNLWRLQVGIRKRNQMKVLLGESDHGFS

SEQ ID NO: 4214 - DNA, 987 bp, Brassica napus
  CDS (1)..(987)
atgctgactctactcttctcctctctcggactcctcctgcttctcggtcttctcctcaaattcgcattcgccgatggggatttaacgctgatttcgaagaagcatgtgaaacgagaagccatagaaggaaaggtggtttggatcacaggggctagccgtggaattggagaagttcttgctaaacagtttgcgagtttaggtgccaagcttattctctctgctaggaacgaagctgagttggttcgtgttaagagtgagctcaaaggtaagtatgcaccagaagatgtcaaggttttgcctttagatctagctagcggcgaagagggtctcaaaggtgttgtagagagagcagtgtcgcttttccctggggctggggttgattatttggttcacaacgctgcctatgagcgtccgaaatcaaatgcagtggatgcgagtgaggaaaatcttaagactacattcgaggttaatgtatttgggaccatatctctcacaaagttggtaactcctcatatgctgaaacaaggaggcggtcattttgttgtgattagcagtgccgcagggaaggtaccatcacctggacaggctatatatgctgcttcaaagcatgctctgcagggctatttccacagcttacgttctgagttttttcagaagggaatcaaggttactgttgtttgcccgggtccaatagagacctcaaatggtacaggaacatcaacttcggaagacaagaagtctcctgagaagcgtgtgtcatctgaacgatgtgcagaactgaccataatcgctgcatctcataacttaaaagaagcttggatttcatatcagccagtactgctcgtgatgtatctagtgcagtacatgcctttccttggcttctggcttatggacaaggttggaggaaaacgtgtggaggttgctgagaagaaaggcaacacatactcatggaacttgctcttccagaagaagactaaaacaaactga

SEQ ID NO: 4215 - protein, 328 aa, Brassica napus
MLTLLFSSLGLLLLLGLLLKFAFADGDLTLISKKHVKREAIEGKVVWITGASRGIGEVLAKQFASLGAKLILSARNEAELVRVKSELKGKYAPEDVKVLPLDLASGEEGLKGVVERAVSLFPGAGVDYLVHNAAYERPKSNAVDASEENLKTTFEVNVFGTISLTKLVTPHMLKQGGGHFVVISSAAGKVPSPGQAIYAASKHALQGYFHSLRSEFFQKGIKVTVVCPGPIETSNGTGTSTSEDKKSPEKRVSSERCAELTIIAASHNLKEAWISYQPVLLVMYLVQYMPFLGFWLMDKVGGKRVEVAEKKGNTYSWNLLFQKKTKTN

SEQ ID NO: 4216 - DNA, 987 bp, Brassica napus
  CDS (1)..(987)
atgctgactctactcttctcctctctaggactcctccttctccttggccttctcctcaaattcgcattcgccgatggggatttaaccctgatttcgaagaagcatgcgaaacgtgaagccatagaaggcaaggtggtttggatcacaggggctagccgtggaattggggaagttcttgctaaacagtttgcaagtttaggtgccaagcttattctctctgctaggaacgaagctgaattggttcgtgttaagagtgagctcaaaggtaagtatgcaccagaagatgtcaaggttttgcctttagatctagctagcggcgtagaggggctcaaaggtgttgtagagcgggcagtgtcgcttttccctggggctggtgttgattatttggtccacaacgctgcctatgagcgtccgaaatcaaatgcagtggatgcgagtgaggagaatcttaagactacattcgaggttaatgtatttgggacaatatctctcacaaagttggtaactcctcatatgctgaaacaaggaggtggtcattttgttgtgattagcagtgccgcagggaaggtaccatcacctggacaggctatatatgctgcttcaaaacatgctctgcagggctacttccacaccttacgttctgagttctttcagaagggaatcaaggttactgttgtttgtcccggtccaatagagacctcaaatggtacaggaacatcaacttccgaagacaagaagtctcctgagaagcgcgtgtcatctgaacgatgtgcagaactgaccataatcgctgcatctcataacttaaaagaagcttggatttcatatcagccagtactgctcgtgatgtatctagtgcagtacatgcctttccttggcttctggctcatggacaaggttggaggaaaacgtgtggaggttgctgagaagaaaggcaacacatactcatggaacttgctcttccagaagaagactaaaacaaactga

SEQ ID NO: 4217 - protein, 328 aa, Brassica napus
MLTLLFSSLGLLLLLGLLLKFAFADGDLTLISKKHAKREAIEGKVVWITGASRGIGEVLAKQFASLGAKLILSARNEAELVRVKSELKGKYAPEDVKVLPLDLASGVEGLKGVVERAVSLFPGAGVDYLVHNAAYERPKSNAVDASEENLKTTFEVNVFGTISLTKLVTPHMLKQGGGHFVVISSAAGKVPSPGQAIYAASKHALQGYFHTLRSEFFQKGIKVTVVCPGPIETSNGTGTSTSEDKKSPEKRVSSERCAELTIIAASHNLKEAWISYQPVLLVMYLVQYMPFLGFWLMDKVGGKRVEVAEKKGNTYSWNLLFQKKTKTN

SEQ ID NO: 4218 - DNA, 978 bp, Triticum aestivum
  CDS (1)..(978)
atggccggcacgtgcgcccacgtcgaattcctccgcgcgcagccggcgtgggcgctggccctcgcggccgtcggcctcctcgtcgccgcccgcgccgccctgcgcctcgccctctgggtctacgccgccttcctccgccccggcaagcccctgcgccgccgctacgggccctgggccgtcgtcaccggcgccaccgacggcatcggccgcgccatcgccttccgccttgccgcctccggcctcggcctcgtgctcgtcggccgcaacccggacaagctcgccgccgtctccgaggagatcaggggcaagtaccccaagaccgaggtccgcaccttcgtgctcgacttcgcttccgaggggctcgccgctggggtggaggcgctcaaggactccatccggggcctcgacgtcggcgtgctcgtcaacaacgccggggtctcgtacccgtacgcccgctacttccatgaggtggacgaggagctcatgcggagcctcatccgggtcaacgtcgagggggtaacgcgggtcacccacgccgtgctcccgggcatggtcgacaggaagcgtggcgcaatcgtcaacatcggctccggtgctgcctctgttgtgccgtccgatccactctactccgtctacgccgccacgaaagcgtacgttgaccagttctcaagatgcctctatgttgagtacaagggcaagggcattgatgtgcaatgccaggtgcccttgtacgtggcgacaaagatggcatcaatcaggaggtcttccttctttgtgccatccgcggacacctatgctcgtgctgctattcgccacattggctatgagccgaggtgcacaccgtactggccacactctgttctgtggttcttgatctcccttctcccagagtcacttgtggatagtacacgcctcagcatgtgcatcaagatccgcaagaaggggcaggctaaggatgccaagaagaaagcgcagtga

SEQ ID NO: 4219 - protein, 325 aa, Triticum aestivum
MAGTCAHVEFLRAQPAWALALAAVGLLVAARAALRLALWVYAAFLRPGKPLRRRYGPWAVVTGATDGIGRAIAFRLAASGLGLVLVGRNPDKLAAVSEEIRGKYPKTEVRTFVLDFASEGLAAGVEALKDSIRGLDVGVLVNNAGVSYPYARYFHEVDEELMRSLIRVNVEGVTRVTHAVLPGMVDRKRGAIVNIGSGAASVVPSDPLYSVYAATKAYVDQFSRCLYVEYKGKGIDVQCQVPLYVATKMASIRRSSFFVPSADTYARAAIRHIGYEPRCTPYWPHSVLWFLISLLPESLVDSTRLSMCIKIRKKGQAKDAKKKAQ

SEQ ID NO: 4220 - DNA, 1775 bp, Brassica napus
  CDS (594)..(1553)
cggcacgaggcgagtttttttttttttttttttcgtacaacaaaagtttcttgaattgggccaacagcgaaacataaacgtataattatatttacaacgctttgtttgcttacacaccaggctccatcactgtttcttttgagtagctgtatctttaaacgaaaaaacaagaagatgaagttcaaacgtgatcgtgaccgtccaaataatcatacactgatatattcaacgcacctccattctcacaatacgccgtcgttgtatctccattcccagagttcccggacgcgtgatcacagctgttaacgattccggcgtcaacggccattccggcattagaagcagcttgctggatagacctcggcgaagtcttggaaactatggaaggaggaagcaagtgagggaagttgagagattcgagcgagtttggttggtgtaaacagtagaaagccacgtcgtgcgccacggctgcgccttccgccgtggagaatgagcctaaccagagacggtcgcgagttcccggaactcgaatctccgatacccatttcccccatttccggcgacggatgcctttgtactttgattgagtttcgatggagatctgcacttacttcaaatcccagcccacatggctcctcgtcctcttctccctcggctccatctccatcctcaggttcaccctcaccctcctcacatccctctacatctacttcctccgccccggcaagaacctccgccgctacggatcctgggccatcatcaccggccccaccgacggcatcggcaaagccttcgcctttcagctcgcccagaaaggcctccacctcgtcctcgtcgcccgcaaccccgacaagctcaaagccgtctccgactcgatccaagccaagcacagcaccacccagatcaagaccgtcctgatggacttctccggagacatcgacgcaggcgtgaggcggatcaaggaggcgatcgaaggtctggaggttgggattctgatcaacaacgctggggtttcgtacccttacgctaagtacttccacgaggttgatgaggagctgcttggtaacttgattaagatcaatgtcgaggggactaccaaggttactcaggctgtgttggtgaatatgctgaagaggaagaggggagctattgttaacatggggtctggtgctgctgctcttatcccttcctatcctttctactctgtttatgccggcgctaaaacgtatgtggatcagttctcaaggtgtctccatgttgagtacaagaaaagtgggattgatgttcaatgccaggtacccttgtatgttgctacgaagatgaccaagataagaagagcatctttcttagtggcatctccagagggttacgcaaaggcagcactgcgttttgtaggctacgaaccacgttgcacaccttactggcctcacgctctcatgggttatgttgtctctgcattgcccgaaagtgtttttgaatcctttaacattaagaggtgtctccagatccggaagaagggcatgcttaaggactccagtagtaaaaaggagtaaaaacttttcgagggtgcatgattttcttctgcagcacttggtttcttgcaagtttctgtttagacttttgcaagacttgtacgctttagtttccgatgtttccaaggttgtttccttattttgaaaattaaaaaccataacgtccactaaaaaaaaaaaaaaaaaagcggccgctttaaaggatccaactttacgtccgcgggcatgcaacgcattagtttt

SEQ ID NO: 4221 - protein, 319 aa, Brassica napus
MEICTYFKSQPTWLLVLFSLGSISILRFTLTLLTSLYIYFLRPGKNLRRYGSWAIITGPTDGIGKAFAFQLAQKGLHLVLVARNPDKLKAVSDSIQAKHSTTQIKTVLMDFSGDIDAGVRRIKEAIEGLEVGILINNAGVSYPYAKYFHEVDEELLGNLIKINVEGTTKVTQAVLVNMLKRKRGAIVNMGSGAAALIPSYPFYSVYAGAKTYVDQFSRCLHVEYKKSGIDVQCQVPLYVATKMTKIRRASFLVASPEGYAKAALRFVGYEPRCTPYWPHALMGYVVSALPESVFESFNIKRCLQIRKKGMLKDSSSKKE

SEQ ID NO: 4222 - DNA, 966 bp, Glycine max
  CDS (1)..(963)
atggaatgctgcataatctccaggctcaagacccaacccatatggttcgcgcttctctttattgtgggattgttaacgattctcaaattggcattcgttgttctcagatgggtctacgtcaatttcctcagaccaccgaagaatctcaaaaagtacggatcttgggccgtggttactggacccaccgacggcattggaaagagcttcgccttcgagctcgctcgcaagggcttgaacctcgtccttgtcggaagaaaccccgacaagctcaaagacgtgtcggattccatcgcggcgaggttcggaaaaaccgaggttaagaccgtcgtggttgatttcttcggggatctggacgagggcgtcaagaagatcagcgaagcgattcaagggttggaagttggagtgctcgttaacaatgtgggtgtttcgtacccttacgcgagattcttccatgaagtggacgaggggcttcttaacaaccttattaagcttaacgttgttggaactactaaggtaacgcaagctgttcttcccgggatgctgaagagaaagaagggtgcgattgttaacatgggttctggagctgctattgttattccttcggatcctctttatgctgtttatgctgccaccaaagcgtacatcgatcagttttcgagatgtctctatgttgaatacaagaggagtggaattgacgttcagtgtcaggttccattatatgtggcaaccaagatggcatcaatcaggaaatcttcattctttgttccatcaacagatggctatgccaaagcaggtgtgaaatggataggctatgagcctcgctgcacaccatactggccgcatactcttctttgggccgtggcgtgctcattgcctgagtttgtcgtcgatgcttggcgcctgtggttttgcttgggtattcgaaagaggggacagcgcaaggattccatgaagaaggaataaaag

SEQ ID NO: 4223 - protein, 320 aa, Glycine max
MECCIISRLKTQPIWFALLFIVGLLTILKLAFVVLRWVYVNFLRPPKNLKKYGSWAVVTGPTDGIGKSFAFELARKGLNLVLVGRNPDKLKDVSDSIAARFGKTEVKTVVVDFFGDLDEGVKKISEAIQGLEVGVLVNNVGVSYPYARFFHEVDEGLLNNLIKLNVVGTTKVTQAVLPGMLKRKKGAIVNMGSGAAIVIPSDPLYAVYAATKAYIDQFSRCLYVEYKRSGIDVQCQVPLYVATKMASIRKSSFFVPSTDGYAKAGVKWIGYEPRCTPYWPHTLLWAVACSLPEFVVDAWRLWFCLGIRKRGQRKDSMKKE

SEQ ID NO: 4224 - DNA, 1791 bp, Glycine max
  CDS (162)..(1124)
ttctacttaaatctggtggttttccgctcatctacctcacccacacttctctctctctatcataaattcaatgctctcatcgttttccctcataaaccgctttctcgtgttgtaacacactcatcactcatcatattcattcacacttcccactttccaatatggaatgctgcataatcgccaggctcaagacccaacctttatggttcgcgctgctcttcgttgtcggattgttaacgattctcaaattggctttcgttgttttcagatgggtctacgtcaatttcctccgaccaccgaagaatctcaaaaagtacggatcttgggcagtggttactggacccactgacggcattggaaagagcttcgctttcgagctcgctcgcaagggcctgaacctcgtccttgtcggaaggaaccccgacaagctcaaagacgtgtcggattcgatcgcggcgaagttcagaagaaccgaggttaagaccgtcgtggttgacttctccggggatctggacgagggcgtgaagaagattagcgaagcgattgaagggttggaagttggagtgctcgttaacaatgtgggagtttcgtatccttacgcgaggttcttccacgaagtggacgaagggcttctcaacaaccttattaaggttaacgttgttggaaccactaaggtcacgcaagctgttctgcccgggatgctgaagagaaagaagggtgcgattgttaacatgggttctggagctgctattgttattccttcggatcctctttatgctgtttatgctgccaccaaagcgtacatcgatcagttttcgagatgtctctatgttgaatacaagaggagtggaattgacgttcagtgtcaggttccattatatgtggcaaccaagatggcatcaatcaggaaatcttcattctttgttccatcaacagatggctatgccaaagcaggtgtgaaatggataggctatgagcctcgctgcacaccatactggccgcatactcttctttgggccgtggcgtgctcattgcctgagtttgtcgtcgatgcttggcgcctgtggttttgcttgggtattcgaaagaggggacagcgcaaggattccatgaagaaggaataaaaggatgcttggttctgctgtgtaggcaaatagatgctctactcatctcatacatatgcagattgttagctgattaaggattccaagttcctgctgcgttcctgattttcatcatactgttgttactcttttgtgctagtatcagttgtgtggcatattctttttactcacccgttttgggtgtttctgttcactgttttagtagtgtgttgaactgatatgatatattggcatatcgcttaacctggttttctctggtgtcattccttccttttctcttattctgagcttttgggaagcctttgtgcttcaagtgaaaactgagccaggaaattaaactggaataaatgattgatcacattttgaattaaaaaaaaaaaaaaaaaaaaaaaaaaaaaaaaaaaaaaaaaaaaaaaaaaaaaaaaaaaaaaaaaaaaaaaaaaaaaaaaaaaaacctcggggggggccccggcccccatttcccccttttggggggggttatacccccccctccttgcccgtggtttaccatcgtggggacgggaaaaccctgggggttccccacttaattcgcttggcaccaaatccccttttccccagttgggtaaaaaccaaaagggcccgcccggtccgcctttccaaaaatttgcccaccttgatgggcaat

SEQ ID NO: 4225 - protein, 320 aa, Glycine max
MECCIIARLKTQPLWFALLFVVGLLTILKLAFVVFRWVYVNFLRPPKNLKKYGSWAVVTGPTDGIGKSFAFELARKGLNLVLVGRNPDKLKDVSDSIAAKFRRTEVKTVVVDFSGDLDEGVKKISEAIEGLEVGVLVNNVGVSYPYARFFHEVDEGLLNNLIKVNVVGTTKVTQAVLPGMLKRKKGAIVNMGSGAAIVIPSDPLYAVYAATKAYIDQFSRCLYVEYKRSGIDVQCQVPLYVATKMASIRKSSFFVPSTDGYAKAGVKWIGYEPRCTPYWPHTLLWAVACSLPEFVVDAWRLWFCLGIRKRGQRKDSMKKE

SEQ ID NO: 4226 - DNA, 1475 bp, Glycine max
  CDS (162)..(1124)
  misc_feature (1454)..(1454): n is a, g, c or t
  misc_feature (1455)..(1455): n is a, g, c or t
  misc_feature (1456)..(1456): n is a, g, c or t
  misc_feature (1457)..(1457): n is a, g, c or t
  misc_feature (1458)..(1458): n is a, g, c or t
  misc_feature (1459)..(1459): n is a, g, c or t
  misc_feature (1460)..(1460): n is a, g, c or t
  misc_feature (1461)..(1461): n is a, g, c or t
  misc_feature (1462)..(1462): n is a, g, c or t
  misc_feature (1463)..(1463): n is a, g, c or t
ttctacttaaatctggtggttttccgctcatctacctcacccacacttctctctctctatcataaattcaatgctctcatcgttttccctcataaaccgctttctcgtgttgtaacacactcatcactcatcatattcattcacacttcccactttccaatatggaatgctgcataatcgccaggctcaagacccaacctttatggttcgcgctgctcttcgttgtcggattgttaacgattctcaaattggctttcgttgttttcagatgggtctacgtcaatttcctccgaccaccgaagaatctcaaaaagtacggatcttgggcagtggttactggacccactgacggcattggaaagagcttcgctttcgagctcgctcgcaagggcctgaacctcgtccttgtcggaaggaaccccgacaagctcaaagacgtgtcggattcgatcgcggcgaagttcagaagaaccgaggttaagaccgtcgtggttgacttctccggggatctggacgagggcgtgaagaagattagcgaagcgattgaagggttggaagttggagtgctcgttaacaatgtgggagtttcgtatccttacgcgaggttcttccacgaagtggacgaggggcttctcaacaaccttattaaggttaacgttgttggaaccactaaggtcacgcaagctgttctgccagggatgctcaggagaaagaagggggcgattgttaacattggttctggagctgctattgttattccttctgatcctctttatgctgtttatgctgccaccaaagcgtacatcgatcagttttcgagatgtctctatgttgaatacaagaggagtggaattgacgttcagtgtcaggttccattatatgtggcaaccaagatggcatcaatcaggaaatcttcattctttgttccatcaacagatggctatgccaaagcaggtgtgaaatggataggctatgagcctcgctgcacaccatactggccgcatactcttctttgggccgtggcgtgctcattgcctgagtttgtcgtcgatgcttggcgcctgtggttttgcttgggtattcgaaagaggggacagcgcaaggattccatgaagaaggaataaaaggatgcttggttctgctgtgtaggcaaatagatgctctactcatctcatacatatgcagattgttagctgattaaggattccaagttcctgctgcgttcctgattttcatcatactgttgttactcttttgtgctagtatcagttgtgtggcatattctttttactcacccgttttgggtgtttctgttcactgttttagtagtgtgttgaactgatatgatatattggcatatcgcttaacctggttttctctggtgtcattccttccttttctcttattctgagcttttgggaagcctttgtgcttcaagtgaaaaaaaaaaaaannnnnnnnnnaaaaaaaaaaaa

SEQ ID NO: 4227 - protein, 320 aa, Glycine max
MECCIIARLKTQPLWFALLFVVGLLTILKLAFVVFRWVYVNFLRPPKNLKKYGSWAVVTGPTDGIGKSFAFELARKGLNLVLVGRNPDKLKDVSDSIAAKFRRTEVKTVVVDFSGDLDEGVKKISEAIEGLEVGVLVNNVGVSYPYARFFHEVDEGLLNNLIKVNVVGTTKVTQAVLPGMLRRKKGAIVNIGSGAAIVIPSDPLYAVYAATKAYIDQFSRCLYVEYKRSGIDVQCQVPLYVATKMASIRKSSFFVPSTDGYAKAGVKWIGYEPRCTPYWPHTLLWAVACSLPEFVVDAWRLWFCLGIRKRGQRKDSMKKE

SEQ ID NO: 4228 - DNA, 25 bp, Artificial sequence
  primer
atgacttttatgcaacagcttcaag

SEQ ID NO: 4229 - DNA, 25 bp, Artificial sequence
  primer
ctattcctttttaacctgtcttgcg

SEQ ID NO: 4230 - protein, 367 aa, Artificial sequence
  consensus sequence
  Variant (2)..(18): Xaa in position 2 to 18 is any amino acid
  Variant (19)..(19): Xaa in position 19 is any or no amino acid
  Variant (21)..(30): Xaa in position 21 to 30 is any amino acid
  Variant (31)..(34): Xaa in position 31 to 34 is any or no amino acid
  Variant (36)..(36): Xaa in position 36 is any amino acid
  Variant (39)..(40): Xaa in position 39 to 40 is any amino acid
  Variant (43)..(44): Xaa in position 43 to 44 is any amino acid
  Variant (49)..(51): Xaa in position 49 to 51 is any amino acid
  Variant (53)..(55): Xaa in position 53 to 55 is any amino acid
  Variant (57)..(58): Xaa in position 57 to 58 is any amino acid
  Variant (60)..(63): Xaa in position 60 to 63 is any amino acid
  Variant (65)..(66): Xaa in position 65 to 66 is any amino acid
  Variant (68)..(70): Xaa in position 68 to 70 is any amino acid
  Variant (73)..(92): Xaa in position 73 to 92 is any amino acid
  Variant (93)..(95): Xaa in position 93 to 95 is any or no amino acid
  Variant (97)..(112): Xaa in position 97 to 112 is any amino acid
  Variant (113)..(123): Xaa in position 113 to 123 is any or no amino acid
  Variant (125)..(125): Xaa in position 125 is any amino acid
  Variant (126)..(126): Xaa in position 126 is any or no amino acid
  Variant (128)..(129): Xaa in position 128 to 129 is any amino acid
  Variant (131)..(131): Xaa in position 131 is any amino acid
  Variant (134)..(134): Xaa in position 134 is any amino acid
  Variant (136)..(143): Xaa in position 136 to 143 is any amino acid
  Variant (145)..(157): Xaa in position 145 to 157 is any amino acid
  Variant (158)..(158): Xaa in position 158 is any or no amino acid
  Variant (160)..(166): Xaa in position 160 to 166 is any amino acid
  Variant (168)..(171): Xaa in position 168 to 171 is any amino acid
  Variant (173)..(173): Xaa in position 173 is any amino acid
  Variant (175)..(179): Xaa in position 175 to 179 is any amino acid
  Variant (180)..(193): Xaa in position 180 to 193 is any or no amino acid
  Variant (195)..(195): Xaa in position 195 is any amino acid
  Variant (197)..(199): Xaa in position 197 to 199 is any amino acid
  Variant (202)..(208): Xaa in position 202 to 208 is any amino acid
  Variant (209)..(210): Xaa in position 209 to 210 is any or no amino acid
  Variant (212)..(215): Xaa in position 212 to 215 is any amino acid
  Variant (217)..(219): Xaa in position 217 to 219 is any amino acid
  Variant (221)..(226): Xaa in position 221 to 226 is any amino acid
  Variant (227)..(244): Xaa in position 227 to 244 is any or no amino acid
  Variant (246)..(247): Xaa in position 246 to 247 is any amino acid
  Variant (249)..(250): Xaa in position 249 to 250 is any amino acid
  Variant (252)..(255): Xaa in position 252 to 255 is any amino acid
  Variant (260)..(266): Xaa in position 260 to 266 is any amino acid
  Variant (267)..(278): Xaa in position 267 to 278 is any or no amino acid
  Variant (280)..(282): Xaa in position 280 to 282 is any amino acid
  Variant (284)..(288): Xaa in position 284 to 288 is any amino acid
  Variant (289)..(293): Xaa in position 289 to 293 is any or no amino acid
  Variant (295)..(297): Xaa in position 295 to 297 is any amino acid
  Variant (299)..(311): Xaa in position 299 to 311 is any amino acid
  Variant (312)..(312): Xaa in position 312 is any or no amino acid
  Variant (314)..(319): Xaa in position 314 to 319 is any amino acid
  Variant (320)..(326): Xaa in position 320 to 326 is any or no amino acid
  Variant (329)..(330): Xaa in position 329 to 330 is any amino acid
  Variant (332)..(352): Xaa in position 332 to 352 is any amino acid
  Variant (353)..(360): Xaa in position 353 to 360 is any or no amino acid
  Variant (362)..(366): Xaa in position 362 to 366 is any amino acid
GXXXXXXXXXXXXXXXXXXFXXXXXXXXXXXXXXGXWAXXTGXXDGIGXXXAXXXAXXGXXXXLXXRXXXKLXXXXXXXXXXXXXXXXXXXXXXXDXXXXXXXXXXXXXXXXXXXXXXXXXXXLXXVXXLXNNXGXXXXXXXXFXXXXXXXXXXXXXXNXXXXXXXTXXXXPXMXXXXXXXXXXXXXXXXXXXGXIXXXGSXXXXXXXXXPXXXXYXXXKXXXXXXXXXXXXXXXXXXXXXXXXSXXLXXEXXXXGIDVXXXXXXXXXXXXXXXXXXXVXXXMXXXXXXXXXXSXXXPXXXXXXXXXXXXXXGXXXXXXXXXXXXXPYXXHXXXXXXXXXXXXXXXXXXXXXXXXXXXXXRXXXXXK

SEQ ID NO: 4231 - protein, 31 aa, Artificial sequence
  protein pattern
  Variant (2)..(3): Xaa in position 2 to 3 is any amino acid
  Variant (6)..(6): Xaa in position 6 is Ile or Leu
  Variant (8)..(8): Xaa in position 8 is Lys or Arg
  Variant (9)..(9): Xaa in position 9 is Ala, Glu or Ser
  Variant (10)..(10): Xaa in position 10 is any amino acid
  Variant (12)..(12): Xaa in position 12 is any amino acid
  Variant (13)..(13): Xaa in position 13 is Glu, Gln or Arg
  Variant (14)..(14): Xaa in position 14 is Phe, Ile, Leu or Met
  Variant (16)..(17): Xaa in position 16 to 17 is any amino acid
  Variant (19)..(20): Xaa in position 19 to 20 is any amino acid
  Variant (21)..(22): Xaa in position 21 to 22 is Ile, Leu or Val
  Variant (24)..(24): Xaa in position 24 is Ile or Val
  Variant (25)..(25): Xaa in position 25 is Ala, Gly or Ser
  Variant (27)..(27): Xaa in position 27 is Asn, Ser or Thr
  Variant (28)..(29): Xaa in position 28 to 29 is any amino acid
GXXDGXGXXXAXXXAXXGXXXXLXXRXXXKL

SEQ ID NO: 4232 - protein, 26 aa, Artificial sequence
  protein pattern
  Variant (2)..(4): Xaa in position 2 to 4 is any or no amino acid
  Variant (6)..(6): Xaa in position 6 is Ala or Ser
  Variant (7)..(7): Xaa in position 7 is Phe or Tyr
  Variant (8)..(8): Xaa in position 8 is Ile, Leu or Val
  Variant (9)..(9): Xaa in position 9 is Ala, Asp, Gln or Ser
  Variant (10)..(11): Xaa in position 10 to 11 is any amino acid
  Variant (13)..(13): Xaa in position 13 is any amino acid
  Variant (14)..(14): Xaa in position 14 is Ala, Cys or Ser
  Variant (15)..(17): Xaa in position 15 to 17 is any amino acid
  Variant (19)..(23): Xaa in position 19 to 23 is any amino acid
  Variant (24)..(24): Xaa in position 24 is Ile or Val
  Variant (25)..(25): Xaa in position 25 is Asp or Thr
  Variant (26)..(26): Xaa in position 26 is Ile or Val
YXXXKXXXXXXSXXXXXEXXXXXXXX

SEQ ID NO: 4233 - protein, 26 aa, Artificial sequence
  protein pattern
  Variant (2)..(2): Xaa in position 2 is Asp, Glu or Pro
  Variant (3)..(3): Xaa in position 3 is Ile or Val
  Variant (4)..(4): Xaa in position 4 is Ala, Gly, Ser or Thr
  Variant (5)..(5): Xaa in position 5 is Ile, Leu or Val
  Variant (7)..(7): Xaa in position 7 is Ile or Val
  Variant (9)..(9): Xaa in position 9 is Gly, Asn or Ser
  Variant (10)..(10): Xaa in position 10 is Ala or Val
  Variant (12)..(14): Xaa in position 12 to 14 is any amino acid
  Variant (15)..(16): Xaa in position 15 to 16 is any or no amino acid
  Variant (18)..(19): Xaa in position 18 to 19 is any amino acid
  Variant (20)..(21): Xaa in position 20 to 21 is any or no amino acid
  Variant (23)..(24): Xaa in position 23 to 24 is any amino acid
  Variant (25)..(25): Xaa in position 25 is Thr or Val
  Variant (26)..(26): Xaa in position 26 is Asp, Glu, Pro, Ser or Thr
LXXXXLXNXXGXXXXXPXXXXFXXXX

SEQ ID NO: 4234 - protein, 20 aa, Artificial sequence
  protein pattern
  Variant (2)..(4): Xaa in position 2 to 4 is any amino acid
  Variant (5)..(5): Xaa in position 5 is any or no amino acid
  Variant (7)..(7): Xaa in position 7 is Asp, Gly, Asn, Ser or Thr
  Variant (8)..(8): Xaa in position 8 is Ala, Pro or Thr
  Variant (9)..(11): Xaa in position 9 to 11 is any amino acid
  Variant (12)..(12): Xaa in position 12 is Ala, Ser or Val
  Variant (13)..(13): Xaa in position 13 is any amino acid
  Variant (14)..(14): Xaa in position 14 is Ala, Ser or Thr
  Variant (15)..(15): Xaa in position 15 is Ala, Cys, Gly, Thr or Val
  Variant (16)..(18): Xaa in position 16 to 18 is any amino acid
  Variant (19)..(19): Xaa in position 19 is Ala, Ile or Val
SXXXXPXXXXXXXXXXXXXG

SEQ ID NO: 4235 - DNA, 1347 bp, Saccharomyces cerevisiae
  CDS (1)..(1347)
atgttgcgacttttttcactggcacttatcacatgcttaatctactattccaaaaatcagggcccatctgctcttgttgcggccgtgggatttggtatagcaggctatttagctacagatatgttgattccacgtgtgggcaaatccttcatcaaaataggcctattcggtaaggacttgagtaaacctggccgtccggtgcttccagaaacaataggtgctatccctgctgcagtttatttatttgtaatgttcatttacattcccttcattttctacaagtatatggtcataaccacttcaggtgggggccatcgcgatgtctcagtggttgaagataacggtatgaattctaatatttttcctcatgataaactatctgaatatttgagcgctatcctatgcttggaaagtacggtcctcttgggtatcgctgatgatttatttgatttacgttggagacataagtttttcttgcctgccattgcagccatcccactgctaatggtttattatgtggattttggagttacgcatgtacttattcccggattcatggaacgctggttgaaaaagactagtgttgatttggggctgtggtattatgtttatatggcatcgatggcaattttttgccccaactccatcaacatcctggcaggtgttaatggtttagaggttggccaatgtatagtgttggccatcttagcgctattgaacgatttgctgtacttctcgatggggccattagccacaagagactcccataggttttccgctgttttgattatcccatttttgggtgtatccttggcgctatggaaatggaatcgttggcccgccacagtgtttgtgggagatacatattgttatttcgctggaatggtattcgcagtcgttggtatactgggtcatttttcaaagacgatgcttttgctattcattcctcaaatcgttaattttatttattcatgtcctcagctattcaaattggtcccctgcccgagacataggttacctaaatttaatgaaaaagacggtttaatgtatccatcaagagcaaacttaaaagaagaaccgccaaagagcatttttaaaccgatcttgaagttactatactgtctccatttgattgacctggaatttgatgaaaataatgagattattagcacctctaatatgacgttaataaacttgacattagtatggtttggccctatgagggaagacaaattgtgcaatacaatcttgaagttgcaattctgcattggaattttggctttacttggaagacacgctataggcgctatcatctttggccacgacaacctatggacagtacgttga

SEQ ID NO: 4236 - protein, 448 aa, Saccharomyces cerevisiae
MLRLFSLALITCLIYYSKNQGPSALVAAVGFGIAGYLATDMLIPRVGKSFIKIGLFGKDLSKPGRPVLPETIGAIPAAVYLFVMFIYIPFIFYKYMVITTSGGGHRDVSVVEDNGMNSNIFPHDKLSEYLSAILCLESTVLLGIADDLFDLRWRHKFFLPAIAAIPLLMVYYVDFGVTHVLIPGFMERWLKKTSVDLGLWYYVYMASMAIFCPNSINILAGVNGLEVGQCIVLAILALLNDLLYFSMGPLATRDSHRFSAVLIIPFLGVSLALWKWNRWPATVFVGDTYCYFAGMVFAVVGILGHFSKTMLLLFIPQIVNFIYSCPQLFKLVPCPRHRLPKFNEKDGLMYPSRANLKEEPPKSIFKPILKLLYCLHLIDLEFDENNEIISTSNMTLINLTLVWFGPMREDKLCNTILKLQFCIGILALLGRHAIGAIIFGHDNLWTVR

SEQ ID NO: 4237 - DNA, 1389 bp, Magnaporthe grisea 70-15
  CDS (1)..(1389)
atggcggtcggcagtgagctttcgacaacagagaccttcagcctgctctcgctatctgcagcatgtgttgcaatcctcgcaaatacattccagggtgatggcgagccgctcgtggcttctctcgccctgagtggcctcgctttcgctgcgagcttctccatgatccgctggctgggacctaccttcctcaaagccggtatcaagggcgcggatctgagcaaagttcaaaggagagagatacccgagtgtatgggcgctgtttgcgccatcgtgtacctgttgatgatcattgtcttcattccattcccgttctataaggatattgtggcggcaacaagcggaggcggcaaccgtgatgtcgtgctgcacactgagcatgtccaagagggtcggtttcttcatcggttccctcacaacaagctcgcatcttttctgtctgcggttatatcactgcagtcgatcacacttctgggcatcggtgacgacctctttgatataagatggaggcacaagttcttcatcccggcgtttgcagccatcccactcctggtcgtctactttgtcgatttcggcgtcacctcagtcgtggtccccatccctctgcagccgtaccttggcgaactgttacacctggggcccctttactacatttacatgaccgccatcgccatcttcagtcccaacagcatcaacatcttcgccggtatcaatggcatcgaagtctcgcagtccctggtgatagctctcctcatcatcctaaacgattgcctctacctatctacgtcgtacccccatccagcgaccgacagccacctcttctccctctacttcctactcccctttgtcggcgtcagcctcgccctgctgtaccacaactggtatccggcccgcgtattcgtcggtgacacgtactgttacttcgccggcatggtctttgtcgttgtgagcatactcggccacttcagcaagacccttatcctgctgctggttccgcaaatcttcaattttgtctactcagcaccccagatctttggcctggtcccgtgcccccgccaccgcatgccgcgcttccatgcccgcaccggccttatggagccctcggtaacgccctggacccccgaacgccagcctcgcgccccaatcgccgtcgccctgaggctgattgctcgcttccgtctcatacgactgacagaggatgccgacggccgcttcgtcgagacgaccaacatgaccattatcaacttgtggctggtctggcgcggacccctgacggagcgtcgccttgccactgaattgaccgtcgttcaggctgtcgccggccttttcggcctgtttgtccggcaccgtctcgccctggtcgtctttaaggaagataactggagtctctga

SEQ ID NO: 4238 - protein, 462 aa, Magnaporthe grisea 70-15
MAVGSELSTTETFSLLSLSAACVAILANTFQGDGEPLVASLALSGLAFAASFSMIRWLGPTFLKAGIKGADLSKVQRREIPECMGAVCAIVYLLMIIVFIPFPFYKDIVAATSGGGNRDVVLHTEHVQEGRFLHRFPHNKLASFLSAVISLQSITLLGIGDDLFDIRWRHKFFIPAFAAIPLLVVYFVDFGVTSVVVPIPLQPYLGELLHLGPLYYIYMTAIAIFSPNSINIFAGINGIEVSQSLVIALLIILNDCLYLSTSYPHPATDSHLFSLYFLLPFVGVSLALLYHNWYPARVFVGDTYCYFAGMVFVVVSILGHFSKTLILLLVPQIFNFVYSAPQIFGLVPCPRHRMPRFHARTGLMEPSVTPWTPERQPRAPIAVALRLIARFRLIRLTEDADGRFVETTNMTIINLWLVWRGPLTERRLATELTVVQAVAGLFGLFVRHRLALVVFKEDNWSL

SEQ ID NO: 4239 - DNA, 1404 bp, Gibberella zeae PH-1
  CDS (1)..(1404)
atggctgtcactgcgacaacatcgctctctcgcacagagatccttactctctcaaccatctcgggcgcatcgtgcgctgttctcgcaaacactctccatggcgatggtgagcctctcatcgcatcaatagccctgtcttttcttggcttctcgctatgcttcgccatgatccgctggctaggtcctacctttatgcgcgccggctttcgcggtcgcgatatgggcaaactgcagcgcactgagattccggaatgcatgggcgccgtgtgcgcagctgtttatctgctcagcctcatcgtcttcatccccttccctttctacaaggacattgtcgcagctactagtggtggcggaaaccgtgatgtcgtggttgagcttgagcaggtcagccaggggcgtttcctgcacaagtttcctcacaacaagcttgcctcttttctgagcgccatcatctctcttcagacaattgccttcttgggtatcggtgatgatctctttgatattcgctggcgacacaagtggtggattcctggtattgcctcgatcccccttctggttgtctactttgtcgatttcgacgtcacatccattgttttgcctctccaactccagccttatcttggtgagctattcgatctgggcgcactttactacgtttacatggcctgtgttgccatgttctgcccccaaagcatcaacatgcttgctggcatcaacggtatcgaggtttcgcagtgcgtcgtcgtcgccctcctcctcgccttcaacgattgcctgtacctcttcacgccttacccgcatcctgcgactgattctcacttgttctcgctctactttcttctcccatggatcggcgtctcgtgcgccttgctctgccacaactggtaccccgccaaggtctttgtcggtgacacctactgttacttctcaggcatggtcttcgctgttgtcggtattctcggccatttctcaaagacgcttgggctccttctggttccccaaatattcaacttcctttactcatgccctcaggtcttcggtcttattccctgcccgcgccaccgacttcctcacttcaacgctcggagcggcctccttgagccctcagtgactccttggtctgcggaacgacagccgcatcccctggttgcacatggcctgcatatcctcagccagctgcgactcgtcaaggtgacagtcgacaaaaacggtcagttcgtcgagacgagtaacctcaccatccttaacctgtggctcgtttggcgtggaccccttcgtgaggatcggctagctctcgaagtgactatgctccaacttgttgttggtctctttggtctgtttgtgagacaccgtttagcactactggtctttaaggaagacaactgggggactattgcgcagtga

SEQ ID NO: 4240 - protein, 467 aa, Gibberella zeae PH-1
MAVTATTSLSRTEILTLSTISGASCAVLANTLHGDGEPLIASIALSFLGFSLCFAMIRWLGPTFMRAGFRGRDMGKLQRTEIPECMGAVCAAVYLLSLIVFIPFPFYKDIVAATSGGGNRDVVVELEQVSQGRFLHKFPHNKLASFLSAIISLQTIAFLGIGDDLFDIRWRHKWWIPGIASIPLLVVYFVDFDVTSIVLPLQLQPYLGELFDLGALYYVYMACVAMFCPQSINMLAGINGIEVSQCVVVALLLAFNDCLYLFTPYPHPATDSHLFSLYFLLPWIGVSCALLCHNWYPAKVFVGDTYCYFSGMVFAVVGILGHFSKTLGLLLVPQIFNFLYSCPQVFGLIPCPRHRLPHFNARSGLLEPSVTPWSAERQPHPLVAHGLHILSQLRLVKVTVDKNGQFVETSNLTILNLWLVWRGPLREDRLALEVTMLQLVVGLFGLFVRHRLALLVFKEDNWGTIAQ

SEQ ID NO: 4241 - DNA, 1344 bp, Candida glabrata CBS 138
  CDS (1)..(1344)
atgggttcgcagaaggtgctgttcgttgcggcactagggttgctgtacctgtcgagccaatactcccccattctatccgctgtggcttttgcaattatagggttcgtgtgcacaaatgcgcttattccgcgggtcggggactcgtttatcaagattggtctgttcggtaaggatatgagcaagcccggtaagcctgtgataccggagaccattggttcagtggcagctgtcgtgtacctgtttgtgatgatgttctttattccgttcattttctaccgttacatggttattggcacatccggtggtggtcacagagacgtggcaagggaagagaccgcacgggagtccttcttcccacataacaagttgtcagagtacttgagtgcgatattgtgcctcgagtcccaagttatgctgggtgtggctgatgacctctttgacttgcgttggagacataagtttttcctccctgcagtggcagctatccctttgctgattgtttactacgtcgattttggcgtcacttacgttctagtaccacagttcttacagaaatacgtgcatttcaccagcatagacctgggagccctgtattatatctacatgagcgcgatgggcatcttctgtccaaactcaataaacatcctggcgggtattaacgggttggaagtgggccaatgtattgtgctggccatactgacactattgaacgatgcaatttacctaactgtaggagcagaggcatctaaggaagctcacagattttctacagtactaattttgccgttcttaggtgtatcactagcactatatagatggaacaagtggcctgctaaagtatttgtgggtgacacttactgctatttcgcaggtatggtatttgcagtggtcggtatactagggcacttctcaaagaccatgttgctgttgttcctaccacagatcgttaatttcctatactcatgtccacagttgttcaacatagttttctgtccaagacatagactacccagattcaacgaaagtgatggcctactatacccatcaagagcggacttgaaagaaaacccaccaaagggttttttcgttccagtgctgaggttattacatgtcctacatctcatagatttggaatttgacaaggacaacaatatcgttagttgctcaaatatgacgatgattaatttgttactagtttggtttggcccactaagagaagataaactttgtaacagaattcttattatccaattcatgttcggactatgtgcattaacggccaggcatgctgttggaacactgctgttcggcaatgacaacttatccagcattcgtttacaataa

SEQ ID NO: 4242 - protein, 447 aa, Candida glabrata CBS 138
MGSQKVLFVAALGLLYLSSQYSPILSAVAFAIIGFVCTNALIPRVGDSFIKIGLFGKDMSKPGKPVIPETIGSVAAVVYLFVMMFFIPFIFYRYMVIGTSGGGHRDVAREETARESFFPHNKLSEYLSAILCLESQVMLGVADDLFDLRWRHKFFLPAVAAIPLLIVYYVDFGVTYVLVPQFLQKYVHFTSIDLGALYYIYMSAMGIFCPNSINILAGINGLEVGQCIVLAILTLLNDAIYLTVGAEASKEAHRFSTVLILPFLGVSLALYRWNKWPAKVFVGDTYCYFAGMVFAVVGILGHFSKTMLLLFLPQIVNFLYSCPQLFNIVFCPRHRLPRFNESDGLLYPSRADLKENPPKGFFVPVLRLLHVLHLIDLEFDKDNNIVSCSNMTMINLLLVWFGPLREDKLCNRILIIQFMFGLCALTARHAVGTLLFGNDNLSSIRLQ

SEQ ID NO: 4243 - DNA, 1344 bp, Kluyveromyces lactis NRRL Y-1140
  CDS (1)..(1344)
atgctttcttattttttgctactgtttgctattgcaataattgtatattttaaagatgtatctcctatcggatctgcagtagggttttctgtaattggctacgtggcagttgatgtattgatcccacaagtaggtgattccttcatcaagattggtttatttggcaaagatatgagtaaacctggtaggccagtgattccagaaacaattggatctgtatctgctacagtgtatttgtttatcatgttcttttcgattcctttcatgttttacaaatatttggtgataacctctggaggtggaaatagagatctggtttctcaagaatcgacggaggaacagctattcccacatagtaagttaagtgaatttttaagtgcacttttatgtcttgaatccacgatattactaggtgctgctgacgatttgtttgatcttcgctggagacataaattcttcctaccagcaattgctgcgattccattacttgtagtctactatgttgattttagcgttacccatgttttgatccctaagtttgtacaagagttaattggtacaagcaagacatccattgatttaggcgctttctattactgctatatggcttcggtcgccattttctgtccaaattcaattaatatattggctggtgtcaatggacttgaagttgggcagagcattgtcctaggcctaatatttatgattaatgatgtgttgtatttaactatgggtgtgaacggacatgctcgtgaatcacacctattctcacttttattgatcgtcccattcctcggagtctcactagcattgttcaaatggaaccgctggcctgcaaaagtatttgtcggtgatacttactgttacttcgctggtatggttttcgctgtagtcggtattcttggacacttctcgaagactacgttactattctttctaccacaaatcttcaatttcatctattcagctccacaaatattcggattggtgccttgcccaaggcatagactaccgaaatttaacgagagtgattggctaatgtacacatcacgagcagatcttataaaagaaaaaccgaagccagtaatgcaaccgatattgagacttttgcacaaattgcgattaatcgatttgaacatcgatcccaaaacaaatacaattttagattgcagtaatatgacgttaatcaatttaatgattgtgtggtttgggcctatgagggaagataagctatgttactctatactcgcgctgcaattcattattggaatatctgcgatatgtctaagacatttaattggatcactattattcgggaacgataatttatggaacatcgtttag

SEQ ID NO: 4244 - protein, 447 aa, Kluyveromyces lactis NRRL Y-1140
MLSYFLLLFAIAIIVYFKDVSPIGSAVGFSVIGYVAVDVLIPQVGDSFIKIGLFGKDMSKPGRPVIPETIGSVSATVYLFIMFFSIPFMFYKYLVITSGGGNRDLVSQESTEEQLFPHSKLSEFLSALLCLESTILLGAADDLFDLRWRHKFFLPAIAAIPLLVVYYVDFSVTHVLIPKFVQELIGTSKTSIDLGAFYYCYMASVAIFCPNSINILAGVNGLEVGQSIVLGLIFMINDVLYLTMGVNGHARESHLFSLLLIVPFLGVSLALFKWNRWPAKVFVGDTYCYFAGMVFAVVGILGHFSKTTLLFFLPQIFNFIYSAPQIFGLVPCPRHRLPKFNESDWLMYTSRADLIKEKPKPVMQPILRLLHKLRLIDLNIDPKTNTILDCSNMTLINLMIVWFGPMREDKLCYSILALQFIIGISAICLRHLIGSLLFGNDNLWNIV

SEQ ID NO: 4245 - DNA, 1482 bp, Debaryomyces hansenii CBS767
  CDS (1)..(1482)
atgtctctcggtcgaataattaaggtgtcattattggtactttctatcgcatgtatcgctccaaataaaccattacaaacgctgtttgcatttgcttgcattgggtacgttataacagcatcgttgataccgaagctcatggacagcttcattagaataggtctcaagggtaaggatctttccaaagcacctcctgtgaaggaaattgctgagtctatgggggttgtatgtgctgtgacatacttgttcctcatgttttggttgattccgtttgttttcttcaaatacttggtgagtttcacgtcaatgtcagacgatgcagatatgtccaataactacaaggaccagtatctggcgctttcgaataaccgtttgtttccacataacaaattggccgaatacttgagtgccgtattgtgcttacaaagtacaactctcttggggttgtttgatgacttgtttgatatcagatggcgccacaagttctttcttccggcagttgcatcgatgccgttgttgatcgtctactatgttgacttcagtgtgacgtctattgttgttccgagctttgtcaccaccaaattgcctggaggcgagttcttgcttgaatcgttgaacactctaattcagacaggcaataatattgtcacctatgttactgggttatctttccgtacgttagacaataactacgtattgcctacgggatcccccaaattacttgatttaggggttttctactatgtctacatgtcagcgatttcgatcttttcgccaaactcaatcaatattcttgctggtatcaacggccttgaagtagggcagtccattgttcttgcagtcatttttcttattaatgatttttgctatcttttctctcctgatatatcggccgcagcatatgactcccatttattttcggccattttcctcattccttttgtcggtacatctttggcattgttccaattcaattggtttcctgcaagggtatttgtaggggatacttattgttatttcagtggcatggtttttgcaatcgttggtatcttgggtcatttttccaaaacgttgttgatattcttgttaccgcagatcattaacttcgtgtactctgctccccaaatattgggagttgttccctgcccacgtcacagaatgccccgattcaacatcgacgacggtctcatgtaccctagctttggagagttgaagtcgctctcaaaacttcagaattgttttttgtcagtgctagaaactttcaagctcataaaagtagaacgcactacaaaggttacaaggttttccaacatgacaatcatcaacttgtgtcttgtatggtttggtcctttgagagaggataaattatgcattttgctcatgatacttcagtttttaattggacttctcatgatttttgttagacacaccttgggcccttggttattgggctttgataacttaacctggggcgttaaatag

SEQ ID NO: 4246 - protein, 493 aa, Debaryomyces hansenii CBS767
MSLGRIIKVSLLVLSIACIAPNKPLQTLFAFACIGYVITASLIPKLMDSFIRIGLKGKDLSKAPPVKEIAESMGVVCAVTYLFLMFWLIPFVFFKYLVSFTSMSDDADMSNNYKDQYLALSNNRLFPHNKLAEYLSAVLCLQSTTLLGLFDDLFDIRWRHKFFLPAVASMPLLIVYYVDFSVTSIVVPSFVTTKLPGGEFLLESLNTLIQTGNNIVTYVTGLSFRTLDNNYVLPTGSPKLLDLGVFYYVYMSAISIFSPNSINILAGINGLEVGQSIVLAVIFLINDFCYLFSPDISAAAYDSHLFSAIFLIPFVGTSLALFQFNWFPARVFVGDTYCYFSGMVFAIVGILGHFSKTLLIFLLPQIINFVYSAPQILGVVPCPRHRMPRFNIDDGLMYPSFGELKSLSKLQNCFLSVLETFKLIKVERTTKVTRFSNMTIINLCLVWFGPLREDKLCILLMILQFLIGLLMIFVRHTLGPWLLGFDNLTWGVK

SEQ ID NO: 4247 - DNA, 1347 bp, Yarrowia lipolytica CLIB122
  CDS (1)..(1347)
atgtactcgtcgatatggacggtactggccatcttggctctttcggccagtctgattttcaatcccgcggaccagcctcttttgtcgtcagtcggtttctccctcatcgcctatctggtcacctacaacctgattcctgcacttggaccagccttcatcaaggtcggcttctcgggtcgagacctgtccaagaaagaccggcctgagattcccgagaccatgggagccgtatgtgccattgtctacctgttttgtatgtttctgttcattccttttgtgttctaccagtacctggccaaaaccatcggaggtggcgtggttgtgggttacgacagcttgagcgagggactggtcaagggacgaattctcagtgcgttccctcacgaaaaactcgccgagtacctttctgccatcctgtgtctgcagtccatgttcatcctgggtgttgcagatgatctcttcgatatcagatggcgaaacaagttcttcttacctgccattgctgccatcccgctgctcatagtttactacgtggactttggaattacagccgtcatggttcccgtggttttgagaccttactttggagacatagtggacctcggggctctttactacatgtacatggcggccgtggccatcttctgccctaactccatcaacatttacgctggcgtgaacggcttggaagttggccaatcggttatgattggcgtgtgcatcttgctgaacgatttcatctacctcgttcagcccaaccaccccgctgaagaatctcatctcttcagtgtctatctgctgctgccgttcctggctgtcagtatcgctcttttgagacacaactggtgccctgcaaaatgttttgttggagacacctactgctacttcgccggcatggtctttgcggttgttggtattctcggccacttctccaagaccctcctgctgttctttgtgccccagatcttcaacttcttgtactctgtgcctcagctgttcaagattgtcgactgtcctcgacatagactgcctaaattcaaccccgagacaggtcttttggagccttcccggacctactttgacaaaaagaagcctggtaagcttggccaaataatgatctacgtgctggagaagctacacctgctgaaagtgtggagagacgagaagggagttgtcatcagcatctccaacatgacactgatcaacctggttttggtctatgttggacccctgcgagaggatcaccttgccgctgtgcttctgggtatccagtttgcttccggtctggctgctattgcgctaagacattcagttgcagctatgatctttggtagggacaacatttaa

SEQ ID NO: 4248 - protein, 448 aa, Yarrowia lipolytica CLIB122
MYSSIWTVLAILALSASLIFNPADQPLLSSVGFSLIAYLVTYNLIPALGPAFIKVGFSGRDLSKKDRPEIPETMGAVCAIVYLFCMFLFIPFVFYQYLAKTIGGGVVVGYDSLSEGLVKGRILSAFPHEKLAEYLSAILCLQSMFILGVADDLFDIRWRNKFFLPAIAAIPLLIVYYVDFGITAVMVPVVLRPYFGDIVDLGALYYMYMAAVAIFCPNSINIYAGVNGLEVGQSVMIGVCILLNDFIYLVQPNHPAEESHLFSVYLLLPFLAVSIALLRHNWCPAKCFVGDTYCYFAGMVFAVVGILGHFSKTLLLFFVPQIFNFLYSVPQLFKIVDCPRHRLPKFNPETGLLEPSRTYFDKKKPGKLGQIMIYVLEKLHLLKVWRDEKGVVISISNMTLINLVLVYVGPLREDHLAAVLLGIQFASGLAAIALRHSVAAMIFGRDNI

SEQ ID NO: 4249 - DNA, 1227 bp, Aspergillus nidulans FGSC A4
  CDS (1)..(1227)
atggctgttgctgcatcaaattccctctcccgtcaagagacctggagtctcttgttcctcgcaggcgcctgtctcggcgtgctggtcaatacgtttgagggagagggtgcccccttggtgtcatccattgcattcagtggaatctcattcgctgtgaccttcacaatgataagatggcttggccctgtctttattcgagccggcttgagcgggaaagacatggccaaaccaaaccgtccagttataccggaaactatgggcgccgtctgtgcggtagtgtatctcctggtactcatcttcttcattccttttgctttctacaaggacatcgtggcagccacttcgggcggcggcaaccgcgatgtcgtccttgaagttcaccatgtggaaacgggccgtagtctgcacagatttcctcatgagaagcttgcatcgtacctttccggtctcttgtcactccaatgcattgtcattcttgggatcggcgatgatcttcttgacatccggtggagacacaaagtactaatcccagctttcggtgccatcccaatgcttatggtctactttgtggactttggtgttacgcatgtcgttgtcccagtgccgttgcggccgtacctcggcgccttccttgaccttggcctcttgtactacgtctacatggccgcagttgctatcttctgcccaaactcgatcaacatgctagcgggaatcaacggggtcgaggttgctcaatcgcttgtgattgctgtcttacttatgatcaacgatgcgctgtatctgattacaccgtcccggcaccctgcaacggattcccaccttttctctctctattttctactaccgttcgtgggagtctcgttagcactactgtgccacaactggtatccgtccaaaatattcaattttgtttactcagtgccgcagctttttcacatcatcccctgccctaggcacaggctccccaagttcaacgcaaagactggattggtggacgcttcggtgactgaatggaatgttcctccttcgcccttgctcgccatggctctagagctactgcacagcctccgcctggcgagggtccgaaaaaatgaacaaggccagattgtcgaatcaagcaatctgaccattctcaacttgtggctggtatggatgggccccatgagggaagatcggctggcgttgagcatggtagctgttcaagctgagaaccctagctacctctaa

SEQ ID NO: 4250 - protein, 408 aa, Aspergillus nidulans FGSC A4
MAVAASNSLSRQETWSLLFLAGACLGVLVNTFEGEGAPLVSSIAFSGISFAVTFTMIRWLGPVFIRAGLSGKDMAKPNRPVIPETMGAVCAVVYLLVLIFFIPFAFYKDIVAATSGGGNRDVVLEVHHVETGRSLHRFPHEKLASYLSGLLSLQCIVILGIGDDLLDIRWRHKVLIPAFGAIPMLMVYFVDFGVTHVVVPVPLRPYLGAFLDLGLLYYVYMAAVAIFCPNSINMLAGINGVEVAQSLVIAVLLMINDALYLITPSRHPATDSHLFSLYFLLPFVGVSLALLCHNWYPSKIFNFVYSVPQLFHIIPCPRHRLPKFNAKTGLVDASVTEWNVPPSPLLAMALELLHSLRLARVRKNEQGQIVESSNLTILNLWLVWMGPMREDRLALSMVAVQAENPSYL

SEQ ID NO: 4251 - DNA, 1485 bp, Candida albicans SC5314
  CDS (1)..(1485): transl_table=12
atgctagcaaggcttttgaaacttgcaatagtagttgcagcaatagcggcaatcacacccaataacccaatacgtacactgatttcatttgggtgtataggttacgtggcaaccttactggtaataccgaaagttagcccaagttttgtcaagatcgggctcaaagggaaagatttatctaaaccaccaccggtgtcagaaatacccgaaacaatggggctagtggcgtcaactacatatatgtttcttatgtttggtcttatcccatttatttttttcaaataccttgtttcttttggatcaatgtctaacgacgaggtgataactaaaaattacttgtctcaatatcaatcgcttgccgacaacaggttattcccccacaataagttggcagaatacttgagtgccttgttgtgtttacagagtaccacattgttgggattactagacgacttgtttgatatcaggtggcgtcacaagtttttcttacctgcagttgcatcattgcccttattgattgtatactacgtcgactttagtgtaacttcagtcgtgatccccaagtttgtcactgaattccctggaggctacgttctaattaatactataaatttttttataaagtatagtaaccatttggtcacaagtatcactgggctttcatttagaactttacaaacagactatgttgttcctgacagttcaccaaagttgattgatttgggaattttctactacgtatacatgtcggctatttcaattttctcaccgaattcaatcaatattcttgcaggcgttaacggtttggaggttggacaatcattagttttagcagccatatttttaattaatgatttctgctatcttttttcaccgggaatatcacaagcagctcatgattcacacatgttttctgttgtatttataattccttttgtcggagtgtcattggctttattgcaatacaactggttccctgcaagagtatttgttggtgatacgtattgttatttcagtggcatggtatttgctattgttggtattataggtcatttttccaaaactcttttgatatttttgttacctcaaataatcaattttgtgtattcagttcctcagttgtttcacatcttgccctgtccaagacacagattacccagatttagtattgaggatggtttgatgcatcccagttttgcagaattaaagaaagcaagccgtctaaacttggcgattttagaaactctcagttttttcaagctcataaaagtggaaaggggttccaaactgaatcagattgttagattttccaatatgaccataatcaatcttacgttggtgtgggtaggacctttacgagaagaccaattatgtatatctattttggtcgttcaatttgttattggcgtgacaatgatagttgttagacataccattggaccatggttatttggatacgataatttatcatggggtgtaaaataa

SEQ ID NO: 4252 - protein, 494 aa, Candida albicans SC5314
MLARLLKLAIVVAAIAAITPNNPIRTSISFGCIGYVATLSVIPKVSPSFVKIGLKGKDLSKPPPVSEIPETMGLVASTTYMFLMFGLIPFIFFKYLVSFGSMSNDEVITKNYLSQYQSLADNRLFPHNKLAEYLSALLCLQSTTLLGLLDDLFDIRWRHKFFLPAVASLPLLIVYYVDFSVTSVVIPKFVTEFPGGYVLINTINFFIKYSNHLVTSITGLSFRTLQTDYVVPDSSPKLIDLGIFYYVYMSAISIFSPNSINILAGVNGLEVGQSLVLAAIFLINDFCYLFSPGISQAAHDSHMFSVVFIIPFVGVSLALLQYNWFPARVFVGDTYCYFSGMVFAIVGIIGHFSKTLLIFLLPQIINFVYSVPQLFHILPCPRHRLPRFSIEDGLMHPSFAELKKASRLNLAILETLSFFKLIKVERGSKSNQIVRFSNMTIINLTLVWVGPLREDQLCISILVVQFVIGVTMIVVRHTIGPWLFGYDNLSWGVK

SEQ ID NO: 4253 - DNA, 1398 bp, Aspergillus oryzae
  CDS (1)..(1398)
atgaattcgagctctctttctcgcaaggagacctggcgtctcttgatgctagtgggtatctgcgccggcatccttctcaacactttccaggatgaaggcgcgcctttggtagcatccattgcctttactgggattgtgtttgcagttgcatacagcctaatcaaatggctggggccggttttcatgaaggcagggttaaagggaagagatatggcgaaaccaaagagacctgaaatcccagagacaatgggcgcagtttgcgcagtcgtgtatcttctggcgcttatcttctttattccctttgctttttacaaagatatcgtggcagccacttcaggtggaggtaaccgagatgtcgttcttgaagttcatcacgttgaaactggtcggatgctccaccgatttcctcacggaaggcttgcatcttacctctctggactcctttccctgcaatgtattgtcatcttgggattgggtgatgaccttcttgacattcgatggagacacaaagttctcataccagcttttggagcaattccaatgcttatagtttactttgtggactttggtgtcacacaggttgtcgttccggtgcccttgcagccctacttgggcgcatttgtcgacctcggatggctgtattacgtatacatggctgcggtggctatcttctgccccaactccatcaacatgttggcagggattaatggagttgaggtagctcaatctctggtgatcgcaatcttgctcatagcaaatgatgcgctgtatcttgcgccgatcacgccgtatccccaccccgccactgattcgcatctcttctccctttatttcttgcttccgtttgttggagtgtcgctggccctgttgttgcacaactggtacccctccaaagtgtttgtcggggatacctactgttatttcgcggggatggtattcgccgtcgttggtattctggggcatttcagtaagacgttacttctgcttttcataccgcagatattcaatttcctgtattcgaccccgcaacttttcaagttgattccttgtcctcggcacagattacccaagttcaatgctttgactggacagcttgacgcttccgtaacggagtggacagtaccaccttcgccactaatcgccgctggcctggagctccttcatcagctgcgattggtgcgtgttacgaagaatgatcatggtcaaattgtggagtcgactaacttgacgatactcaatctgtggctggtgtggatgggcccaatgaaagagaatcggctggcttggaatatggtcgcagttcaagtcgtttgtggactttttggtttatttgtgcggcatcgactagcattgctagtattccgggaagataaccgggcatcttggtaccaattatag

SEQ ID NO: 4254 - protein, 465 aa, Aspergillus oryzae
MNSSSLSRKETWRLLMLVGICAGILLNTFQDEGAPLVASIAFTGIVFAVAYSLIKWLGPVFMKAGLKGRDMAKPKRPEIPETMGAVCAVVYLLALIFFIPFAFYKDIVAATSGGGNRDVVLEVHHVETGRMLHRFPHGRLASYLSGLLSLQCIVILGLGDDLLDIRWRHKVLIPAFGAIPMLIVYFVDFGVTQVVVPVPLQPYLGAFVDLGWLYYVYMAAVAIFCPNSINMLAGINGVEVAQSLVIAILLIANDALYLAPITPYPHPATDSHLFSLYFLLPFVGVSLALLLHNWYPSKVFVGDTYCYFAGMVFAVVGILGHFSKTLLLLFIPQIFNFLYSTPQLFKLIPCPRHRLPKFNALTGQLDASVTEWTVPPSPLIAAGLELLHQLRLVRVTKNDHGQIVESTNLTILNLWLVWMGPMKENRLAWNMVAVQVVCGLFGLFVRHRLALLVFREDNRASWYQL

SEQ ID NO: 4255 - DNA, 1413 bp, Neurospora crassa
  CDS (1)..(1413)
atgacgggacaccacacaaattatcataactcgaccacttgcctctcgcaggccgagagcctttccctcctcgccctctccgccgcttgtgtcgccgtcctcgccaacaccttccagggtgatggctacccactcatcgcctcgctcgcgcttggcgggctggcattcagcgcgaccttctccatgatccgatggctgggaccaaccttcatgagggccggcctgaaaggcgtggatatgagcaaacaccataaaaaggagctgccagaatgcatgggcgcgatcgcagccatggtgtacttgctggctgttattgtctttattccgtttccgttctacaaggatattgtggcggccacgagcggaggtggaaaccgcgatgtggtgatgcatgttgagcatgtacaggaagggaggtttctacatcggtttccgcatggaaagctcgcctcctacctctctgccgtcatggccctccaatccatctccctcctcggcatcggcgacgacctcttcgacatccgctggcgccacaaattcttcatccccgccttcgcctccatccctctcttggtcgtctactttgtcgactttggcgtcacctctgtcgtaatcccgacccccttacagccttacctaggcgagctcttcaacctcggcgccttatactacgtctacatggcctcggttgccattttcagtcccaacagcatcaacatcctggcaggaatcaacggcatcgaagtcacccaatccatcgtcatcgccctgttgctcgctttcaacgattgcctctaccttttgacgccgtatccgcacccggctacggactcccacttgttctcgctttatttcctcgtcccctttttgggtgtgtcttttgctctgctctggcataactggtaccccgcccgcgtcttcgttggcgacacgtactgctatttcgcgggcatggttttcgtggtggtcagcatcttgggacacttcagcaagacgttgattttacttttgattccgcagatcttcaactttgtttattccgtgccgcaactctttggtcttgtaccctgcccacgtcaccgtctaccgcggtttaacgcgcgcacgggactgttggagccgagcgtgacgccctggacgccagagaggcagcccaagccgccggtggcgtgggcgctgaagacgcttgataaggtgaaactgttgagggtgacgctggatgaggaggggaggttcgtggagacgagtaactttacgatcttgaacttgtggctggtctggagaggcccgttgcgggaggaccggttggcaatggagatcacggggatgcaggtagtggtgggactgtttgggttgtttgtgaggcatcggttggcgttgattctgtttaagcaggacaatttgggggtttga

SEQ ID NO: 4256 - protein, 470 aa, Neurospora crassa
MTGHHTNYHNSTTCLSQAESLSLLALSAACVAVLANTFQGDGYPLIASLALGGLAFSATFSMIRWLGPTFMRAGLKGVDMSKHHKKELPECMGAIAAMVYLLAVIVFIPFPFYKDIVAATSGGGNRDVVMHVEHVQEGRFLHRFPHGKLASYLSAVMALQSISLLGIGDDLFDIRWRHKFFIPAFASIPLLVVYFVDFGVTSVVIPTPLQPYLGELFNLGALYYVYMASVAIFSPNSINILAGINGIEVTQSIVIALLLAFNDCLYLLTPYPHPATDSHLFSLYFLVPFLGVSFALLWHNWYPARVFVGDTYCYFAGMVFVVVSILGHFSKTLILLLIPQIFNFVYSVPQLFGLVPCPRHRLPRFNARTGLLEPSVTPWTPERQPKPPVAWALKTLDKVKLLRVTLDEEGRFVETSNFTILNLWLVWRGPLREDRLAMEITGMQVVVGLFGLFVRHRLALILFKQDNLGV

SEQ ID NO: 4257 - DNA, 1407 bp, Aspergillus niger
  CDS (1)..(1407)
atggcagcagcaaattcaagctctctttctcgccaggagacctggcggctcttcgccttggtgggagcctgcgtcggcatccttctgaataccttccaaggcgatggtgcgcccttggtagcttcgctcgcgtttagcggtatcgcattcgcagtcacgtttagtatgatcagatggcttgtaccggtgttcttgaaggcaggcctgaaaggacgcgatatggcgaaacccaggagacccgaaataccggaaacaatgggagccgtttgcgctattgtctatctccttgctctgatcttctttatcccctttgctttctacaaggatatagtggctgccacctcaggtggaggcaaccgagatgtcgtaattgaggtagaacacgttgagactggccggatgctacaccggtttcctcacgggaagcttgcgtcctatctctccggtcttctttcactgcaatgtattgtcattctcggaattggcgacgacctacttgatatacgatggagacacaaagtcctgattcccgcctttggagctattccaatgcttatagtgtactttgtggactttggtgtgacgcaagtcgtcgtgccagtaccgctgcagccctatctgggctccactatcgacctcggctggttgtactatgcctacatggcggctgtggccatcttctgccctaactccatcaacatgctggctggaatcaacggagttgaagtggcccagtctttggtgatagcggttctgctgatagcaaacgacgttttatatttggcccccattacgccatacccgcatccggcaacagactctcatctgttctctctatacttcttgttgccttttgttggagtatccgtggcccttttgtgccataactggtacccatcgaaagtctttgtgggagatacatattgctactttgcgggcatggtgtttgccgtcgttggcatcttgggccacttcagcaagacgctcctgctgctcttcatcccgcagatcttcaacttcttatattcaacgccacaactttttaacttgatcccttgcccgcgtcatcggttgcccaaattcaattccgtcactggtctgttggatgcatcggtgaccgaatggaccgtgccaccatcaccactggtggctactgctctcaatcttctgcacacattacggctgatgcgagtcaccaagaacgaacagggccagattgtggagtctacaaatctcaccatcctcaacctgtggctcgtatgggctgggccgatgaaggagaaccaactagcgtggagcatggtggctgttcagacattttgcggccttgctggcctgtttgtgaggcaccgcctagcactgctggtattccgagaagataacctggccttggggggttccgtatag

SEQ ID NO: 4258 - protein, 468 aa, Aspergillus niger
MAAANSSSLSRQETWRLFALVGACVGILLNTFQGDGAPLVASLAFSGIAFAVTFSMIRWLVPVFLKAGLKGRDMAKPRRPEIPETMGAVCAIVYLLALIFFIPFAFYKDIVAATSGGGNRDVVIEVEHVETGRMLHRFPHGKLASYLSGLLSLQCIVILGIGDDLLDIRWRHKVLIPAFGAIPMLIVYFVDFGVTQVVVPVPLQPYLGSTIDLGWLYYAYMAAVAIFCPNSINMLAGINGVEVAQSLVIAVLLIANDVLYLAPITPYPHPATDSHLFSLYFLLPFVGVSVALLCHNWYPSKVFVGDTYCYFAGMVFAVVGILGHFSKTLLLLFIPQIFNFLYSTPQLFNLIPCPRHRLPKFNSVTGLLDASVTEWTVPPSPLVATALNLLHTLRLMRVTKNEQGQIVESTNLTILNLWLVWAGPMKENQLAWSMVAVQTFCGLAGLFVRHRLALLVFREDNLALGGSV

SEQ ID NO: 4259 - DNA, 1341 bp, Schizosaccharomyces pombe
  CDS (1)..(1341)
atgatagagtcctgttttaatgtgggaatatgggctacaggtttggctttgttgatgaaccaaggtcaatctccgctactttctaatgttggtctctctgtcttagcatacaaagctacagcaatgttcattcctagagtaggaccctcctttattaaacgaggcttttcggggaaggacatgaataaagtagagaaatatgtaatacctgaaacaatgggagcagtttctgcattggtatattttatgtgtatgattatatttataccggtactattttataagtacttggtacctaatcataacccgaatcttccatccgatggatctgtcgccgaggttgccaaatcccagtttccacatgatcttttgggcgcttatttgtctgccctcctttcaattctgtcggtttctttacttggaattcttgatgatttattcgatattcgatggaggcataaattctttttaccagcaattgccgctatcccattgttggttgtttactacgttgactatggagttacttatgtgtccgttcctagcattgtaagaccatttttaaagagatctcttatcaacttgggttttctttattacttttatatggctgcggttgcgattttttgtccaaacagtattaacattattgctggagtaaatggtgttgaggcaggccaatcgcttgttcttgctcttgttattgcttgcaatgatttgttttatgtactctctcccaaaaataaggatgcattaagagctcatctcctttccctttatctagtcttgcctcttataggtgtcactgctgggcttctaaaatacaattggtggccttcgcgagtgtttgtaggtgatacgttttgctattttgcaggaatggtaatggcagttgttggaattttaggtcatttctctaagacacttatgctcttttttatccctcaaattttcaattttgcgctttccgttccacagctttttggattggttgaatgtccccgtcatcgacttcctaaactaaatgtgaaaactggattgttggaaaactcctacacagaattctctctaaacgagcatcctttacctaaaaagactttgctgactatttctatttttgaaaaattacgattgattcgggttgagtacgatcctagcaccgggcgcccgctcaggtgtacgaactttacaattattaattttgttttgtatcatctgggcccaatgagggaagaccatttaacaatatgtataatgggattgcaattacttaccggaatattcggtttaattatcaggcattttgtcgctcctttagtgtatcctgaagataacatataa

SEQ ID NO: 4260 - protein, 446 aa, Schizosaccharomyces pombe
MIESCFNVGIWATGLALLMNQGQSPLLSNVGLSVLAYKATAMFIPRVGPSFIKRGFSGKDMNKVEKYVIPETMGAVSALVYFMCMIIFIPVLFYKYLVPNHNPNLPSDGSVAEVAKSQFPHDLLGAYLSALLSILSVSLLGILDDLFDIRWRHKFFLPAIAAIPLLVVYYVDYGVTYVSVPSIVRPFLKRSLINLGFLYYFYMAAVAIFCPNSINIIAGVNGVEAGQSLVLALVIACNDLFYVLSPKNKDALRAHLLSLYLVLPLIGVTAGLLKYNWWPSRVFVGDTFCYFAGMVMAVVGILGHFSKTLMLFFIPQIFNFALSVPQLFGLVECPRHRLPKLNVKTGLLENSYTEFSLNEHPLPKKTLLTISIFEKLRLIRVEYDPSTGRPLRCTNFTIINFVLYHLGPMREDHLTICIMGLQLLTGIFGLIIRHFVAPLVYPEDNI

SEQ ID NO: 4261 - DNA, 1296 bp, Arabidopsis thaliana
  CDS (1)..(1296)
atggcagctcgtaagagagcttcatcgatctcaattcccaacaaaccggacccgtcggaacccaactcagcgccatcggagcagaagatgacccgaaagacggtttctgcttccggtgaggaatttcgtctcgcgccgccgaaattaggagtgatcttcgtgatctctactcttctctgttcgctctatctataccttctctgttttcactacaaggttgataatgagctcaagcgatcgattctaattaacgcggggcttagcttggttgggtttttcgtcactctcaaaatgattcctgttactgccagatacgttctgagacgtaacatgtttggttttgatatcaacaaaagaggcacgcctcaaggagatattaaagtgccagagtcattgggtattgttgttggtattgtctttttgatcgtggcgataatatttcagtattttaacttcactgaagattctaattggcttgtggagtataatgcagcactagcatctatttgcttcatgattttgcttggatttgtagatgatgtccttgatgtgccttggagagtaaagcttgtcctgccatcttttgctacccttccacttttgatggcttatgctggtcatacaactattgttataccaaaacctcttgttgcttatattggcttggaagtgcttaatctaggaaggatatataagttatatatggggctacttgctgtcttttgtacaaactctattaacatccacgctggtctgaatggccttgaaatcggtcaaacagttgttattgccgctgctatcctgatacacaacgttatgcaaatcggagcatctgttgatcccgagtatcaccaagctcatgccttctcgatatttcttactcaaccgctgatggccacatccttggcaatgcttgcttacaattggtatccttcttcagtttttgttggagacacttacacagtcttcgccggaatgactatggcagttgttggtattctgggtcacttcagtgaaaccctcctcatcttctttcttcctcaagttctgaactttctattatcgcttcctcagcttgctgggattgtgaaatgtccgcgccatcgtctcccaaggtatgatcctgctaccggattactgaccggcacaaaagatgggacactcgtcaatgtttacttgaggttgtttggtcctaaatcagaaaagtctctttgcatccatcttctcgttttccaggctctagcctgcgccttctgcttcatacttcgacactttcttgctggttggtataaatag

SEQ ID NO: 4262 - protein, 431 aa, Arabidopsis thaliana
MAARKRASSISIPNKPDPSEPNSAPSEQKMTRKTVSASGEEFRLAPPKLGVIFVISTLLCSLYLYLLCFHYKVDNELKRSILINAGLSLVGFFVTLKMIPVTARYVLRRNMFGFDINKRGTPQGDIKVPESLGIVVGIVFLIVAIIFQYFNFTEDSNWLVEYNAALASICFMILLGFVDDVLDVPWRVKLVLPSFATLPLLMAYAGHTTIVIPKPLVAYIGLEVLNLGRIYKLYMGLLAVFCTNSINIHAGLNGLEIGQTVVIAAAILIHNVMQIGASVDPEYHQAHAFSIFLTQPLMATSLAMLAYNWYPSSVFVGDTYTVFAGMTMAVVGILGHFSETLLIFFLPQVLNFLLSLPQLAGIVKCPRHRLPRYDPATGLLTGTKDGTLVNVYLRLFGPKSEKSLCIHLLVFQALACAFCFILRHFLAGWYK

SEQ ID NO: 4263 - DNA, 1281 bp, Arabidopsis thaliana
  CDS (1)..(1281)
atgactgctcgtaagagaactccttcagtgtccaattcggagaaactagctctacctgaacctgcatcttccccgacggttcagaagacctctgtttccggagaggatttccagctcgcgccgccgaaattgggcgtgattttcgtgatctcttcgcttctgtgttcgctttatctttaccttctctgtttccactacaatgttgacaatgagctcaagcgtccgatcctcattaacgctgggcttagcttggttggattctttgtcacactcaagttgattcctgtagctgctagatacgttctgaggcgtaatatgtttggttttgatatcaacaaaagaggcactcctcaaggagaagttagagtgcctgagtcattgggaattgttgtcggtattgtcttcttgatagtggcgattgtatttcagttctttaatttcactgaagattcggtgtggcttgtggagtataatgcagcactggcgtctatttgcttcatgatattgcttggatttgtagatgacgtccttgatgtgccttggagagtgaaacttctcttgccatcttttgcaacccttccactgttgatggcttatgctggacatacaactatcgtcataccgaaacctttagtttcttatattggcttggaagtgtttgatctaggacgtatatataagttatatatggcgctactggctgtcttttgcacaaattctattaacattcacgctggtttgaatggccttgaaatcggtcaaaccgtagttattgcagctgctattctgatacacaacgttatgcaaatcggagcatctgttgatactgagtatcatcaagctcatgccttctcaatctatcttactcagccattgatggcaacatccttggcaatgcttgcctacaattggtacccttctgcagtttttgttggagacacttacacagtctttgctggaatgactatggcagttgttggcattctcggtcacttcagtgaaaccctgttaatcttttttcttcctcaagtgttgaactttttactgtcacttccgcagcttgctggcattgtcaaatgtccacgacatcgtctccccaagtatgatcctgctacgggactgttaacaggaacaaaagatgggacactcgtgaacgtctacttgaggatttttggtaggaaaacagaaaagtctctatgtattcatcttcttgttttccaggctcttgcttgcgcattttgtttcatgcttaggcattttctagctggttggtacaaataa

SEQ ID NO: 4264 - protein, 426 aa, Arabidopsis thaliana
MTARKRTPSVSNSEKLALPEPASSPTVQKTSVSGEDFQLAPPKLGVIFVISSLLCSLYLYLLCFHYNVDNELKRPILINAGLSLVGFFVTLKLIPVAARYVLRRNMFGFDINKRGTPQGEVRVPESLGIVVGIVFLIVAIVFQFFNFTEDSVWLVEYNAALASICFMILLGFVDDVLDVPWRVKLLLPSFATLPLLMAYAGHTTIVIPKPLVSYIGLEVFDLGRIYKLYMALLAVFCTNSINIHAGLNGLEIGQTVVIAAAILIHNVMQIGASVDTEYHQAHAFSIYLTQPLMATSLAMLAYNWYPSAVFVGDTYTVFAGMTMAVVGILGHFSETLLIFFLPQVLNFLLSLPQLAGIVKCPRHRLPKYDPATGLLTGTKDGTLVNVYLRIFGRKTEKSLCIHLLVFQALACAFCFMLRHFLAGWYK

SEQ ID NO: 4265 - DNA, 1293 bp, Oryza sativa
  CDS (1)..(1293)
atggacgcccgccgcaggcccgcggcgacggcggcggcggcggcggcggcacccgctgatgcgcagccgcgggcgaggccggctgctgcggtggcggcggcggaggccgcggatgctgagctggtgctccgggcgccgaacctgcgcgtggtcgccgcggcgatggtggccttcctcgcgcccttctcgtaccttgcgttcgtgcactacccgctggacgcggcgctgcggcgatccatcctcatctgcggggccatgagcttcggcggcttcgtcgtcgtgctccgcctcgtccccgtcgccgcacgctacctcctccgtcgcgggatgtgggggaaggacatcaacaagcgcggcttgcccatgggcgagatcagagtgcctgaggcacttggcattgttgttgggattgtctacttggtcattgctattctatttcaacatttcaacttcacagcagactctatgtggcttgttgaatacaacgcggcactagcatcagtctgctttatggtgcttcttggatttattgatgatgttcttgatgttccatggagagtgaaacttctactacccacaattgcagcacttcctttgctgatggcatatgctggtggtacttccgtcagcattccaaagcctctaacatcttatgttggagtagctgttctggagctaggttctctgtacaagctctttatgctcctattagcagtcttttgtacaaattcgatcaatatacatgctggcctgaatggtcttgaagttgggcagacagttattatatctgctgcggttttgatacataatgtaatgcgcataggatcttctacggacattgaagcgcaacaagcccatgcattctcgatttatcttgtcctgcctttcttgaccacttcattagctttgctcgcatttaactggtatccttcatctgttttcgttggtgatacctacacctatttttctggaatggcattggctgtggtgggaattttgggtcatttcagcgagacattattgctcttctttttacctgaggttcttaactttctgtgctcagtcccacagctgtttaagtttgttccctgcccaaggcacaggttgccaaggtttgatccccacacaggactgttgacgggtaccaaagatggtaacttggtaaacatattccttaggatatttggaagatgcacagagaggaccctttgcataaggctgctcatatttcaggcgttgtcatgcctattctgcttttggctgaggtacatgattactggatggtacaaatga

SEQ ID NO: 4266 - protein, 430 aa, Oryza sativa
MDARRRPAATAAAAAAAPADAQPRARPAAAVAAAEAADAELVLRAPNLRVVAAAMVAFLAPFSYLAFVHYPLDAALRRSILICGAMSFGGFVVVLRLVPVAARYLLRRGMWGKDINKRGLPMGEIRVPEALGIVVGIVYLVIAILFQHFNFTADSMWLVEYNAALASVCFMVLLGFIDDVLDVPWRVKLLLPTIAALPLLMAYAGGTSVSIPKPLTSYVGVAVLELGSLYKLFMLLLAVFCTNSINIHAGLNGLEVGQTVIISAAVLIHNVMRIGSSTDIEAQQAHAFSIYLVLPFLTTSLALLAFNWYPSSVFVGDTYTYFSGMALAVVGILGHFSETLLLFFLPEVLNFLCSVPQLFKFVPCPRHRLPRFDPHTGLLTGTKDGNLVNIFLRIFGRCTERTLCIRLLIFQALSCLFCFWLRYMITGWYK

SEQ ID NO: 4267 - DNA, 1269 bp, Zea mays
  CDS (1)..(1269)
atggccgtccgccgcaggcccgcggctgctgctgccggggacctgcctccgcaggcgccaccggcagatgcagcgccgacgccggcgccagacgaactggtcctccggccgccaaacctccacgtggccgctgtggcggcggtgctcttcctcgcgcccttctcttatctctcgttcgtgcgctaccgcttgggcgccgatctgcagcgatccatcttaaaatgcggcgccatgagcctcattgggttctgcgtcgcgctcaagctcatccctgtcgcggccagctaccacctccgccgccggatgttcggctacgacatcaacaagaaaggcttgcccacgggccaaattaaagtgcctgaagcactaggtcttgttgtggggattatctacttggtcattgctattatatttcagcagtttcactatgccccagactccatttggcttgttgaatataatgcagcgttggcatcagtctgttttatgattcttcttggatttgtcgatgatgttcttgatgttccatggagagtgaaactggcattgccaacgtttgcagcactcccattgctaatggcatatgctggtggcacttccatcatcattccaaagcccttaactccttatgttggactaacggttttggagctaggtttattttacaagctattcatgctcttgttagcagtcttttgtacaaactcgataaatatacatgctggtctaaatggacttgaagttgggcagactattgttatatctgctgcggttttgatacataatgtaatgcgcatagcatcttctacagatatcgaaactcagcaagctcatgaattctctatttatcttgtcttgccattcctaaccatttcattagctttgctagcttttaactggtatccctcgattgtttttgttggtgatacctacacctattttgctggaatggctttggctgtgataggaattttgggacatttcagcgagacattattgctcttctttttacctcaagttcttaatttcctatgttcagtcccacagctctttcactttgttccttgcccaagacataggttgccgaggtttgatcctgaaacgggtctgttgactggtaccaaagatggtaatctggtgaacatattccttaggttatttgggaagtgctcggagaaggccctttgcataaggctccttatttttcaggctctatgttgcgtattctgcttctggctaagatacatgctcaccggatggtacaaatga

SEQ ID NO: 4268 - protein, 422 aa, Zea mays
MAVRRRPAAAAAGDLPPQAPPADAAPTPAPDELVLRPPNLHVAAVAAVLFLAPFSYLSFVRYRLGADLQRSILKCGAMSLIGFCVALKLIPVAASYHLRRRMFGYDINKKGLPTGQIKVPEALGLVVGIIYLVIAIIFQQFHYAPDSIWLVEYNAALASVCFMILLGFVDDVLDVPWRVKLALPTFAALPLLMAYAGGTSIIIPKPLTPYVGLTVLELGLFYKLFMLLLAVFCTNSINIHAGLNGLEVGQTIVISAAVLIHNVMRIASSTDIETQQAHEFSIYLVLPFLTISLALLAFNWYPSIVFVGDTYTYFAGMALAVIGILGHFSETLLLFFLPQVLNFLCSVPQLFHFVPCPRHRLPRFDPETGLLTGTKDGNLVNIFLRLFGKCSEKALCIRLLIFQALCCVFCFWLRYMLTGWYK

SEQ ID NO: 4269 - DNA, 1522 bp, Brassica napus
  CDS (59)..(1327)
cgattcccgtgctttagcgaaaagtctgagagacgaaggaggagccaacggatccgccatgactgctcgtaagagaacttcttcggtgactaatccggagaatccgccgcctgcgacgaaggagcataaacccaccgtcgcttccggcgaagatttccggctagcaccgccgaaactgagagtgatcttcgtgatctcttcgctcctctgctcgctctacctctacctactctgtttccactacaatgtcgataacgagctcaagcgtccgatcctcatcaacgccgcgcttagcttggtgggtttcttcgtcacgctcaagatgatccccgtagctgctagatacgttctgaggcgtaacatgttcggtttcgatatcaataaaagaggcacgcctcagggagaggttaaagtgcctgagtcgttgggtattgtcgttggtgttgtgttcttgatcgtggcgattatatttcagtacttcaatttcactgaagattcgaattggcttgtggagtataatgcagcactagcatctatctgcttcatgattttgcttgggtttgtagatgatgttcttgatgttccttggagagtgaaacttgtgttgccgtcttttgctactcttccactgttgatggcttatgctggacatacaacaattgttataccgaaacctctagttgcttatgttggcttggaagtgcttgatctaggaaggatatataagttatatatggggttacttgccgtcttttgcacaaactctataaacattcacgctggtctgaacggccttgagatcgagcaaaccgtagctactgcagctgcgatcttgatacacaacgttatgcaaatcggagcatccgtggattctgagcttcgtcaagctcatgccttctccatatacctcactcaaccactgatggcaacatccttggcaatgcttgctttcaactggtacccttctgcagtttttgttggagacacttacacagtctttgccggaatgactatggcagttgttggcattctgggtcacttcagtgaaaccctcctaatattcttccttcctcaagtgctgaactttctgttgtcacttccgcagcttgctggcattgtgaaatgtccacgccatcgtctcccaaagtttgatcctgcaaccggattactaaccggaacaaaagacgggacactcgtcaacgtctacttgaggatgtttggtacgaaatcacaaaagactcttggcatccatcttcttgtcttccaggctctagcgtgtgccttctgtttcttacttcgacactttctagctggctggtacaagtaaacttgcatcccgaagagtcttcggaagatcctgtctctctgttcctgagacaaatcacacatacagaacataacttatgttccttgtacaatctaatattgcaatgtaacttgttttgttaacatgtgtcaagtagtagtatctcagagaaacaaagttcagacaatgtatcataatcctgagtttggataatcc

SEQ ID NO: 4270 - protein, 422 aa, Brassica napus
MTARKRTSSVTNPENPPPATKEHKPTVASGEDFRLAPPKLRVIFVISSLLCSLYLYLLCFHYNVDNELKRPILINAALSLVGFFVTLKMIPVAARYVLRRNMFGFDINKRGTPQGEVKVPESLGIVVGVVFLIVAIIFQYFNFTEDSNWLVEYNAALASICFMILLGFVDDVLDVPWRVKLVLPSFATLPLLMAYAGHTTIVIPKPLVAYVGLEVLDLGRIYKLYMGLLAVFCTNSINIHAGLNGLEIEQTVATAAAILIHNVMQIGASVDSELRQAHAFSIYLTQPLMATSLAMLAFNWYPSAVFVGDTYTVFAGMTMAVVGILGHFSETLLIFFLPQVLNFLLSLPQLAGIVKCPRHRLPKFDPATGLLTGTKDGTLVNVYLRMFGTKSQKTLGIHLLVFQALACAFCFLLRHFLAGWYK

SEQ ID NO: 4271 - DNA, 24 bp, Artificial sequence
  primer
atgttgcgacttttttcactggca

SEQ ID NO: 4272 - DNA, 24 bp, Artificial sequence
  primer
tcaacgtactgtccataggttgtc

SEQ ID NO: 4273 - protein, 445 aa, Artificial sequence
  consensus sequence
  Variant (2)..(14): Xaa in position 2 to 14 is any amino acid
  Variant (16)..(16): Xaa in position 16 is any amino acid
  Variant (18)..(19): Xaa in position 18 to 19 is any amino acid
  Variant (21)..(26): Xaa in position 21 to 26 is any amino acid
  Variant (27)..(30): Xaa in position 27 to 30 is any or no amino acid
  Variant (33)..(34): Xaa in position 33 to 34 is any amino acid
  Variant (36)..(36): Xaa in position 36 is any amino acid
  Variant (38)..(40): Xaa in position 38 to 40 is any amino acid
  Variant (44)..(51): Xaa in position 44 to 51 is any amino acid
  Variant (53)..(53): Xaa in position 53 is any amino acid
  Variant (55)..(60): Xaa in position 55 to 60 is any amino acid
  Variant (61)..(91): Xaa in position 61 to 91 is any or no amino acid
  Variant (93)..(94): Xaa in position 93 to 94 is any amino acid
  Variant (96)..(97): Xaa in position 96 to 97 is any amino acid
  Variant (99)..(107): Xaa in position 99 to 107 is any amino acid
  Variant (110)..(111): Xaa in position 110 to 111 is any amino acid
  Variant (114)..(115): Xaa in position 114 to 115 is any amino acid
  Variant (117)..(118): Xaa in position 117 to 118 is any amino acid
  Variant (121)..(121): Xaa in position 121 is any amino acid
  Variant (123)..(125): Xaa in position 123 to 125 is any amino acid
  Variant (127)..(128): Xaa in position 127 to 128 is any amino acid
  Variant (130)..(131): Xaa in position 130 to 131 is any amino acid
  Variant (135)..(136): Xaa in position 135 to 136 is any amino acid
  Variant (138)..(140): Xaa in position 138 to 140 is any amino acid
  Variant (141)..(143): Xaa in position 141 to 143 is any or no amino acid
  Variant (145)..(148): Xaa in position 145 to 148 is any amino acid
  Variant (150)..(161): Xaa in position 150 to 161 is any amino acid
  Variant (162)..(203): Xaa in position 162 to 203 is any or no amino acid
  Variant (206)..(207): Xaa in position 206 to 207 is any amino acid
  Variant (209)..(210): Xaa in position 209 to 210 is any amino acid
  Variant (213)..(215): Xaa in position 213 to 215 is any amino acid
  Variant (217)..(217): Xaa in position 217 is any amino acid
  Variant (219)..(220): Xaa in position 219 to 220 is any amino acid
  Variant (225)..(226): Xaa in position 225 to 226 is any amino acid
  Variant (229)..(229): Xaa in position 229 is any amino acid
  Variant (232)..(232): Xaa in position 232 is any amino acid
  Variant (234)..(235): Xaa in position 234 to 235 is any amino acid
  Variant (237)..(238): Xaa in position 237 to 238 is any amino acid
  Variant (240)..(262): Xaa in position 240 to 262 is any amino acid
  Variant (263)..(265): Xaa in position 263 to 265 is any or no amino acid
  Variant (267)..(267): Xaa in position 267 is any amino acid
  Variant (270)..(274): Xaa in position 270 to 274 is any amino acid
  Variant (276)..(279): Xaa in position 276 to 279 is any amino acid
  Variant (281)..(281): Xaa in position 281 is any amino acid
  Variant (284)..(286): Xaa in position 284 to 286 is any amino acid
  Variant (289)..(289): Xaa in position 289 is any amino acid
  Variant (291)..(291): Xaa in position 291 is any amino acid
  Variant (292)..(292): Xaa in position 292 is any or no amino acid
  Variant (300)..(301): Xaa in position 300 to 301 is any amino acid
  Variant (303)..(303): Xaa in position 303 is any amino acid
  Variant (306)..(307): Xaa in position 306 to 307 is any amino acid
  Variant (318)..(318): Xaa in position 318 is any amino acid
  Variant (320)..(325): Xaa in position 320 to 325 is any amino acid
  Variant (328)..(329): Xaa in position 328 to 329 is any amino acid
  Variant (332)..(333): Xaa in position 332 to 333 is any amino acid
  Variant (335)..(335): Xaa in position 335 is any amino acid
  Variant (338)..(343): Xaa in position 338 to 343 is any amino acid
  Variant (351)..(351): Xaa in position 351 is any amino acid
  Variant (353)..(356): Xaa in position 353 to 356 is any amino acid
  Variant (359)..(365): Xaa in position 359 to 365 is any amino acid
  Variant (366)..(407): Xaa in position 366 to 407 is any or no amino acid
  Variant (409)..(410): Xaa in position 409 to 410 is any amino acid
  Variant (412)..(413): Xaa in position 412 to 413 is any amino acid
  Variant (415)..(417): Xaa in position 415 to 417 is any amino acid
  Variant (419)..(421): Xaa in position 419 to 421 is any amino acid
  Variant (423)..(424): Xaa in position 423 to 424 is any amino acid
  Variant (426)..(432): Xaa in position 426 to 432 is any amino acid
  Variant (434)..(436): Xaa in position 434 to 436 is any amino acid
  Variant (437)..(443): Xaa in position 437 to 443 is any or no amino acid
IXXXXXXXXXXXXXGXDXXKXXXXXXXXXXPEXXGXVXXXVYLXXXXXXXXFXFXXXXXXXXXXXXXXXXXXXXXXXXXXXXXXXXXXXXXLXXYXXAXXXXXXXXXLGXXDDXXDXXWRXKXXXPXXAXXPLLXXYXXXXXXTXXXXPXXXXXXXXXXXXXXXXXXXXXXXXXXXXXXXXXXXXXXXXXXXXXXXXXXXXXXLGXXYXXYMXXXAXFXXNSINXXAGXNGXEXXQXXVXXXXXXXXXXXXXXXXXXXXXXXXXXHXFSXXXXXPXXXXSXALXXXNWXPXXVFVGDTYXXFXGMXXAVVGILGHFSXTXXXXXXPQXXNFXXSXPQXXXXXXCPRHRLPXFXXXXGLXXXXXXXXXXXXXXXXXXXXXXXXXXXXXXXXXXXXXXXXXXXXXXXXXTXXNXXLXXXGXXXEXXLXXXXXXXQXXXXXXXXXXRH

SEQ ID NO: 4274 - protein, 26 aa, Artificial sequence
  protein pattern
  Variant (2)..(2): Xaa in position 2 is Ile or Val
  Variant (3)..(3): Xaa in position 3 is Phe, Ile, Leu or Val
  Variant (6)..(6): Xaa in position 6 is Ile, Leu or Val
  Variant (7)..(7): Xaa in position 7 is any amino acid
  Variant (9)..(9): Xaa in position 9 is any amino acid
  Variant (12)..(12): Xaa in position 12 is Ile, Leu or Val
  Variant (13)..(14): Xaa in position 13 to 14 is any amino acid
  Variant (15)..(15): Xaa in position 15 is Phe, Ile, Leu or Val
  Variant (16)..(16): Xaa in position 16 is Ile, Leu or Val
  Variant (17)..(17): Xaa in position 17 is any amino acid
  Variant (23)..(23): Xaa in position 23 is Leu or Met
  Variant (25)..(25): Xaa in position 25 is His, Lys or Arg
  Variant (26)..(26): Xaa in position 26 is Phe or Tyr
QXXNFXXSXPQXXXXXXCPRHRXPXX

SEQ ID NO: 4275 - protein, 39 aa, Artificial sequence
  protein pattern
  Variant (2)..(2): Xaa in position 2 is any or no amino acid
  Variant (4)..(5): Xaa in position 4 to 5 is any amino acid
  Variant (6)..(6): Xaa in position 6 is any or no amino acid
  Variant (8)..(8): Xaa in position 8 is any amino acid
  Variant (9)..(9): Xaa in position 9 is Phe, Trp or Tyr
  Variant (11)..(11): Xaa in position 11 is Ala or Ser
  Variant (12)..(12): Xaa in position 12 is any amino acid
  Variant (20)..(20): Xaa in position 20 is Cys or Thr
  Variant (21)..(21): Xaa in position 21 is any amino acid
  Variant (23)..(23): Xaa in position 23 is Ala or Ser
  Variant (26)..(26): Xaa in position 26 is Ala, Thr or Val
  Variant (27)..(27): Xaa in position 27 is Phe, Leu or Met
  Variant (28)..(28): Xaa in position 28 is Ala or Val
  Variant (29)..(30): Xaa in position 29 to 30 is Ile or Val
  Variant (31)..(31): Xaa in position 31 is Gly or Ser
  Variant (33)..(33): Xaa in position 33 is Ile or Leu
  Variant (38)..(38): Xaa in position 38 is Glu or Lys
AXLXXXNXXPXXVFVGDTYXXFXGMXXXXXXIXGHFSXT

SEQ ID NO: 4276 - protein, 56 aa, Artificial sequence
  protein pattern
  Variant (2)..(2): Xaa in position 2 is Ala, Gly, Ser or Val
  Variant (3)..(3): Xaa in position 3 is Ala, Glu or Ser
  Variant (4)..(4): Xaa in position 4 is Phe or Tyr
  Variant (5)..(5): Xaa in position 5 is any amino acid
  Variant (6)..(6): Xaa in position 6 is Ala or Ser
  Variant (8)..(8): Xaa in position 8 is Ile, Leu or Val
  Variant (9)..(9): Xaa in position 9 is any amino acid
  Variant (10)..(10): Xaa in position 10 is Ala, Cys or Ser
  Variant (11)..(11): Xaa in position 11 is Ile, Leu or Val
  Variant (12)..(15): Xaa in position 12 to 15 is any amino acid
  Variant (16)..(16): Xaa in position 16 is Phe, Ile, Leu or Met
  Variant (19)..(20): Xaa in position 19 to 20 is any amino acid
  Variant (23)..(23): Xaa in position 23 is any or no amino acid
  Variant (25)..(25): Xaa in position 25 is any or no amino acid
  Variant (27)..(27): Xaa in position 27 is Ile, Leu or Val
  Variant (28)..(28): Xaa in position 28 is any amino acid
  Variant (31)..(31): Xaa in position 31 is any amino acid
  Variant (33)..(34): Xaa in position 33 to 34 is any amino acid
  Variant (35)..(35): Xaa in position 35 is Ile or Leu
  Variant (37)..(37): Xaa in position 37 is Ala, Gly, Ser or Thr
  Variant (38)..(38): Xaa in position 38 is Phe, Ile or Val
  Variant (40)..(40): Xaa in position 40 is Ala, Ser or Thr
  Variant (41)..(41): Xaa in position 41 is Ile, Leu or Met
  Variant (45)..(45): Xaa in position 45 is Ile, Met or Val
  Variant (46)..(46): Xaa in position 46 is Ala or Val
  Variant (48)..(48): Xaa in position 48 is any amino acid
  Variant (49)..(49): Xaa in position 49 is Gly or Val
  Variant (50)..(51): Xaa in position 50 to 51 is any amino acid
  Variant (52)..(52): Xaa in position 52 is Asp, Gly, Ser or Thr
  Variant (53)..(53): Xaa in position 53 is Ile or Val
  Variant (54)..(55): Xaa in position 54 to 55 is any amino acid
  Variant (56)..(56): Xaa in position 56 is Ile, Pro or Val
LXXXXXAXXXXXXXXXLGXXDDXLXDXXWRXKXXXPXXAXXPLLXXYXXXXXXXXX

SEQ ID NO: 4277 - protein, 51 aa, Artificial sequence
  protein pattern
  Variant (3)..(4): Xaa in position 3 to 4 is any amino acid
  Variant (6)..(7): Xaa in position 6 to 7 is any or no amino acid
  Variant (9)..(10): Xaa in position 9 to 10 is any or no amino acid
  Variant (12)..(12): Xaa in position 12 is Ala, Gly, Ser or Thr
  Variant (13)..(13): Xaa in position 13 is any amino acid
  Variant (14)..(14): Xaa in position 14 is Ile, Leu, Met or Val
  Variant (15)..(15): Xaa in position 15 is Ala, Gly or Ser
  Variant (16)..(16): Xaa in position 16 is Ile or Val
  Variant (18)..(18): Xaa in position 18 is Cys or Ser
  Variant (19)..(19): Xaa in position 19 is Pro or Thr
  Variant (24)..(24): Xaa in position 24 is Ile or Met
  Variant (25)..(25): Xaa in position 25 is any amino acid
  Variant (28)..(28): Xaa in position 28 is Ile, Leu or Val
  Variant (31)..(31): Xaa in position 31 is Ile, Leu or Val
  Variant (33)..(33): Xaa in position 33 is Ala, Ile or Val
  Variant (34)..(34): Xaa in position 34 is Ala, Glu, Gly, Ser or Thr
  Variant (36)..(36): Xaa in position 36 is Cys, Ser or Thr
  Variant (37)..(37): Xaa in position 37 is Ile, Leu or Val
  Variant (38)..(39): Xaa in position 38 to 39 is any amino acid
  Variant (40)..(40): Xaa in position 40 is Ala or Gly
  Variant (41)..(41): Xaa in position 41 is Ala, Ile, Leu or Val
  Variant (42)..(46): Xaa in position 42 to 46 is any amino acid
  Variant (47)..(47): Xaa in position 47 is Asp or Asn
  Variant (48)..(50): Xaa in position 48 to 50 is any amino acid
  Variant (51)..(51): Xaa in position 51 is Phe, Ile, Leu or Val
LGXXYXXYXXMXXXXXFXXNSINXXAGXNGXEXXQXXXXXXXXXXXXXXXX

SEQ ID NO: 4278 - protein, 32 aa, Artificial sequence
  protein pattern
  Variant (2)..(2): Xaa in position 2 is Ile, Leu or Met
  Variant (3)..(3): Xaa in position 3 is Ile, Leu or Val
  Variant (5)..(6): Xaa in position 5 to 6 is any or no amino acid
  Variant (8)..(10): Xaa in position 8 to 10 is any amino acid
  Variant (11)..(12): Xaa in position 11 to 12 is any or no amino acid
  Variant (14)..(16): Xaa in position 14 to 16 is any amino acid
  Variant (18)..(19): Xaa in position 18 to 19 is any amino acid
  Variant (21)..(21): Xaa in position 21 is Ala, Cys or Thr
  Variant (22)..(23): Xaa in position 22 to 23 is any amino acid
  Variant (24)..(24): Xaa in position 24 is Ile, Leu, Met or Val
  Variant (25)..(26): Xaa in position 25 to 26 is any amino acid
  Variant (27)..(27): Xaa in position 27 is Phe, Ile, Leu, Met or Val
  Variant (29)..(31): Xaa in position 29 to 31 is any amino acid
  Variant (32)..(32): Xaa in position 32 is Cys, Gly or Pro
TXXNXXLXXXXXGXXXEXXLXXXXXXXQXXXX

SEQ ID NO: 4279 - protein, 21 aa, Artificial sequence
  protein pattern
  Variant (3)..(3): Xaa in position 3 is Ala, Cys, Ser or Thr
  Variant (4)..(4): Xaa in position 4 is Ile, Leu or Met
  Variant (6)..(6): Xaa in position 6 is any amino acid
  Variant (7)..(10): Xaa in position 7 to 10 is any or no amino acid
  Variant (12)..(12): Xaa in position 12 is any amino acid
  Variant (13)..(13): Xaa in position 13 is Phe, Ile, Leu or Val
  Variant (14)..(14): Xaa in position 14 is Phe, Ile, Leu, Met or Val
  Variant (15)..(15): Xaa in position 15 is any amino acid
  Variant (16)..(16): Xaa in position 16 is Ile, Leu, Met or Val
  Variant (17)..(17): Xaa in position 17 is Phe, Ile, Met or Val
  Variant (18)..(18): Xaa in position 18 is Phe, Ile, Leu or Val
  Variant (19)..(19): Xaa in position 19 is any amino acid
  Variant (21)..(21): Xaa in position 21 is Ile, Leu, Pro or Val
PEXXGXXXXXVXXXXXXXXIX

SEQ ID NO: 4280 - DNA, 321 bp, Saccharomyces cerevisiae
  CDS (1)..(321)
atgtcgaaattgggtccgttagcaagatctgtgaagtggactctctctgtgggagtaatcggttctgttttttacctgtaccgatacagtaacaatggctacttctacgatcacgatgctacatggttgaaacaagatcatcaggtacaggacctggtggatagaaaagaagtggtacctggggagaccaggaaccgcaagctagttgtgacggatgatggcactgcatggagcaggaccatgggggagagcataaaagatatttggaatgaacagataagaaactctgtcgattggatctactcctggggtaagaattag

SEQ ID NO: 4281 - protein, 106 aa, Saccharomyces cerevisiae
MSKLGPLARSVKWTLSVGVIGSVFYLYRYSNNGYFYDHDATWLKQDHQVQDLVDRKEVVPGETRNRKLVVTDDGTAWSRTMGESIKDIWNEQIRNSVDWIYSWGKN

SEQ ID NO: 4282 - DNA, 345 bp, Candida glabrata CBS 138
  CDS (1)..(345)
atgagcaagatagcgaagctgggatcgttcacgctggtgagcggagtggtagcgacgtcgtgctactactacttcatcgaccgggacgggtaccattacaagcggtctgtgtggaagcaggtaggcgacgaggtgcagcgggtcatagaccgcaagcctagcctggtgttcagcaaggagaagtacggcgaccagttcgactacgactacaaggtgagcggtgagcgggtggagcgtgtgccagtggaccacaagcagctggtgctgcggtacaactcagagaccatgaaggacctgtggaacaaggaagtacgggcgctggtggactgggtctactctaggtga

SEQ ID NO: 4283 - protein, 114 aa, Candida glabrata CBS 138
MSKIAKLGSFTLVSGVVATSCYYYFIDRDGYHYKRSVWKQVGDEVQRVIDRKPSLVFSKEKYGDQFDYDYKVSGERVERVPVDHKQLVLRYNSETMKDLWNKEVRALVDWVYSR

SEQ ID NO: 4284 - DNA, 294 bp, Zygosaccharomyces rouxii
  CDS (1)..(294)
atgagcaagttgattaaattgacctctattactgcagtatcgagtaccttagcggcttcttattatttttattttgtagatagagacggttttcattaccaaaattcacaatggaagaaaattggtgataaagttcagggtataatagacggtagtgaaaacatcaacccaagtacaccatcgaacagtaatcaagtaattgtagtgaaaagaccaatgactgagacgatgaaagatttatggaatgaacaaataagaaatactgctaactggttctactcttgggggaaatga

SEQ ID NO: 4285 - protein, 97 aa, Zygosaccharomyces rouxii
MSKLIKLTSITAVSSTLAASYYFYFVDRDGFHYQNSQWKKIGDKVQGIIDGSENINPSTPSNSNQVIVVKRPMTETMKDLWNEQIRNTANWFYSWGK

SEQ ID NO: 4286 - DNA, 24 bp, Artificial sequence
  primer
atgtcgaaattgggtccgttagca

SEQ ID NO: 4287 - DNA, 24 bp, Artificial sequence
  primer
ctaattcttaccccaggagtagat

SEQ ID NO: 4288 - DNA, 1092 bp, Saccharomyces cerevisiae
  CDS (1)..(1092)
atgatgaatgaagaggattctacagaaacgaaaagcctagtcataactaatggcatgtttatcatagacgacatcgagcgtagtaaatataatattcactataagaatgtcccaggaggcggagggacttttgccattttgggtgcatgcataatatcttccggcaatgtcacatccaaaggtttgaagtggatagtggacagaggctctgactttccaaaggaagttataagggaaatagactcatggggtactgatgtgaggtttcgagatgactttagcagattaactaccaaagggttgaattattacgagggaagtgatgatttgagaaagttcaagtttttgacgccgaagaagcagattaacgtcgatgactggatttccacatttgggcagaagataattgatgaaatgcatgcgtttcatttgctatgttctgggtctagatgcttagacataataaacgatctgctacgggtgaaaagttcaaagggcacaaaaccaatcgtgatttgggagccattcccagatctttgcgactttgatcatcaaaatgacattaaaagtgtaatgcagaggaacgatgttacggtaatattatctccaaatgccgaagaatcaagtcgcttatttggtttaagtagcaaggaaccgactagtttggaagaatgtctagcattagcgcatcgtttcgatgatttcatggatgaaaacaatatgtgtattctacgatgcggtgccctcggaagcatatcggtaagtgagaagtttaagaacggacgaacctatgaccatttccccgcctaccatttcaaaactcagtctaaagtactagatcctactggcgggggaaactcgttccttggcggctttgcagtttcttatgccctaacgaaaagcttagatattgctagtatatgtgggaacatcgctgcaggcgcaataattgaacaattcggaataccgaggtacgatccaattgctaaaacctggaacggaatcacattcttggatagactgaaattttacctttcacagtccggtcttcaatataatataaacgatctttacaaaagtctaacacgatga

SEQ ID NO: 4289 - protein, 363 aa, Saccharomyces cerevisiae
MMNEEDSTETKSLVITNGMFIIDDIERSKYNIHYKNVPGGGGTFAILGACIISSGNVTSKGLKWIVDRGSDFPKEVIREIDSWGTDVRFRDDFSRLTTKGLNYYEGSDDLRKFKFLTPKKQINVDDWISTFGQKIIDEMHAFHLLCSGSRCLDIINDLLRVKSSKGTKPIVIWEPFPDLCDFDHQNDIKSVMQRNDVTVILSPNAEESSRLFGLSSKEPTSLEECLALAHRFDDFMDENNMCILRCGALGSISVSEKFKNGRTYDHFPAYHFKTQSKVLDPTGGGNSFLGGFAVSYALTKSLDIASICGNIAAGAIIEQFGIPRYDPIAKTWNGITFLDRLKFYLSQSGLQYNINDLYKSLTR

SEQ ID NO: 4290 - DNA, 1053 bp, Candida glabrata CBS 138
  CDS (1)..(1053)
atgatcactactaatggtatgtttatcttagatgatattgaaggtaaagtaacctacaatggtattccaggaggtggcggaacgtacgctgtcttaggagctgctatatgtacaccaagcgctcacgttagatcacaagttttgtggattgtcgatggaggacatgactttcccgattctatcaggcaaacatttgatcaatggggtgtcactacgaaatatcggatcgattctaacagggagactataagaggcctcaattactatccaaacttggaggccgagggcaaggatagagatttacggctcttcaaatttttgacgcccaaaatacaaatcaatgttgaagactgggtaggcacatttggagaagataaagtacgagaggacataaactgcttccacctggtatgttcagcagaacggtgtttagctataattaatgatctgaaagtaatcaaatcgaatcccaacatgggatacacaatagtatgggaaccacttcctagtctgtgcgacaacgatcatattgaagattttaagaaggtgtttcaatcagaaatacccattatattctctcccaacgcggaagaggctagccggctacttacgaataattcagaagagccttcaactctagagcaatgtaccgagctgttgaactcaatttatcaattagctgatggtaaccaggtcataatccgatgtggtaaactaggatcagttaccaggtcaccgattgacggtaaattactccattacccagcatatcatagtaaaacaccagataaagtaattgatcctacaggtggtggcaatacatatttaggcggttttgctcaaatttatgaaacgactaaggactatcatattgcaaatatttgtgctaatgtcgcagctagttttgcaattgagcaagtaggtatccctgagtataagaagaatgaaaacacttggaatggtactacttttgtagatagactcacgtcctatctacaaggcaatgattacaaagctacaatagaagagatcatacgtaaaattgagaagtaa

SEQ ID NO: 4291 - protein, 350 aa, Candida glabrata CBS 138
MITTNGMFILDDIEGKVTYNGIPGGGGTYAVLGAAICTPSAHVRSQVLWIVDGGHDFPDSIRQTFDQWGVTTKYRIDSNRETIRGLNYYPNLEAEGKDRDLRLFKFLTPKIQINVEDWVGTFGEDKVREDINCFHLVCSAERCLAIINDLKVIKSNPNMGYTIVWEPLPSLCDNDHIEDFKKVFQSEIPIIFSPNAEEASRLLTNNSEEPSTLEQCTELLNSIYQLADGNQVIIRCGKLGSVTRSPIDGKLLHYPAYHSKTPDKVIDPTGGGNTYLGGFAQIYETTKDYHIANICANVAASFAIEQVGIPEYKKNENTWNGTTFVDRLTSYLQGNDYKATIEEIIRKIEK

SEQ ID NO: 4292 - DNA, 1059 bp, Kluyveromyces lactis NRRL Y-1140
  CDS (1)..(1059)
atgggtcttcttactaccaatgggatgcttatcatcgatgagatcgagacggcgtcatcgcactattacgacgtactaggtggaggtgggacgtatgccatgttaggcgcatcaatatgctgtactgacctatctctgcgcaaggaactgctatggattgttgatcgtggaatggatttccctaagcaactgacggagactatcgaatcttgggacacgggttgtgtgtttcgagatgacaatgaaagattaactacaagaggttataacgtatatggtccgaatgattttagatcattcaaatatctagcgccaaagaaaagaatagatgtttctgactggtgcgagtcgttcggtgtcaaagcagtacaaagagtttcatgctatcatttgctatgttctgctgatagagtggccgatattctggataagcttgccgaagagttgtcatttgagggaactctgaaaacaggtcaaacgtttatatgggaaccaataccagatttgtgtaacgttgagcacctcgaagggattaagaagttgctcaacggaccataccatttcatcttttcgccaaatgcggaagaaggcgctaggatgctgggtgaaacagagccaactgaactttcggattgcagcacaatattattgaaattagcagcattgattaaacctggtaacatttgtgtcctcagatgtggtaaaaaagggtcattggccttaatttgcaataaaaatccatcaaacgatgacattatccatttcccagcataccattacaagactccagaatgtgtcattgatccaacaggaggcggaaatactttccttggagcatttgcattcgcatacgccatgtgtaaagacatttcaattgccagtatatgtggcaatattgctgcaggttgtgccatcgaacagatcggtgtaccatctcacaatggaatgcactggaataaaacgacttttgcagatagattattatattatttatccacttatgaactgaagcagggccacagtgaaatattgaactctcttcaaccaatgaaatattaa

SEQ ID NO: 4293 - protein, 352 aa, Kluyveromyces lactis NRRL Y-1140
MGLLTTNGMLIIDEIETASSHYYDVLGGGGTYAMLGASICCTDLSLRKELLWIVDRGMDFPKQLTETIESWDTGCVFRDDNERLTTRGYNVYGPNDFRSFKYLAPKKRIDVSDWCESFGVKAVQRVSCYHLLCSADRVADILDKLAEELSFEGTLKTGQTFIWEPIPDLCNVEHLEGIKKLLNGPYHFIFSPNAEEGARMLGETEPTELSDCSTILLKLAALIKPGNICVLRCGKKGSLALICNKNPSNDDIIHFPAYHYKTPECVIDPTGGGNTFLGAFAFAYAMCKDISIASICGNIAAGCAIEQIGVPSHNGMHWNKTTFADRLLYYLSTYELKQGHSEILNSLQPMKY

SEQ ID NO: 4294 - DNA, 1050 bp, Debaryomyces hansenii CBS767
  CDS (1)..(1050)
atggctaaggatgatcctatatttacgtcgatgggaatgtttatcatcgatgagaatcaatatcctccatcatctaaaaaggagccggtacataatattataggtggtggtggtacttatgctatcattggttcgagaatcattgctggtgctgaaaaatccaaactaatttgtggaattatagataagggatctgattttccagaaattgtggaagaagaaatcttgagttggaattcaggaatcgtttggaaagaagatctctctaggctaactactagaggacttaatatatatgacgaagccgatattagacatttcaaatacaaaactgataaaaaaaggattgaagcgcaagatatagtcaatcacccttacttgataagatcacgcaccattcatatcattagttcggttgaaaggtgtgaatccatcatagatacgattttatccaatactccaaatgatgttattccaactttcatatatgagcctttacctgatgtctgtgttgcatcaagttatgataagctaaccttattgttgccgaagattgatgtattcacaccgaacttaaatgaaatgtcgaatttagcaaatttggctagggtacccgaaactatggaggatatcaaaacattgagttctaagtttagtccttatttgacaaaacctaattctggttctgttgttagatgtggacccttaggatgctttatcaagacttccaaagtggaaatttcattacctgcataccatagaaatcaagataaagttgtagacgtaactggtggtggtaacctgttttgcggtggattcgttacaggtttatgcttatccaaaggtgactgggttattggtggtatttgtggtaatatagctagtggatgtgttattgagcgacttggaatgccacgattatatctgggtctttcggatgaaaaatggaatggttcatctacctctaaaaggttaaagtactatgtagatatgaataagagcattctagacggaacattcgatgtaacaaaaattgactggctagcctaa

SEQ ID NO: 4295 - protein, 349 aa, Debaryomyces hansenii CBS767
MAKDDPIFTSMGMFIIDENQYPPSSKKEPVHNIIGGGGTYAIIGSRIIAGAEKSKLICGIIDKGSDFPEIVEEEILSWNSGIVWKEDLSRLTTRGLNIYDEADIRHFKYKTDKKRIEAQDIVNHPYLIRSRTIHIISSVERCESIIDTILSNTPNDVIPTFIYEPLPDVCVASSYDKLTLLLPKIDVFTPNLNEMSNLANLARVPETMEDIKTLSSKFSPYLTKPNSGSVVRCGPLGCFIKTSKVEISLPAYHRNQDKVVDVTGGGNLFCGGFVTGLCLSKGDWVIGGICGNIASGCVIERLGMPRLYLGLSDEKWNGSSTSKRLKYYVDMNKSILDGTFDVTKIDWLA

SEQ ID NO: 4296 - DNA, 981 bp, Yarrowia lipolytica CLIB122
  CDS (1)..(981)
atgacctggttcaccaccatggggatgttcatcatcgatgaaatccactttggaactcactcggtatacgacattgttggaggagcgggaacttacggggttcttggagcgcgtttctttgccaaacaagacaaggccaaggacattggatggattgtggacgctggaaacgactttccgcagtcggtagaggaacagattacaagctgggacacaggtttagtcatgcgaagagatccgagtagaaaaaccaccaggggatggaactcttatggagataacgaccttcgaagcttcaagtatctgacaccaaagaaacggatagaggtgtcggatctccaggaatgtggtctggactcttctcgtagcatccacgtcatctgctctccggatcgatgcatgaaaatctgctctgatttggccaatggacctcgacaagaccagcaggtgttcctatgggaacctgtgcctgactgttgttgtccggaaacgtttccgaccatgctacaggctctcaattccgtccaggtactttctccaaactgccacgaggctgctttgtttgtaggtcttcctgaacctacgacagtgtccgaaatcgagtctctagtctacgactattgggctcctcatcttgacaagctgaaaacggtgtttgtgctgcgatgtggcaagctcggagtgttggtctacagtgacaagaagctcaaatggtaccctgcgtaccaccagagctcggagaaggtgattgatcccactggagggggaaatacatttgtgggaggcttcctgtacggctatcttgagagcgacggagacctggacactgctgcgtcgtatggaaacgtcgcagctggattggcagtcgagcaggttggagttcctcttctgacctaccaacgcggacaagagctgtggaatgacactaccatcgagcagagattggacgtgtacgcttctttgttgaaggccagcaactag

SEQ ID NO: 4297 - protein, 326 aa, Yarrowia lipolytica CLIB122
MTWFTTMGMFIIDEIHFGTHSVYDIVGGAGTYGVLGARFFAKQDKAKDIGWIVDAGNDFPQSVEEQITSWDTGLVMRRDPSRKTTRGWNSYGDNDLRSFKYLTPKKRIEVSDLQECGLDSSRSIHVICSPDRCMKICSDLANGPRQDQQVFLWEPVPDCCCPETFPTMLQALNSVQVLSPNCHEAALFVGLPEPTTVSEIESLVYDYWAPHLDKLKTVFVLRCGKLGVLVYSDKKLKWYPAYHQSSEKVIDPTGGGNTFVGGFLYGYLESDGDLDTAASYGNVAAGLAVEQVGVPLLTYQRGQELWNDTTIEQRLDVYASLLKASN

SEQ ID NO: 4298 - DNA, 1131 bp, Candida albicans SC5314
  CDS (1)..(1131): transl_table=12
atgacaattttcacaacattaggaatgtttatagttgatgagaatcgatacattgacagtaacaataatcctttacccccaccaccttcttcatcgtccttacaacaaacaaacattattggtggggctggaacatatgctataatgggagcaagaataatatgtgatggtcgtcaagatttaattgatcaaatatctgggattattgatatgggttcagatttcccttttgaaatcaaacaagaattggatacttggaaaactagaggggtaatatatcgagaaaatcctcatcgattgactactcgtggtgtcaatatttatcaatacacagataataataataataaaagttttaatagatcaattgataacgaatcggaagtggaacctgagcaagatgcaattaggtattttgaatatgtgacaccaaaattaagaattgaaatcaatgatatcttggaatatcccaatttgaaacaaagttcaaattatcatttaatctgttcaattgaacgatgtaaatcattgatcgattcaattactcaatttaacccaacagctaagtttatttatgaaccattacctgatgattgtgtttttgaaaatttggaatttttacaaaatgatatattacccaaaattcatgtgttcacacctaatttgaatgaagcaaggttattattagggttaaaggataatgaaaatgaaacaaataaaagtgatgacaatgacgaattacaaaaaatatcgcaacaatttacaaatcatttacaattatcaaattcaggtacagtattacgatgtggagctcaaggttgctatataaatactaaatcaggcgacaaattccaattaccagcatatcatcaggatcatactaaagtggttgatgtcactggtggtggaaattctttctgtggtgggtttatgatggcgtatcatttaagtgatcgtgattggttagccagtggagttgcaggaattattagtagtggctgtataattgaaaaattgggtatgccaacagtttctgacgatagcaaatttaataataaatcattaagagatagactagatacatatttaactgaaaatccaacattaaaagttgatttcaattggatttaa

SEQ ID NO: 4299 - protein, 376 aa, Candida albicans SC5314
MTIFTTLGMFIVDENRYIDSNNNPLPPPPSSSSLQQTNIIGGAGTYAIMGARIICDGRQDLIDQISGIIDMGSDFPFEIKQELDTWKTRGVIYRENPHRLTTRGVNIYQYTDNNNNKSFNRSIDNESEVEPEQDAIRYFEYVTPKLRIEINDILEYPNLKQSSNYHLICSIERCKSLIDSITQFNPTAKFIYEPLPDDCVFENLEFLQNDILPKIHVFTPNLNEARLLLGLKDNENETNKSDDNDELQKISQQFTNHLQLSNSGTVLRCGAQGCYINTKSGDKFQLPAYHQDHTKVVDVTGGGNSFCGGFMMAYHLSDRDWLASGVAGIISSGCIIEKLGMPTVSDDSKFNNKSLRDRLDTYLTENPTLKVDFNWI

SEQ ID NO: 4300 - DNA, 1131 bp, Candida albicans SC5314
  CDS (1)..(1131): transl_table=12
atgacaattttcacaacattaggaatgtttatagttgatgagaatcgatacgttgacagtaacaataatcttttacccccaccaccttcttcatcgtccttacaacaaacaaacattattggtggggctggaacatatgctataatgggagcaagaataatatgtgatgatcgtcaagatttaattgatcaaatatctgggatcattgatatgggttcggatttcccttttgaaatcaaacaagaattggatacttggaaaactagaggggtaatatatcgagaaaatcctcatcgattgactactcgtggtgtcaatatttatcgatacaccgataataataataataaaagttctaatgaatcaattgataatgaattggaagcggaacctgagcaagatgcaattaggtattttgaatatgtgacaccaaaattaagaattgaaatcaatgatatcttggaatatcccaatttgaaacaaagttcaaattatcatttaatctgttcaattgaacgatgtaaatcattgatcgattcaattactcaatttaacccatcagctaagtttatttatgaaccattacctgatgattgtgtttttgaaaatttggaatttttacaaaatgatatattacccaaaattcatgtgttcacacctaatttgaatgaagcaaggttattattagggttaaaggataatgaaaatgaaacaaataaaagcgatgacaatgacgaattacaaaaaatatcgcaacaatttacaaatcatttacaattatcaaattcaggtacagtattacgatgtggagctcaaggttgctatataaatactaaatcaggcgacaaattccaattaccagcatatcatcaggatcaaactaaagtggttgatgtcactggtggtggaaattctttctgtggtgggtttatgatggcgtatcatttaagtgatggtgattggttagccagtggagttgcaggaattattagtagtggctgtataattgaaaaattgggtatgccaacagtttctgacgatagcaaatttaataataaatcattaagagatagactagatacctatttaactgaaaatccaacattaaaagttgatttcaattggatttaa

SEQ ID NO: 4301 - protein, 376 aa, Candida albicans SC5314
MTIFTTLGMFIVDENRYVDSNNNLLPPPPSSSSLQQTNIIGGAGTYAIMGARIICDDRQDLIDQISGIIDMGSDFPFEIKQELDTWKTRGVIYRENPHRLTTRGVNIYRYTDNNNNKSSNESIDNELEAEPEQDAIRYFEYVTPKLRIEINDILEYPNLKQSSNYHLICSIERCKSLIDSITQFNPSAKFIYEPLPDDCVFENLEFLQNDILPKIHVFTPNLNEARLLLGLKDNENETNKSDDNDELQKISQQFTNHLQLSNSGTVLRCGAQGCYINTKSGDKFQLPAYHQDQTKVVDVTGGGNSFCGGFMMAYHLSDGDWLASGVAGIISSGCIIEKLGMPTVSDDSKFNNKSLRDRLDTYLTENPTLKVDFNWI

SEQ ID NO: 4302 - DNA, 1251 bp, Aspergillus oryzae
  CDS (1)..(1251)
atgacagaacaaagcggccctacatctttcgccaatcatgtggacttctgtacactaggcatgttcatccttgatgatattgacttcgggggcactagacctaatgtcaagaatatcctcgggggtgcagcgtctttcgcggttgtcggtgctcgtctagtcgctggaaaggagcactcccacgctgttagctggattgttgatgttggctccgactttccctcggaggttttagatgtcatcaacacatggggcacagcatgcgtgatgagagaagacaacaaccgattaaccaccagggcttggaatggctacggtcccaatgagaagcggggtgagcacctaaccttctttcgcatgaactctagaaaggatactgacgggctagacttcaaatatttgacccctaaattacgactagaaccttggatgctatccgattcccaggtgttctcgaggacctttcatatggtctgttcagcaggacgttgcgtgtcaattgtgcagaatatactgcagcggcgagaagaactacggcgagaaggcaaagcaccttccagcagccaggcttcggagaggccattctttgtctgggaacctgtgcctgatctctgtacacccgaagagcaagataaattctttgttgcaaaccgggtagtcgatgtggtaagccctaatgaactggagctaggaatgatgtttgggcagccagggtggaatgaagagagcgaattcgggaaagatattgtcaagcgcatccttgattcgggcattggcccgaacggaaatgggcacttggttattagagcagggaaagatggaagctatacattctcaagaggccagaggatttggttgcccgcttaccatcaacccgatgcttcagcaaatacgccagtcgtcgatccgactggtgcaggtaattcttttttgggggcactgactcaagggatggtgactgttgatagggccccagccaagattgttggctcagtgcttgcagggtctgctgtctgggaaagggcattggaagcgttgggcaagcagagttatatactgtcctctctgatattcgccactgttgctgcaggtttcgttgtggagcagattggagtgccccatctgtctacgtctaccgaggaaagagaactttggaacggaactgaattcacggaacgagtccgtctgtacacgcagcgattgtatcgaacactcgaagagtctccccggaagcacttgcagatcaattga

SEQ ID NO: 4303 - protein, 416 aa, Aspergillus oryzae
MTEQSGPTSFANHVDFCTLGMFILDDIDFGGTRPNVKNILGGAASFAVVGARLVAGKEHSHAVSWIVDVGSDFPSEVLDVINTWGTACVMREDNNRLTTRAWNGYGPNEKRGEHLTFFRMNSRKDTDGLDFKYLTPKLRLEPWMLSDSQVFSRTFHMVCSAGRCVSIVQNILQRREELRREGKAPSSSQASERPFFVWEPVPDLCTPEEQDKFFVANRVVDVVSPNELELGMMFGQPGWNEESEFGKDIVKRILDSGIGPNGNGHLVIRAGKDGSYTFSRGQRIWLPAYHQPDASANTPVVDPTGAGNSFLGALTQGMVTVDRAPAKIVGSVLAGSAVWERALEALGKQSYILSSLIFATVAAGFVVEQIGVPHLSTSTEERELWNGTEFTERVRLYTQRLYRTLEESPRKHLQIN

SEQ ID NO: 4304 - DNA, 1434 bp, Neurospora crassa
  CDS (1)..(1434)
atgacagacaataacggcaacccggaagtgcccggccaaagtccagacgatgttgacaaagcctcggatgagagctcagaatggcaagatatcaacgacactccctcaataatagactttgtcaccctcggcatgttcatcatcgatgaaatcgaataccctccgccccgtcctccatcaaccaacgtcttaggaggcgccggctcctactccgccctcggcgcccgcctcttctctccagctccggacctctcccgcaccgtgggctggatcgtcgatcagggctccgacttcccccaggccatcaccgatctcatcaccggctggtccacctcggccgtcttccgccatgaccccacccggctcaccacccgcggctggaacggctacgtcggctcctcggagcgccgcgaattcaagtacaccactcccaagaaacgactgacggccgccgacctggtcggaacccccttgttgaaggctaaagccgtgcacatggtctgcagtcccaaccgctgcaaagagttggtggaggagatcatcacccttcgcaagcgcgaagcccgacttgctgctgctgccgcctccaacaagaacaacaacaataacgacaacgacgacgattgcgacgatgttgatgacgacaccaacgaccccaacgcctacacccgccccttaatcatctgggaaccagtccccgatctctgcacccccttcgagttactaaactgcaccaacgccctcccactggtcgacatctgcagccccaaccacgccgagctagccgggttcatgggcaccgacggcctcgacccggaaacgggcgagatcagcgtcgagcaagtagagcgcaactgcgaacagctgctggccagcatgccgctgacgacgtacacgctggtggtcagggccggggagaagggctgctatgttgccaagaatggggggcgaaggaggaaacagccacctatgaaaaggggaaagaagaagaagatgaaggtagggctggacgcccgaaacttccacggcggtctacagcacgacacagacatgatgtctctctttgccggacttttgcaagatatggaagaccggaacaacgaggatgacccgttcggtcgtttcgatgtcgaggaggggatcgaggtcgattcggggatcgagaggtggctgcccgcttaccacacggacgccacaaaggtcgtcgatcccacgggaggtgggaacacgttcctgggtgggttggcggtggcgttggcgaggggaaagagcatcgaggaggcgtgtgcgtggggcagcgtggcagcaagttttgccattgagcaggtgggagtaccggagctggggatggatgtggaggggagagagacgtggaatggggagagggtggaggagaggttgagtgggtatctggagagggtcggattgttgtga

SEQ ID NO: 4305 - protein, 477 aa, Neurospora crassa
MTDNNGNPEVPGQSPDDVDKASDESSEWQDINDTPSIIDFVTLGMFIIDEIEYPPPRPPSTNVLGGAGSYSALGARLFSPAPDLSRTVGWIVDQGSDFPQAITDLITGWSTSAVFRHDPTRLTTRGWNGYVGSSERREFKYTTPKKRLTAADLVGTPLLKAKAVHMVCSPNRCKELVEEIITLRKREARLAAAAASNKNNNNNDNDDDCDDVDDDTNDPNAYTRPLIIWEPVPDLCTPFELLNCTNALPLVDICSPNHAELAGFMGTDGLDPETGEISVEQVERNCEQLLASMPLTTYTLVVRAGEKGCYVAKNGGRRRKQPPMKRGKKKKMKVGLDARNFHGGLQHDTDMMSLFAGLLQDMEDRNNEDDPFGRFDVEEGIEVDSGIERWLPAYHTDATKVVDPTGGGNTFLGGLAVALARGKSIEEACAWGSVAASFAIEQVGVPELGMDVEGRETWNGERVEERLSGYLERVGLL

SEQ ID NO: 4306 - DNA, 25 bp, Artificial sequence
  primer
atgatgaatgaagaggattctacag

SEQ ID NO: 4307 - DNA, 26 bp, Artificial sequence
  primer
tcatcgtgttagacttttgtaaagat

SEQ ID NO: 4308 - protein, 475 aa, Artificial sequence
  consensus sequence
  Variant (2)..(2): Xaa in position 2 is any amino acid
  Variant (7)..(7): Xaa in position 7 is any amino acid
  Variant (9)..(20): Xaa in position 9 to 20 is any amino acid
  Variant (21)..(35): Xaa in position 21 to 35 is any or no amino acid
  Variant (38)..(38): Xaa in position 38 is any amino acid
  Variant (40)..(44): Xaa in position 40 to 44 is any amino acid
  Variant (47)..(60): Xaa in position 47 to 60 is any amino acid
  Variant (61)..(62): Xaa in position 61 to 62 is any or no amino acid
  Variant (64)..(64): Xaa in position 64 is any amino acid
  Variant (66)..(66): Xaa in position 66 is any amino acid
  Variant (68)..(68): Xaa in position 68 is any amino acid
  Variant (72)..(80): Xaa in position 72 to 80 is any amino acid
  Variant (82)..(87): Xaa in position 82 to 87 is any amino acid
  Variant (88)..(88): Xaa in position 88 is any or no amino acid
  Variant (90)..(93): Xaa in position 90 to 93 is any amino acid
  Variant (95)..(95): Xaa in position 95 is any amino acid
  Variant (100)..(100): Xaa in position 100 is any amino acid
  Variant (102)..(102): Xaa in position 102 is any amino acid
  Variant (104)..(110): Xaa in position 104 to 110 is any amino acid
  Variant (111)..(133): Xaa in position 111 to 133 is any or no amino acid
  Variant (135)..(137): Xaa in position 135 to 137 is any amino acid
  Variant (141)..(146): Xaa in position 141 to 146 is any amino acid
  Variant (148)..(158): Xaa in position 148 to 158 is any amino acid
  Variant (159)..(164): Xaa in position 159 to 164 is any or no amino acid
  Variant (166)..(167): Xaa in position 166 to 167 is any amino acid
  Variant (170)..(171): Xaa in position 170 to 171 is any amino acid
  Variant (174)..(191): Xaa in position 174 to 191 is any amino acid
  Variant (192)..(229): Xaa in position 192 to 229 is any or no amino acid
  Variant (232)..(232): Xaa in position 232 is any amino acid
  Variant (235)..(235): Xaa in position 235 is any amino acid
  Variant (237)..(255): Xaa in position 237 to 255 is any amino acid
  Variant (256)..(258): Xaa in position 256 to 258 is any or no amino acid
  Variant (261)..(262): Xaa in position 261 to 262 is any amino acid
  Variant (264)..(298): Xaa in position 264 to 298 is any amino acid
  Variant (299)..(306): Xaa in position 299 to 306 is any or no amino acid
  Variant (308)..(308): Xaa in position 308 is any amino acid
  Variant (310)..(311): Xaa in position 310 to 311 is any amino acid
  Variant (313)..(332): Xaa in position 313 to 332 is any amino acid
  Variant (333)..(403): Xaa in position 333 to 403 is any or no amino acid
  Variant (406)..(406): Xaa in position 406 is any amino acid
  Variant (408)..(408): Xaa in position 408 is any amino acid
  Variant (414)..(416): Xaa in position 414 to 416 is any amino acid
  Variant (418)..(444): Xaa in position 418 to 444 is any amino acid
  Variant (445)..(445): Xaa in position 445 is any or no amino acid
  Variant (447)..(448): Xaa in position 447 to 448 is any amino acid
  Variant (450)..(450): Xaa in position 450 is any amino acid
  Variant (452)..(458): Xaa in position 452 to 458 is any amino acid
  Variant (459)..(463): Xaa in position 459 to 463 is any or no amino acid
  Variant (465)..(470): Xaa in position 465 to 470 is any amino acid
  Variant (473)..(474): Xaa in position 473 to 474 is any amino acid
TXGMFIXDXXXXXXXXXXXXXXXXXXXXXXXXXXXGGXGXXXXXGAXXXXXXXXXXXXXXXXIXDXGXDFPXXXXXXXXXWXXXXXXXRXXXXRXTTRGXNXYXXXXXXXXXXXXXXXXXXXXXXXXXXXXXXFXXXTPKXXXXXXDXXXXXXXXXXXXXXXXXHXXCSXXRCXXXXXXXXXXXXXXXXXXXXXXXXXXXXXXXXXXXXXXXXXXXXXXXXXXXXXXXXEPXPDXCXXXXXXXXXXXXXXXXXXXXXXPNXXEXXXXXXXXXXXXXXXXXXXXXXXXXXXXXXXXXXXXXXXXXXXRXGXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKVXDXTGGGNXXXGXXXXXXXXXXXXXXXXXXXXXXXXXXXXEXXGXPXXXXXXXXXXXXNXXXXXXRLXXY

SEQ ID NO: 4309 - protein, 18 aa, Artificial sequence
  protein pattern
  Variant (2)..(2): Xaa in position 2 is Ile, Leu or Val
  Variant (4)..(4): Xaa in position 4 is Pro or Val
  Variant (10)..(10): Xaa in position 10 is any amino acid
  Variant (11)..(14): Xaa in position 11 to 14 is any or no amino acid
  Variant (16)..(17): Xaa in position 16 to 17 is any amino acid
  Variant (18)..(18): Xaa in position 18 is Ala, Gly or Ile
VXDXTGGGNXXXXXFXXX

SEQ ID NO: 4310 - protein, 26 aa, Artificial sequence
  protein pattern
  Variant (2)..(2): Xaa in position 2 is any amino acid
  Variant (4)..(4): Xaa in position 4 is any amino acid
  Variant (8)..(8): Xaa in position 8 is any amino acid
  Variant (9)..(9): Xaa in position 9 is Ala, Glu, Gln or Ser
  Variant (10)..(10): Xaa in position 10 is Ile, Leu or Val
  Variant (11)..(11): Xaa in position 11 is any amino acid
  Variant (12)..(12): Xaa in position 12 is Asp, Glu, Gln or Arg
  Variant (13)..(13): Xaa in position 13 is any amino acid
  Variant (14)..(14): Xaa in position 14 is Phe, Ile or Leu
  Variant (15)..(15): Xaa in position 15 is Asp, Glu, Asn or Thr
  Variant (16)..(16): Xaa in position 16 is Gly, Gln, Ser or Thr
  Variant (18)..(18): Xaa in position 18 is any amino acid
  Variant (19)..(19): Xaa in position 19 is Thr or Val
  Variant (20)..(25): Xaa in position 20 to 25 is any amino acid
  Variant (26)..(26): Xaa in position 26 is Asp or Glu
DXGXDFPXXXXXXXXXWXXXXXXXXX

SEQ ID NO: 4311 - protein, 19 aa, Artificial sequence
  protein pattern
  Variant (2)..(2): Xaa in position 2 is any amino acid
  Variant (4)..(4): Xaa in position 4 is Glu or Lys
  Variant (5)..(5): Xaa in position 5 is Phe or Tyr
  Variant (6)..(6): Xaa in position 6 is any amino acid
  Variant (7)..(7): Xaa in position 7 is Ala or Thr
  Variant (8)..(8): Xaa in position 8 is Asp or Pro
  Variant (10)..(10): Xaa in position 10 is any amino acid
  Variant (11)..(11): Xaa in position 11 is Gln or Arg
  Variant (12)..(12): Xaa in position 12 is Ile or Leu
  Variant (13)..(13): Xaa in position 13 is Asp, Glu, Asn or Thr
  Variant (14)..(14): Xaa in position 14 is Ala, Ile or Val
  Variant (15)..(15): Xaa in position 15 is Ala, Asp, Glu, Asn, Gln or Ser
  Variant (17)..(18): Xaa in position 17 to 18 is any amino acid
  Variant (19)..(19): Xaa in position 19 is Glu, Gly, Asn or Ser
RXFXXXXXKXXXXXXDXXX

SEQ ID NO: 4312 - protein, 14 aa, Artificial sequence
  protein pattern
  Variant (2)..(3): Xaa in position 2 to 3 is Ala or Gly
  Variant (4)..(4): Xaa in position 4 is Ser or Thr
  Variant (5)..(5): Xaa in position 5 is Phe or Tyr
  Variant (6)..(6): Xaa in position 6 is Ala, Gly or Ser
  Variant (7)..(7): Xaa in position 7 is any amino acid
  Variant (8)..(8): Xaa in position 8 is Leu, Met or Val
  Variant (11)..(11): Xaa in position 11 is any amino acid
  Variant (12)..(12): Xaa in position 12 is Phe, Ile or Leu
  Variant (13)..(13): Xaa in position 13 is any amino acid
  Variant (14)..(14): Xaa in position 14 is Ala, Cys, Ser or Thr
GXXXXXXXGAXXXX

SEQ ID NO: 4313 - protein, 11 aa, Artificial sequence
  protein pattern
  Variant (2)..(2): Xaa in position 2 is any amino acid
  Variant (5)..(5): Xaa in position 5 is Phe or Leu
  Variant (7)..(7): Xaa in position 7 is Ile, Leu or Val
  Variant (9)..(9): Xaa in position 9 is Asp or Glu
  Variant (10)..(10): Xaa in position 10 is any amino acid
  Variant (11)..(11): Xaa in position 11 is Asp, Glu, His or Arg
TXGMXIXDXXX

SEQ ID NO: 4314 - protein, 16 aa, Artificial sequence
  protein pattern
  Variant (2)..(2): Xaa in position 2 is Leu, Met or Val
  Variant (3)..(3): Xaa in position 3 is Ile, Leu or Val
  Variant (6)..(6): Xaa in position 6 is Ala, Gly, Ile or Pro
  Variant (7)..(7): Xaa in position 7 is Asp, Glu, Gly, Asn or Ser
  Variant (9)..(11): Xaa in position 9 to 11 is any amino acid
  Variant (12)..(15): Xaa in position 12 to 15 is any or no amino acid
HXXCSXXRXXXXXXXI

SEQ ID NO: 4315 - DNA, 282 bp, Saccharomyces cerevisiae
  CDS (1)..(282)
atgttgagaaccacttttttgcgcactccaagacaattgatgcgtaaatcgccaagggcgtctttctcaatcgtcactagggccgcctttcctcacctaaagaacaatcaagatgaagctgagaaaaaagaacagggtttgtttgatagcaacaagaagaggttggacactttggaacacggcaagaatccagattataagcaacctggaatggaagatttgaaaaaaaagggagatgacgctagaatcgaacaaaacaggccagatgacggtgtttattaa

SEQ ID NO: 4316 - protein, 93 aa, Saccharomyces cerevisiae
MLRTTFLRTPRQLMRKSPRASFSIVTRAAFPHLKNNQDEAEKKEQGLFDSNKKRLDTLEHGKNPDYKQPGMEDLKKKGDDARIEQNRPDDGVY

SEQ ID NO: 4317 - DNA, 285 bp, Candida glabrata CBS 138
  CDS (1)..(285)
atgttgagacaagtcattgccaatactagagtatctgttcgccaacctgaatgcgcaagatttctatccactacacgccagttattcaccaaggatcacttgaagaaagaccaaaatgctgctgagaaagctgaacaaaaaatgttcgatgagaaccaaaaagatcttgaacaacttgaacacggtaagagcaccaaatcccataactacaagtgtgatgacttaagagaaaagggtgagaacgcaagaattgagcagaatagaccagatgatggtgtctactaa

SEQ ID NO: 4318 - protein, 94 aa, Candida glabrata CBS 138
MLRQVIANTRVSVRQPECARFLSTTRQLFTKDHLKKDQNAAEKAEQKMFDENQKDLEQLEHGKSTKSHNYKCDDLREKGENARIEQNRPDDGVY

SEQ ID NO: 4319 - DNA, 273 bp, Kluyveromyces lactis NRRL Y-1140
  CDS (1)..(273)
atgatccaattaaccagagttataaagtcttccccagttgctacccaatgtttgagaagaaacttctcagcttctgttatggcaggcactacacagaagtcaaaggatccagatcaaaggatgttcgatagaaataagaagaagctagaagagttggaacacgattctaaaaccgacgatccaaactacaaacgtcctaatctaaaatccttgaagcagaagggtaaggatgccccaatcaaacagcatagagcagatgacggtgtctattaa

SEQ ID NO: 4320 - protein, 90 aa, Kluyveromyces lactis NRRL Y-1140
MIQLTRVIKSSPVATQCLRRNFSASVMAGTTQKSKDPDQRMFDRNKKKLEELEHDSKTDDPNYKRPNLKSLKQKGKDAPIKQHRADDGVY

SEQ ID NO: 4321 - DNA, 25 bp, Artificial sequence
  primer
atgttgagaaccacttttttgcgca

SEQ ID NO: 4322 - DNA, 24 bp, Artificial sequence
  primer
ttaataaacaccgtcatctggcct

SEQ ID NO: 4323 - protein, 98 aa, Artificial sequence
  consensus sequence
  Variant (2)..(13): Xaa in position 2 to 13 is any amino acid
  Variant (14)..(19): Xaa in position 14 to 19 is any or no amino acid
  Variant (21)..(24): Xaa in position 21 to 24 is any amino acid
  Variant (25)..(26): Xaa in position 25 to 26 is any or no amino acid
  Variant (28)..(29): Xaa in position 28 to 29 is any amino acid
  Variant (31)..(44): Xaa in position 31 to 44 is any amino acid
  Variant (45)..(46): Xaa in position 45 to 46 is any or no amino acid
  Variant (48)..(49): Xaa in position 48 to 49 is any amino acid
  Variant (52)..(52): Xaa in position 52 is any amino acid
  Variant (54)..(54): Xaa in position 54 is any amino acid
  Variant (56)..(56): Xaa in position 56 is any amino acid
  Variant (58)..(59): Xaa in position 58 to 59 is any amino acid
  Variant (63)..(75): Xaa in position 63 to 75 is any amino acid
  Variant (76)..(78): Xaa in position 76 to 78 is any or no amino acid
  Variant (80)..(81): Xaa in position 80 to 81 is any amino acid
  Variant (84)..(85): Xaa in position 84 to 85 is any amino acid
  Variant (87)..(87): Xaa in position 87 is any amino acid
  Variant (89)..(89): Xaa in position 89 is any amino acid
  Variant (91)..(91): Xaa in position 91 is any amino acid
  Variant (93)..(93): Xaa in position 93 is any amino acid
MXXXXXXXXXXXXXXXXXXAXXXXXXRXXFXXXXXXXXXXXXXXXXQXXFDXNXKXLXXLEHXXXXXXXXXXXXXXXXLXXKGXXAXIXQXRXDDGVY

SEQ ID NO: 4324 - protein, 16 aa, Artificial sequence
  protein pattern
  Variant (2)..(2): Xaa in position 2 is Asp, Glu or Lys
  Variant (3)..(3): Xaa in position 3 is Asp or Asn
  Variant (5)..(5): Xaa in position 5 is any amino acid
  Variant (7)..(7): Xaa in position 7 is Glu or Lys
  Variant (9)..(9): Xaa in position 9 is any amino acid
  Variant (11)..(11): Xaa in position 11 is Ala or Pro
GXXAXIXQXRXDDGVY

SEQ ID NO: 4325 - DNA, 336 bp, Saccharomyces cerevisiae
  CDS (1)..(336)
atgggtctatttaataacttcaagtttaaatatacaagggcgcaactggagatctttagattttcattttgtttgctagcacctgttgctgtaatgtactatattggtacagatactgataaaaaattaaatgttccagggttttggccagatcctgcaacgttgaaccaaataccaaaagagccttatgagattaaagctgaactggcaaggatgaaaaaagaacgtttagagaaaaggcttaggttggagaaaaagatacaagaggagtttggtttagaccttgaggaggaaaaagaaaaaattaaacgggatttggctctcaaaaaaggatga

SEQ ID NO: 4326 - protein, 111 aa, Saccharomyces cerevisiae
MGLFNNFKFKYTRAQLEIFRFSFCLLAPVAVMYYIGTDTDKKLNVPGFWPDPATLNQIPKEPYEIKAELARMKKERLEKRLRLEKKIQEEFGLDLEEEKEKIKRDLALKKG

SEQ ID NO: 4327 - DNA, 330 bp, Candida glabrata CBS 138
  CDS (1)..(330)
atgaagttaccattcagatacacaagggcacagctcgagatatttagattctcattttgtcttctggctcctgtggcggtgatgtattacattggtactgatacggataagaagttgaatgtacctgggttttggcctgatcctgagtcgctaaatcaaataccaaaggaaccatatgaaattaaggcagagcttgcgaggatgaagaaggaaagactagagaagagactaaaactggagaagaggttgaaggaagagtttggtttggatgtggaggctgaaaaggcgaagatgagagaagagctgggtttgaccagcaaaacagaataa

SEQ ID NO: 4328 - protein, 109 aa, Candida glabrata CBS 138
MKLPFRYTRAQLEIFRFSFCLLAPVAVMYYIGTDTDKKLNVPGFWPDPESLNQIPKEPYEIKAELARMKKERLEKRLKLEKRLKEEFGLDVEAEKAKMREELGLTSKTE

SEQ ID NO: 4329 - DNA, 399 bp, Kluyveromyces lactis NRRL Y-1140
  CDS (1)..(399)
atgagatggagactaccattcaagtatacccgcgcacaacttgaagtgttcagattcgggttctgtcttttggcacctgttgctgtgatgtactatatcggtacagataccgataaaaagctaaacgttccagggttttggccagatccagagactttaaataagatccctaaggaaccatacgagatcaaagcagagttggcaaggatgaagaaggagagactcgaaaagagactgagattagagaagaagattgctgaagaattcggaattgatatcgaagcagagaaggaaaaaattagacaagaagagctggctcttaaagcagcacaagaaccagtaaaagaagaggaacaagaacaaggattggccttggataaacctgcttcttcagaataa

SEQ ID NO: 4330 - protein, 132 aa, Kluyveromyces lactis NRRL Y-1140
MRWRLPFKYTRAQLEVFRFGFCLLAPVAVMYYIGTDTDKKLNVPGFWPDPETLNKIPKEPYEIKAELARMKKERLEKRLRLEKKIAEEFGIDIEAEKEKIRQEELALKAAQEPVKEEEQEQGLALDKPASSE

SEQ ID NO: 4331 - DNA, 27 bp, Artificial sequence
  primer
atgggtctatttaataacttcaagttt

SEQ ID NO: 4332 - DNA, 25 bp, Artificial sequence
  primer
tcatccttttttgagagccaaatcc

SEQ ID NO: 4333 - protein, 101 aa, Artificial sequence
  consensus sequence
  Variant (2)..(2): Xaa in position 2 is any amino acid
  Variant (10)..(10): Xaa in position 10 is any amino acid
  Variant (14)..(14): Xaa in position 14 is any amino acid
  Variant (45)..(46): Xaa in position 45 to 46 is any amino acid
  Variant (49)..(49): Xaa in position 49 is any amino acid
  Variant (74)..(74): Xaa in position 74 is any amino acid
  Variant (78)..(80): Xaa in position 78 to 80 is any amino acid
  Variant (85)..(85): Xaa in position 85 is any amino acid
  Variant (87)..(87): Xaa in position 87 is any amino acid
  Variant (89)..(89): Xaa in position 89 is any amino acid
  Variant (92)..(92): Xaa in position 92 is any amino acid
  Variant (94)..(97): Xaa in position 94 to 97 is any amino acid
  Variant (98)..(98): Xaa in position 98 is any or no amino acid
  Variant (100)..(100): Xaa in position 100 is any amino acid
FXYTRAQLEXFRFXFCLLAPVAVMYYIGTDTDKKLNVPGFWPDPXXLNXIPKEPYEIKAELARMKKERLEKRLXLEKXXXEEFGXDXEXEKXKXXXXXLXL

SEQ ID NO: 4334 - protein, 60 aa, Artificial sequence
  protein pattern
  Variant (8)..(8): Xaa in position 8 is Ile or Val
  Variant (12)..(12): Xaa in position 12 is Gly or Ser
  Variant (43)..(43): Xaa in position 43 is Ala or Glu
  Variant (44)..(44): Xaa in position 44 is Ser or Thr
  Variant (47)..(47): Xaa in position 47 is any amino acid
YTRAQLEXFRFXFCLLAPVAVMYYIGTDTDKKLNVPGFWPDPXXLNXIPKEPYEIKAELA

SEQ ID NO: 4335 - DNA, 915 bp, Saccharomyces cerevisiae
  CDS (1)..(915)
atgcaacaagcaactgggaacgaattactgggtatcctagatctggataacgatatagactttgaaactgcttaccaaatgctcagcagtaacttcgacgaccaaatgtctgcgcacatacatgaaaacacgtttagtgcaacttcccctcctctgttaacacacgagctcggcataattcctaacgtagcaaccgtgcaaccctctcacgtagaaactatacctgccgataaccaaactcatcatgctcctttgcatactcatgcacactatctaaatcacaaccctcatcaaccaagcatgggttttgatcaagcgcttggtctcaagttgtctccttccagttcggggttgttgagcacgaatgaatcgaatgccattgaacagtttttagacaatctaatatcacaggatatgatgtcttccaacgcttccatgaactccgaatcacatctacatataagatcaccaaaaaagcagcataggtataccgaattaaatcaaagatatcctgaaacacatccacacagtaacacaggggagttacccacaaacacagcagatgtgccaactgagttcaccacgagggaaggacctcatcagcctatcggcaatgaccactacaacccgccaccgttttcagtacctgagatacgaatcccagactctgatattccagccaatatcgaggacgaccctgtgaaggtacggaaatggaaacacgttcaaatggagaagatacgaagaataaacaccaaagaagcctttgaaaggctcattaaatcagtaaggaccccaccgaaggaaaacgggaaaagaattcccaagcatattcttttaacttgtgtaatgaacgatatcaagtccattagaagcgcaaatgaagcactacagcacatactggatgattcctga

SEQ ID NO: 4336 - protein, 304 aa, Saccharomyces cerevisiae
MQQATGNELLGILDLDNDIDFETAYQMLSSNFDDQMSAHIHENTFSATSPPLLTHELGIIPNVATVQPSHVETIPADNQTHHAPLHTHAHYLNHNPHQPSMGFDQALGLKLSPSSSGLLSTNESNAIEQFLDNLISQDMMSSNASMNSESHLHIRSPKKQHRYTELNQRYPETHPHSNTGELPTNTADVPTEFTTREGPHQPIGNDHYNPPPFSVPEIRIPDSDIPANIEDDPVKVRKWKHVQMEKIRRINTKEAFERLIKSVRTPPKENGKRIPKHILLTCVMNDIKSIRSANEALQHILDDS

SEQ ID NO: 4337 - DNA, 1299 bp, Candida glabrata CBS 138
  CDS (1)..(1299)
atgatgcaggatcatcagaaatctggagtttcttctagtcaggatctatttgatcttttcgaacagggtaatgatattgactttgagacagcatatcagatgttaagcggtacattagaagaatcagaaccattacaatttatgcacaagggtccaagacagcaagaagtaagtactcctattgcaaatatcttacctcctttagatcctattaaacctgcaacacctaatgttatgagtaacacaacaccttatgaatacgccaatacaaacctaatcaaaacacctcacgataataatattcttttttcaccggataatcatacaaagtcaatgttcagcttggatggacatactacgaaccatgggataagtaacaatcaaaagtcctattataatttcgatggcattaggagtaaacatactggatttgagggtagtgttttacctcatttttacgaatcgaaattgaccagcccacaaagacttctaaccgaaagtccacatcttcctacgatcagccaaaactttctaacaagatcaccaatatttacttctcagcctttcgaaaatcatcaaaatattggaataccaccaatgatccaggaaaagctacataacaatttcggttttcctcagaaaggattagatgatcactttaaaagtccagaattactaagttcatatgaatcacatgcgatagagaacttcttagataacctggtcgcatctgatcctttccacaatgataaaaatgatatagatttcaaaattggaaatgacaaagcagctgtgcatgaggatatgaataacaagggcaacattctcagcgctgaaattataaataataacaaatgcaattcttctattgatgtgacacaaaatagaattaattcaaccctgcataaaaattcaaactcatctgacattgtccataatagagaagactataaaaatacggatcttacaacaaaccataaaataaaaaaaataccagtaccgaaggattatcctacaaaaaatattgagctcccaggtattgtaatatcagatgatgatatacccgctgatattagacacgatatggcaaaagtacgaaaatggaagcatgttagattggaaaaactcagaagaacccattcaaaaaatgcttttgatgatctaatcaaattaatagaaaccccacatccaaatttggataaaagaataccaaagtataaactcttaggcctagtaatgaatgatatcaaagggttattagaggccaatgaaaagctcgaaaaattattaaactcctaa

SEQ ID NO: 4338 - protein, 432 aa, Candida glabrata CBS 138
MMQDHQKSGVSSSQDLFDLFEQGNDIDFETAYQMLSGTLEESEPLQFMHKGPRQQEVSTPIANILPPLDPIKPATPNVMSNTTPYEYANTNLIKTPHDNNILFSPDNHTKSMFSLDGHTTNHGISNNQKSYYNFDGIRSKHTGFEGSVLPHFYESKLTSPQRLLTESPHLPTISQNFLTRSPIFTSQPFENHQNIGIPPMIQEKLHNNFGFPQKGLDDHFKSPELLSSYESHAIENFLDNLVASDPFHNDKNDIDFKIGNDKAAVHEDMNNKGNILSAEIINNNKCNSSIDVTQNRINSTLHKNSNSSDIVHNREDYKNTDLTTNHKIKKIPVPKDYPTKNIELPGIVISDDDIPADIRHDMAKVRKWKHVRLEKLRRTHSKNAFDDLIKLIETPHPNLDKRIPKYKLLGLVMNDIKGLLEANEKLEKLLNS

SEQ ID NO: 4339 - DNA, 1158 bp, Kluyveromyces lactis NRRL Y-1140
  CDS (1)..(1158)
atggaagctcaaagccaaggtggcctcggttctctgttggacatggatttggaaggtttagatttcgagactgcctatgagttaattaatgagaaagcggaactatgggatgattcaaacgatcaatttcatatgaatcttgtagatgattctcagttcttcaaccatatgactgttgttccagagaatgcttcgacaggaggggatcagcatactaatactgatgaggaagttgacaaagtagtcaatagagatagagctttccaagaagaaaaagacacaaagccagctgcatcacaaatcacccattctgttcctagtagcagaccgcagactccccgaaaccacatttcatcacctttcggggcgtttggtgaacactctggaaactcacataacgaaggtttgttgagtgtgaacgagtcgcatgcaattgagcactttttggatagtttattaactacctcaccgtcaaaggcttctaatgccgcccttttctctccgaaactggctcaaaattttatgcgaaatgcggaacatttgggagctgatcctcatacctatattttcgaccatactgaactacaaaccacaatatccagacatttccaggataagtcaaccactaagcagggagaaaggctggacacaaagattgccattgcggcatccccatctcatgaagaaaaaaacaataatgtaaattccaaggatattctaaaaaatgacaatggtagtaaaggtaaatctactacgatagaacccatgattcttccaatattcgaatcatatgaacagtacaagccaattgatcccaaaattcctatcgttgaagttcctgaacacgtcattcctgaagatatctcaagcgatgctgcagagctgcgaaggtggaaacatgtctatttagagaaacaaagaagaaacactttcaaaagagaatacgatgagttgatcgggatgatacgatatccacgaccagtttggactgaagttcataagaatctgccgaaatcaaaagaaatcatctcccttgactacaaactcccgaagaaggaagggaaaagaatcacgaaacatacactgttaaattatatcgtccaggacatccagctgcttttactggcgaatgaggagcttgaacaactttgtaaatga

SEQ ID NO: 4340 - protein, 385 aa, Kluyveromyces lactis NRRL Y-1140
MEAQSQGGLGSLLDMDLEGLDFETAYELINEKAELWDDSNDQFHMNLVDDSQFFNHMTVVPENASTGGDQHTNTDEEVDKVVNRDRAFQEEKDTKPAASQITHSVPSSRPQTPRNHISSPFGAFGEHSGNSHNEGLLSVNESHAIEHFLDSLLTTSPSKASNAALFSPKLAQNFMRNAEHLGADPHTYIFDHTELQTTISRHFQDKSTTKQGERLDTKIAIAASPSHEEKNNNVNSKDILKNDNGSKGKSTTIEPMILPIFESYEQYKPIDPKIPIVEVPEHVIPEDISSDAAELRRWKHVYLEKQRRNTFKREYDELIGMIRYPRPVWTEVHKNLPKSKEIISLDYKLPKKEGKRITKHTLLNYIVQDIQLLLLANEELEQLCK

SEQ ID NO: 4341 - DNA, 24 bp, Artificial sequence
  primer
atgcaacaagcaactgggaacgaa

SEQ ID NO: 4342 - DNA, 24 bp, Artificial sequence
  primer
tcaggaatcatccagtatgtgctg

SEQ ID NO: 4343 - protein, 455 aa, Artificial sequence
  consensus sequence
  Variant (2)..(11): Xaa in position 2 to 11 is any amino acid
  Variant (12)..(12): Xaa in position 12 is any or no amino acid
  Variant (19)..(54): Xaa in position 19 to 54 is any amino acid
  Variant (55)..(62): Xaa in position 55 to 62 is any or no amino acid
  Variant (64)..(96): Xaa in position 64 to 96 is any amino acid
  Variant (97)..(153): Xaa in position 97 to 153 is any or no amino acid
  Variant (155)..(156): Xaa in position 155 to 156 is any amino acid
  Variant (158)..(175): Xaa in position 158 to 175 is any amino acid
  Variant (176)..(210): Xaa in position 176 to 210 is any or no amino acid
  Variant (214)..(215): Xaa in position 214 to 215 is any amino acid
  Variant (218)..(218): Xaa in position 218 is any amino acid
  Variant (222)..(222): Xaa in position 222 is any amino acid
  Variant (226)..(226): Xaa in position 226 is any amino acid
  Variant (228)..(270): Xaa in position 228 to 270 is any amino acid
  Variant (271)..(309): Xaa in position 271 to 309 is any or no amino acid
  Variant (311)..(316): Xaa in position 311 to 316 is any amino acid
  Variant (318)..(325): Xaa in position 318 to 325 is any amino acid
  Variant (326)..(326): Xaa in position 326 is any or no amino acid
  Variant (328)..(340): Xaa in position 328 to 340 is any amino acid
  Variant (341)..(341): Xaa in position 341 is any or no amino acid
  Variant (343)..(349): Xaa in position 343 to 349 is any amino acid
  Variant (351)..(358): Xaa in position 351 to 358 is any amino acid
  Variant (361)..(362): Xaa in position 361 to 362 is any amino acid
  Variant (364)..(365): Xaa in position 364 to 365 is any amino acid
  Variant (367)..(370): Xaa in position 367 to 370 is any amino acid
  Variant (372)..(372): Xaa in position 372 is any amino acid
  Variant (377)..(378): Xaa in position 377 to 378 is any amino acid
  Variant (381)..(381): Xaa in position 381 is any amino acid
  Variant (384)..(386): Xaa in position 384 to 386 is any amino acid
  Variant (388)..(392): Xaa in position 388 to 392 is any amino acid
  Variant (395)..(399): Xaa in position 395 to 399 is any amino acid
  Variant (401)..(405): Xaa in position 401 to 405 is any amino acid
  Variant (406)..(429): Xaa in position 406 to 429 is any or no amino acid
  Variant (433)..(433): Xaa in position 433 is any amino acid
  Variant (435)..(436): Xaa in position 435 to 436 is any amino acid
  Variant (439)..(443): Xaa in position 439 to 443 is any amino acid
  Variant (446)..(450): Xaa in position 446 to 450 is any amino acid
  Variant (454)..(454): Xaa in position 454 is any amino acid
LXXXXXXXXXXXDFETAYXXXXXXXXXXXXXXXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPXXPXXXXXXXXXXXXXXXXXXXXXXXXXXXXXXXXXXXXXXXXXXXXXXXXXXXXXLLSXXESXAIEXFLDXLXXXXXXXXXXXXXXXXXXXXXXXXXXXXXXXXXXXXXXXXXXXXXXXXXXXXXXXXXXXXXXXXXXXXXXXXXXXXXXXXXXNXXXXXXNXXXXXXXXXTXXXXXXXXXXXXXXYXXXXXXXPXXXXXXXXIPXXIXXDXXXXRXWKHVXXEKXRRXXXKXXXXXLIXXXXXPXXXXXXXXXXXXXXXXXXXXXXXXXXXXXKRIXKXXLLXXXXXDIXXXXXANEXL

SEQ ID NO: 4344 - protein, 49 aa, Artificial sequence
  protein pattern
  Variant (2)..(2): Xaa in position 2 is Ala or Glu
  Variant (3)..(3): Xaa in position 3 is Asp or Asn
  Variant (5)..(5): Xaa in position 5 is Glu, Arg or Ser
  Variant (6)..(6): Xaa in position 6 is any amino acid
  Variant (8)..(8): Xaa in position 8 is any amino acid
  Variant (9)..(9): Xaa in position 9 is Ala or Val
  Variant (10)..(10): Xaa in position 10 is Glu or Lys
  Variant (11)..(11): Xaa in position 11 is Leu or Val
  Variant (13)..(14): Xaa in position 13 to 14 is any or no amino acid
  Variant (16)..(17): Xaa in position 16 to 17 is any or no amino acid
  Variant (20)..(20): Xaa in position 20 is any amino acid
  Variant (21)..(21): Xaa in position 21 is Leu or Met
  Variant (24)..(24): Xaa in position 24 is any amino acid
  Variant (27)..(29): Xaa in position 27 to 29 is any amino acid
  Variant (31)..(31): Xaa in position 31 is Glu, Asn or Arg
  Variant (32)..(32): Xaa in position 32 is Ala or Glu
  Variant (33)..(33): Xaa in position 33 is Phe or Tyr
  Variant (34)..(34): Xaa in position 34 is Asp or Glu
  Variant (35)..(35): Xaa in position 35 is Asp, Glu or Arg
  Variant (38)..(39): Xaa in position 38 to 39 is any amino acid
  Variant (40)..(40): Xaa in position 40 is Ile or Val
  Variant (41)..(41): Xaa in position 41 is Glu or Arg
  Variant (42)..(42): Xaa in position 42 is any amino acid
  Variant (44)..(47): Xaa in position 44 to 47 is any amino acid
  Variant (48)..(48): Xaa in position 48 is Asp, Gly or Thr
  Variant (49)..(49): Xaa in position 49 is Glu or Lys
PXXIXXDXXXXRXXKXXHVXXEKXRRXXXKXXXXXLIXXXXXPXXXXXX

SEQ ID NO: 4345 - protein, 8 aa, Artificial sequence
  protein pattern
  Variant (7)..(7): Xaa in position 7 is Glu or Gln
  Variant (8)..(8): Xaa in position 8 is Leu or Met
DFETAYXX

SEQ ID NO: 4346 - DNA, 1992 bp, Saccharomyces cerevisiae
  CDS (1)..(1992)
atgcgtgcgcacagaatcgatacatttctcataagagaaaacatcaaactggagatcatacatgaatcgaattcctattttggtggagaacatatatcaattgctttccgatttaagcacctaggctcacagcatgaattgttcaactataaagaaaagcttctcactgtcgataaagctgttgaagagaagttggaacaacaagcgaaagtgcaagatgatggtgaaggcacgatggaaaatcaaacctggtccctaaaatcattactaggtgccttcaaaagaacaggcgaacctgaagagagtgtggatgtggataacatgaaaatgctaaatgagagtaagatgttaagagaaaaaatacagaagcaaatgtattttcatcaacctgtaacgttaatatccggttatgttcaaatatcgggggtctttcaatacgattcagaggtaatttcagagtcaaaatttaaacaagatgaagtaaaaatggtaggactagatattgtacctggacatacgacaaattctgttcttgcattggaagatggagaacatttcaaaggtaaaagaaatttaaccaactacctcaactcagattatacaaatgtgaccaatggtcttcttttctcagaaagcggttctaggggaagaacaggtacctataacgaacggaccttaatgatatcaaacgataccagtataaaaacattacctcttcttttaataccacagacgcttttattttctgaaatttctttagaaccaggtgaagtaagaacattctattttaaatccacaaagctgccaaaagatatatgcccaagttattcatcgtcaaaagtggcatcaataaattacacgctggaggttggtgcggatgtactttctgatgataatatcgagaaattttcaaatagagtcccaataacaatagcaccatatattagttcgaatgccgaacagtacacatcacgtctggataagcctgctatcatattaaagacaggtaacataaaggaactaaagccacgtttgtttactcgaaaagtttctacggcttctgctgtatcatttggtaggagaaaatcttctataattgacattgattctccattagaagataatgaatttgtcaagcgtgtcaaaaaaaacttcattgaactggtggaatctaaccaaaatgtgtcaagagatatagacgaacttattgacttgcaaatgggggtacagttcggaaaggatgaggattcttcggatcctgaacccaacgactcacacttttcgaacgaaatggtgacgtctgcagagtctagcctgagaagcgatgctgtaactaagaggagaaaaagttattcggtacgcgataacatttctaacctcgagcaaaagatgtggaacgattgttctctcgttaagtcagatgagaattctaatcttctacctcagctaattaatttacagaacgcatatcaaattaacagaaataatgagactatggcaaaagtatccttatcagcacctttttataagacaactgatgatataaatttagtcattgaattagatccgataacgacgcctttacttaaagtgacttcgttgactgtatccttagaatcgtttgaaattataaatccaaaatataagactgaaggaaaaggaatagggagcaaaccaaaaggaaactcggtgtatgagaaacattttatttgtttcgatgagtgcaagtccgtatcggtgaaattacttcctccaagatcgcctacaaaccagattaccggacaattcaagacagatgtttttcaacataagtggatgataggactaaaatttgtaataattgcaaagacagaaagtatcactttggatcaattttatgaggataaaaagggcatcctattccattcaaaagagaatttagaaggtgaagagtttacatgttacgttcccattccaatactgtgtacatccgaagatttcatgggatggtaa

SEQ ID NO: 4347 - protein, 663 aa, Saccharomyces cerevisiae
MRAHRIDTFLIRENIKLEIIHESNSYFGGEHISIAFRFKHLGSQHELFNYKEKLLTVDKAVEEKLEQQAKVQDDGEGTMENQTWSLKSLLGAFKRTGEPEESVDVDNMKMLNESKMLREKIQKQMYFHQPVTLISGYVQISGVFQYDSEVISESKFKQDEVKMVGLDIVPGHTTNSVLALEDGEHFKGKRNLTNYLNSDYTNVTNGLLFSESGSRGRTGTYNERTLMISNDTSIKTLPLLLIPQTLLFSEISLEPGEVRTFYFKSTKLPKDICPSYSSSKVASINYTLEVGADVLSDDNIEKFSNRVPITIAPYISSNAEQYTSRLDKPAIILKTGNIKELKPRLFTRKVSTASAVSFGRRKSSIIDIDSPLEDNEFVKRVKKNFIELVESNQNVSRDIDELIDLQMGVQFGKDEDSSDPEPNDSHFSNEMVTSAESSLRSDAVTKRRKSYSVRDNISNLEQKMWNDCSLVKSDENSNLLPQLINLQNAYQINRNNETMAKVSLSAPFYKTTDDINLVIELDPITTPLLKVTSLTVSLESFEIINPKYKTEGKGIGSKPKGNSVYEKHFICFDECKSVSVKLLPPRSPTNQITGQFKTDVFQHKWMIGLKFVIIAKTESITLDQFYEDKKGILFHSKENLEGEEFTCYVPIPILCTSEDFMGW

SEQ ID NO: 4348 - DNA, 2034 bp, Candida glabrata CBS 138
  CDS (1)..(2034)
atgcatcttcacaaaattgatgcattttacataactgataatgttaaggtagaactaatacatgaatcgaatccattttttgcaggggaacccatatcgattattgtgaggataaagcatttggggtctctaagagaaagagaccatttggaaactacactaaataacttgaatgggaaaatacagaggatacgacaggaaaatagggaaatcttagaaaatgaaataccagaaagtaaatggtcactaagaaatatgttttcgaagaagaatggtgatgagtctgctcaaaatgcaactgatagtaatttaacattgatcacagatgtcaaagaacaattggtattgctagaaaaaagcagagaaagactgacaaaagatctgaaattcaactccatagtaaattttgtctcttgctacttacaggtaagtggtaagttacaatacgacaattccataatagataaaagtaccttcaaatcaaatgattctaagctattaggagtaacatatgccgattcaactgcaaaacagttaaatgaagaatctataagcaaatctgataaatatgttaattctgaatacgctaatataacagaaggcttgcggtttgggtatagagaagatgaaaagattataaatgatactaacatctctatgggagccaatgatagagaaaattctaatgccgagtatgaacaagttccgatattcttgattccacaaactttaattttctctgaaatcaatttagaaccaggggaagcaaaaactttcttatttaagtctcaacctttgaataaagaaatttgtccaacatacatgctttcaaactttctctcagttctttatgatgccgagtttggtataactggtgttgttgatggtaatcttattcctattgctaaaaaagttcctatttcaattgcaccatatgtattagaaggtggtatgcaggcctcatctgttctaaatcgccctgccgttattcagggttctggaacagtaaaggagattaagtcatcaccctcttcgataagaagagcatctgctccacaaaaccatgtctctaacactttagaaaggagatattctgttgaaagaagaagctcgttatatgaaaggagactatctattaattttgaaagaaaaaactcaaacccaacagttgttgatgatattgaacctgagagattatctttaatgaaagaaaactttattaagattatcagtgataaagagacaaactatgatgatattgataagcttgtggataatttagtcgaggttcaatttgataaagacgaaaaagacaaggattccaagcctgacattgaacttgaggaggaacacaaaaatgaggagtatgtggttacgaggaagagaagtgactctgtgcgtgatcacattgcagaactacagaacactcctaatatgcaatataatgtggagtcgtatgtcattgatggtgtcacgatgatcccacaacttgctaacttacaaagtacatatcaaattaacaggaatggtgaaacaattgcaaaggtagttttttcaaaaccattctttatgacttcagatgatattgatatatccgtgaccttagatgattgcgatgagaggcaaactagaataactggtatttctgccatacttcaatcttttgtactactgaatcctcgatttgctgttgataaaacttcaaaggcagcaagaccaaaaggaaaaactgttgcagtcgataactctataagttttgatgacttcacatcaatctcgttcaagttgagtccctctaagactccgacaaaccatattgctggtcaatttaaatctgatattttccaacacaaatggatggtgcttctaaaatttgtaatacaaaaacctattgaagatggtcacttagaacaattttatgaagataagaagggtaggttatttcatgccaaagaaactatggaaggagaggaattttcctgccacattccaattcctataattactgcctctcaagaattcggtggatggtga

SEQ ID NO: 4349 - protein, 677 aa, Candida glabrata CBS 138
MHLHKIDAFYITDNVKVELIHESNPFFAGEPISIIVRIKHLGSLRERDHLETTLNNLNGKIQRIRQENREILENEIPESKWSLRNMFSKKNGDESAQNATDSNLTLITDVKEQLVLLEKSRERLTKDLKFNSIVNFVSCYLQVSGKLQYDNSIIDKSTFKSNDSKLLGVTYADSTAKQLNEESISKSDKYVNSEYANITEGLRFGYREDEKIINDTNISMGANDRENSNAEYEQVPIFLIPQTLIFSEINLEPGEAKTFLFKSQPLNKEICPTYMLSNFLSVLYDAEFGITGVVDGNLIPIAKKVPISIAPYVLEGGMQASSVLNRPAVIQGSGTVKEIKSSPSSIRRASAPQNHVSNTLERRYSVERRSSLYERRLSINFERKNSNPTVVDDIEPERLSLMKENFIKIISDKETNYDDIDKLVDNLVEVQFDKDEKDKDSKPDIELEEEHKNEEYVVTRKRSDSVRDHIAELQNTPNMQYNVESYVIDGVTMIPQLANLQSTYQINRNGETIAKVVFSKPFFMTSDDIDISVTLDDCDERQTRITGISAILQSFVLLNPRFAVDKTSKAARPKGKTVAVDNSISFDDFTSISFKLSPSKTPTNHIAGQFKSDIFQHKWMVLLKFVIQKPIEDGHLEQFYEDKKGRLFHAKETMEGEEFSCHIPIPIITASQEFGGW

SEQ ID NO: 4350 - DNA, 1794 bp, Kluyveromyces lactis NRRL Y-1140
  CDS (1)..(1794)
atgcatcttcatagaagggaccgtgctgttgttggagggaatattcgactggaaatcattcacgaatctaatccttgtttcgctggcgaaccgatatgtttattgataaggttaaagcatttgggctcacaacatcagaaagaatctttagagaagaaacttgtcgtgtttgaggaaaaaagggataagtttttggccaatctgaataatgacgagtccaagccatggttaatgaggactttatggaatactttccagcaagaagacaagtataaagatgaagctttgcaggaacaaatttttgctttgaagaagaaattgcagttccataatcccgtggatctaatgtcttgcttcgtgcaaatcgtcggacagtgttctatggatgaggcaataataaatacagatatgctaaacacaggatccaatgttcatcaattggtaggaattggttccaaaaacgcaagtactgatgaaaattccccaatgtctaccgtcatttcatctttcttcgatacgagcatggacgaaatatcacggaaggtggcccctttgatgtctacggagaccatcgataccggtgattggataaaagcgccattcttacttataccacagacgcttttattctccgaattgattttagggccgggcgaaactaggttattcaagttcaagacggaccaattagggaaagatcttccgccttcttatacgaactctgctcatttcaatatatcatatgtcgtacaggtgggactttcggtgaatgctccagaagatatccctcaccaacacttttacaacttccctatttctgtacaaccgtttgttgataagagtatatgccaatatgagatgccacttgatagagaagtactcatcacaccaccgggaaaagttcaagatgttgggagtactataaaatctacaaaacccaggaaattaacaggccaatccatccagttagatagagaaataagaagaaagagcgtgtcaagtatcgggaaaccttcaggaacttcgattgaagccatgaaacaaaagtttaaagacgtagtctcagaatggaatgaaaatgatgattccgacgtacccattgattcattattaggccaacaatttgaaacagaaccctcaacctcagtccgaatgaacttgtcgcaattttattttacaggtatcccagagaactctattgatgagacgcaaagcaattcttcgctactatcgcagttgcagtcattacaaactgagtatgttgtaaaaatgaatgataagttcatttgtaatttagaactctccaaaccagcgtactctgtttccgatcaaatcgatataatacttgacttgaaaaatgtagaagataattccaattttaaagtgactgctgtgacagcatccatcgaaacatttgagttgattaatccaaaattctcgtcagatgaaaatatctcaaagaagaagccttcgggaactttagtctacgaaactcacgctacaaatttcgataattgcgataagatttgcatgaaacttattcctcaatgctctcccacgacttacattactagtcaatttaaaacaaacatatttcaacttaaatggatgctaacatttaaatttgtcatgattccattagctgagcaaaacactgaaatatcattgagtaaaacctatgaggaccgaaaaggtaccctataccatgccaaaagagacatggagggatacgatttcgtatttcacgtgccccttacagttttgcctacagaaaaacagctagcaggctggtaa

SEQ ID NO: 4351 - protein, 597 aa, Kluyveromyces lactis NRRL Y-1140
MHLHRRDRAVVGGNIRLEIIHESNPCFAGEPICLLIRLKHLGSQHQKESLEKKLVVFEEKRDKFLANLNNDESKPWLMRTLWNTFQQEDKYKDEALQEQIFALKKKLQFHNPVDLMSCFVQIVGQCSMDEAIINTDMLNTGSNVHQLVGIGSKNASTDENSPMSTVISSFFDTSMDEISRKVAPLMSTETIDTGDWIKAPFLLIPQTLLFSELILGPGETRLFKFKTDQLGKDLPPSYTNSAHFNISYVVQVGLSVNAPEDIPHQHFYNFPISVQPFVDKSICQYEMPLDREVLITPPGKVQDVGSTIKSTKPRKLTGQSIQLDREIRRKSVSSIGKPSGTSIEAMKQKFKDVVSEWNENDDSDVPIDSLLGQQFETEPSTSVRMNLSQFYFTGIPENSIDETQSNSSLLSQLQSLQTEYVVKMNDKFICNLELSKPAYSVSDQIDIILDLKNVEDNSNFKVTAVTASIETFELINPKFSSDENISKKKPSGTLVYETHATNFDNCDKICMKLIPQCSPTTYITSQFKTNIFQLKWMLTFKFVMIPLAEQNTEISLSKTYEDRKGTLYHAKRDMEGYDFVFHVPLTVLPTEKQLAGW

SEQ ID NO: 4352 - DNA, 23 bp, Artificial sequence
  primer
atgcgtgcgcacagaatcgatac

SEQ ID NO: 4353 - DNA, 25 bp, Artificial sequence
  primer
ttaccatcccatgaaatcttcggat

SEQ ID NO: 4354 - protein, 700 aa, Artificial sequence
  consensus sequence
  Variant (2)..(3): Xaa in position 2 to 3 is any amino acid
  Variant (5)..(6): Xaa in position 5 to 6 is any amino acid
  Variant (8)..(13): Xaa in position 8 to 13 is any amino acid
  Variant (15)..(17): Xaa in position 15 to 17 is any amino acid
  Variant (19)..(19): Xaa in position 19 is any amino acid
  Variant (25)..(26): Xaa in position 25 to 26 is any amino acid
  Variant (28)..(28): Xaa in position 28 is any amino acid
  Variant (31)..(31): Xaa in position 31 is any amino acid
  Variant (33)..(36): Xaa in position 33 to 36 is any amino acid
  Variant (38)..(38): Xaa in position 38 is any amino acid
  Variant (44)..(53): Xaa in position 44 to 53 is any amino acid
  Variant (55)..(75): Xaa in position 55 to 75 is any amino acid
  Variant (76)..(83): Xaa in position 76 to 83 is any or no amino acid
  Variant (85)..(112): Xaa in position 85 to 112 is any amino acid
  Variant (113)..(128): Xaa in position 113 to 128 is any or no amino acid
  Variant (130)..(132): Xaa in position 130 to 132 is any amino acid
  Variant (134)..(136): Xaa in position 134 to 136 is any amino acid
  Variant (138)..(140): Xaa in position 138 to 140 is any amino acid
  Variant (142)..(144): Xaa in position 142 to 144 is any amino acid
  Variant (146)..(147): Xaa in position 146 to 147 is any amino acid
  Variant (149)..(152): Xaa in position 149 to 152 is any amino acid
  Variant (154)..(156): Xaa in position 154 to 156 is any amino acid
  Variant (158)..(170): Xaa in position 158 to 170 is any amino acid
  Variant (171)..(172): Xaa in position 171 to 172 is any or no amino acid
  Variant (174)..(223): Xaa in position 174 to 223 is any amino acid
  Variant (224)..(245): Xaa in position 224 to 245 is any or no amino acid
  Variant (247)..(248): Xaa in position 247 to 248 is any amino acid
  Variant (255)..(255): Xaa in position 255 is any amino acid
  Variant (259)..(260): Xaa in position 259 to 260 is any amino acid
  Variant (262)..(262): Xaa in position 262 is any amino acid
  Variant (266)..(268): Xaa in position 266 to 268 is any amino acid
  Variant (270)..(270): Xaa in position 270 is any amino acid
  Variant (273)..(275): Xaa in position 273 to 275 is any amino acid
  Variant (277)..(277): Xaa in position 277 is any amino acid
  Variant (279)..(281): Xaa in position 279 to 281 is any amino acid
  Variant (283)..(283): Xaa in position 283 is any amino acid
  Variant (285)..(286): Xaa in position 285 to 286 is any amino acid
  Variant (288)..(293): Xaa in position 288 to 293 is any amino acid
  Variant (295)..(298): Xaa in position 295 to 298 is any amino acid
  Variant (300)..(315): Xaa in position 300 to 315 is any amino acid
  Variant (316)..(316): Xaa in position 316 is any or no amino acid
  Variant (319)..(321): Xaa in position 319 to 321 is any amino acid
  Variant (323)..(329): Xaa in position 323 to 329 is any amino acid
  Variant (331)..(334): Xaa in position 331 to 334 is any amino acid
  Variant (336)..(340): Xaa in position 336 to 340 is any amino acid
  Variant (342)..(344): Xaa in position 342 to 344 is any amino acid
  Variant (346)..(365): Xaa in position 346 to 365 is any amino acid
  Variant (366)..(367): Xaa in position 366 to 367 is any or no amino acid
  Variant (369)..(370): Xaa in position 369 to 370 is any amino acid
  Variant (371)..(372): Xaa in position 371 to 372 is any or no amino acid
  Variant (374)..(375): Xaa in position 374 to 375 is any amino acid
  Variant (376)..(380): Xaa in position 376 to 380 is any or no amino acid
  Variant (383)..(394): Xaa in position 383 to 394 is any amino acid
  Variant (395)..(413): Xaa in position 395 to 413 is any or no amino acid
  Variant (415)..(416): Xaa in position 415 to 416 is any amino acid
  Variant (418)..(428): Xaa in position 418 to 428 is any amino acid
  Variant (429)..(429): Xaa in position 429 is any or no amino acid
  Variant (431)..(431): Xaa in position 431 is any amino acid
  Variant (433)..(435): Xaa in position 433 to 435 is any amino acid
  Variant (437)..(441): Xaa in position 437 to 441 is any amino acid
  Variant (444)..(447): Xaa in position 444 to 447 is any amino acid
  Variant (448)..(481): Xaa in position 448 to 481 is any or no amino acid
  Variant (483)..(483): Xaa in position 483 is any amino acid
  Variant (487)..(513): Xaa in position 487 to 513 is any amino acid
  Variant (514)..(514): Xaa in position 514 is any or no amino acid
  Variant (517)..(518): Xaa in position 517 to 518 is any amino acid
  Variant (521)..(522): Xaa in position 521 to 522 is any amino acid
  Variant (524)..(527): Xaa in position 524 to 527 is any amino acid
  Variant (529)..(537): Xaa in position 529 to 537 is any amino acid
  Variant (539)..(539): Xaa in position 539 is any amino acid
  Variant (541)..(545): Xaa in position 541 to 545 is any amino acid
  Variant (547)..(547): Xaa in position 547 is any amino acid
  Variant (549)..(553): Xaa in position 549 to 553 is any amino acid
  Variant (555)..(564): Xaa in position 555 to 564 is any amino acid
  Variant (565)..(565): Xaa in position 565 is any or no amino acid
  Variant (567)..(574): Xaa in position 567 to 574 is any amino acid
  Variant (576)..(578): Xaa in position 576 to 578 is any amino acid
  Variant (581)..(592): Xaa in position 581 to 592 is any amino acid
  Variant (594)..(594): Xaa in position 594 is any amino acid
  Variant (596)..(597): Xaa in position 596 to 597 is any amino acid
  Variant (599)..(605): Xaa in position 599 to 605 is any amino acid
  Variant (608)..(614): Xaa in position 608 to 614 is any amino acid
  Variant (617)..(617): Xaa in position 617 is any amino acid
  Variant (619)..(621): Xaa in position 619 to 621 is any amino acid
  Variant (624)..(625): Xaa in position 624 to 625 is any amino acid
  Variant (627)..(628): Xaa in position 627 to 628 is any amino acid
  Variant (632)..(634): Xaa in position 632 to 634 is any amino acid
  Variant (637)..(637): Xaa in position 637 is any amino acid
  Variant (641)..(643): Xaa in position 641 to 643 is any amino acid
  Variant (647)..(651): Xaa in position 647 to 651 is any amino acid
  Variant (653)..(655): Xaa in position 653 to 655 is any amino acid
  Variant (656)..(658): Xaa in position 656 to 658 is any or no amino acid
  Variant (660)..(662): Xaa in position 660 to 662 is any amino acid
  Variant (666)..(666): Xaa in position 666 is any amino acid
  Variant (669)..(669): Xaa in position 669 is any amino acid
  Variant (671)..(671): Xaa in position 671 is any amino acid
  Variant (673)..(673): Xaa in position 673 is any amino acid
  Variant (675)..(677): Xaa in position 675 to 677 is any amino acid
  Variant (680)..(681): Xaa in position 680 to 681 is any amino acid
  Variant (683)..(686): Xaa in position 683 to 686 is any amino acid
  Variant (688)..(698): Xaa in position 688 to 698 is any amino acid
MXXHXXDXXXXXXNXXXEXIHESNXXFXGEXIXXXXRXKHLGSXXXXXXXXXXLXXXXXXXXXXXXXXXXXXXXXXXXXXXXXWXXXXXXXXXXXXXXXXXXXXXXXXXXXXXXXXXXXXXXXXXXXXKXXXFXXXVXXXSXXXQXXGXXXXDXXXIXXXXXXXXXXXXXXXGXXXXXXXXXXXXXXXXXXXXXXXXXXXXXXXXXXXXXXXXXXXXXXXXXXXXXXXXXXXXXXXXXXXXXXXXPXXLIPQTLXFSEXXLXPGEXXXFXFKXXXLXKXXXPXYXXSXXXXXXYXXXXGXXXXXXXXXXXXXXXXXPIXXXPXXXXXXXQXXXXLXXXXXIXXXGXXXXXXXXXXXXXXXXXXXXXXSXXXXRXXXXXXXSSXXXXXXXXXXXXXXXXXXXXXXXXXXXXXXXKXXFXXXXXXXXXXXXDXDXXXDXXXXXQFXXXXXXXXXXXXXXXXXXXXXXXXXXXXXXXXXXXXXXSXSVRXXXXXXXXXXXXXXXXXXXXXXXXXXXXQLXXLQXXYXXXXNXXXXXXXXXSXPXXXXXDXIXXXXXLXXXXXXXXXXXTXXXXXXXXFXXXNPXXXXXXXXXXXXPXGXXVXXXXXXXFDXXXXXXXKLXPXXXPTXXIXXQFKXXXFQXKWMXXXKFVXXXXXEXXXXXXLXXXYEDXKGXLXHXKXXXEGXXFXXXXPXXXXXXXXXXXGW

SEQ ID NO: 4355 - protein, 57 aa, Artificial sequence
  protein pattern
  Variant (2)..(3): Xaa in position 2 to 3 is any or no amino acid
  Variant (5)..(6): Xaa in position 5 to 6 is any amino acid
  Variant (8)..(13): Xaa in position 8 to 13 is any amino acid
  Variant (14)..(14): Xaa in position 14 is Cys, Asn or Ser
  Variant (17)..(17): Xaa in position 17 is Asp, Glu or Asn
  Variant (18)..(20): Xaa in position 18 to 20 is any amino acid
  Variant (21)..(21): Xaa in position 21 is Ile or Val
  Variant (22)..(22): Xaa in position 22 is Cys or Ser
  Variant (23)..(23): Xaa in position 23 is Phe, Met or Val
  Variant (26)..(26): Xaa in position 26 is any amino acid
  Variant (28)..(28): Xaa in position 28 is Pro, Gln or Ser
  Variant (29)..(29): Xaa in position 29 is any amino acid
  Variant (30)..(30): Xaa in position 30 is Ser or Thr
  Variant (33)..(33): Xaa in position 33 is Asn or Thr
  Variant (34)..(34): Xaa in position 34 is any amino acid
  Variant (36)..(36): Xaa in position 36 is Ala or Thr
  Variant (37)..(37): Xaa in position 37 is Gly or Ser
  Variant (41)..(41): Xaa in position 41 is Ser or Thr
  Variant (42)..(42): Xaa in position 42 is Asp or Asn
  Variant (43)..(43): Xaa in position 43 is Ile or Val
  Variant (46)..(46): Xaa in position 46 is any amino acid
  Variant (50)..(50): Xaa in position 50 is Ile, Leu or Val
  Variant (51)..(51): Xaa in position 51 is any amino acid
  Variant (52)..(52): Xaa in position 52 is Phe or Leu
  Variant (56)..(56): Xaa in position 56 is any or no amino acid
KXXGXXVXXXXXXXFDXXXXXXXKLXPXXXPTXXIXXQFKXXXFQXKWMXXXKFVXI

SEQ ID NO: 4356 - protein, 47 aa, Artificial sequence
  protein pattern
  Variant (2)..(3): Xaa in position 2 to 3 is any or no amino acid
  Variant (5)..(6): Xaa in position 5 to 6 is any amino acid
  Variant (7)..(8): Xaa in position 7 to 8 is any or no amino acid
  Variant (10)..(12): Xaa in position 10 to 12 is any amino acid
  Variant (13)..(13): Xaa in position 13 is Ile or Val
  Variant (14)..(14): Xaa in position 14 is any amino acid
  Variant (15)..(15): Xaa in position 15 is Asp, Glu or Gly
  Variant (17)..(17): Xaa in position 17 is Ile or Val
  Variant (18)..(18): Xaa in position 18 is Lys or Arg
  Variant (19)..(19): Xaa in position 19 is Leu or Val
  Variant (21)..(21): Xaa in position 21 is Ile or Leu
  Variant (27)..(27): Xaa in position 27 is Pro or Ser
  Variant (28)..(28): Xaa in position 28 is any amino acid
  Variant (30)..(30): Xaa in position 30 is Ala or Gly
  Variant (33)..(33): Xaa in position 33 is any amino acid
  Variant (35)..(35): Xaa in position 35 is Cys or Ser
  Variant (36)..(36): Xaa in position 36 is Ile or Leu
  Variant (37)..(37): Xaa in position 37 is Ala, Ile or Leu
  Variant (38)..(38): Xaa in position 38 is Phe, Ile or Val
  Variant (40)..(40): Xaa in position 40 is Phe, Ile or Leu
  Variant (46)..(46): Xaa in position 46 is any amino acid
  Variant (47)..(47): Xaa in position 47 is His or Arg
MXXHXXXXDXXXXXXNXXXEXIHESNXXFXGEXIXXXXRXKHLGSXX

SEQ ID NO: 4357 - protein, 40 aa, Artificial sequence
  protein pattern
  Variant (2)..(6): Xaa in position 2 to 6 is any or no amino acid
  Variant (9)..(9): Xaa in position 9 is any amino acid
  Variant (11)..(11): Xaa in position 11 is Phe or Tyr
  Variant (13)..(13): Xaa in position 13 is Ala or Ser
  Variant (15)..(15): Xaa in position 15 is Glu or Arg
  Variant (16)..(16): Xaa in position 16 is Asp, Asn or Thr
  Variant (17)..(17): Xaa in position 17 is Leu or Met
  Variant (20)..(20): Xaa in position 20 is any amino acid
  Variant (21)..(21): Xaa in position 21 is Asp or Glu
  Variant (23)..(23): Xaa in position 23 is Ser, Thr or Val
  Variant (24)..(24): Xaa in position 24 is any amino acid
  Variant (25)..(25): Xaa in position 25 is His or Tyr
  Variant (26)..(26): Xaa in position 26 is Ile or Val
  Variant (28)..(28): Xaa in position 28 is Ile or Leu
  Variant (29)..(29): Xaa in position 29 is Pro or Thr
  Variant (30)..(30): Xaa in position 30 is Ile or Val
  Variant (31)..(31): Xaa in position 31 is Ile or Leu
  Variant (32)..(32): Xaa in position 32 is Cys, Pro or Thr
  Variant (33)..(33): Xaa in position 33 is Ala or Thr
  Variant (34)..(34): Xaa in position 34 is Glu or Ser
  Variant (35)..(35): Xaa in position 35 is any amino acid
  Variant (36)..(36): Xaa in position 36 is Asp, Glu or Gln
  Variant (37)..(37): Xaa in position 37 is Phe or Leu
  Variant (38)..(38): Xaa in position 38 is any amino acid
KXXXXXKGXLXHXKXXXEGXXFXXXXPXXXXXXXXXXXGW

SEQ ID NO: 4358 - protein, 55 aa, Artificial sequence
  protein pattern
  Variant (2)..(4): Xaa in position 2 to 4 is any amino acid
  Variant (10)..(10): Xaa in position 10 is Ile or Leu
  Variant (14)..(14): Xaa in position 14 is any or no amino acid
  Variant (16)..(16): Xaa in position 16 is any or no amino acid
  Variant (18)..(18): Xaa in position 18 is Glu or Gly
  Variant (22)..(22): Xaa in position 22 is Ala, Thr or Val
  Variant (23)..(23): Xaa in position 23 is Lys or Arg
  Variant (24)..(24): Xaa in position 24 is any amino acid
  Variant (26)..(26): Xaa in position 26 is any amino acid
  Variant (29)..(29): Xaa in position 29 is Ser or Thr
  Variant (30)..(30): Xaa in position 30 is Asp, Gln or Thr
  Variant (31)..(31): Xaa in position 31 is any amino acid
  Variant (33)..(33): Xaa in position 33 is Gly, Asn or Pro
  Variant (35)..(35): Xaa in position 35 is Asp or Glu
  Variant (36)..(36): Xaa in position 36 is Ile or Leu
  Variant (37)..(37): Xaa in position 37 is Cys or Pro
  Variant (39)..(39): Xaa in position 39 is Ser or Thr
  Variant (41)..(42): Xaa in position 41 to 42 is any amino acid
  Variant (44)..(46): Xaa in position 44 to 46 is any amino acid
  Variant (47)..(47): Xaa in position 47 is Asn or Ser
  Variant (48)..(48): Xaa in position 48 is Ile or Val
  Variant (49)..(49): Xaa in position 49 is any amino acid
  Variant (51)..(51): Xaa in position 51 is Asp, Thr or Val
  Variant (52)..(52): Xaa in position 52 is Ala, Leu or Val
  Variant (53)..(53): Xaa in position 53 is Glu or Gln
  Variant (54)..(54): Xaa in position 54 is Phe or Val
PXXXIPQTLXFSEXIXLXPGEXXXFXFKXXXLXKXXXPXYXXSXXXXXXYXXXXG

SEQ ID NO: 4359 - protein, 34 aa, Artificial sequence
  protein pattern
  Variant (3)..(3): Xaa in position 3 is any amino acid
  Variant (4)..(4): Xaa in position 4 is Asn or Ser
  Variant (7)..(7): Xaa in position 7 is Asn, Ser or Thr
  Variant (8)..(8): Xaa in position 8 is Ala, Glu or Thr
  Variant (10)..(10): Xaa in position 10 is any amino acid
  Variant (11)..(17): Xaa in position 11 to 17 is any or no amino acid
  Variant (19)..(19): Xaa in position 19 is Cys or Asn
  Variant (20)..(20): Xaa in position 20 is Asn or Arg
  Variant (21)..(21): Xaa in position 21 is any amino acid
  Variant (22)..(22): Xaa in position 22 is Glu, Gly or Asn
  Variant (23)..(23): Xaa in position 23 is any amino acid
  Variant (24)..(24): Xaa in position 24 is Ser or Thr
  Variant (25)..(25): Xaa in position 25 is any amino acid
  Variant (26)..(26): Xaa in position 26 is Ala or Pro
  Variant (27)..(28): Xaa in position 27 to 28 is any amino acid
  Variant (29)..(29): Xaa in position 29 is Ser or Val
  Variant (30)..(30): Xaa in position 30 is Phe, Leu or Val
  Variant (32)..(32): Xaa in position 32 is any amino acid
  Variant (33)..(33): Xaa in position 33 is Pro or Gln
  Variant (34)..(34): Xaa in position 34 is Phe or Ile
QLXXLQXXYXXXXXXXXIXXXXXXXXXXXXSXXX

SEQ ID NO: 4360 - protein, 15 aa, Artificial sequence
  protein pattern
  Variant (2)..(2): Xaa in position 2 is Cys or Gly
  Variant (3)..(3): Xaa in position 3 is Phe or Tyr
  Variant (4)..(4): Xaa in position 4 is Leu or Val
  Variant (6)..(6): Xaa in position 6 is Ile or Val
  Variant (7)..(7): Xaa in position 7 is Ser or Val
  Variant (9)..(10): Xaa in position 9 to 10 is any or no amino acid
  Variant (12)..(12): Xaa in position 12 is any amino acid
  Variant (13)..(14): Xaa in position 13 to 14 is any or no amino acid
SXXXQXXGXXQXXXD

SEQ ID NO: 4361 - DNA, 1770 bp, Saccharomyces cerevisiae
  CDS (1)..(1770)
atgagtggagtatcaaataaaacagtatcaattaatggttggtatggcatgccaattcatttactaagggaagaaggcgactttgcccagtttatgattctaaccatcaacgaattaaaaatagccatacatggttacctcagaaataccccatggtacaacatgttgaaggattatttgtttgtgatcttttgttacaagctaataagtaattttttttatctgttgaaagtttatgggccggtgaggttagcagtgagaacatacgagcatagttccagaagattgtttcgttggttattggactcaccatttttgaggggtaccgtagaaaaggaagtcacaaaggtcaaacaatcgatcgaagacgaactaattagatcggactctcagttaatgaatttcccacagttgccatccaatgggatacctcaggatgatgttattgaagagctaaataaattgaacgacttgataccacatacccaatggaaggaaggaaaggtctctggtgccgtttaccacggtggtgatgatttgatccacttacaaacaatcgcatacgaaaaatattgcgttgccaatcaattacatcccgatgtctttcctgccgtacgtaaaatggaatccgaagtggtttctatggttttaagaatgtttaatgccccttctgatacaggttgtggtaccacaacttcaggtggtacagaatccttgcttttagcatgtctgagcgctaaaatgtatgcccttcatcatcgtggaatcaccgaaccagaaataattgctcccgtaactgcacatgctgggtttgacaaagctgcttattactttggcatgaagctacgccacgtggagctagatccaacgacatatcaagtggacctgggaaaagtgaaaaaattcatcaataagaacacaattttactggtcggttccgctccaaactttcctcatggtattgccgatgatattgaaggattgggtaaaatagcacaaaaatataaacttcctttacacgtcgacagttgtctaggttcctttattgtttcatttatggaaaaggctggttacaaaaatctgccattacttgactttagagtcccgggagtcacctcaatatcatgtgacactcataaatatggatttgcaccaaaaggctcgtcagttataatgtatagaaacagcgacttacgaatgcatcagtattacgtaaatcctgcttggactggcgggttatatggctctcctacattagcagggtccaggcctggtgctattgtcgtaggttgttgggccactatggtcaacatgggtgaaaatgggtacattgagtcgtgccaagaaatagtcggtgcagcaatgaagtttaaaaaatacatccaggaaaacattccagacctgaatataatgggcaaccctagatattcagtcatttcattttcttcaaagaccttgaacatacacgaactatctgacaggttgtccaagaaaggctggcatttcaatgccctacaaaagccggttgcactacacatggccttcacgagattgagcgctcatgttgtggatgagatctgcgacattttacgtactaccgtgcaagagttgaagagcgaatcaaattctaaaccatccccagacggaactagcgctctatatggtgtcgccgggagcgttaaaactgctggcgttgcagacaaattgattgtgggattcctagacgcattatacaagttgggtccaggagaggataccgccaccaagtag

SEQ ID NO: 4362 - protein, 589 aa, Saccharomyces cerevisiae
MSGVSNKTVSINGWYGMPIHLLREEGDFAQFMILTINELKIAIHGYLRNTPWYNMLKDYLFVIFCYKLISNFFYLLKVYGPVRLAVRTYEHSSRRLFRWLLDSPFLRGTVEKEVTKVKQSIEDELIRSDSQLMNFPQLPSNGIPQDDVIEELNKLNDLIPHTQWKEGKVSGAVYHGGDDLIHLQTIAYEKYCVANQLHPDVFPAVRKMESEVVSMVLRMFNAPSDTGCGTTTSGGTESLLLACLSAKMYALHHRGITEPEIIAPVTAHAGFDKAAYYFGMKLRHVELDPTTYQVDLGKVKKFINKNTILLVGSAPNFPHGIADDIEGLGKIAQKYKLPLHVDSCLGSFIVSFMEKAGYKNLPLLDFRVPGVTSISCDTHKYGFAPKGSSVIMYRNSDLRMHQYYVNPAWTGGLYGSPTLAGSRPGAIVVGCWATMVNMGENGYIESCQEIVGAAMKFKKYIQENIPDLNIMGNPRYSVISFSSKTLNIHELSDRLSKKGWHFNALQKPVALHMAFTRLSAHVVDEICDILRTTVQELKSESNSKPSPDGTSALYGVAGSVKTAGVADKLIVGFLDALYKLGPGEDTATK

SEQ ID NO: 4363 - DNA, 1704 bp, Magnaporthe grisea 70-15
  CDS (1)..(1704)
atgccgggaacttctaggataccgcagagcctgagagatggcctcatcagtgtcaagaggaacagaccaaccagcgtcgtacagcttctcagcattgacctgctccgaaacatagtcttcacactctttgtgctacgatggacgcggcgcgccttctggaaactccggggtcgcggactcctaggatggcttgccgagctgtacgctgcgatgcgggtcacggcctacggatggctgctgcgcgcccccggcgtgcgcaacaaggtgcggtcggaggtcgatacggctctgtccaagctcagcaagaagacgctgccgccgccggaggctccgcgctacttgcagattcccaagcagggctggaccaacgaggcagtccgagctgagcttgagtcgctcgccaacatggaccacacacgctgggaggatggttatgtatcgggtgctgtctatcacggcgaggacgagctcataagtctccagaccgatgcgtacggcaaattcactgtcgccaaccccatccaccccgatgtcttccccggcgtgcggaagatggaggccgaggtggtggccatggtcctgtcgctcttcaatgccccggttggcgctgcgggtgtctcgacttctggaggtactgagagtatcctgatggcggtgctgagtgcccgccaaaaggcctacaatgaaaggggtgtcactgagccggagataattctccccgagacaagccataccgctttccggaaggcagccgaatactacaagatcaaggtcaactttgttgcctgccccgctcccgactatcaagtcgatgtatctcgggtgcgccgactgatcaatgccaacaccattatgcttgttggctcggctcccaactttcctcacggcatcattgacgacatctctgggctttccaagctcgctgtccgttacaagatccctctccatgtcgactgctgtctcggttcattcttggtccctttccttgaacgtgcgggcttcgagacccggcctttcgacttccggttgaagggtgtcacctccatcagcgtggacactcacaagtacggctttgcccccaagggcaacagcactgtgctttaccgcaccgctgagcttcgcaagtaccagtactttgtgtgtcccgactggagcggtggtgtctatgcctcccctgggattgctggctctcgtcccggtgcccttattgcaggctgctgggccagcatgatggccgtgggtgaggccggatacctggccgcctgcgtcgagatcgtcggcgccgccaagaagcttgtcgaccacatcaacgcgtcacccagcctggccgccgagctcgagatcatcggcaagcccttgtcctcggtcgttgccttccgggcgcgcaacctcaacatctacgacattgccgatgccatgggcgagaagggatggcacctcaactccctgcagaacccaccagcaatgcacgtggcattcaccctccccaccgccaaggtctgggagcgcctggccaccgatctcgaggcctgcgtcgagggcgagcgcgagaaggagcgtgctaggatcgccgagggcaagggcgccaagggtgcggccgtcggagactcggccgccctgtacggtgtcgccggcagcttgcccaacaagagcgtcgtcgttgagttggccaatggcttccttgacctgctttacaagacttga

SEQ ID NO: 4364 - protein, 567 aa, Magnaporthe grisea 70-15
MPGTSRIPQSLRDGLISVKRNRPTSVVQLLSIDLLRNIVFTLFVLRWTRRAFWKLRGRGLLGWLAELYAAMRVTAYGWLLRAPGVRNKVRSEVDTALSKLSKKTLPPPEAPRYLQIPKQGWTNEAVRAELESLANMDHTRWEDGYVSGAVYHGEDELISLQTDAYGKFTVANPIHPDVFPGVRKMEAEVVAMVLSLFNAPVGAAGVSTSGGTESILMAVLSARQKAYNERGVTEPEIILPETSHTAFRKAAEYYKIKVNFVACPAPDYQVDVSRVRRLINANTIMLVGSAPNFPHGIIDDISGLSKLAVRYKIPLHVDCCLGSFLVPFLERAGFETRPFDFRLKGVTSISVDTHKYGFAPKGNSTVLYRTAELRKYQYFVCPDWSGGVYASPGIAGSRPGALIAGCWASMMAVGEAGYLAACVEIVGAAKKLVDHINASPSLAAELEIIGKPLSSVVAFRARNLNIYDIADAMGEKGWHLNSLQNPPAMHVAFTLPTAKVWERLATDLEACVEGEREKERARIAEGKGAKGAAVGDSAALYGVAGSLPNKSVVVELANGFLDLLYKT

SEQ ID NO: 4365 - DNA, 1719 bp, Gibberella zeae PH-1
  CDS (1)..(1719)
atggcttctcctcctcatattgggagtctctcccgtcttcccgccaacttgcgcggtagtattgagtctgtcaagcgtggtggacataatgtgtcttggcctttgctaaacctcgatctattgcgcaacgtccttctcttcctcttcttttggcgatggtcccgtcgcgcattctggcagctcagaggtcgcggtatcatcggctccgtcgtcgagctatacaccaacatccgtcgcatcctctacggttacttccttcgagcccccggcgtacgaggcaaggtccagcaacaagtcaacgaatccttggttaagctatccgataagctggttcccaaagaccagatccgttatctcaccctgccaaaggagggattctcccatgatgtcgtgcgctccgagctcgagaacctcgccaacatggaccacacgcgctgggaggacggttatgtctctggtgctgtgtaccacggagaggatgaactgctggctctgcagactgaggcgtatggaaagttcactgttgccaatcccatccatcccgatgtcttccctggtgtgcgcaagatggaggccgaagttgtgagcatggttctgagcatgttccacgcccctcctggagctgctggtacatctaccagtggaggaaccgatagtatcctcatggcttgtctggctgctcgtcaaaaggcttatgctgagcgtggagtaactgagcccgagatgattctccccgagaccggccacactgctttccgtaaggctgctgagtacttcaagatcaagcttcacctcgtcgcatgcccagctcccgagtaccaggttgacgtcaacgctgttcgacgtctgatcaaccccaacacggtcatactggtcggctctgctcccaacttcccccacggtatcatcgacgacatctctgctctgtccaagctcgcccttcgcaagaacatctggctccacgtcgactgctgtctgggttctttcttggttcccttcctcgagcgtgctggtttcgaaactctgctctttgatttccgactgaagggtgtttccagcatcagctgtgatacccacaagtacggttttgcgcccaagggtaactcgactgtcctctaccgaaccgccgagcaccgaaagttccagtactttgtctcccctgattggtctggtggtgtctacgcttctcccggtatggctggttctcgacctggtgccctcattgctggttgctgggctagtttgatgactatgggtgagtccggttacatcgattcctgcaccaagatcgtgggaactgccaagaagatcgccgaagctattcagaccaccccggcattgggtggcgagcttgagatcatgggaaagccgcttgtctcggttgttgctttcacagctcgcaatctcaacgtctacgatattgccgacggtatgggtaccaagggatggcacctcaacgctcttcagagccctcctgctatccacgtcgctgtcactctacccatcaccaaggtctgggagaagctcatcaccgatctcgaagccgtcgtcgaggaggagcgtgagaaggagcgtgtccgtctggttgagggcaagggaacacatggtaaggccatgggtgacgcctcagcgttgtacggtgttgctggctctttgcccaacaagagtgtcgttgtcgatctggcgagtggattcttagatctgttgtacaaggcgtaa

SEQ ID NO: 4366 - protein, 572 aa, Gibberella zeae PH-1
MASPPHIGSLSRLPANLRGSIESVKRGGHNVSWPLLNLDLLRNVLLFLFFWRWSRRAFWQLRGRGIIGSVVELYTNIRRILYGYFLRAPGVRGKVQQQVNESLVKLSDKLVPKDQIRYLTLPKEGFSHDVVRSELENLANMDHTRWEDGYVSGAVYHGEDELLALQTEAYGKFTVANPIHPDVFPGVRKMEAEVVSMVLSMFHAPPGAAGTSTSGGTDSILMACLAARQKAYAERGVTEPEMILPETGHTAFRKAAEYFKIKLHLVACPAPEYQVDVNAVRRLINPNTVILVGSAPNFPHGIIDDISALSKLALRKNIWLHVDCCLGSFLVPFLERAGFETLLFDFRLKGVSSISCDTHKYGFAPKGNSTVLYRTAEHRKFQYFVSPDWSGGVYASPGMAGSRPGALIAGCWASLMTMGESGYIDSCTKIVGTAKKIAEAIQTTPALGGELEIMGKPLVSVVAFTARNLNVYDIADGMGTKGWHLNALQSPPAIHVAVTLPITKVWEKLITDLEAVVEEEREKERVRLVEGKGTHGKAMGDASALYGVAGSLPNKSVVVDLASGFLDLLYKA

SEQ ID NO: 4367 - DNA, 1698 bp, Candida glabrata CBS 138
  CDS (1)..(1698)
atgaatatcaatgacatcaaggaacttgttgatcaagtttctgtggaagatgtggtgaattgcgtagtaaataagactacacgctacttggatgacaccccgtggtacaatatcttaaaggactatgtcttcttgattgtactatacaagtttgtcaagaaaatctattattatctggctggctatggtttattgaagtccatgcagctattatacaagagtgttgcgaattggatatttcaaagattactggaatcacctttgctgagaggctctgttaacaaagaggtctctaaggctgtcgctggtatggagaaagaactgatcaagaacgatgatcaattggctgattttgaagttttacctaaagagggtttatccagtgaatctatcaacagtgaattggataagttgaattctatactacctcatacgtcctgggagcaaggcagagtatcaggtgctgtctaccatggtgggaaagagctcatcaagttacaaagcgaagcttttgagaagtattgtgttgctaatcagttacaccccgatgtttttcctgcagtaagaaaaatggaagctgaagtggtgtccatgactttgaaaatgttcaatgcacctgagacaggttgtggtactactacatcaggtggtaccgaatcgcttctattggcatgtctgagtgccaaagtttacggcctgaagcaccgtggtatcaccgaacctgagatgattgtccccgtaacagcgcatgctgggtttgacaaagctgcctattactttggtatcaagatacaccacgttgatcttgatccagttacgtacaaagttgacttgaagaaagtcaagcggttaataaatgggaacacagtcttgctcgctggttctgctcctaacttcccacacggaatagttgacgacatcgaaggcttgggcaagctggctcagaaatataagattccactgcatgttgattgctgcctgggctcatttatcattgcgttcatggagaaagccgggttcaacgacattgggtctttcgatttcagggttcccggtgtgacttccatctcgtgtgacacacataagtacggtttcgcccctaagggttcctccgtgattatgtacagaaacagcgagctcaggaagcaccagtactacgtggactccaagtggaccggtggtctgtatggttcacccacgctagcgggctcgagacccggcgcactagtcgtgggctgctggtctaccatgatacacatgggtgagtcgggctacaaggactcctgcacgcgcatagtgtccacagcgcgcaagttgaaggaccacatccgcaacaagctcccacaactggaagtgcttggcgaccccaagctgtcagtagtgtcgttctcctccaacaagctgaacatctacgagctggcagaccgcctcgccaagagcggctggcacctgaacgcgctgcagaaacccgccgcgctgcacctggccatcaccacactgagcgttcctacgatcgacaccttcatcgaaacactcacggaggccgtcgagcagatgagcgcagaccccacgagcacaccaagcaccgagggcaccagcgccctctacggtgtcgcaggctcagtgaaaacaacaggcgtagcagacaaactgatcacagccttcctcgacaccttgtacaaggtcaagtccgactag

SEQ ID NO: 4368 - protein, 565 aa, Candida glabrata CBS 138
MNINDIKELVDQVSVEDVVNCVVNKTTRYLDDTPWYNILKDYVFLIVLYKFVKKIYYYLAGYGLLKSMQLLYKSVANWIFQRLLESPLLRGSVNKEVSKAVAGMEKELIKNDDQLADFEVLPKEGLSSESINSELDKLNSILPHTSWEQGRVSGAVYHGGKELIKLQSEAFEKYCVANQLHPDVFPAVRKMEAEVVSMTLKMFNAPETGCGTTTSGGTESLLLACLSAKVYGLKHRGITEPEMIVPVTAHAGFDKAAYYFGIKIHHVDLDPVTYKVDLKKVKRLINGNTVLLAGSAPNFPHGIVDDIEGLGKLAQKYKIPLHVDCCLGSFIIAFMEKAGFNDIGSFDFRVPGVTSISCDTHKYGFAPKGSSVIMYRNSELRKHQYYVDSKWTGGLYGSPTLAGSRPGALVVGCWSTMIHMGESGYKDSCTRIVSTARKLKDHIRNKLPQLEVLGDPKLSVVSFSSNKLNIYELADRLAKSGWHLNALQKPAALHLAITTLSVPTIDTFIETLTEAVEQMSADPTSTPSTEGTSALYGVAGSVKTTGVADKLITAFLDTLYKVKSD

SEQ ID NO: 4369 - DNA, 1749 bp, Kluyveromyces lactis NRRL Y-1140
  CDS (1)..(1749)
atgggaaagatgagtttcattgaaggattgcagaagcgcttttttttaggatattcatacaaatacaacacgttcgaacttgatcctattatactggcaacttctatcaaggtggcagttttagattattttcggaatacgccttggtattggatcatcagagacgccgtcttttaccatctgctttttaacgttttgtcccggattattttgtacataagggggtatgggcttctgacatcaatttctaaattattccattatgccagtagacgtttatttgaggttctattgagcttaccaatggtaagaggttctgtcgataaagaggtttctaaagtcttagccacaatagagaaagatatgataaaaaacgatgcgaatttaaaggatttccctgaactaccaagaacaggattaagtgaagctgatgtattgaaagaactagataaactcaattctgttttgaagcattctgattgggaaaatggtaaagtatctggtgcagtgtatcatggtggggatgatttgattgatttacaatccaaagcgtttaaaaagttttgtgtggcgaaccagttgcatccagatgtctttcctggtgtgcgtaaaatggaagcagaggtagtgtccatggttttgaacttatttaatgctccaccgactggttgtggtactacaacaagtggtggtacggagtcgttgttattggcttgtgtaagcgcaaaaatgcttggattgcgctacaagggaattaccgaacccgaaataatcatcccgaagacagcacatgcaggttttgacaaagcgggatattactttggcataaagatccatcatgttgatttggatcctgtgacattccaagctgatgttaagcagatgagaaaacttatcaatagaaatactgttatgttggctggctctgctccaaacttccctcacgggatcattgacgatatcgtttcgatcggtaaacttggtgaaacttacaaaattcctgttcatgttgactgttgtttgggatcattcattgttgcgttcatgtccaaggccggatttaacgatgtaccattgtttgacttcagagttcccggtgtcacctctatttcatgtgatacacacaaatatggctttgcaccaaaaggctctagcgttatcatgtaccgcaaccctgaattgaggaaacaacagtattatgtcagtaccgagtggacaggaggtttgtatggatcgccaacgcttgcgggaagtagaccgggtgccttggttgtcggttgttgggcaactatggtacatgtgggagcagatggatacattaattcatgtaaagacatcgtcggaaaggctcgtgagttgaaagaattcattcaaaaggaaattccagagcttcaaattttaggcgatccattatgttctgtgatatcattcacgtccaacaaaattgatatctacgaactttcagacacattgtctaagtctggatggcacttaagtgcattgcagaacccatcttctatccatcttgcactcacaaagctatccctaaaatcggttgatgaattgaagcacttgttgaagagcaccgttgacaaaatgaaacaatcacctgatgccaaaccttcttctgatggtacgagcgctctttatggtgtagcaggaagtgtgaaaaccgttggtgtggctgaccgtttgattgaaggtttcttagatagtttgtacaaacttgagccagaacacgctacttaa

SEQ ID NO: 4370 - protein, 582 aa, Kluyveromyces lactis NRRL Y-1140
MGKMSFIEGLQKRFFLGYSYKYNTFELDPIILATSIKVAVLDYFRNTPWYWIIRDAVFYHLLFNVLSRIILYIRGYGLLTSISKLFHYASRRLFEVLLSLPMVRGSVDKEVSKVLATIEKDMIKNDANLKDFPELPRTGLSEADVLKELDKLNSVLKHSDWENGKVSGAVYHGGDDLIDLQSKAFKKFCVANQLHPDVFPGVRKMEAEVVSMVLNLFNAPPTGCGTTTSGGTESLLLACVSAKMLGLRYKGITEPEIIIPKTAHAGFDKAGYYFGIKIHHVDLDPVTFQADVKQMRKLINRNTVMLAGSAPNFPHGIIDDIVSIGKLGETYKIPVHVDCCLGSFIVAFMSKAGFNDVPLFDFRVPGVTSISCDTHKYGFAPKGSSVIMYRNPELRKQQYYVSTEWTGGLYGSPTLAGSRPGALVVGCWATMVHVGADGYINSCKDIVGKARELKEFIQKEIPELQILGDPLCSVISFTSNKIDIYELSDTLSKSGWHLSALQNPSSIHLALTKLSLKSVDELKHLLKSTVDKMKQSPDAKPSSDGTSALYGVAGSVKTVGVADRLIEGFLDSLYKLEPEHAT

SEQ ID NO: 4371 - DNA, 1791 bp, Debaryomyces hansenii CBS767
  CDS (1)..(1791)
atgcatgcattatttgaaactgattggttcttggatagcaagaagtatggaactccatgtataccaaaaagttttaatgaatttatgtatttagtggaaatcaatgcgttctatacgtacaacaaattgagagattatattaatacctattatataaatgcatattgtggcgtatggggatacttggctattatacgtgatgcagtattcatctatttgatgtatctgtatatgagccaaatggttgtgcttattagaggccgtggtatgattgcttctattagaatatttatacacgctataagtaaacgaggttttcaatttttactctccatcccacctataaagaaaaagatcgatcaagaactatcagaaactaccaagaaaattgaagaggagttgatgcagaatgatgaaagtttaatgcaatttaaatcattgccagaaaagggattggatgctacaatagtgaaaaaggagttggacaggttgcaagacttgaagcactctgattggtacaatggtagagtaagcggagctgtgtatcacggagggaatgaattattggatttacaatcagatgcgtaccacaagtattccattgctaatcagctacaccctgatgtatttccaggtattcgtaaaatggaatccgaaatcgtatctatggttttgcgcttatttaatgcaccagaagaaggatgtgggtctactacttcaggtggtaccgagtccttattattggcaggtttatctgcaagggagtatggaaagttctataagaatatttctaatcctgaaatcattgcaccaataactatccatgctggcattgagaaggcctgttattattttggtatgaaattacacaaggttgacttggaccctgtcacattcaaggttgatgttaataaggttaagaaattaattaacggaaatactgttttattagtaggatcggctccaaatttcccacatggtattattgacgatattgaagctttgtctaatttagcagttaaatataaaattcctttacatgttgatgcttgtcttggttcatttattgtctcatttttagagaaatcgaaagttcatggtgataaaccaattccaaagtttgatttcaggttaccgggggttacttcaatttcatgtgacacacataagtatggatttgctcctaaaggttcttcgatcgtaatgtaccgtaactctaaattgcgtcaatgccagtattacattctgactgattggacaggtggtatgtatggatcgcctactctagcaggatcaagacctggcgcactcatggctggttgctgggcaactttagttaactttggcgaggataattacgccgagtcttgtcgtacaatagtcggagcttcaatgaaattaaagtgtgcgattaaagaacatgagatgttaagtaaatacctagaggttattggggaccctataggatcagtggtagcatttggggttactaaaaactatagaagtacgctcagtatctataaaattggcgagtgtttgagctctaaaggttggcacttttctacattgcagaatcctgccgcattacactttgcacttaccagattgaccgttccggttatcggtgaattaatatccgatctagtagaagtgacaagtgccgctctcaaggatgaatcgaattcagagagtgaaattgccgccttatatggtgtagctggtagtgttaagactacgggtgtggcagaaagagtcgtcgttgcgttcctagataccttgtataaaatatga

SEQ ID NO: 4372 - protein, 596 aa, Debaryomyces hansenii CBS767
MHALFETDWFLDSKKYGTPCIPKSFNEFMYLVEINAFYTYNKLRDYINTYYINAYCGVWGYLAIIRDAVFIYLMYLYMSQMVVLIRGRGMIASIRIFIHAISKRGFQFLLSIPPIKKKIDQELSETTKKIEEELMQNDESLMQFKSLPEKGLDATIVKKELDRLQDLKHSDWYNGRVSGAVYHGGNELLDLQSDAYHKYSIANQLHPDVFPGIRKMESEIVSMVLRLFNAPEEGCGSTTSGGTESLLLAGLSAREYGKFYKNISNPEIIAPITIHAGIEKACYYFGMKLHKVDLDPVTFKVDVNKVKKLINGNTVLLVGSAPNFPHGIIDDIEALSNLAVKYKIPLHVDACLGSFIVSFLEKSKVHGDKPIPKFDFRLPGVTSISCDTHKYGFAPKGSSIVMYRNSKLRQCQYYILTDWTGGMYGSPTLAGSRPGALMAGCWATLVNFGEDNYAESCRTIVGASMKLKCAIKEHEMLSKYLEVIGDPIGSVVAFGVTKNYRSTLSIYKIGECLSSKGWHFSTLQNPAALHFALTRLTVPVIGELISDLVEVTSAALKDESNSESEIAALYGVAGSVKTTGVAERVVVAFLDTLYKI

SEQ ID NO: 4373 - DNA, 1719 bp, Aspergillus nidulans FGSC A4
  CDS (1)..(1719)
atggcatcgtctgtcgtgccagtcgctttgcagaacaaactgcttggctatggcagagcccccagcgcccagctggctgttctgaacctggaccttgttcgcaatattgtatttgctctattcttattccgctacgttcgaaaaacgttctactccctgcgaggctacggtttcttcggcagtattcacaatgtctacctagccattcgtttatttttatactctatctttttgcggtttcccggagtccgtggacaggtcgacaaacaagtgacggctgcgattgagggcctagaatcgaaactcgtggcaaacggccccggtgttacacgatacctgactctgcccaaggaaggatggacgcacgagcaggttcgtgcggaactagctaagcttgggaacatggagcataccagatgggaggatggtcgcgttagcggtgccgtgtaccatggtggaaaggacttgctcaaaatccaggccgaggcatttgagcaattcggcgtcgcaaatcctattcaccctgatgtttttcctggtgttcggaagatggaagccgaggtggttgcgatggtccttgcaatgtttcacggcccttctgatggcgcgggggtgacgaccagcggtggtactgaatccatcctcatggcctgtttggccgcacgtaacaaggcgcgcgctgaaagaggcgtgacggaacctgaaatgatcattcctgatacagctcatgctgcgtttattaaggcgtctagttactttggtatcaagctgcatcgtgttccttgcccagcgccagaccacaaggtcgacatcgccaaggtgcgccgactgatcaactccaacaccgttctgcttgttggctctgctccaaacttcccccatggtatagttgacgacattcccgctttatcacgactggccacacattataagattcctctgcacgttgattgctgcttgggttcatttgtcattgcgcttctgaagaaagctgggtttccgtcgccttacgaggaggaaggcggcttcgattttcgccaaccaggcgtgaccagcattagcgtcgacacccacaagtatggctttgcacctaagggtaactcagtccttctgtaccgcaacaagacgtaccgcagccaccaatacttcatctaccctgactggtctggtggtgtctatgcgtccccttcggttgctgggtcacggcctggtgcgttgattgcgggatgctgggctagtctcatgagcgtaggcgaatctggctatatcaagagttgtcttgatatagttaatgcggcgaagaagtttgagtcagctatcaatgaggacgcacgcctttcgccaaatctccaagtcgttggacaacctatggtcagcgttatagccttcgagagtaaaaatgatgccgttgacatttacgacattgccgatgacctttcggcaaagggttggcatctgaacgccttgcaatctcctccggcaatgcatgtcgctttcacaattccaacagctgctgctgttgatacgctcatttcagacttggttgcggtggtcgaaaaggaactggagaaggcggaagagcggaagcgacagggcaaatcttatgtcgtcaaacgcggtgatacatctgctctctatggcgtggctggaagtatgccggataaaagcatcgtcagtcgccttgcagaaggcttcctagacaccttgtacaaagcttag

SEQ ID NO: 4374 - protein, 572 aa, Aspergillus nidulans FGSC A4
MASSVVPVALQNKLLGYGRAPSAQLAVLNLDLVRNIVFALFLFRYVRKTFYSLRGYGFFGSIHNVYLAIRLFLYSIFLRFPGVRGQVDKQVTAAIEGLESKLVANGPGVTRYLTLPKEGWTHEQVRAELAKLGNMEHTRWEDGRVSGAVYHGGKDLLKIQAEAFEQFGVANPIHPDVFPGVRKMEAEVVAMVLAMFHGPSDGAGVTTSGGTESILMACLAARNKARAERGVTEPEMIIPDTAHAAFIKASSYFGIKLHRVPCPAPDHKVDIAKVRRLINSNTVLLVGSAPNFPHGIVDDIPALSRLATHYKIPLHVDCCLGSFVIALLKKAGFPSPYEEEGGFDFRQPGVTSISVDTHKYGFAPKGNSVLLYRNKTYRSHQYFIYPDWSGGVYASPSVAGSRPGALIAGCWASLMSVGESGYIKSCLDIVNAAKKFESAINEDARLSPNLQVVGQPMVSVIAFESKNDAVDIYDIADDLSAKGWHLNALQSPPAMHVAFTIPTAAAVDTLISDLVAVVEKELEKAEERKRQGKSYVVKRGDTSALYGVAGSMPDKSIVSRLAEGFLDTLYKA

SEQ ID NO: 4375 - DNA, 1770 bp, Candida albicans SC5314
  CDS (1)..(1770): transl_table=12
atgcttgaattgaattcaattacgattcctcggaatttcactgaattccaactcacagcattaaagatctactatcaacttaagattttatttcttgccacatactgtgctcaaggatcatttggcttgaacggttcagtctgtttagcaagagatatttttgttggctatgttgtatacactcaattattaaagctttatcgagtattaagagggtacggtattgtagattctattcgaaggttatacctatatgttagttctacggtgtcatctcaaatcttttcactaccatttattaaatccaaaattgacaaggaattgcaagcgactattggcaaagtagaagaagagattatgaaaaacgatccacagttattacagtttcccgaattgccagaacagggtattgacgctgacaatgtttccttggagttggataaattacaaaacttgaaacattctgactggatcaatggaagagtcagtggagcagtttatcatggaggtgagaatctattgtcattacaagttgaagcttacaagaaatactcggtggccaatcaattgcatcccgatgttttcccaggtgtgcgtaagatggaggccgaagtagttcatatggttttggatatctttaatgctccgagtgacgggtgtggatcgacaacttcgggaggtactgagtcgttattgttagccgggttgtcagctagagaatatgggaagaaatatcgtggaataactgagcctgaagtcattgcccccgtgacaatacatgcgggaattgaaaaagcctgtttttattttggaatgaaattacataaagttgacttagatccggttacctttcaagttgacgttaagaaagtagaaagattgatcaatagtaatacagttttaatctgtggatcagccccaaattatcctcatggaataattgatgatatagagtccttatccaagttggcagtcaagtataatatcccgttgcacgttgatgcatgtttggggtcatttattgtttcgtttttagaaaaatcaaaagtacatggcgataggaaattgcccatatttgattttcgattaccaggtgtcacgtcaatctcatgtgatactcacaaatatgggtttgctcccaaggggtcatcaataattatgtaccgttcgccaaaattacgtgagtgtcaatactatattgcaagtgattggacgggtggaatgtatggttctccaactttggctggttctaggccaggtgctcttgtagttggatgctgggctacattaatcaatattgggaaacaaggatacaccaagttttgttacgatattgtgctggcgtcaatgaaagttaaacgagcaattgaaactgacccgatactatccaaacatttacaaattattggtgatccaattgggtcggtaatttcgtttcaacttgcacctcagcaatcgggaaatttaagtatttacgagattagtgatttgttgaccaaaaaaggttggcattttgcaactttacaaaacccatcagcattacattttgcatttacaagattgactgtcccggtggtcgatgaattgattgcagatttggttgaagctacaaaagaagcggtggcaattgccgaggaacacaaaaagaatggagtgaccaaagctccaggtgatactgctgcgttatatggtatagctggcagtgtacatacagcagggttggctgatagattaattgttgcatttttagataccttatacaaaatttga

SEQ ID NO: 4376 - protein, 589 aa, Candida albicans SC5314
MLELNSITIPRNFTEFQLTALKIYYQLKILFLATYCAQGSFGLNGSVCLARDIFVGYVVYTQLLKLYRVLRGYGIVDSIRRLYLYVSSTVSSQIFSLPFIKSKIDKELQATIGKVEEEIMKNDPQLLQFPELPEQGIDADNVSLELDKLQNLKHSDWINGRVSGAVYHGGENLLSLQVEAYKKYSVANQLHPDVFPGVRKMEAEVVHMVLDIFNAPSDGCGSTTSGGTESLLLAGLSAREYGKKYRGITEPEVIAPVTIHAGIEKACFYFGMKLHKVDLDPVTFQVDVKKVERLINSNTVLICGSAPNYPHGIIDDIESLSKLAVKYNIPLHVDACLGSFIVSFLEKSKVHGDRKLPIFDFRLPGVTSISCDTHKYGFAPKGSSIIMYRSPKLRECQYYIASDWTGGMYGSPTLAGSRPGALVVGCWATLINIGKQGYTKFCYDIVSASMKVKRAIETDPILSKHLQIIGDPIGSVISFQLAPQQSGNLSIYEISDLLTKKGWHFATLQNPSALHFAFTRLTVPVVDELIADLVEATKEAVAIAEEHKKNGVTKAPGDTAALYGIAGSVHTAGLADRLIVAFLDTLYKI

SEQ ID NO: 4377 - DNA, 1770 bp, Candida albicans SC5314
  CDS (1)..(1770): transl_table=12
atgcttgaattgaattcaattacgattcctcggaatttcactgaattccaactcacagcattaaagatctactatcaacttaagattttatttcttgccacatactgtactcaaggatcacttggcttgaacggttcagtctgtttagcaagagatatttttgttggctatgttgtatatactcaattattaaagctttatcgagtattaagagggtacggtattatagactctattcgaaggttatacctatatgttagttctattgtgtcatctcaaatcttttcactaccatttattaaatccaaaattgacaaggaattgcaagcgactattggcaaagtggaagaagagattatgaaaaacgatccacagttattacagtttcccgaattgccagaacagggtattgacgctgacaatgtttccttggagttggataaattacaaaacttgaaacattctgactggatcaatggaagagtcagtggagcagtttatcatggaggtgagaatctattgtcattacaagttgaagcttacaagaaatactcggtggccaatcaattgcatcccgatgttttcccaggtgtgcgtaagatggaggccgaagtagttcatatggttttggatatctttaatgctccgagtgacgggtgtggatcgacaacttcgggaggtactgagtcgttattgttagccgggttgtcagctagagaatatgggaagaaatatcgtggaataactgagcctgaagtcattgcccccgtgacaatacatgcgggaattgaaaaagcctgtttttattttggaatgaaattacataaagttgacttagatccggttacctttcaagttgacgttaagaaagtagaaagattgatcaatagtaatacagttttaatctgtggatcagccccaaattatcctcatggaataattgatgatatagagtccttatccaagttggcagtcaagtataatatcccgttgcacgttgatgcatgtttggggtcatttattgtttcgtttttagaaaaatcaaaagtacatggcgataggaaattgcccatatttgattttcgattaccaggtgtcacgtcaatctcatgtgatactcacaaatatgggtttgctcccaaggggtcatcaataattatgtaccgttcgccaaaattacgtgagtgtcaatactatattgcaagtgattggacgggtggaatgtatggttctccaactttggctggttctaggccaggtgctcttgtagttggatgctgggctacattaatcaatattgggaaacaaggatacaccaagttttgttacgatattgtgctggcgtcaatgaaagttaaacgagcaattgaaactgacccgatactatccaaacatttacaaattattggtgatccaattgggtcggtaatttcgtttcaacttgcacctcagcaatcgggaaatttaagtatttacgagattagtgatttgttgaccaaaaaaggttggcattttgcaactttacaaaacccatcagcattacattttgcatttacaagattgactgtcccggtggtcgatgaattgattgcagatttggttgaagctacaaaagaagcggtggcaattgccgaggaacacaaaaagaatggagtgaccaaagctccaggtgatactgctgcgttatatggtatagctggcagtgtacatacagcagggttggctgatagattaattgttgcatttttagataccttatacaaaatttga

SEQ ID NO: 4378 - protein, 589 aa, Candida albicans SC5314
MLELNSITIPRNFTEFQLTALKIYYQLKILFLATYCTQGSLGLNGSVCLARDIFVGYVVYTQLLKLYRVLRGYGIIDSIRRLYLYVSSIVSSQIFSLPFIKSKIDKELQATIGKVEEEIMKNDPQLLQFPELPEQGIDADNVSLELDKLQNLKHSDWINGRVSGAVYHGGENLLSLQVEAYKKYSVANQLHPDVFPGVRKMEAEVVHMVLDIFNAPSDGCGSTTSGGTESLLLAGLSAREYGKKYRGITEPEVIAPVTIHAGIEKACFYFGMKLHKVDLDPVTFQVDVKKVERLINSNTVLICGSAPNYPHGIIDDIESLSKLAVKYNIPLHVDACLGSFIVSFLEKSKVHGDRKLPIFDFRLPGVTSISCDTHKYGFAPKGSSIIMYRSPKLRECQYYIASDWTGGMYGSPTLAGSRPGALVVGCWATLINIGKQGYTKFCYDIVSASMKVKRAIETDPILSKHLQIIGDPIGSVISFQLAPQQSGNLSIYEISDLLTKKGWHFATLQNPSALHFAFTRLTVPVVDELIADLVEATKEAVAIAEEHKKNGVTKAPGDTAALYGIAGSVHTAGLADRLIVAFLDTLYKI

SEQ ID NO: 4379 - DNA, 2913 bp, Ustilago maydis 521
  CDS (1)..(2913)
atggctgctcgaacccccgcgcgagaagcagcagctgccaagatggccatgccctcgtccttactgaagcgagcggcgcttaccgcatccgacgaaacgctgctcgtctcggctctcaagatgctcgccacttttgacaacgccaagaacaccgtatttgcgctcgtcgtctaccgctactcaacacgtctgctgcgacatgttcgcgcgtacggtatctcggaaagtctctaccagctttattgtctggtttcggcgcaagtgtttgcactgatcctcaagacgcccgcggcaaaacgcaaggtgaagcgcgaactcgacacggccatggccgaagtggaagccaagattgtaccgcgtccgtcgcacctcgggatccaccaccagctgccgcagcttggaaaagagaccgaatggatcaagaccgagctcgccaaactacagatcatggaggccggtgtggacgccaaactggtcgaggcggattgggagaatcgcgacggtcagatggtgtggaagggcggtaaagtatctggcgccgtatatcacggcggtgatgatctgagcgatctattggcggatacgatcaagcagttcctggtaagcaatcctttgcatccggacgtgttccctggagtgaggaagatggaggccgaggtcgtgagtatggtgctcaagatgtacaatgcgcccgcaggtgcggtgggcgccacgtcgagcggcggcacagagtcgatcctgctttcgtgtctggccatgcgagagtgggcgcgagcgaccaagggcatcaaagagcccgagctgatcgtcagcgtttccgcccacgctgcgtttgacaaggccggccagtactttggcatcaaggtgcaccacattcccgtcgacacagtgacgcgaaaagtacaggtggcacgcgtagccagggcgatcaactcgaacacaatcggcctcgtcggttcggcgcccaacttccccgatggcatcatcgacgacatccccaacctcgccaagctagccaagcgccacaagatcctgttgcacgtcgactgctgtctgggctcgttcctggtaccgttcttggaaaaagccggctttgaatccgagccgtttgatttccgcatcgatggcgtcacatccatcagctgcgatacgcacaagtacggttttggtccgaaaggcctctcgacgattctctaccgttcggcggatctacgacggttccagtactacgtcaagaccgactggccgggcggagtgtacgctacacccaccctatccggtagtcgaccaggctcgctcatcgccggcacttgggcggccatgatgaagatcggtgagtctggctacacccagtcttgccgtgacattgtgggagcagctaaagagatctcgacgcgcatcgaacgcgagatcccggaactccgagtgctcggtcggccgctcgtctcggtcgtcgctttcgccagcgcagccccgaactcggtatccatctatgatctcatcacggacctcaaagccgccgtcaaacacgcgcgctcctcgttcaccggccagaaaggcagcatggccacgctgtacggcttaggcagcggcgtcagcgcaaccgccatcgtaggccagttggcatctagtcgccttgaactccaacagttgcgcctgcaggacttggttggtctcgcccaaccttgcacactcttgtgtcaaggtgtgcagttcttgctcggtgtgcatcgacttggggtgttgctcgctgaggaggacgctgatttcgtggctcaaggctgtgcgctgctgcacttggcgcgtcaactctgcgctcaagtgctggttttcgagctctacactctgcaacctattctggacgtcgtccaaacttgcctctgtggcctcgacgaggtagaccatctggtcccacttgtccaagagcttgcgcatctgcaccctctgctgctcgtacttgagcacatccgcatcccacttgaccattttggcgcgatcgctttgcaactgcgtgtgcatctcaaacagttgtgcgcccgtctgctcgagctgccgagtgagcgaaacgatgcgtgccgaatcttcctctgcctgcgccttgagttgtcgtgcctcggacgtccacgccttgcgctcctctcgctcggcgtgctgcgcctcgttcgacgtgcgcagcgtgcgcaccgtgtggtacagattctgtcgctccgcttccagcgctgtgtcggtgaccttttcgcgatctcaaagttgagctcgttgcgcagcagcagattctcgcgttgcagcaacgacacgctcgtcgcttggctccctacgctgccctctaccgcggtgcgcatcgtcgtgtcgtacgacggcatggctgacaacgctgtatcgctcgacgcttctcgtgcagctgttgtcggtgcatccgccgccaagtggctcattgcgagcgcatgtcgcgacgtgggcgacagaggcgatgtaccgctcaccgtgtggttaagagactgcaacgacgacatcgagccggaccgcgaacgcacacgtgcgagcgacacgtgcgtggcaggagacacgggcattgagcaagccacatgtgaagcgctcgagctgcccatcgccgttacgatcgccggcgtcgccgctgccgcggcactagctgccggaagcagcttcgaaagcgtactgctcgccgccatgccgctcgctgccctcgtcggcatcggagtcgcttcgtccaacctctgcgccgctgccgccatgggttggatggccgagccaaagtccatcagtgtgcatgtggcctcgctcgcagcctcgcctgctgcgccggtcgagacgagtggcgcacccgaacgcaacgatgcgtacgtgagcagaatctcgtccggattcaccgagcgcggcagtcgttgccactga

SEQ ID NO: 4380 - protein, 970 aa, Ustilago maydis 521
MAARTPAREAAAAKMAMPSSLLKRAALTASDETLLVSALKMLATFDNAKNTVFALVVYRYSTRLLRHVRAYGISESLYQLYCLVSAQVFALILKTPAAKRKVKRELDTAMAEVEAKIVPRPSHLGIHHQLPQLGKETEWIKTELAKLQIMEAGVDAKLVEADWENRDGQMVWKGGKVSGAVYHGGDDLSDLLADTIKQFLVSNPLHPDVFPGVRKMEAEVVSMVLKMYNAPAGAVGATSSGGTESILLSCLAMREWARATKGIKEPELIVSVSAHAAFDKAGQYFGIKVHHIPVDTVTRKVQVARVARAINSNTIGLVGSAPNFPDGIIDDIPNLAKLAKRHKILLHVDCCLGSFLVPFLEKAGFESEPFDFRIDGVTSISCDTHKYGFGPKGLSTILYRSADLRRFQYYVKTDWPGGVYATPTLSGSRPGSLIAGTWAAMMKIGESGYTQSCRDIVGAAKEISTRIEREIPELRVLGRPLVSVVAFASAAPNSVSIYDLITDLKAAVKHARSSFTGQKGSMATLYGLGSGVSATAIVGQLASSRLELQQLRLQDLVGLAQPCTLLCQGVQFLLGVHRLGVLLAEEDADFVAQGCALLHLARQLCAQVLVFELYTLQPILDVVQTCLCGLDEVDHLVPLVQELAHLHPLLLVLEHIRIPLDHFGAIALQLRVHLKQLCARLLELPSERNDACRIFLCLRLELSCLGRPRLALLSLGVLRLVRRAQRAHRVVQILSLRFQRCVGDLFAISKLSSLRSSRFSRCSNDTLVAWLPTLPSTAVRIVVSYDGMADNAVSLDASRAAVVGASAAKWLIASACRDVGDRGDVPLTVWLRDCNDDIEPDRERTRASDTCVAGDTGIEQATCEALELPIAVTIAGVAAAAALAAGSSFESVLLAAMPLAALVGIGVASSNLCAAAAMGWMAEPKSISVHVASLAASPAAPVETSGAPERNDAYVSRISSGFTERGSRCH

SEQ ID NO: 4381 - DNA, 1524 bp, Symbiobacterium thermophilum IAM 14863
  CDS (1)..(1524): transl_table=11
gtgctttcggcgttttccccgcctttgccctgcgacccggcgcgttcccacccaacgccggaatttccctcctcattgcaggactattgcgaaattcgcggaattcaatcgcaaccgcctgcgaggagggaccccaccatggactggctcgcctccctgcggtcgcagatcaagccttaccgcgaccgctttccttcccacgcccgcctgccacgggccggcctgccccgcgccgagatcctcgccgagatcgcggccatgggcgcggccgagtccccggcctggcgggacggctatgcctccggcgccgtctaccacggcgatgagcaccacatcgcgttcctcaacgaggtctacgccctccagtcccagtccaacccgctccacccggacctctggccgagcacggccaagttcgaggccgaggtcgtcgccatgaccgcccacatgctgggcggggacgccgccggcgggaccgtctgcggcaccgtgacctccggcggcacggagtcgctcctcctggccatgaagacctaccgggactgggcccgcgcgaccaaggggatcaccgccccggaggccgtggtgccggtgagcgcgcacgccgccttcgacaaggccgcgcagtacttcggcatcaagctggtccgcaccccgctggacgccgattaccgggcagacgtcgcggccatgcgggaagccattacccccaacaccgtggtcgtcgccggatccgcgccgggctacccccacggcgtcgtcgaccccattcccgagatcgccgccctggccgcggaacacggcatcggctgccatgtggacgcctgcctgggcgggttcatcctgccgtgggcggagcggctgggctacccggtgccccccttcgatttccggctggagggcgtcacctccgtctcggccgacacccacaagtacggctacggggccaagggaacgtcggtgatcctctaccgcagacctgatctgctgcactaccagtacttcatcgcggccgactggcccggaggcctctacttctcccccaccttcgccggcagccggcccggcgcgctcagcgcgaccgcgtgggccgccatgctctccctgggggaggagggctacctggatgccacccgccggatcctgcaagccgccgaccggcttaaggcgggcgtgcgcgcgatccccagcctgaagatcctgggcgacccgctgtgggtgatcgccgtggcctcggacgagctcaacatctaccaggtgatggaggagatggccgggcggggctggcggctgaacggactgcaccggccgccggcgtttcacgtcgccctgacgcttcgccacaccgagcccggggtggtcgaccggttcctcgccgacctgcaggacgcggtggctcaggtccgggcccaccccgaaaaggcgaccgggatggccccggtctacggcatggccgccgccgcgccgccggagctggtccggcaggtgctcaccggcttcatcgacctgctgtacgaggtgtga

SEQ ID NO: 4382 - protein, 507 aa, Symbiobacterium thermophilum IAM 14863
MLSAFSPPLPCDPARSHPTPEFPSSLQDYCEIRGIQSQPPARRDPTMDWLASLRSQIKPYRDRFPSHARLPRAGLPRAEILAEIAAMGAAESPAWRDGYASGAVYHGDEHHIAFLNEVYALQSQSNPLHPDLWPSTAKFEAEVVAMTAHMLGGDAAGGTVCGTVTSGGTESLLLAMKTYRDWARATKGITAPEAVVPVSAHAAFDKAAQYFGIKLVRTPLDADYRADVAAMREAITPNTVVVAGSAPGYPHGVVDPIPEIAALAAEHGIGCHVDACLGGFILPWAERLGYPVPPFDFRLEGVTSVSADTHKYGYGAKGTSVILYRRPDLLHYQYFIAADWPGGLYFSPTFAGSRPGALSATAWAAMLSLGEEGYLDATRRILQAADRLKAGVRAIPSLKILGDPLWVIAVASDELNIYQVMEEMAGRGWRLNGLHRPPAFHVALTLRHTEPGVVDRFLADLQDAVAQVRAHPEKATGMAPVYGMAAAAPPELVRQVLTGFIDLLYEV

SEQ ID NO: 4383 - DNA, 1827 bp, Legionella pneumophila subsp. pneumophila str. Philadelphia 1
  CDS (1)..(1827): transl_table=11
ttgttcgtaaggatatgtgcaatgttcgggtttgtttcagatttattaacagcagcggtcagttctttagatgaattattacaagatactccggcacatcaaatcatattaggcacagctgctctttattttctttataatcaataccataacccatcgatttccaggtggtaccgtagccgtaataacgccagtatgaagcagcgtattattgatagtgcttacgccttggcaaaaaatttacctggggtgaatcagatcattgagaaagagctcaataaagaactctcttcaacgagagaaaaattgagaattcagcgttccggtatgactctgagggaggaaataccggaggaagggctttctccccaagatattttgagtgcatttgatgtggatgtggaaaaatgtcattttgattttttatccgtaactaatgacagccctgagagggagtttcttgttgaaagaggggatggtaaagattcaggtgcattatacgctattcaccctaaggaactgacagagctgcttaaagaagtttatggggcaactgctctcactaatcctttgcatgataaatggcctagaattaacgcaatgcaagcggaggtgattcgctggtgtcaaaatttgtttcatggttcaaaagaatgttatggtttattaactcatgggggtacgaccagcattattgaggcgatggctgcttatgtcattcgcgcaagggcaaaaggcattgattatcctgaaattgtcgttcctgaaacagcacatgctgcatttaaaaaagcagccgaattaactggagcaatattaattacggttcctgttgataaaaaaacgggtgcggtgaatcccaaggtcatgagttcctatattaccagaaatactgctgtaatcgttggatctgccccatctttcatgaatggaattcatgatcctgtctctgagttaggtcaattagcaaagaaaaaaaatgttccttttcatgtggatgcctgtttgggtggatttttaacggcttttttagatacttcatcagaacctatggattttagagtacctggagtgacttccatttcagccgatttgcataaatatggctgttgtcctaaaggcacctctgtttgtctttttagtgaggattcgcctgctttgtcggtttatgccgcattaaactggtcaggtggattgtatgctacaccaggaattctcgatggttcaaccagtggggctcgggttgcagaggtctatgccactttgtcttactatggaaaaaataaatatcaggaaatcgctaaaagcattatcacattacgcaatgcgattcaaaaagaattaacgacattactggaggaaggcaatggattaaccagtgaggatatttatgtttatggtaatcctcaatggtccatcctgggttttagaagtaacacttgcaatgctcatttcattgcagatgaattggagaagcgaggttggaagcttaatttgctacaaaatccggacggatttcacttatgtttgactcatgtgcacacattagtcaaaggtttcgaaacgcaatttataaaagatttaagagaggcggtgattgatgttaaaaattatcctcctggaaagaaaccaagcggtaatgtcaaagtgtatggtgctgttggtatgatgccgattgagcttcagcgagaaatttgtaaacaatatcaaaaagcccgtcttaattatacttctgccagtccagggagtttgaggatatttacaaatgtgcctgtagaagaagatgaaggacttagaaatagaaaaacagagaaatataaagtgtaa
